United States Patent 10,900,036 (RNA INTERACTOME OF POLYCOMB REPRESSIVE COMPLEX 1 (PRC1)) - sequence listing, part 13

SEQ ID NO: 26108 - DNA, 1193 bp, Mus musculus
agttgtgagatgccatgtgggtgctgagaatggaagtgggtcctttaaaagaacaagtactttgaatcactgagccctggcctcagcccccttatatgttatttagtggtggtgagaatggtttggaaatccagtctggctttgtccctgaagctatggctcctgtttccagaccagcttctctctgaatcctctctagtagatgcttggggaatgtcacaggatggagtggaacccagtccccttccttattatctccacgtctcgtttgccctctcaagagcaaggtccacggtgtacagaagaaggcctaccgcgtgctggaggaggtgtgtgccagttctcagggcccggcagcccgcttcgtgcagagccacctggatgatctgaagaagactctgctggactcgcttcggaccacatcctcgcctgctaaaagggtaagggttccgggctgcctcgtctgcaagggagggagggcgtcaacaggcacgcccaggggtcagggtgacactggaggaccccggtgttgttgttgtgcccacagccccgtttgaagtgcctcatacatattgtgaagacgctgtcggctgagcatgaggagttcatagctgccctcatcccagaggtgaggggttgtggagggatgtgggttgtggtttcttagtgtggattccaagagaggcccgaggagggagggctgtaggtaacagtgggagcacacgctcccttcactgcctagtgcatgtgtaggcgtgaagagctcacccaggctgcccctcagttccatgtcctgacaaaggctgtttggccaggtgatcctgtgcaccaaggaggtgtcagtgggtgcaaggaagagtgcgtttaccttgctggtggagatgggccatgctttcctgcgatttggctccaaccaggaaggtgagagtgtgggctgtggactgagagctggggtggacaaactgccttggcccagagaagacttttttttttttttttttttggtttctcgagacagggtttctctgtgtagccctggctatcctggaactcactctatagaccaggctggcctcgaactcagaaatacgcctccctctgcctcccaagtgctgggattaaaggtgtgcgccaccatgcccagtgagagaaaagtcttaaagcctctgtccagtcttaagagaaaaggtgga

SEQ ID NO: 26109 - DNA, 1404 bp, Mus musculus
ttttccacatgtacttttgtagggatttctgtagtgtaactttctgcagtttgttggtggctcatcttagaatcttgtatactttagtcactctttctaatgttaagaggcttgaaagttgtaattgggggctggtccatggggcactagatccactaagatccactagatccacagaaaggatgttttgtttgttcctacttaagtgctttgctattagtagataaagagtaaatctataggggatgtggactctttcttgtggctgaaaatggtggctcttttaggtctctcagaagaggccatcatggagctgaacctgcccacgggcatccctatcgtctatgaactggacaagaacttgaagcccatcaagcccatgcagttcctgggagacgaggagaccgtgcgcaaagccatggaagctgtggctgctcagggcaaggtgaagaagtgaaggcgaagaggcagactcctaccccgacaccctccctgcctgttcctgcctcctgcaccctccccagcacctgccacactgactatgtctttaggattttaagtttaagttgtagctgcagatgggggcctgtggctcccgttttcattgtagtattttatcccctgcacccactcccttcatagaatctagtcagaataacgcctctgggggtgcaggttctcggaccacatcgagggacagctccctgtaccaggagagttgagagatagtaactatagtttttcttaggtctttgtttactaagggtctgcttaggaagaattcagggaggaactgtgctgtggtgtgaccaatgaaaagctgcagtccagttttgtccctggaacctgtcctgcactcttcctgcagttaggtaactgggggcatagtcattccagtggagagtggaagtaacctcatggtgatttttaaccctaatttctctctgaccctaaaggagctgctggccctagaaggttgggatcaatcttgtcaagtctatgttacacttacttttacaaaaaaaagtatatatacatattatcagcacacaaaagcaactctgaggttgctagtgacatttgaaacagtcctgtgtggtcaccagaaaataagccattcctcatatcagtgggataaactccttgtacctcttgctgtgtttggatcccttggccttgttttgtagaggtgaagtacccctggatcatgtccgagtttttgtctttcactgtctgaatcatgttccagctgcttgaccctaccgtgtgggttcagagctcgtttgggcgtaacaactaagtctctttccagatcagtataataaaggagtgatgtgcaatactttactgtttgtcttgtgtctgtggtctgagaaaaccacagcattcagtttgagatgcaca

SEQ ID NO: 26110 - DNA, 1228 bp, Mus musculus
ttttcactcagctgctcatgactgggtattgatttcctttacccttaagccatctccacagcccatgctgtcactattgggtgaacttgcagtgatatttctgactccatctccccaatgcagggattacaagcatggctaacatgtcttctgttgtctttagcagagagaagaatctaagtagtagcgtgacttttggatcaggtgtatttacctagtggccctcattaactatgcccatcaccaacccatccttttgtgttttatctgatgtgtgcctgcttccctctatgtgagtcgttgtgtagcgtctctggaggccagaagatggcattggatccccggaactggagtcacaagttgtgagctccaactactctcagccactggtctcagccactcttttgttttgtttcttgagacaaggtctgagtactacataataaacctctcactaacatgcattatgtttagtgaaaactgttgtgcctgtgggtgactcaaacagcatgtgagtggctctgaaaatgtttagtaaacatagttactgtgacagagtaggcatccctgaactgttgactctgaattgacaggagaggcaggatgccaccatgtgagatggttgaggattggtgacaagaccaaaagaattgtgaaggaatttggtaagcgtgaaggtgatcctagtgcgtggagatcagaaatcacactctgggtttggggaggaggaaagctatgagctagctaagcatgaagacactgcaggggtggctcttgctgacatgcaaggaccttgaagttcagtgtgctttatccatgctggaggtgagctctgggttcaacctgcctgggtccgtgagctctggttgctaactttcagcaagttagtatgttttatttagttttatcttttttaaagaaatgacttagtatgtgtaagcatgtgctgtgtatataagtgtaggctcgtgcgtagtcagagggcagcttttgggaatcagttcttagctaacttggtttttggtttttttttttttttattagatggccactttttaaagttatgttgtgtaattaaaattgtataattgtgtgcacaagtctgtgccacagcacgtatgacacagtatgtgtttgaaagtcgaaggacagccatgtgagtccgttctctccttctacctttctgtgagttgcagagatcagcctcaggtccccaggcttgcacagc

SEQ ID NO: 26111 - DNA, 1099 bp, Mus musculus
tattacattttttatgtattaattgcttgccacaatatgtctgtggaagtctctccttccaccatgtagcttccaatgattgaatgctaatcaggcttaacagcaggtgcctttacccactgacctgctgatccagtttgatggcctgatagcatgttcttccattgttctccatgtgtatgtgtgtgtggtatgtgtgtacatgcacaaagatatgtatacctggaggtcaaagaacagctaaccaagttagttgtaccaaatgggttccagggattgagctaggtcataaatgctttacctaaggagttatcttgccagtgcttctacttcatttttttgaaacaggatttcccagggaacctcaaacgtgctgctttggcaagatcagctagccagcaagccaggtgctctgtctccactcggctgcactgcagcacttatagtacctatgggtcaatgggactaaaactcgtgtttctcagaaagtactttcccacctgacctatcttccctagccccaacccttctcttaggcagatctctcactgtctaacttagactggctttgaagccccttgcctcagcctcctgaatgctgaataggcttcagtcatcacatcttactatgtaagctgatgtacctactcatttgagttagagattgaattctcaaactgaatgtctaaccccagtttgtctcccacacattttctttttttatttctatccccagatgtgaagccaaactatctgaagggtctgtctcacgtactcaacaggctgcccaagcctgtgcttttaccagagctgcccacagtaagtcctgcagacaccctcagcaaaggagagggctgttcccatggctacagctggtagagggagatccaagaccataacgtgcatcctattttctgttgttccttagcttctttccttgctgctggaagcattatcctgccctgactctgtggtccagctttccactctgagctgtctccaacccctactactggaagcacctcaaatcatgagtcttcatgttgacactctggttacaaaattcctgaacctcagctccagttactcaatggtgcgt

SEQ ID NO: 26112 - DNA, 1197 bp, Mus musculus
gcctttaatcctagcactcagagggcagaggaaggccgatctctgtgagtttgacctcaacctagtctacagagagttctaagacaactagggctacacaaagaaacactggctcaaaaagaaggaaaaaacaaaaaacaaaaacgatacaaaaacaaaaaaagaagtcctgtccaaccaagtgttgtaggacttgggtcttgctcttcagcaaggtatccatgatagcccattctcgtggagcttcctgctcccaggccttgggaagagagggatgggccaaggctctgctaatgctgttcattgtccccagtagggtggccgcactggaggcatcaggaaccctggccactctgtatcctggagccttcagcagacacttgctccccaagcttgctgaggagctgcataaaggtatgtgtcctaactgttccaacccttgccagcagggctttctgagagggccttcacaccaccacacagggaaaacttatctcaccaattgctttcaggggagtcagatgtggctagagcagatggtcccaccaaatgttcccggcatttccgctgtctgcaagctttgtcagctgtttcaacacatcccagcattgtcaaggagacactgcctctgctactgcagcatctctgtcaagcaaacaaaggtaagtagcagtaacactcatcaaggggcaggactaaatggaaccctggtctagggcctgtaagttgtaattgtagttgtacgtagcagtgacatggtaagctctttaaaaccaatatctagtgattgtttatatggttatattaatatagctatacagtaagcggatgtacatttatggttgtacagttcggtgtttcatccaaatacaccataagaaaggaagtggtctacggttagcttacatatcaacccttttggtgtctcggaagtcttgagagtcatttctagttggtattttgcaatattctagaaaccgttgtcatccttagttatcctgttgaacactatatctcttgggaggatcctcggggcttcctggctcaccctcgtagctgattcagagaccgtgcacacccacaaaagctattcttctaatcccgtgtggcacacagtatctaccctctccctcttctccctttcacttcctttccggtaaccaatatttgaaacatgaaaaaaaaatttttcttgtg

SEQ ID NO: 26113 - DNA, 1137 bp, Mus musculus
ctcagctggtctttcttccaggctgcttggttcctctgagagcgtctcacaatttttactgcctatgatgtatacttggggagagggagagactagtgaatctggtcaatttcaaggacttcttaaagatattttaagttgtttgtttcctgtcttagctagcttgcctggaggatagagtactttatctccctgtaaacattctttcttaaaagacccagtttgacatccccatttatcctgggtcttaagcttctccaaaacaaaaggcttaattagcctctgaggaaactgctccacagcacatgtgcatgtgcaggagttggctctcaccttccaccatgcggatcccaggtcgtcagcctcggtgcccgcttccccacactgagccggctccttagtctgtgtgtgaggatagctggtacttaggcgccgtgggatacaggtggatatcagagggcagctttgtggagtcagttcttctctgcactttacatgggttctcagggttggactcagctctagacttatgcagaaagggcctttacttggtgagccatcactggctccatcagtcggtcaatctctctctctctccatatatatatatgtatatatatatgtatatacacacatacatacatacatacacacatattcatacatattccttgctcccttccttgttttgttttgttgaggggaagccctgaacacattgggggaaattctatatgagcttcgttttctaatgacttacatggatagtatgggaacttcttaaaatcattcttattttgccaatcttctttaaaaaacaaaacaaaaaaccttagggactgcctagcacaagaaaaaaaataaaagaaaagaaaaaataaaaagaaaaaagggggaaaaaaaaaaggactgcctagcagaagtgaactgagattatcaataccggtaccatatcccttttgagattatcaataccggtaccatatcccttttgagattatcaataccgataccatatccctttgacctcctggtgcagcactgaggctctcaactgcaccaccgaaactgtagactcctttctgacccagtgttgaaaattaaacttgaaggctctgctacgatgaaggaagaata

SEQ ID NO: 26114 - DNA, 1198 bp, Mus musculus
ggaggcctggctccagactggcctctgtgtcttcttatccctcctcggtgtaagagtgtggttttcttctccctcagctttagctgcgtcttccttacctgagttacagcagacagcccaatccccgtcggtgcctctctccccccttagacatcagacaggatccctttatagaatagccaagtaagaaaccagtgtaaaagtaacttatgacctgcactcctgactcactccagggtgaagggcagacctatccaggctttctgtggaatggcctggaatcccaggaaaggcctgcactgagagctccttcccagcgtaccattggatcaggctcactgtcccctgggtgttcacagacttgggtccatccaagcgtgagaactgtctagcatgggcttctccttttgactctggaagcaagagtcttggccctcaggcctgggacagatcttcctgccaaaatgatcataaggtctccagttagcctagtcccagtcccagccctagtcccagccccagccctagtcccagccccaggtcccatcctccaatctctctcaacagcagactgtggtggaaattatagctgtgtgcctctatttattatctgaactgtactgtagaaacaagtgtttataggaataaaccagtcaccagaactgcctataatttgtgttatgaactttctggacttgggattcatgaatgtcaacctgtttaatatttatggaaacagctgatactgaacactttgctatgtgatgtcatctgtttctcagaacccctgtggggagctggagagaaaagccagccagtggaatgcttgctatgcaagcgtgaggacccgagttcgatcctcagtgcccacgtaaatagctggatgtggctgtgcatgcttagactcccaggtccagggattcaaagacaaagtatctctggtgctgactgtccggccagcttagcctagcctaactagtgggtcccaagtaccagaatggacagctcctgggggacacagaatgtcgaactataactacacacacacacacacacacatacacacacacacacacaccctctgtgaagtagaaggcatgaagtttttaaaaccagcaggttcaggttgtccaggccagtaagtggcagactagatggggtttctgtcctacacattctgattataattcccttccac

SEQ ID NO: 26115 - DNA, 1358 bp, Mus musculus
gcacaatggggggacaagagtgttcctggaccttcagagtgttggggaggctcctgtccaggcaaggagctcaggcggctgaggaggagccactccctcctagcatttggtggctggttgggaaagtcccatctctccctgacaaccctctccatccaggttacctaatatattctgcatcagaaaccaacaaaacaaaaacaaaagaaacaaatttaaatgcttgtaggaaaacctacattagatcctctgacatcagaagcccttaatctagaacctaaatttgctcagacacaggcgctctgatacctagcacttgtttactccatgaactgagcggtcagaggtccatcgctggcccacggacagaagccattcctttctggttttgccaaattgagcctcctcttgccacactggtactgacttcgtgtggcagtgagcaggttcatgctctgctcctctaaggctctgcacacaggctttttctctgccctgctgtaacttgcccggcactcatctgaggtgggaggggctagccttggcagtgtgctctgccaggagtggttgtgtgacgcggaggtgattgacttggcctggttgcatgctgggtgctaggagggttctgtgggagcctggcacagcctcactcctggtccttagttgcggccttccctacctttctgtttggtagtctagtttcccccattttaaaatgagaagttcagtttgggttctggagtggctctcagtaggtgttgtgggtcagtaggttcatgggcagccaggacagcatctctgttcttcatgtgttaactgctgctgcctggagagaacaggaccgtgttctgccccctaaccggcgtgccccttggctcctgccttccgtcttgggatggtttcttctcagcttcttgaagagaggccttcggacagttccccagtgcctgcccagctcagcgtgcatcttcctgcttccatgtcttctcccttgccaggtgtttgaaccctttctacaccaaagcagagaactgacttcaggagggagtgaaaagggggccgagaggccgtaggcagcggcagtggtcacaccctgtgctgtggacccttgagtgttctcacactctacagttggtcagtcagccttggaaagaaatgtcctgaaggcgtgaaacaaccaaagacctggagtgaggagcacaactgtgcctcagctgcttgccgggctcccaccgcctagaggcagggctgaagacagccttctgtcaggtgtggcaggctgctccctgcccattccaacccaggagccagcttgctatgggctttcactcagcaacatgaatctccaagcactggat

SEQ ID NO: 26116 - DNA, 2105 bp, Mus musculus
agcgcctctgaaggatggctacaggagtgtttatgtctctacttttcatttcagagtaccagtgatggggactccagcctctgtcgtgagcgagccacccctgtggcaggtttcaacacctcagacccggggccgcaagcaggcctctgccaacatcttccaggatgctgagctggtccagatccagggcctgttccagcgcagtggggaccagctggctgaagagcgggcccagataatctgggagtgtgcaggggatcaccgtgtagctgaggcgctgaggaggctgcgcaggaaaaggccgcccaaacagaaccactgcagccggcttaggtaggtgcccaggactggagggccgagggtgggggagaaaggatgcctgtcccactgctctggctgtgtggcctagagccggtgacttgccctcattcttcctgtttctagtgctttggtgctggtacctcaaagactattgttattgttagagtcatgtgactctgtaatatccataggaaagaaaggccagtcaaagcagtgctacggtgtttctgtgactcttggccagctagaagggagaactgtttggaaagaaataaaaacttaccagtagtaaaattcaaaggcaatcctagttaaagccttatggggaactagagagataatggtctaagattatgtggagagtctaggtgacaaagcagtagagattatctctgaccatctacctctgcccacgtcactgccagcccaggaatagtgagcctcgggggacccaggtaaactacccggctttaaagccatcactacaagtttctctctaggatcttcccctcatagtctgaacagatcctccggtctgagatggtgagtgagtcttcactgcttgcactaactgatgtcatttatgcctgtcttacacagtgccataaaagccaggctgagaaagtagggaggagccaggcggtggtggcacatgcctttagtctcagcactcaggagtctgaggcagatggtctacagagtgagttccagacagccagggctctatgaaggagaaaaagaaggtggggagagacttgttgagtgtcccaccccccaatccagccccagcctcttaacgttcagttttggaaaggtgccatacagttcttgggggcagaccgtccccttttatagaccctcctgctctctgtgctgacactgacctatctatcacacacttgttttcacagagtgccggagcctggttctacagcgtctgacccccaggccagcaccactgacacggcctccagcgagcagtctgggaactcccggagaacaagtgctagagccccccggaactggaataagccaggccccacaggttacctccaccagatcagacactgactggtgaagggtggggaggtcctccccaaacactgcagggactttggccaaagggcttatggagttgtaaaaaggacatctgagcaggccctgtgtaggtgaagaagaaagtggtaattggaatgccctgagttcagctcagagccagcatctgttggactctgcacttgtgggtccttcttaccaagggaggcaatagaggctggtcacgcatcagcctttctgacctaaaggtgtaactgggctgcatggcgttcctctggaataaaagtattatgcactcaaatgcagtgtctcaccatctctgcatctcactaacttgacagttaatgtcaccacccagccatctgttttgtgccacaggccagtgcaaaagggaaacttgtttaagtggaaaataaagacatttgcatcaagatttgtcagagtgtgctacagaaggggagaatcccaaaaccgacatagccaggtttggaggacaggatattctccaggacatagatctgggctggatgcttgtgcttctgtaattacagccctgggcatcctggtactacagcttcctcttccagaggtgggcagggtgcaagaaaaaatgaggtctctgcagataggcctgatccaaaggagcagaccaggggaaggggagacaggtcagcctacatcagctccacactgcagcacttgggtcctaggtagtgtgtgtagttgct

SEQ ID NO: 26117 - DNA, 1152 bp, Mus musculus
ccctctccctgcctgcgtttccactgcccgcgccctggatccccgacgttcagttctagtctgactgctgtaccgcagctcagcccagatatcagcttccagggacccacgcagccatccgaggcgccgacgcacacacccagttgggccgcttcaggcgaagcctggaagtccctttcctcattccctgtcgagagctagacgtggacaggcgccgccgcgtagatccgggggaggctcccaaattggaaccagtctttggactgcgccattgccccctccctcctgccctgcagtcggaagagcatcccttccctgccccctcttccagcctagggaggtgtagaatgcagtcaggcagctgcaagaggagctggggacaggctttagctagtgctaggatggatgatggatgacgtctttagttgtagtttggctctctccctgcgcagccctacgtctacgaagtctttgggtggagtcagctacagaagtggtggatagcaaaggcctgctggctataccttacttaacgacgcaagtcttctctccgcctaaatccttggtgttcattcagattgggccaactgtactaacttccctggcctctcagatgtcactcactagcttccgccgcactccacctataaatatgtttgcattggggatcccacgtggccaacggcgatcattaaggtgctgcccacctctttgggaacccagatcccgctcttccaaacagctgttctaatattagaagcacactctttcctctaaagcagtgggttgtctagggagccagtactgtgttacttcccaaagaaggggtagaaggcaaacgggtctgtcaatggtgctgccttcccgagcacattcacaatgtttgttagcacaatgcggtctctctgagaagttctgcaggtatcgcagccacacatggtaattcagttcactggagtaactattgggcctaagccatccccaccgcaagactgtgtctatgctgtctaggtcatgcctacaggttgacccactgaaaattaggaagctcttttttccctaactctaactgggggtccacccagtgacaaaggagctaggaccccctccctagctagagacctgagaagagttgaatattcattcacgttg

SEQ ID NO: 26118 - DNA, 1547 bp, Mus musculus
tgttggaggttatggagggtagattatgagttcaaggccagcctgggctacatagttccaggccagctccagtcacacagtaagaccctatcctccaaagaaacaaaacaacaagcaggtttgttgttgttgttgtttgttttagttcctctaggaaaccccagagcatggcctcctgtgttcttcaatgtctccagctagctctgctgcccagctccacaaaggatgattttccctccttcctttcccaccagagacagtagtggtctgtgcctggggggagctttgctgggacaccttgatagccagtgactcttgttcttatgttgcaggtttccatgttgctgaggcctccaagattctcagagcagtcagaatggccctgcctgattggctgaactggtctccctgggaccagcagaaggtttggcagtcttcgctgcttcggggcagtggggaacaaacagtctcttttgcaagtgtctagtggaagagccgtggtagagaagacttgatttctttcttgatacaagaggattcccaagctcttatgttatcatttaggcacaagatctggtcacttgggactgaactctgcccatctcccattgcctaaatgacaggtgtcagttctggctcccattccttacctgtttgcctttcttagatcaccgtctaagctcaggtccagtcccctcaggataggctcagtcccagcgctctgggtctgaggccagcacaccttactcaggagcacacgtcttggcctctctggtgcctcatctaccctcgcgtgcctatagcactcgggagctcacgagctcttctccacgtgccttccagctttgactccagcagcgggcatggcggtccctccgtttgccactcgtgagaagcacagataagattattataatacccacctttcctcaaacggcatagtatgatcgccctgctgtggcccagagcatttggaaactggtagcactctccctggcttatctctctgacaccaggactggggccaggccaagaccacccagacagctccccaccataagtctggggtctcttgtgggcccaggagacaatttctacagtgtggacaaaggccaggcagggtgggttttggtgtagggagggtagttacagagaggggccatgtgccttatccagtagtgtattcatggtcaccccagtatgcttttttggaataaagtttgttttgtctgatcttgtgtttgggtctcacggcctggtcctctgtggtaactttctgctgggttccctcagactcagcccttgccttctgggagagaagggaaaatgagctcacaggtttccactgtggctagtcagggcctgagggcagatgcagaagaagaaacactctgttttgggttggtgctgaatagaactacagagctttctccctcctgtctgctctctactggcccctacttatgagtgccactccctgtcaggctgggagtgactgtttgtagagccagcagggttctgttttggtccagcccattgtatcatac

SEQ ID NO: 26119 - DNA, 1224 bp, Mus musculus
ctctcctccctccactgtcttgtcttattgctctaaatgatctttaggcaaaagctgtgcaactccgtgcaatggaatcagaaatgcgcaggccctcaccagatagtcttagaacctaaggcgaggcctagacatcctctaaggcatgctggaacagtctctctgtcctgcagtcacacctctgctggtgggaccccctcaaactcagatcccaggtgaactaaaaaaaattcccgaagagtgtttccccgatgtccttcatccttgccgctctcagctcaaggtcaccgtagtagaggctgtggtctcaaacaatcccttctcttctggcatctggggcacctagaagatgctctcatttctgatgtccttctgttctgctggtctggtgggtccatgggtaactctgttttccactatcacccagtttctttacgtaccgtatgcacttccttggggttggttcttcttggaactttagcagatttggtggcctttcttcattaggaaccctggtgccaatctggaattctgagaagtaaaatcctcccctgcccttgaaggtcacccagtgggtgcttattgccaaggaaaatgctcaagattgttcagctcttcagtctcactgacaagatgggtcttcatccataagaaagaagggaggtgaggatataggccaccagagagccatagctcctttccttaagtgcgattccgagaactgtgtttgagatccacgtcagcctatttaacttctcggtcttgatctgattctacgtaagatcagaggagtataattacattcagtataagaagagtataggatcttcctgtgagggtaggtgagcaaagatgggggaagatggtctttgggattcttctctttaggtgcgatgcgaagagctagtcatttggaaggagctattagtgctggatcactgggaacactgtgggatcttttcctctgcagctaaggccaagtgttgaggtttgcacatcagcttctggtcatggtggcatcaggactgatgagcaaagtctgactggcaggtctctctctggcccactgctggattttcactttggggttctgccatgctcggggaaaagaaattttacaggtcccaggataattttgaatgtgatggaaggccctgagctattgattcctgaggaaggatctttctgctgggagaagccttcctcagagcccagtgatttaag

SEQ ID NO: 26120 - DNA, 2185 bp, Mus musculus
agggagtttggctaggtggctcagcaagtaaaggtgccagcagccaagcttggcagtctgcgcttcagtcccaggagtcatgtgatacaggagagaactaattcctgtccaagtgtcctctgatctccacatggcacagtggcttatatgcataagcacacacatgcatgtatgtgtacacacacacacaactaaataaaaactaataaaacatttcatagaagaagagaggcccagatgtatctctcatgagttttgggaatttattttcctgattgacatgcctgaatggattaagtattttatgtcaagtttttttaagtcaatgattgctgacaaacaaacaaacaaaagaacagattaaaatacttaaaaacttcattcttggaatttttttgtcttttattattaaccctttcattttctttcagattgaagtggtgccatgcagcaagaagcagagagatgtagagttcgaaccaaaaggcctgacatggcactctatgtacctaaagctcgaaggggaacagctctcctcaagtcaagtgaccaggaggaaggccatgggcctcctgcctttgtgccaaaagatcaaaaagaaggttgtcttccccagaagatctctgcaagtaaacccgagtcccagagacgaggtgcaggccattctgataggaaggatgttgactgtagggaaggaaagagatctgcatcacaactaaggaaagacaggtgcccacaaaaacagaataaagagaaggcttgttctaagaaaggagctgaagaatccacagaagcctcatcccaagaacatcaacacagagctcccgacgctgggattgtatctagtatacctttacaaagactttttaaaccaaaggacatggactgttgggaagttcagactgcgggagcgacaggacactggcgggtgtctccatctcagtcttcctcagaagtcagtgctgctcaggttccaagcagaccattccagaatgtggaactctgtgatttcagtggggaaacttttgtaaatagaaatttggaaagcagcattgtaactgaggccaaagttccagagctagtctcccaatttcctcaagttgttaccactctgctgaaaccagatggtatggctatgccagtaacactaagttctgattctgaaactgcaccatccagtctggaaacaccagatgggatgtcaaagcacagtcctggggacatctctgtggtttctgttcctggaggtccagatgaagatgttgattcaacttttgtagactttgaagttgagagtgagggtacagtcaacagtacagagtctgtcttgggtcaaaaaggtgtagattccattcttgagactgtggataacgtttctcttaaaatggcggtagtcagcaaattagagagcacaaatggcactattgatccagcagtgactagagaatgtgagagtgacagctctgctgatgagttatgtgtaaagtctgaaccttctgatacagcggtcctcgtgcatgaaatagacacagatgatggatttaggaatgtatgtgacagtaccagcaaggcttgtatggtggacattgcaggtacagcttgtgaccctgtaactgaaggcagctcttgtacaggtgcagttggagaatctggtgagagtagtggcaacatgagaaatttctcagattatatagaaatgagtgcagatgtagctccacttgatagagctaagagtgagaacgactctgaaaacattagcagcctaagtgcttgctcagatatttatgctgagagtattgcatctggttttacagagtcaacaggaaagttgatagaaagtgtgtcagatggtgcttcctctttacccataaagaagactgctgatagtaatattgccacttgtctggactctgaactgagtatgtcagatgcatcagacgtacttttggagagtgccttgggcagtgatctggataccactgaggagatgacagaggccttgcacgacctaaaaactgctgaagagtttaaaacaaaagaggaagattactcagagagtgtagtgtgtggcatatcattttctgattcatctgtggaaacatctgtagatctaaaaacaacagacacttctcacatacaaggaagtagtgctgtggaggaaagctgggaatctatgtttaatgat

SEQ ID NO: 26121 - DNA, 1164 bp, Mus musculus
tagcgaaattatagttatgaagtagcacacatataattttatggttggggtcaccacaacatgatgaactgtatcaaagggtcgcaacgtaggaaggttgagaaccgctgctctagaacacttttggtttggtttgtgtttaacgtgtggagccctgagtttcatcctaagcatgacagaaaagaaaaggaggaaaggtagagagagaaaggggaaaaaaaaagaaagaaaacaaaaccaagagtagtatcaattctttaaagcacttggaaagctaaaaaaatgttaacctctgggatcaggtgaaaggtgatcagggaatccccctgtctcgtgaataatctttgtcttgtaatttgattaaaggagacttagtggctgtgtgaaatctataatcatatgattaacattggcctttatttacagagagaaaacggttggaagccaagcaacgggaagacatctgggaaggcagagaccagtctgtggtttgaatatcagttcctgaaaggaatgaatccatgattgggaagtggttgatattcttgagacaagaggatctttccagagctgtgcacatgcagatgagcatgttaaagaaaacatgaacaaaacagacgacttggagaacgagggtccagtcctcactcttgaattcagacctgtccactgtgacagagacgttaaaaggaactgtcatgtgggaaggaaaatggaagtggcttctaagcgtcctgggtggagcaggtcatcttcatgtgggtcaggcctccaggaagtctgaagcaaatgtaaagcaaaacaggattcaagcctgcagtgataggagtcggaggtccgtggcagggcagggcgctccttagtacttctcagagttgagaactgcaggatgaggggcagcagtaagacagggagaggaaacagctcacagacaggagtgcctggtgcactcagcccgtacagagactacactgctggcccagaactccagagcccctgaaccgcagcgcatcgtgggtgtttgttcctgagtgtgtactaagcttggggcctggtacttgggcctgcacagcagccgggtctgctaccttccttcctcacaaggaccagccctagggaactgagtgccgctccagtttaatcagtgatatcttgtgagaggga

SEQ ID NO: 26122 - DNA, 1267 bp, Mus musculus
aaaatagatgctcgcagacagaactgattttacagcattctcctccccacagtacaagagctaccctgatagtcaaaagacatgttttgggataccttctgtgaacaaaaagtacctttttctgtctcctccattccgtcatctccttcatctggcacaggaagcctgttttggtgtaacagtttaggtaaacaagggaaggactgatttcctgttggatccagcaaacagtgatatgatcctcacacatgaagctaatgttctgcacaagaatgtgcgcagctagctagggtggggtggcaagtgatgactggacttgggcagggaggttaccctcaccttcttgttggatctagtttccaagagaccagcaaaagcaggccaggcagacaaccaacagcacgctctcagctttccggcccacatcacacgagtggtaggtgcagccagttctaattcctggaaaaagctatacaagggctgtgctgttaaacttctgagttgaaagggaaagacacgggcagcttggtggctggcatgacttataactagatgaggaatgttaacagaatactaaccgccaaattccagacagaaccaaaaacctcagaagactttcaccctggcacaccttgacttcacgtgtgctccagagaagggctaggaagctctcctcagaagttacgctaatagacttttagactatgaagagaaaactagaatccacagggactgtagctttctactagaaattctacataaccctgagatttagacgtttaccatatacaaaacatatatgtagagtgtacatgagaggtcatcccccacagctaacttttctttcagagcagccacagcactcaaacagctctccttatcttggagagttctgttctctgagagcagcagccgcactgtgttctcccattagctcctcttataaaccaaggatttatcctgcatggacaagcttgagccgtggctgggacttcttactactaatacacagcatccccgactactggaataatgtaagcaaaaagcatattttcaatggaagtaaaaacagccctgtcccaaaactttcaaatgctgactttaaaaaactgttctccgagactgatgggagttatcctgagagttaaacgtagctgattatcagacataagatgggttgcttctttaaaaactgggtaataaacattagcaatgcctatagagaaggactctaagcagctaacaagaagtcctttcacagacatgt

SEQ ID NO: 26123 - DNA, 1150 bp, Mus musculus
ttcgtttcccaccccatccttgcacacctccagtcagtgcccagagatccagtgctgcctgctgaatctccaactattccctagctgcctcccccaacctccactcccaccccacccccattcagtcacggggaaatacttgcccacaggaacttttaactcaggggttgttgacctggggccattaccccatgggggtccatagtttgactccagtgggctaaagagcccttaaaattgtcggaagtgtttttgtgtgtttttcagaagcttgaagctttcttaatattctcaaagttcccagatccaggaaggctttttaactgttttgaataatggaactttcagcccgatgtttctgcaatgcagagtgaattctgggatgcttgagaagagtgtttgattataaagtggtgaagcattcttgtcaatgggggaaggttgggacccaccaagacagggtccttagaaatccctggcacaccacgcagtagggtcacaacctacatcccatataacttttgcccactgtctaccaaacccacagtaggtattgccaagagggccgtagcccatgggagggaagtttggagccagagatgcctcttctgtgtatgtcatggacttcacatgccccttgtttagcctggctgccctgaggctcagccatgcatgtgttctagctaagtccacagccacctctcccaacctgctcctgcctgctcagaatacagtgccagcccttagtgctggtgtcgcagacctaggccagtaagtgatgatgagtttggaacaagatctcacaagggagccctgctaggtaaagttccctctcattagtcctttggccaccaggctcaggccactactgttgtattaactccaccctctgcagaccctctaagggacctgtcaccattcctttccctagctcccaagccccaccccccccctccgattttcttcaggttaaaatacattttaaaaaaagattttaaaataaagtatttatgaaaactcaataaattgtaaataatttttaaataaaataaaaatgtgttttcctggactagctgctttgcttgcccatgggattctggagtttgaaaatggtttcatttgagatgcgtgtcagacaatgcacaggtgt

SEQ ID NO: 26124 - DNA, 1366 bp, Mus musculus
aggaagaaggaagatggtgatctctgagtgtccactgcttaagtcagtgtcttgccctcctgtcttctctacagccaagcaggtcgagtatttggtcaacgagaagcatatctatctcctgccgagtggtcggatcaacatgtgcggcttgaccaccaagaacctagattacgtcgctacctccatccatgaagccgtcaccaaaatccagtgaagaaacacctcgtagttcacgccaccaaagcagttcttgtcacacctttcctgcctgcgcaaacctagctgtacctagctgtacacgtcctttattagagatgaccgaggggaagcagctgctgtttagctgaccccccacatgagaagacgtttcttgaaatgagccccgggggctctggggttagagcctgttggaaaccagagtagattaaagttatttaagaataaaaagaactttggctatgagatgtaatcaccttgccttcctctctagcattctgcaggagtgatgcccacggagccttgggcttctgcgtgttgcctgactgtacaaaagtctagtctcaaagatcaagttggtctgaggagccggatgtgactgtgggtgttggctggggcattaaaactcatcatcgccacccatctctgtctctcgtcaccctgatctccccgcacggttgtgtccctggtctggaacattagtttttttaaggcaactgtggccaatatttatatcatgacatacaaatggatttacgtatttgactgaaatgaaagttccactaaacggtatttgctcttgtgatatgtggcacattgtgatattttcttagtctgttctgttttatttaaaaaataaaactgctgatcaagacaagtgaaatggagtttgtgatccattcatgagttgccacccacagtttagaatgaagtctttagaggggttcactgatggcaaaggtaaaggaaaaaacaaaatgtgttcatgaaactggaagttcaagtaggatccaggctgtaagtccatgttgcttttgtaggtttatcgttcagacaccagccattttcttaagaaactaggatgatatcatttagagggattctagaataccagctctttccgtcaccgctggagctgctatgtccctagtgtattgaaaacattacagctgcttaaacatcacaagttccagagtccctgaactctgggaaaagggtgggtctggaaaaattggtagggctatgccttactttaagcaacagagtaaccacttttcaaaatatttaagagtagcttttcagaatttcccaggactcccttgaggtataaaaatcccacgatttttaaagatggtcggctccagaagtc

SEQ ID NO: 26125 - DNA, 1195 bp, Mus musculus
acctgagtttgtggcatcccaattttatgtcagcattccagttctggagctcacattaaaagctatataatctgaatggggcagggggagcgaggctgtcctgtgtgcccagcaccaacccgggactcaattcagcaagtgaacgcactgtgtttctgtctctgtcctgctttggctagaaggtgggggatttttctctgtccgtatttacacacgctgccttggaggctgcctgacgttcatgtgatctctttctctgtactcagcgtaccgcacagatgaatctcagccctgggttttgccagtagtgaggaaggtcgaacagaagattgctaacgacaacagcctcaaccacgagtacctgcccatcctgggcctggcagagttccggagctgtgcttctcgcctagttcttggggacaacagcctggctatcagggagaatcgggtgagtttgggggggtgtggatagtttctcattaggaaccgtaaatgtctaaaaataagagattaaaagttcaatttccttgaaggcactgaaagttatatcttgaggattcttggaaaatacatttatgttatttttttccttgacggtaagctgacctcttttacatttttatttatgtgtctgagctttgtgcttgcatgtaatgcttgtacatcatgtgtgggcctggtgcccaaggaggccagaagagggcattgggtcccctgggactggagcttcagatggctgtgaactgctatgtgggtgctgggaattgaacctgggtcctctgggaagagcagccaggactcttaatgactgagccatctctccagcccaccaaatatattttcagtcagtgtaagaggataattatggctgtatccggagctcagcttcacttactcagttttgtccagtacgttatcagatttcagccgctggcgttgaaaccgttactagaaaagccaaacaaagagaagttaatggactgtgaagagtttggagatgtatagactcatctctgccactgctttgggccacaggcagatcatttacctacttgctatctgtgtcttgaatttagaaaggaaagaaactatagctcataatcccatcaggggttctttcctctaaatgtatgactttcgttcatttctggggaaaaatttctttaattttacccggctcctcagaaggttatca

SEQ ID NO: 26126 - DNA, 1174 bp, Mus musculus
tggagagaaattttcccaaaacattcggtgagaattgaggtgatcagccaacggttaggggccatgtttcttcagcttagtaggtctggcaagactgggatgtaaacagctaaagttagctagaggtgcacagaactcaagccatgttatgtgtctaagggaacagggaatgctaggaactgaagccagcgcttctcaaatcagaactgtggtttttcatggcagcgttttctttcttctttcacctccagtctcagttttgagttcagggttcccatcataccaaagggacggaacttgagggctctgctcactacggtgtgcactgccactgagccatctgtggttgagaaaggttaagataatactaagctcttcatttcacagagaccctccctccgggattactgaactatagatatgctgggtgttagctggttggttttaaagaattcctactaggagtgggctcattttagaatttttcttactaaccctttccttccttctcactacaataagagaaatacagactcttaggaaactcaccatcctttgttttcttcccaccacattgacggatctgctgacttgaaaccctgaattgggatgctctgtcgctggctggttgctgccccgtttccccttctccttcctggtggctctcagtcgtcaagcagaggatgcagatgtacaactcgccgtaccaccgcgtgacagactgtgttcgggcagtgtggcaaaatgaaggggccggggccttttaccgcagctacacgacccagctgaccatgaatgtccccttccaagccattcacttcatgacctatgagttcctgcaagagcactttaacccccagagacggtacaaccccagctcccatgtgctctgtggggcctgcgcaggagcagtagctgccgccgccacaaccccactggacgtttgtaaaacactgctcaacacccaggaatccctggctttgaactcaaacattactggacacatcacaggcatggctagtgccttcaggacggtctatcaagtaggcggggtgactgcttacttccgaggggtgcaggccagagtcatttaccagatcccctccacagccatcgcatggtctgtgtatgaatttttcaaatacctaatcacaaagcggcaagaggaatggag

SEQ ID NO: 26127 - DNA, 1191 bp, Mus musculus
ccggaacagccagcccgtggttaagaaaataaagccaggtactcgtcagaaggagtttcgttgttaatcgtttacctggtctggcgtcagaagggaagggagggaggaagctccccttgtctttgtgaggatctggtcagcgagaggaatccagaatttgctgtcatcctgcttctttcaaaagcataaatgtaggtccttccacaggatctttttttgtttgtttgtttttgtgtgagacagggtttctctgtgtagccctggctgtcctggaattcgctttgtagtccaggttgactgccaactcagagatccacctgcctctgcctccagagggctgggattaaaggattacaccccactcccccagcctgtatatgtgtgtctatatacatacatacatacatacatacatacatacatacatacatacatatttatacatacatacatacatacatatgtctctatatattttctgttattgttttgttttgtattgttttacttaagggatctccgcaatggcagacactccggaacatgctagcgattaccttcgacctctgctgagcttcgctgctgctcatgtgcccgtgaagaagcacagggagacgcccctttacatcctctgcactgcgggcatgaggctgctccctgagaggtgagattcaggactttcacaggacttagggaagcgagtcccctgcagccaggatggagttcacagcgggcaaaagcagcaggctcagaagcaggggagagccatctctgtagccagtgacgcacggtcagacagtcacatctttatgtcatttgctgctttgggatcagtgtcacctgagatgacaaaggggttccaggttggttgagggtgtggttgcagttgggagtggcggcagtggtgactgggtcatgatgcaggtagggagagaccatgtttgcacaagagccgtaggaggctcaccttggggagactggagcagcaatgcagccttctctctctctccctccctgcatcctgtggtgactgctgagcctctcctcttcccgctgcacatacgtcagtctctgttcctttagatagcttttccagccccaaccagtgagggctcatccacccgaaccaaaatcagcctgatatcttgacacccgatccttcttcttacagaagagtgcaagagggaagag

SEQ ID NO: 26128 - DNA, 1182 bp, Mus musculus
ttcactcctaagatcttatatatatatattgggaaggaatgtacttgttttgtttataaattatgttttgttttaagaaagaatagcatcaggagagtgggcaaaggcaataaaatccaaggttttgatttttgtttttgttttttgtttgtttgttttttgttttgttttgtttagtttttttgagacagggtctctgtagctctggctgtcctggaggaatttgctctatagaccaggctggccttgaactcaaactcacagagacctgcatcttcctcccgatcactgggattaaaggcatgagccagcatgcctggcttaaagtcaaagatcttacttttttttttttttttttttttttgagatgctcaaaagacagcaaattctaaactttggaataactagataaatctgccatggagcaacctggccactttctggatgtctgtcacaaatagctctcccactagcggggagaggaaagccatattcccgatgttctcacctactgcctctcagacggccttctctgcagccagcctttcatactgtagtcctccatcgtcagctcctccctgcccccacctgggattgttcccagggccgaagcaggagtttgatttcttcttttggggagtaaggcaggtctcctgagcccagttttctaggtcgccaaggccagccttgaagccctgatatccctgcctctgtgtctttgtagcgctggcttcaaggagagcatcaccaacctggctcattttctcttcattttgccaaagccttttatctctagtgttggagttcagaagaaaaaaaaaagagtctaaaggaataaaaatgaatttctttgataataaattcctcctgggaacagaaggaaatgaaatgatttatgaaatagagaaaaaagtcaagatggtcttagggaggaagccaacgtgaggatgagtgtgttgacttagcagttaggcaaggctgcaattaccatcatctcctccctcttcctccccctcctccctctctctcctcgccccctctctcttcttccttctcctttccctttcctccccttccctcttcttcctcctcctcctcccccttcctccttttcttccttttcttccccctccctcccctctccctcccctccccctcctcttttcttttcttttctttttt

SEQ ID NO: 26129 - DNA, 1154 bp, Mus musculus
ggagctgaggacattgctctcaactcatccctgagggtagacttcaaatgggatctcattagccaagttttcgctgcatctgttttagtatttaaaatacttttggttttatgtttaagccattagcttaactttgcacaatttttttcttacccacaacattccaataattacaatctgaatgaaggtacaaatgcataatagagatatctacctcattatggaataggtggcgattcttgggaagtttctagactgggatttgtatgtgacttcattttagctggactaggaattaagtaggaacagcattggctgtttcagagtctcttaaatcggtctcttagtttatgttttaccctccgtctttgctgtggggaaggtagacttctgccaaactcgtgaagattttgctggcattataaaaattagtatgttcaaaaatgaggactaagaaccaagttttggcacctttgactaacaatacagaataacaaatatttttgtaaaccatgattgcaaaacaatgattgaaatcaaatacttttaggtaatggtctgtatggtgggtggctctgtccttgaccttcaccctcctcctaacttggatgtgatcgaactggaaaagctgttgtaccctgcgtgggttcctgtccattccaggctttctgttttggtgggaggcttgttaaggttctattttaagccagctttgtcttgttttatatccccatcggctgtctttgaagggtttcatatttccccttggcctagtagttcattatttttgtttgttaatactatcattagaaggacagaggagaaccacacaccagcagaccattttcatttctggaaatcggagcaataaaaagactttttttatattgtaaaatggaattattgctcatgctataagggcttccagtttttcaaatatgaaccaggccattgcttccatggcatgaaaacttgagttgaaaatgttctgagtcataggctgtttaaccatgcctgcatgtcagacaagcttgaagatgtgtctattcctgagcctctccttaaagcaggacaattactaccagacccctgactcccacccccacccccaggctgctagtccgtttactgtaaccaaacacttgagatcgttt

SEQ ID NO: 26130 - DNA, 2146 bp, Mus musculus
ctatatagtgagttctaggccagccagggttacacagtgagactttgccttaaacaaacaacaaaaacagaaaactgtgtctctccatgaccacagacatgaaaagtgaggcatataggatggtagcagtgatgacctgtggggacaggaagcaggagctgggtgtggtagcccatgctcatgatcccagcactctggagactgaggcaataggattgcttgcaccatgactgactgcgtcctggatttctttattttatggatgcttgcttctgacatggggtacatgcatttgtaatgtctgagagacaccgtggcggtgtgtgcagtcactttcaagatgacttcttttcttctttcttctaccacaggtggccctgggcattagcactctgcttatgtacgtccccactccgctggctgccacacaccagtcaggctccttggctctgctcagtggtgccctttggctcatgaatgaactccgaagagtccctaaataattctcagaggatcatttcctaggactggaactgccttggaaactcatcaccaaacacaagaacttagccttttctaagacggtggtattgacatgccacatggtttccaaattggtcaagtcattcagaactgttctgagatgggcactggaccacgaacattactaaggtgtgcttataccagaggtttcctttaaaactctgctacataaacaaggatctgccatttgctgcttcataagaggcgggctgacttcttagatcttggtttctatgtcctgcccactagtcaggcttctggtgacagtgacagattcaggaacacgtgcccctgtggagctactcgaccagttggctggtgactgcatgttagtttgttaccaaggtctaaaattgtcatattttctggttttgataagcagctaactagctaggtttgtgaagtgaatattcttttatgcatatgtgtgtttgtgttaatatatgccatgtgtgtacgggtgcccatggaggccagggaaggtgctgggtccctggagctggacttaaaggtgattttaatatgcctgatacgggtgctagtaaccaaacacgggtcctctggaagagcagcaggcacttttaacagctaagccatctctccagccctggagtgtatattattaaaattaaatgttgacaatttcaagttttaaaaaatatatggaggcttaacatgtctgacctgaggttgcacatttgcagtttctgaacaagatgatcaggtttttttttttaactctaataattattctgtgagtctcggtgtatcctaaaggatactgttcttagctagtcttagcaaaaacaaacgcacatgtgtttcactcctcaagtcccaggccctgctgggcttgtgttattgcacaaaagaggttccctcaacctcagaacaagactcatcctagacctaagcgatcacaaggcctctgaacaggactgggctgggttgaagttctgccagcttgttcccattccctccgaatcgctaccgcacctaccgtgcctcatttaacctgttgggcctgtgtcagcagggtagaaactccgctagacaggagccttccaagaaggggaccagggcagcttgcacaccctctgcttcccaactccaaatccgcactcttcagttagaagcaatcagcacagggctggagggtccagccagagaccactcggaaccggtttatagtcaccccaagcacatggcaactggagtcagctcaagtctcagatattttgctgcaggtttttgtttgtttgtttgtttgtactacagttaagcatgttcggaacagatccaatatttagctgtttaactgctttatggtatatatatatatatatatatatatatacacatacatacacacacacacacacacacacacacaccctaaatacaccctaatacaattattgatttatgccccaaatgtctatttcagaaaaatccattgcacacttaaaggattaaataatttcttttaatgttttcaacagtctgtccacaattctgtcaattgtttttaatttataaataaaggtaattaaaacatgtattttcagtcagctaacccaggatttttgtttgggattgatta

SEQ ID NO: 26131 - DNA, 1171 bp, Mus musculus
ggggtgggaggggagcgaaaaggacgattaaaattagtaatccacaaaatgagtacccatagtcatataatccagcgttggttataaagcaattgattatagaaccttgggatgcgcttttaaaactggtaaatctaaacactaggacaaatgtaactgttgggttatgttttgagatattggttatttaaagagctggttactggttactggttactggctactggttactggttactggctactgactcggcgggtgaaggtacttgctgcccacccagcaatctgagctctatctccaggatccaggtggtggaaggagagattcatctcaaatatgcatgcaatcctagcaactgaggatgcctgccgagacaggagagctgtggtgacagcctgggccacagcgcacacagtccttcctgtcccaacaacagccaagagtgcccaattgctatgaagttggtccctggggctctggccaaggtcctgacttttgcttctctttctccaggagacctggtgattctcgacgacagcgctcccactgcaggatggctgcagggccgaagctgctggggcgcttggggcttcttcccatcctcctgtgtccaggagctctgcctctcctctcggagccgacgctggcacgcacagagtgcgttgcttcaggccccagagtactccctgggacaagcacgggccctcatgggcctttctgcccagttggacgaggagttggatttcagggaaggagacctgatcaccattatcggggttcctgagccgggctggtttgagggagagttagagggtcggaggggcattttcccagaaggttttgtagagctgctggggcccctaaggactgtggatgagtccgtaaactccagaagtggagatgactccgctgtcaacggtgaggtggatgtccctccagaagaagcagagagtggaggcgacgaggacgaccagcagtcggggacctatggaatcgccctctacagattccaagccctggagacgaatgagttggactttgaggtaggggacagaattcaaatactggggaccttggaggatggctggctggaaggatgtctgaagggcaagacaggggtctttccccatcgctttgtgaagttatgtcctagcaacaggacagaggaaa

SEQ ID NO: 26132 - DNA, 1144 bp, Mus musculus
tccctgggatgcagataccgaagttgcttttccaactttcgcctccgctaggagatcagaaagaattcttgtgacttcctgggcagccattgaattcattttccatgagaagatgacagagttagcctgtggctataggagatcatgtcatccagacctttttgcccatcacattaactttcctggaatattgtgctgcacaggtagacctgaatctgcccagcttgttgacagctcttgtgtatactgtgttgaagccagacagaaaagtaatggggccacttctgaaacctctcagctgttgatctcacagcagctaaagggttgtgccaaacattttattaagaaagtaaagcccagatttgaatgggggttttccctaggccttatagtatagaggcatttgtaatatggagaaaataatttttctcatttaattatagaaattaccttcaaacagattttgtgttctttggcccttcaaatactggtgttacattgttgctgcagataaatgatgattgtcgtgggatatctggatcactgagctctgtgctttcattcctagagatgtttctcattcccatttagtgaaatgctgttgccccaaagtgatggttgtgggatttcttaccggtcataggccccggtgaggagcagggaagcgccattgtgaaagattaaagaaagcacttccacttgagctccttatggagtgagcttccctgtgcccactcagtgaactaagtctgaccatccttcagggacgttccttttggtaaatatacactgtaatctttaagtctaaatttatatgtgaaagttaactttttttaaaaacctaaataaaattattttcctatcagtgattgtgtgtgttctattttctccatgtcttcatacatttctgttgctataacgtgttccaaggctgtctgtaacgtgctctaaggctgtcttgcccattttaactagagggccagggtgtttgctgattaaacttaactgtagaggtttgtacttttttcaaaataatgactactaggtataaattttttaaaataacatgtccactttttcctaactctgagattttgttattgtttgtgggataaatcaggtgcaatggattgaagaaagaaaa

SEQ ID NO: 26133 - DNA, 1266 bp, Mus musculus
tatacaggaatgaaaaattcacccagtgttcatttgaagtaaagttttatctatgggttttctgtggaagagactgctgacaagtaaaattgctcttcctgaagactaagcccagcctccttgtgttgctctcagcaagtgttcttcatggcatcacatggagtcagatgaatcccatctttaatcacacatttaatagagtccttttcctgtgtaaggggttggacttttgtgcctttgatatcagctgaccataatgaattgtgttgtgtgctatatgtatatgtatttaaggtgtacatttaataatatcaaagagaagatgcctgttaatttataatgtatttgaaggttgtattgtttttgcatttgtaaaaatgggttacttgtttaaacaatcttttatgtcttgtcatacaaattccaaagggtctgcattcctttatctgtaattacagtctcagaatccaagttctgaaaacaaggtatctattctgatctgacactggatctgcttatcccatttagtgtgaatattcattgatttatgtgtttgattattgggatgtgctgccacaggctctcttgaaggttgatgtagtgtggcgtatgcactgaattacctttctaaaatctgaacagttctcattctgaaacatctagacttaagggtttcagataaaagactgcggttctctgccttatgttaaataacttagaagatgttattttgtttgaaaaaatgtgaaatgcttttatattctagtttttcactttgcatattaaatgattttaaaattattttgaatctctactcattttaataccataggctaatatggtttgagaaaatgtaaagggtcatgtgataggttaggagcactagtgacaggatagatttttttatcctttgttatttgtgtgtgcgcacatgtgtggaagccagaggacaactgtggggatagtcttcaggaatattgccctactttttgagagtatatcagtggcctggagcttatcaattaaggtaggttgggtggactgtgagtcacagggtcttcttgtctttgccactacaggtggcttccaccatgcctggcattttacatgcattctgaggaaccagactcagatcctcctacctacaaatcatatactttactgatcaagtcatgtccccaaccgtgtacttccttctagaattaaatagacttactgggaagagttaaggaacttccttactgtaatgtttttacctaggacgta

SEQ ID NO: 26134 - DNA, 1118 bp, Mus musculus
ggaggtgtgaaggtggatttaaatcaccatagctccttcatgtagaagacctcccttcccgaggctagggctctacagagaggagaatgaaagccactattggttaagcctacgatctaactgcccctttgttacagtgttcagatctgtgcacacagcttatcctgtgaagctgagctgctgctttaggagatagtagctacttctcagaaccagaaaaaactgggggacgatggaggagatggaacttgctttaaagcttgaaagaagtatagagtttggattagtagagagagaaggcgtattctcgactggaaagaagcaaggttaaaataaagatgtacaggaataatctccagttccttgagagaagcagtcatgtcaggcatacagcccttacagctagtcaggtagtaaattctttttagcatctatggggttaatatttggaaaggaactcacaaagaatgaaatataatgtagcttacctcccttaacaccatcttacttacagtacaagacagcaaaatacaactgccaattatacagctgcggaaagtatgggctgaagcagtgcactacgtatctgggctaaaggaagactacagcaggctcttccagggacaaagagcagcaatgtaagtggattgttttgaagcgtaatgccatgtgtatcatgtactcaagaattattcttgccaggtttcactagcaggactgtgtacaaactaaaatattgagcattaaattttttttaaaaaaccatgtgtttatgtacatgtgaatgggtgtgcatgtggaagccagaggttgatgttgggtatctttccttagtgttttctcacctaagttttgaggcaggatctattactaaacctggagctcactgagttagactgactagccagtgagctcgtaggatctgtgtccctcccaagcctcttagtactgggggtacaagcacactctgtcatgtactaagctgagataatcatgcgtgcaaggcaagcactctacccactgagctgtcaccctgataataatcctaaccagacttagatttctttctttcttttttttttttttttttgtttgttttttttttgttttttcgagac

SEQ ID NO: 26135 - DNA, 1230 bp, Mus musculus
agggtctttctacatagctctaactgtcctggaactcactagactaagctgtctctgtctctggcaattgttgggaataaaggtgtgaaacaacactcctagacaattttcacattttaagtgtacagttcattgatactcaataaacttattgaattatgaaaccatcacctaccagcggtttagattcccgatgtgatgttgcatgcttttagtcccagtcctcaggaggcagaggtaggtgatgtcttgagctcaaggcaaatctgtctacatagcaacttccaggacagccagcatcacacagagagacctttgtctcaaaaaaagaaaatatgaaatgggggtttaaagtatttccatcagcccagtaaaatttcctagacacatttatattaatttcaatataaattctattctcagccttggccaccacttgcatactttgtatctttaggtttgtggggttttagacatttaactgaaatcatgtaatgcagtgtgtgtgtgtgtgtgtgtgtgtgtgcgtgtgtgtgtgtgtgtgtgctggtgccggagcctgaggatccctggggctagaactataggaagttgtgaacctcctgacacggttgttgggaactaaactcaggtcctctgagcacaacctgcgctcttgactgctcagctctctctctagcttggttttaactttttaggaatttgtcaaactgatttccaaaattactacattgttttatgctcccatcagcaacattatgagagattgacctttgcacattcacgtcaatattacttaaagtctttttttctcctcttgagcatgttggagactgaagccagggtcttgtgcatgatgaataagaactctgccattgagatacatccttagcctgttgtctgcctttttggttataggcactatagtgttgtggaatcagtttcctgagcactccttctctgtctccttccataggattaatcttctgtatatgtcttagattcatctatgtttcatgaggtattgattcttttaatttcgcactgttttaaatattcctcagttttccctgttttaaatagtgaaaagagaaggggatcatgtgtttatatacgaatactaggtttaaaatgttgatattgttagcttgcgtggtcttgtgacttatgcctgtaatttcagcactcaggaagctgaggcaggaggattgtcacaaattcaaggtcagc

SEQ ID NO: 26136 - DNA, 1403 bp, Mus musculus
tccttcaaatgagctattcctttttcttccaacagggggaaccagctgtttgggagaacctgtataatccgtcctaggtgtcactccagctccctgggagttcagggtggacaggaggatggaaaaggggtcctaaagcaacagacagcaaattcttctctctatgcctcccccacaagcctcatctccatctccatcctcatcctttctagggcagcatgtttcatgatggctgctatgaagttccccctgtatctggccttttcagccgatgtttttgtgtgtagctgggcagcatgcttagacttgtcccttggtgtttctttatggagttgcacagctctgtgaagtagcatttcctaccaggcccctctcttcctgggcacttacttctgccagagttgattgacatcaacaacaaacaagaaaaaggagcagatgggaatgactctccggaagacctcagacaaccacgattagttaacaggtagaagtccaaagagtgggcgatggatgtcttcctacgttccagtaactcttaccctttgtgtgcatcacgatatctgccactggcaggcatggttgtgtgtaggaggccttccctttctttcctcatggggtttccctgtaaaagagaaaaggaagctgtagtggaaagaagatttttgtgtggtgagattccaacagaggagttaagagtgaccccctccaaaggtgaagtcagtgaattctggaggagcctgccttctggttcttatgttccagcgactagctggaactgaggggacttcaaacctggaatcaaacaaaacctgaaggaatcaagccagaaaggctatcaggattcattgatcttttggactaatatgtggtggtctctggctctcttcgtcataggacaatgtgaggttccaaggtgattagcaataaaattctttagaaaaccacgtctttgcatttccttctggggctattgagagaagagagaaggataagagtgtaagacattgttgtacactctctggaatgtactgggggccatgtcaatctcagggaggttgcttctcccagcaatcttgaaataagaagccttggttcataggaatgtttgaaacggcgggtactttgattatcctatagaaaggagtggagagaaggagaatcagtctagggagaatcagtcttcagagaggagattagaggataaccaagactaagttaaacttagtcaaaaactctacacttaagattttggatgctcaggagcctgcatcctgaaaacccttacacacctctttccccctctccagtgactctcattccctcacactgagccttctattcatccctgtcacccccacctgttctcaccacccccctcccccaagcattccgtaaacccg

SEQ ID NO: 26137 - DNA, 1099 bp, Mus musculus
cctgagaccaaaccagacctcttgccttctggtctcaggggcttgccaactctctggcttgtgaccagacacctccattgcaggcctggctcactgaccatagccaagaatgctgaacaagaccaggtgtcctcagcaaatggctggcggaggctcagaggtactgtgtgaagttatctggagatgtcacttccccctgggttgtctgcgtgatgtctgatcttttactagctgtgggtttgtcctttgtccttggctgttaaaaacaaactcccttagactgtgaggcctttacaacagatactggctcctcacggttctgggggctgggtatctatagcaaagccccagcagtttgattctgccaagaatgggcctttgattcttaggtggccatctctgtgttcaatggggaaggggtgagctttgtctctggggtttctctttaaaaacaaacaaaaagatttagtattacttgtaattatacggacatgtgtgtgtgtgtgtgcatatgcacacatgtgtgaaggtacttgagaatgctagaggtggcaggttcccaggaactggagttgagcagtctgtgtgggaactgagaatccaactctggtgctctgaaagaacagcaaatgctcttaatggctgaaccgcctctccaaatcctggggtctcttttaaaaggaccactcccatcatccacagggtgtgtgtgtgtgtgtgtgtgtgtgtgtgtgtgtgtggtggagcatcaccctccatgctactattccagatactgatgaaggtccaccagatgagttgggatttccaagtatctattgcatgctgctttggggaagaagacacagtgtttcctttggaatgccttgattgctactaaaggcagctctccactggagacaaactgcccttacattccctcaacctgcagcctacagtgctgcctgcatcagagctggttggtgatgtttcttaagccagctgccattgcattcattgtctatcggagaaagcaagggaggcctgccaagacaatgacgtagaacaggagtcctacatttctctcccttggggagaaagttctggaaacctagaaaag

SEQ ID NO: 26138 - DNA, 1099 bp, Mus musculus
tctcttccagagaaagcgctgaagcgcccccgtggcagggtgggggctgggtggaggaccagcgggggatgggtgagaagccaggagcagaaaaagaagggaggaggggggggcggagctggaggcagagggaacagcagattgtgcagagccaatgagagcagcaggacgaggtggtaccaaattcccatcggccaatgactagccagagtttacgaaggcctcattagcatcgcccccctccgcttggctagggatgggacaatgcggtgttggtgtctgcagtattctgactcctggacaccggtggctgcaagctgcgattttggcgtcctctcattttctatccttatctccgcccgcggctgccctggccagccagtttttgattttttatctggtcattgatcaatataacgaacctaaggatatacaggacattaataccccactgccagctctggcccagagcttgtaccgcgcagcgggctgcagaaacttagtcatagcaccctttgtcgctgaggtctgaagctcgctgcacgttctcatccctgggaacgtgaccccagcatccgacgccaagatgccggcccacatactgcaagaggtgagcttacaccccaccccccaccccctcctcaggttggcggttgcagattggacttctaggtgggtggctgttgagggttggagagagttcagagcagctgggagcatttagccatcatttccgaattgctcaaccttgatagattgtttctggaccgggtgataaccggatttttactcagtacagttgattgtcccaacttgtgtttcttaaagtaaaacctgacctcttttcgatatgcgcagattttcctttgtgagttgctaagggtgctgctaataaagcgtcctttcctgccccttcatcataaggcttattcccgatggcctgcacatttccgtgttccattggtgcgctctacagtcatgcaaccttggcactggggtatggccgttattgcatctctcccgcagttatattagagggaaagtaacccctgctgcccccacgcgtctgcagtccctaattctccaccccctctcattg

SEQ ID NO: 26139 - DNA, 4470 bp, Mus musculus
atgaaactgggtttagccattcactcacctgcagccctgattcccctaagtctgaggagcccactgggtaagaggcgtgggcagaggaggaagcactgagccccctctctgttctccttgcttctatttgcaggcgagggcttccacaactaccaccacgccttcccctacgactactctgccagtgagtaccgctggcacatcaacttcaccacgttcttcatcgattgcatggctctcctgggcctggcttacgaccggaagagagtgtccagggctgctgtcttggccaggattaagagaactggagacggaagctgcaagagcggctgagtgtggggtcttgcagttcctgttccagaagccagcttggcagaggcttactgttctgttaattaactactgagtattgccacccagatgctaaaatgatgactgacgttaacccattctggtacagtattgtaaaacggacaaaaatcggaagtcgacagctcttccttctatgctaagctcatcttcccttctagtttcttttcccgttgtctttttctttgctttgtccctgatgacctcgtttctcattgcttctcccaagccagccgccgctcagctataggtcagtgttcaccttccagagtacaccaacttctcaagggtctacagtaaaggttcgtgccccacccccaactcttcttaagctgctctgagttagaaatacaagaaaaatcttgagagatttctcctgttatttttagcccaggctttgccagatggaatgaaaaagaaaatagtttttatttggcagggagcctataaaagaggtaaatcttaaggggccaagttcaacacgcaggctatgattcatcaaagccgtgggagagggggatctcttatgaacaggctcagctccgtctggcagagctaccgcagcctttcaacatagcgcgcctcctctcctaattcttagtaggtggcaactgaggaacttcgtgacactaaaatacagtaacacatcagtatctcagtgtagtttaggctgaagatttaaaaaatatatatatatatatatactagtaaagtgaaaaacaatttgtaggaaaagtggtctttaataaggattttcttttcctttaatgacaaggacccggggccaggtgtggtggcttgcatcttaaattgcaggactggagaggcagaggcaggtggatctctgagttcaaagccagccagggctagatagtgagaccttgtctcaaattaaaaaaaacaacagttagcaggacatgcagagcaagggaccctcgagtgaggcatgtttggaatccgtagggcagtcgctcatggtttcgagcgtcccgtgagctgcacccccagggtctttttaattcctgttcttccatctttaagatgatggtcgtgcccacaaattgaggatagctgtggcgtttccatacatctaacagtggaaggatttcaagagttgaacttgagtcacagttaaaactgaaaagtcgtaaagtctgtcctggatccttacaaacactccgtgagtgcttccctcagaagacgatgctgcgcgccttctccctcccactgtcgggcagtggacgggcacgttggaagtcgctgtgggcgcctcctaatgacttctcaaaggaaagcttctgagggccccttaccaggggacttcacggctttggggtgttctagtggagcaggttaggttttttttagcccctttcagtcccgctgctgtttgtggcaaggcagtactgactcatgcctcactagctctgtgaccaggtaggactctgcctgggatacatggttgaaatctctcagctctaccacacctgcctcttttcccctacccattttttgtgttttggggtgggtttttttgttgtatttcttttttcctctttgacatttagtcttggtctaggcagaaatgtcctggatatttccaggcagtaaagatgtgtggtcctggcaccttcctcactcagagatacaacctctatctgcagtaggtagagacggctatccttttctggtgggtttcagattctccacctcttatccctcccaggcttctgacactctcttcagctctaaagaaaaagtttggccaactttctagaaacatccctggctcagagagactctttgtcagtcattccaaaacaaatggtttggtggcacacatgccggcgagtcagggcggacagagcatgcaccgtgctcccggcacttggcaaagcttcggcaaagcttcgcgggctaatcagccctcctgggtgatgctgtggttaagtgggaagcacagcactcgaggttgtgttcttaagtgcctctgtttgaaagctttgggtagggtaggagagctgagatgccatgaatttcacagaaaggctctcgtgcagcagtgcagaagcctggccgcgtcggctgtacagcataccaggtgctgtgcttcgaggggacagtcttcctgggctagttgaatagagagaggctttagggccttcctgtgcccacttgaaagtagccttacccttcagctgtttgctaaaagagaattcttgggcgaatccaaggtatttgctgagctgtggccctattctattccttggatatgccttttgagtgatttcagttccgctggttatggtgcccacttaaacaaatgtgaaaaataaaagcagctctcttcttagcctgccccgtggatctgaaccatgctgtggctaaggaccccgtaaaataacatctgtcgttaagggtgtaccagctcactaagaaacactgctatcaagatttttaaagctcaaaccaagtgacacttttaataagagactaagatctgattgagggagttttctaacagtccttgcctcgtggacacgctaaagtttgacttgggtgccttacctcttttctaaccagtgttgctcgtgagcctgtggcgctcgcttgctcgctcgctcgctcgctccgtggattccttaaaaccagagagcctgtaagtgtggcaagatcaaaactggcctggctggagggttagctggacatggatctgcaggattgcctctggggacctcgttttgggaacttttcttggggctgttttgctcaagtgcccgtagctgatggatgggtgaagtaattttgaacgtacgcgatttgtaggttttgttatttgttttaagatttaaaagctggttataggattttaagtgaaagcttttcttcctggtttgctagtgttcttgagtgtcttctttagttgaaataggttagtaggaaatttaagaaagtggtggccgtgttacactggtggtgaaggccagggccgcctaccaactctcagttttttgtaacagtcccactctgacgataatgagttcactccttggataaggatgttaatgagggaagagccttcccgacctgacctaatcagctcttactggacccagctgtcaacactgttgcattggggatttaagtttccaacccatgacttatgggacagattcaaaccgtagcactgggcatttcgcctaacaatactgtgactcagtattctgtgaaactgggataatattcctgacctacctccacgggtaggtgtgagcatgagaaaatgctctttataaaacatttggggatcctctgcagaggagtatttaagtcctgcacatttttgtagtaactgtccatcgtggacttgacatgtgcctatgtcccagatgacgttgttaatctacatcattctcagaggttgaatggatgcgtcagataatgtatactcactgctatgaaaacatgcaggactccgtttccttccttgggtgggatttttcctttattatgtgcaactgtagttatttgtaatctaataattttcattaataccaactccgaaagtatttctactcatctgaggttgtgtttgttcataataaaatgaaatgatctgactgcaaaatgtctcgtggtgttttggctgcaatacagcctcccaggagctgggtggtggcaacggtggcgcgcaactttaatcccagcaatagggagtcaggggcaggcagatgtctgagtttgaggccagcctggtctacagagtgagactcaggacaactagggctacacagagaaaccctgtcttaaatttaaaaaaggaaaaagagaatttagaagtcatgaggtttgagtcataccccagtaacctgccctgccttcggtgttatttgagattcatttctgggaacaggaaaccagtagtaagtggatattaaatcagaaacatcagctggcaccttggcttgacaaatgccaggtctttgagtagctcatggccaaacacacccagtcaacgaagcgtcttagtgcagatctttccttgaagctctggttgggcagtccagctcattcttaggaatatcctgtctttagggaaca

SEQ ID NO: 26140 - DNA, 4470 bp, Mus musculus; identical to SEQ ID NO: 26139

SEQ ID NO: 26141 - DNA, 3094 bp, Mus musculus
gttgtgctagatgggatggagaaattatcttcatttgatacagagcaagtagattgtctcgagagaaaagttagcatgcgtggtatgatttgtaagtaaagatggaagagagagagagagagagagagagagagagagagagagaggtagccatatctaacagcctacttaccaaagaccccaggcctctctgcttggcatgcctcctttctgtccatcctctgaaccccagagattagtgagatttgaataattaaatcattttcagagtgaagggggttaatgcagggtctgtgctaggggagggttttagcttttggtaactgaagattttttcatggaaaaagtcttcgtgttcaatgtgcctagaactgataactaaacagctgacatttgtcggggacagatatggtgtgaaactatgaaaatataagcaaaatcttcacttggaacatgaaactatttcacttagaaaataatcgaaggacccgaggtgttgcctgggttgccagtttctttcgtggctgggcaggaactagtgaggttgaggggcagtgtctgtaagtagctgctaagaggtgcatttccagatgaagcccttggggaacatctgccagggatccgcatggtgttggctccatccattgctttagtttcctccttggattgtgtagaaacttggcttcccatggttttgaaccttccatgccttctttgctttgtggccacccagcctgcctagtgctgcctaggaagctcttacccacctgatttcttctgacatttctttctttggcctttttttctttctccggacatgcagctagttgcctgagtgtatcaagagcacccaggacttgctgctgtccaggcctgttcctcccccagtatccgtgggtgtggaagagctgtgtagcttcaggaagcagagccaggtgccacctttctgtggcttccagatcctccctacctccaactcatgtgcctctgtcacagtgatttcaggaaagcttggtagaccctctagcaacatctcggttcagaaagtctctctggtttgtgagttaacagctcagctaagtgctgttttgtctcagtgagttaaccactgaatgcgagggttggttgttgatctgtctcggtgtgtgtcggagtagacagcatatgcacttctccctgtgcgctttgcaaggtaatgtggctttggctgatccatgcaggcaggtagtggtacagtgctgctgaaaggaagaagttccccattttatctgttaaaacaccagagacatgggcaagtgctaatggacctcacttcaggaagagggtctgcttcctgaagccagtgtgtgatgaaaagtgactgagacctgatatctaaggtgagacctgatacctaacactctgtcacacagtccagggccaacagtgctataggaaagtctagaagaaaacatcacatcagtattttagaaccatcaaccatctcttgtccctatagcccaatccagaggcctggtttttagaactggctgtgtaaggtgccaaacactcagttcacttgtagaatcagagccttttttcccccctatgttaattgaacacgcgctctgagctgttttgttgaagtagaaaatctcatagaaaaatcactgtagatctactgacctatagccctctggaaatgcctttgagatggttttacttttctaggtcatagatgcctgatttataagatgaacaataaaatcagctttctttctttctcttctgatcttattccccagatctgattcaggccatgttccaaagcaaggctacattgaggtcctggtgtctttaagtaaaggacatctttcagatcctctcaaagaaggatttataacagtttccagatgaatgtactaatagctttgggtgccttatctctttcctaatctgtagtgcctgtgagctcagtctcactccttcccttagcccggagaccccttagatcgagtgggaatagtcaagaggctggctggagagtcatcagtacattggtttgcagaaatcttttacaggctacattttggaatttttttttttttagtaagtgatcaaatttggtgggaagtaattcgagtgtattcgattgtattgtcgtcctcgttatcattgtcaaacatgttatagacggcagttggcactggggctgctaatctctgggtgtagtctctgaaactgtagctccagtgaggtggtgtgaaaggttagcaaagccaccatctgctggtggctccagccaaggtgcctcttagccactgaattgctatgttatcctttctcttgtaacaaacccaccccagagataaagcctttaatcaacccaagaaactcctgggctaagtatctgacagtctcacatctcaacagtgtgaattaagtgtccatagcatcagctcaggaggacactctgggagagtgctgacaaaaaagggttattaatactgacctactacttcaagggcagttctgaggtgattagagctttttttaaaaaccaagtatttggggatcctcagcagaggtattcatacagactcccaaagaactatatatgttcctgagaccatcgtttagtctacattgctcttcccagagactgacagatatgaccagtcaaagtgcaagactacctacccactgccatgaaaaccattgcaggaaacctttcccttccctgaatgagattttttttttccctttttatgtggggtaattatttgtgacccaagtgtaatttggatgatttccattaatatcaactcttgaagcctacttgtactgattgagattgtatttgttcctaataaaagtggatctggttgtactgtctgggagcttttgtgtgtggtcactagcatacctatcacaaacacgcacacagctaaggatgggacctgacgattcccacatgctgggcaagcatctacagatgaggttcctccacagcctctttgtcttgaagctgtttatctgagacagacgctcacagcagagccttagctggcctggaagtctcagcaatgcacttacttttttgttgggattacag

SEQ ID NO: 26142 - DNA, 1149 bp, Mus musculus
cacccgactgctcttccaaaggtcctgagttcaaatcccagcaaccacatggtggttcacaaccatctgtaatgaggtctgatgccctcttctggtgtgtctgaagacagctacagtgtacttacatataaaaaaacaaacaaacaaacaaaacaaaaagggaacttctcatgtattagcatcactcggggtgggctgccaggtgctgagtggaagggtgaagtgccttctgtttagactctggaacgatagttcttaactcacgtcatgtgggtcgtgatccccttgggagtcaatgacccttccacaaggggtcacccaagatgactggaaaacacagatattcgtgatgatagcatgaagtagcaaagaaaataattttatggttggggtcaccacaacatgagctggtgtatattaaggggttgcagtactaggaatcactgccctagagaatgaccctcgacaccacctaggctggagcctgggccaaggccttaaactatctgtgattatttttaggaatcagagcctggcttctcaaaggcccagggctcctcttcccctcagcgacctcgtgtctctcagccgcttcctctggccatgcttccgtgctgacctcctatctgtgcaataaagtgcaatgacctgtttcccactccgtctcctctgcatcctaccttgctaatgcctctctttcaagaacagagaggtgtggcttcctgcactgtagaggaagacagaagaaaggtctggggagagataagaactccaaaactgaagagcttaaaagaaaatatgtgtttgggagtttagcctgcatgtatgtactatgtactatgtatgttacctggtgcctgcggaggccggacgaggacacctattagtgctaagaactgaacctgcgtcctttggaagacccagcctaaggaaataactttttaaagtgtcgtcccacgaatggatttgtgttataggcctttccttgcaacatctgtagccacactgcttggggtgtgtgtgtgtgtgtgtgtgtgtgtgtgtgtgtgtgtgtgtgtgtgtgtgtttgtgcgtgcccgcatgcttgtgcatgtctgtctgtgtctgtctgtctgtctccatctgtgcctgacagtgagctgcagggtt

SEQ ID NO: 26143 - DNA, 1057 bp, Mus musculus
ggaggcagctggtgggcagtgttagaatcagccacagcagtcatcaggggccaaaggaggtggaggtggatcaggtcctgaaaggagtctggttcatcatagactttgtagacaggcttccagggaacttgtgtgaaatacccatatgcgtggatcttgttcatgaaaccttgattcttaggtagtctgtattgtggtccagagggtgaagaatcgcgtctttgaagagcttgttgtggagcagagctcagacacggagaaagaattcagctctgtgactactgttcaacctcttgccatggagatgctagtaacagccttgagttcccgacgtgggcactaccagggactgctcacccatactgatgggagttttctcttggggaatgtaggttgtatctgcagcagacactcaatgacaccgtggggaggaagattgtcatggacttcttgggttttaactggaactggatcaataaacagcaggggaaacgcggctgggggcagctgacctctaacctgttgctcattggcatggaaggtaagaaatgcttccagaagcatggctttgtaccacgcaaacctgatttctaatcctgtctccactacttagtagccatatgactggaaactaggccctggactttttaatgcttcagcgtcctcatccgcaaaaggaacaagctagcatagtataagtagctacatagtataagtagctaccgcagttgaatgaggtaatgtataacgtaagtcatttggatagtggcgtgcagtcttgaggaagttctcttcctctctcagtggtgctgtgagcacgatgccaagatagggaggtctctctgaaacactgcctcgttccattgaagtacagggtgtagagggatctattcctgtacaaatggaaacttgttttaaaaagacaggttctcactaggtagctctggctggaactcagtatatagaatagaccagagtggccttgaattcacagagatccacctgagtgctgggataaaagaaaggcatgcaccattgtgcctggcagagactattc

SEQ ID NO: 26144 - DNA, 1513 bp, Mus musculus
tgtccctacaacatctgggctgtggtgccagaatgactctgcacatgagtctgccttctgccagtttttgcagcatagtcaggctacaaaccaggtggcaataactgctggggccctaatggggacattgagaaggaggcttatctttgggaggtagccttctagtggaagaggattagataagattccagttgagaactacatgcttaagccatacatagaaggaaaacttggggacctgaaaccaggattgtgcatatgtccaaatacaggcatttgcagccgttctcttcagtaccagctcctgtccctgtgctgcaatgagggattctagctctgacttttttgggctcgaggggtatgaacctctgcatgtgtgtgtacacatctgcacacttgtatgcatgtgtgatcacacttgccatccttcttgcttactaaggttctcaactgctaacattgtccagtgtggcagtacagcgtgaaccccagatactgcctgactcagcctagagcttttacactcggattttagccatcccgtcttggtcagatcttactgcagcctacctaaagctgactggctcaagcctcccagtcctgtgtctttccctgtctgaaccacatccctgctcctgctgagcttcctggctgagtagatgaaatggggtcagacttaggcagctaactcaatacctttcatccacctcagggcaaggggaaaaaaaatgtcctcttgcctcttagagccagcgcctctgccagacccaacaaagcgtcgcatgtgagctggagtagagctgggagagcttggagatagaatttacttttctgttggtagctgtttatgggagccctcctcggggctgcagcttatagctctgtgttacacaacacagagcgcaatcatttgtatctgttaagagggaatggggccccagcagcttggcagagtggtggccccgtgtccacttacctcaagtcccttccttctctgtcaaccttttttctctaaaattggagttggaagtctgattttattcttttctttgccaccttttagtccccttccctgtagatttgacctcccgtgttcaagctgtgggtcttagccctgaagctcagcttacagcgccccatggactgaacagatgcaggcgaatgcttgtgcacccgtgtgcgtttaggggcgggagctctagcccccactctgggctctgcagtgtggttgcgcagacttggtaccttcttgagtatggctctttaaatacagcccgtgctgggcagtgtgatcgcggcaaacgcatgcctccatctcttttgggaacgagggatgcagcagaagagggaggcagagtggtattagtttggccaccgtggcggattttcattctccgcagatctatggtcctggctctgccctcaaaggtgtctgggatgtgtggcagggagtctggatctgctcggttgacccttcagtataactctgctctcacaggtctgacctagggtg

SEQ ID NO: 26145 - DNA, 1899 bp, Mus musculus
aaaacttggtgcagaatttagcaagggctaccagcagtgaccctctgaccagtttttcctacatggccaggggtggggatggggatagctcagggttgtagaggccaggcctttccagttcctgtttctcttggtgtcctcttgacccatctttaagaggatccttgagctttctcctaactaggctctcagtggcctctttaccaaggctcttttcctcaaagacgctctctggctccaagtgctgggcagcctggctggaggatccctctccacagggtctgtccctgcccctgcttcacttctgacctcaggtagctctgttgctgtgtccctgctgagttgctatgtccgtctgctctgtccacttaccattcctcagtctttccatgctgggccgttgtcttaccatggccatccttcctaccttttcttcagccagctctgtttaattatagacccatagggtcctgactggagccccattgagcactttggggacgtttctggaggaacagaggctcagaaactggtgtcctcaaggcccatgggcctgtggttagcgaagcctcggagacaactggggaggaacttggagaggtgaaggacttggtgagagacttggagaaagaggccaggcttgggaaagcagggtggcaggagcgagctctgttttccatgagtgtgtccttgtgccttagggtccagcagttcaggtatgaggggcattttctgaatgcctcctaatttctctcaggtctttggctcagtgtcaccaagtttgacagaccccttcgttcctgagcttgctagaagggaagcagcacgttgagtggtgtggtgtggtgcgagagcggaggcctcccatgcagaaggctggggtggtggacaagagaaagggcccggtggtcagcttctcaccgatgactctccatgcctcaagagactgagtatagtagttggttcaagaagttactctaaaactgcctgccctcttcacctaaagtctgttctcatttcggggaggaatgcaagtccttaattttcaagggaagacagtctagtgtttaaaagcatgtgtctggggtctggtccctttggtacatttctagcttgctacttaccagctgggtttgaccttggttgattgattgaacccgagtctcggtttcctttcctataatgacttgtgggggtgggggtttgaaaatatctacctcagggttgctggatgaactgaaataatgtctgtaaagctttagcacagtgcctggcaagcacttaataaacggctgtggtggtggtggtttatagtatgtgacttatttaaaaaacttggcttcagtgatgtgtacgatttccagcgactcagcctctctaaacccatgcatgcctcttctgcccggtcagccaggctcctgctcactgccgcctggtgtcagagcccctcactgacacatggtgggagctcagtggcccctcatcccacccggggaagctactgcctcccacatacagagcacctacccctgctcatgcctgtctcccaactgtcactggcacctgtcgccactcccttctaaattcctctgaagagagtgacagctcaggccctgtggctcacttttatgacattcagcatgtttaaatgacaaatgtgttaagattgctcgagggcatagggaattccaattgaagaaaatgggtgggtgttgactaactgttaagtgcttctgtccaggcactgtgctagtcccttgcactgggtgctcttggctcagtagggaagttaaggatgccctggacaagcacttcactcagcttggatattcacagtagagtaggccttctatggaacgctacagcctgaactgataactggaagacatgtagctcctt

SEQ ID NO: 26146 - DNA, 1575 bp, Mus musculus
agttttattctgtgttgagtttactggtaagaatattgtcttgatgctacctctcaagggtattgttacaaatgccactatggttaaagagatagatacgaagagctatatttgactgaagcttgaaactctggcatctatctgcccaacggtggggctctcactctgtaatttaatccttgtagatacattgtttgtgtgtaattttataagtgttcatatttttctcattttgcattgtgtaaagtgtacaaaatctcaaagtataaaaatctgcttatattgcttgtaattacagtgtgtaaatattttctattgtgtacattgacggggacaagtgggttattcaggtttttaagtgatccttttatattgcagtttcaaccaataaccacccatcaaatttaaaaccactttgatacattcttatttagcaggtcctataagaataaaatctctattttcaattgtctttctccactagagaaaaatactttatctgtccctttaaaataaatggccagacatcagtttcggcctctgaatttatgactctggtagcagccttcagtctccgggtcagagtccagtcagtatttacatttgggttcttgtggaaatgttgtggttctattttagcacaagtagctcatggtttttaatcccaaatcaagtattttccatcttctgagtccctgtgcgttgtctccctctgtctgttgttgcccagaaagtgggatggtagcgagggaggaagtgctcgctgcacagagactgtcaggccatacttgggactgggcaaacgagcttgcactgagcggtggtgtgtttggcaatattactgtgccaaaaataatccttgtctcattttctggatgtgtgatgtcaaactttttacccttactgcaagctgaacattaaagtacttgtgtttatgcttttgtgtgtaactgtttgcctttcctgacctgcttttcttgttacctgaaagtacagttctgtaacacatgtcaagtgaaaaggttttccatgctcaagatcacctgtgtagctctgcagtcagtgttgtgcattgttttgtctctgtcctgatggcaacggtgcctttgtcacctttcagaaggttggcttttttttttttttaatgcaagtaatagcttgcttcgacttcacaaaaaaaaaaaaaaaaagaaaagtgaaatatatatatatatccccagtaatgatagataagttaccacccaggctctgttttttgtttgtttggctttttgttttgttttgttttcttcccctttccccccaatcagaacagacacagttggtggggacagtaatgtgtggagtcttgaaaccaggagtgtttttccatttacaaactgactcatcgccaagcggctgggttggagaactttcttggcttgtctctcaggaggcaagggtctgctacaggtggtgggggcgtgagtcagcacaatcccatctcgtggctatgcctactctatggtgcaggcgcacctcatctgtgcctcagtttccccggggcattcttgtcagccagttaatctactagct

SEQ ID NO: 26147 - DNA, 1160 bp, Mus musculus
cctccgcagccctggagtcagcctccctcctcctctcattcacatgtaaggctgccagggctccaggcatggcctttcccagatcaagtgcttacatttccacccacatgtacattctgaacttcccccttgctgcctccgtcagacctgtgtctactaggtttggtccatggatatttcaaaggaagatttcccttcccatttatcggtcctcactgaactaggacaagtggccaacactgcactcaatgagccagcttccctcttagggaccaagtgattgcttctcctaggccagagcaggaggaagtgatctgctatctcacctggcacatgaagcccactcctggaactatgcaaagggcagaggctgggcgtgtggatgcttggctcccatccctgtcctacctcaccagggcactttcaaggtccaagggcctcagatgtctccaggcccacatgggacaatcaaccctgactgagccccccattcctcttgggtgaggatgactgttatttttgtagctgagaacgtggaaccccacgagtttttactgtccttcacccatacctctcccacctccaccccacaatgaatgtatttattgtgagaatggctgtacttcttcaggaatgcccccactcatcacccaggtgggtggaacaggcatgtgatggaatggggagcctgggctctgctcctcctgacattggctaataaatgccctctttccccacagctttgagtgtctgcttggtctagactggctttaccagaaacagatttctggcttatggagaaggtgctccagagatttcttcatctaggggtagctttgggaatgagatctgcttctgcctttgctgagtcgggcaggtacagggaccatgagttaggggctcattttactccctgatgatgatgttaagggggacaaaatcagagcggctcaagaagtcacaaggattcccagcgtttgctcctggcccccctcctgtatctttgcagacagggaatctcactgttatttgagctgttgccagctcctagatctgtgcaactactgatgcacaataacagctccttgttgtgtgtgtgcacatatgcttgaccatgccagggtgcatatgtgcaggtcagaggacaaggccagagaacc

SEQ ID NO: 26148 - DNA, 1183 bp, Mus musculus
tttggatttcaagctcaggccgagtaggtgggtggagcctaccagccggggcgtggcctgagataaagaagaaccttttcctttgcccacttgtagctaggtgcagtgaccttgtgaataccctaattctgattcaattggcctccttgcaagctgagatgtgagaagtgtacaacacttgtacaaggaccgtgttttctgaaatacgaataataatgacttcaaaacacatgaaagagtctggaggctgtcttctgaaggacacgggatgccctgttgctcttgctggtatggcattgggcaaggcaccttatatccgtgtttgtgtgcagtttaggaagttgaagatgagcctggcgttggtagtgcataacctttaatcccagcatttggttggcagaggcagatgaatctctgcgtttaaggccagcttggtctacagagtgagttccaggacaacccagtctcaaaaactaaaaatgaaataaaaaagaaaaagaaaactgaagtcattaagactatatttgaaggggctggtgagatggctcagcaggtaagagcacccgactgctcttccaaaggtccttagttcaagtcccggcaaccacatggtggctcacaaccatctgtaagaagatctgattccctcttctggtgtgtctgaagacagctgcagtgtacttacatataataaataaatctttaaaaaaaaaagcagtgtttaaaaaaaaaagactatatttgaagattgattatctatcatgtgtataaatacatgcctgcatgtatttctgtgcacggtgcgcatgcagtgtccatggaggccagaagacagtgtagggtcccctggaactggagttacaggcagttgtgagccaccatgttggtgctgggaattgcacttgtgtcttttaaaagaacagtcagtcttttatccacctgagccatctctctagcctctcaaagtcacaattcaaaaatttgtactttttctcaagatgtagatctcactatgtagctctggttgtccaggatcactatgtagaccaggctggcttcaaactcacagagacctgtctgcctctgcttcccaagtgctgggactaacggtgtgcgccactgtgctcggctcacggtgtaggcgtagtttcagcataagccagtcttttaactccaaactaga

SEQ ID NO: 26149 - DNA, 1191 bp, Mus musculus
ggggccaaagagggtgtcctacttagggaaggcccagaagctgaggttagggaggaggtcttgaggatctggaaccgagccatacctctttgggagcttccagaccctgaggaagcccagctagctcgtgtgatgtttggccttaccaaggtgacagatgacacactcaggcgattcagtgtccgctatcttcgatctgctcgaagtctggtcttcccttggttcacccctgggagctcaggattacgtggcctgaagctactaggggctgagggtcaggaaaatggagtacagtatgtagagaccaccatcccccggcctggtgtctatcacaacctatttggattaccactgatcagccggagagatactgaggtggttgtgacaagtcgtgaactggacagcctggccttgagccagtcgacggggctgccaaccctttccctaccccgagggacagtctgcttacccccagccttactgccttaccttgaacagttccgtcggattgtgttctggttaggagatgaccttcgatcctgggaagctgccaaactgtttgctcgaaaactcaaccccaagcgatgctctctggtgaggcctgggaaccaacagcctcgtcccctggaggccttaaaccaaggcttaagtcttccccgtattcttcgtaccgccctacctgcctggcacaagtctattgtgtcttttcggcagctccgagaggaggttttaggagaactgtcaaatgtagagcaagcggctggtgtccgttggagccgcttcccagacctgaatcgtctgctgaagggacatcggaagggcgagttgacggtctttacaggtgactctataagatcactgcttcggagctggagagacggctcagtgattaagagtactggctgcttttgcagaggacttggagttatatttccatcacccatatagtggctcacaactgtctgcagctccagttctggggggatttgatgccttctaaggacaccaagcgtacctgtaatccatagacacacatgcagctaaaacacccatatccataaagtagtattataaaaatatcagtgacttaggtaaaggattagacaagatggtgacaaagtatgtggggtttggccattggcagtgtctatgtgcatgaatgcttcgcttatgtgtgtatatcacttggaa

SEQ ID NO: 26150 - DNA, 1483 bp, Mus musculus
gcaaagcccgactcaagaagatcaaggacgacaatggactagtggccaaaaaatcctcttctggcaaaaaaggggctgcgcaccagaaccctgagatttgcttaggccaggaccccagccccgcccagccagatacctccaagtcctcagggtgaaagcagtgcactgctgctcgctgaaatgagcctggtggagcaggccttctgctggggctcttccatatagtcctgagctacagaacccttcccagcccagggctggactccatggtgaaaatttttaattgagcagctactggggaatctcctgtatgctggtttgtgtttgttttttccccataggttttctgtatagcactggaaagacaaaggctgtttccaaagaaccagcgttttggtgaaaggaacgaagcaaagggaaggatgctagactcagctcgttttgggtttttgttttttgtttttccagatagggtttcttctctgtatagccctggctgtcttggaactcactttgtagaccaggctggcctcgaactcagaaatccgcctgcctcgtcagcttgttttgattagtcagtctgaaaaggtgtctgaacagagtgcatgggagaactagacatgggcctgtgaacctctgcagaaagggatccagatggaaacacgccagaccctcaggtgggaatgagcaaggcagatgaagaggccaggcccctgaagctgccgtgaaacaggaggtttgctgaagctccagagccgaaggctgatgcggtaggcaccgagcctctctgctctgctttgtagagccaggcagaagaattgatctgaggtgctgatcctgtactcttagggcttcaaagatggaagctgcttcccactggaccatggaaagaagctgtaagcctgcagtgcctgccccgtgggtgccgatttcactgctgcctctgacagctggagctaggactcttttgtagagccttttccagtttgaatgaaacatttctattgcctttgtttctgtgcgttttttcttacttgtccaccaggtgtctccccacactaattggatttcttctctgacttgggagtaaatgggtccttttccccacttcaacctctgagccggaagctcccaaatagcagggagcagtacagggccttcacatctcaccccctagagatacaccgtccttggaataggggaaacagggtgctgtgttgaggaccccataaaattcctgacaggtgtgggtcacatacccaggccttgcctgaccagctgtcgctcttcacctgtgaggtgaaccattcacatatctcagtgtagactcaagagtcagccctagctgggcgtggtggtgaatgcttttaattccaacacctgggaggtagagggcagaagatcaggagttccaagtatcctaagtctaggccagactgggctactcaaaactttacctcaaaaatagctcattatctctttc

SEQ ID NO: 26151 - DNA, 1149 bp, Mus musculus
aagattcttcaccggggagtggagggaagccagctcctgggtctgagacactgagcccggagtatatttacctagcctgtgttgttctattgcagctccatacatgtgaccaggctggagccggagctgagagctcagatccaagcacaaaaccccagcatcgatgtggtttactacaacaaggggctttgaggggagtcggcctctgtccctgtccttacctccttaggctgcttctctgatgccaccttgcaatgctaccacctgtttatcttctgggtactgggcaagggggcttgatgtggggagcagccactgagaccagcaaccttagactgggggaggcactcctataagcctctccgctcctctctggtttcaaagagcaagtcacaaaacccatccctcctgtgtttgtgtgtgtgcactgccacatatgcagcacatgtgtttatacatttcatcctggaagctaagagcagaaatgctgttctaggatgtcctgctatttgtcttctcttctcagtctcctgcccacctaacagcaagcctggttatgggtgagacttccttccctaaactgttcctctagctaagtcatttctgatagcatcttagccttctgtgcccaagataagccccaggatcccagaacagggactgaagaacatcgtaggccacccagagcttaacccttcaggtttcaaatacagctatttgaaccagctctaaaagctggttcaggacgtgggctggtagaggaagcagtgtggaatcagggaggcagggggctcatgcttgctggaccccacaccctagaatggctccactcctctcttctggtggaccatgggggtgtcagtagcctgcactgctctccacactgcattgtgggtgcttttagagaccatcttgagcattcttcgtctgttctgatgagtcatgtcatgattcagaaatcccacacttccaattcctcccccaatcagaaagccacacaacacaggcagagcaagcattcccttcaggaactgccaccacccgtacccacttgtaggggctggtgtgggaccggtgcttaaacacaggcctcaagcgtacagtatcaagacaggtaattctgtgtttcattgactcttcttagacaca

SEQ ID NO: 26152 - DNA, 1104 bp, Mus musculus
tcaagtccttggagatctacctgttttccctgcccattaagaagtctaagatcgccactcaggtggatttctgagtttgaggccagcctggtctaccaagtgagttccaggacagccagggctatagagagaaaccctgtctcaaaacaaacaaacaaacaaaaaaaagtctaagatcattgacttcttcctgggtgcgtcactaaaggatgaggttctgaaaatcatgccagtgcagaagcagactcgggctggccagcggaccaggttcaaggctttcgttgttattagggactacaatggtcacgtttgtcttggtgttaaggactccaaggaggttgccactgtcatccgagaggccatcatcttggccaagctttccatcgtccctgtgcagagaggctgctgggggaacaagtctggcaagccccacactgttccatgcaaggtgacaaggctgatgtggctctgtgctggtgcatctcatctctgactcccagaggcactggcgttgtctctgctcctgtgaccaagaagctcctgatgatggctggtatagatgactgctacacttcagccagaggctgcattgacaccctgggcaactttgccaaggccacctttgatgccatctccaagacttacagctacctgacccctgacctctggaaatagactgtcttcaccaagtctccttatcaggaattcacggatcatcttgtgaaaacccacaccagagtctctgttcagaggacccaggctccagctgtggctactacataagggttttgtacaaggaaaataaaagaattaagtctgctaaaaacaaaacaagtggctgatcttccagagcacccaggatttgattcccagcaaacacaaggcagataactaaccatctgcaactcttgtttcagggaatccaacacccactcctggcctctggagatactgtgtacacccatacacagaaaaaggtgggatttttaaaatctaatttaatgtttttaattaaaacgttcttaaattaaaagtaaacaagcagaatatcttttttttaaagatttatttatttttattatatgtaagtacactgtagctgtc

SEQ ID NO: 26153 - DNA, 1186 bp, Mus musculus
gagaaggaaggctcatcttgaccaacttgcccctgaaaagcacaaaactggagcctttaacttagagtctgtgtaggaagaaaagctaatgtttaggacagtgaaagtcaagtccgcattgctaagtctgtgtgaaacatcttggcccagagtgcagtgactgggacagatactactgctgttcttcatgagattcctagcttatatgtgtcttttttattgaatgtcagtgttaaaataataacccaaaaatttgggccaaattataaggtgacagtgactacctatgtcctcctctctgggcactatacaagaagcacccactaaacctgcctttcctgtctgtacacatgaaccatggtgtttcctcatggttcctgtgtaccctgcctggggcatgcagaacaagagcacttgccatgaaagcaggaggtgagccaagcatgatggtgcacacccttagtcccagcactggaaggcaggggcaggcggatctctgtgaattcaaggacatcctggtctacagagtgagttccaggacagccaggactacacagaaacccccgtctccaaaagaaaaagaaagcaggggtgacatgcattgattgattgattgattgattgattatcccattggtggtcaagaataggccgtgcgttgtactaagtaccatctgattcctgggtgtccttttcagagtgtgggatgtaaatgcaggtgagatgctaaacacattgattcaccactgtgaagccgttctgcacctgcgcttcaataatggcatgatggtgacctgttccaaagaccgttccatcgctgtgtgggatatggcttccccaactgacatcaccctcaggagggtgctggtgggacaccgagctgcggtcaatgttgtagactttgatgacaagtacatcgtttctgcctctggagatagaaccataaaggtaacaggtcacttttcagtaagttcacaagctgcagtaggagtttgtgtaaaagcgtgattgagggcaactgtatacacaagccttgttgtaggatactgtaataattaaattcaatttttatttctataaacaatggttatgggctggaggtgtagcttaatgacggcacttacctggtgtgcccaagagccagattggaaagataacagtgccactgatgatggcagtgatggca

SEQ ID NO: 26154 - DNA, 1181 bp, Mus musculus
taccttctactgcctacagacagacggcaaccacctgctggccacaggctcctcctactacggtctcgtgcggctgtgggaccgacgccagcgggcttgcctgcatgtaagtgttctgcccagtgtatgcctctgggatggcaagattcattgtgggttgcatctgagagcgggtgacgagcccaaggtgtacctaaagccggctgtcgtcattaagtttcactggtctaaactcctccctagcaagagcaccccatctcccacttgagaggttctcatcactcctgtgtctcccttgcaggccttctcattgacgtcgaccccactcagcagccctgtgtactgcctgcggttcaccactaggcatctctatgctgcgctgtcttacaacctccacgtcttagactttcagaacccatgacagagcagccctgcttagggggctgggcaagtcagctactcagggacctctcctgcctggcaggtgaggggatacctcactcttcttcccagccctgctgagtgagctcctaggtctctggccaccatgccctggcacctgaagcactgagtcctggacgctgggctgactctgacgtgggccctcctgtgctcttaggagaatgtacctgaacttaggtgtttacagtagggtcaggccttctcctgagcccttcccagcactactgcagcctacagagtgaaatgagggctctcaccatcccggacagaaagagatgcagttgctagaacttgtgctggtcccagccacctcctcagtcagatggtaactctggccaacatcttggagctgggctcgtgcctgaggtaccagtctgctttgctttgaaacgaaggaaggacaaagaaagcctgtcagcttggggttccggactagctgttcctcagtcctgctatgggaaacatgctaccattgtaatttttataaaaataaaatttaattgttgacaaatctggttctttggtggttaggtcattctaagtggctccaggaaggcagtgtacagggaaaggacaaaactatggctctgtgtccccaagaacctcctcagggggtagacaaggaactgtcggaggactctaggctgttgagctatggtgacctttcgcctctgtcctaccatacacacacctttgacagtactgtaaccatgttcttt

SEQ ID NO: 26155 - DNA, 1176 bp, Mus musculus
tatccagaggttttacaagatggttatctaggagcgccagtacttgaaaactaaaagaaatggtttgtgattatgtcactgtctcaggaggcagtgcgttggtctcatgccatattattactgtgtgtgctcacaatgtgcgtgtgggcaggtgcatgcgtgacacgtgggtagaggtcagaggacagcctttggcagtcagttctccctttctaccaaggcctttgtggccagtgtgtcttacccagggagctgtctcagtggctctagcactttcttgtcctgcttttcactagactgttttgacatcactatagacacttctaatggtttaaaggatagacgtctgcttggatttcttgattagccacgtatggaggtaggagtggttagttcctgatctcacaatccctttagtgtatatttgattccattctgcatgtttccgagtcctgacccagtaagcccctcgactcctcctttattgctaatgagctgcagtgacgagttcttccttctctttgcacatagcatggcaggcattccagtaaaggagcgcgtgaaactgtctcagaactggcggctggggcgctgccgagatcggattctgctgaagtggagatataggtaagcagcttcttgattgtttaaaaatgtttatttgtttttatttcatgtgtatctttgctgttgttttaagatggagtctcactatgtagctctggctatccccaatttactctgtagaccaggctgttcttcaactaacagatccacctacttctgcctcccaagttctgggattaaaagtgtgcaccactaagcctggcttgaaaatagtttgttcctgtatatgtctcttcacagtgtgtacttgaggaagttccagagggcatgagatcccctggaactggagttacagacaattgtgagccaccatgtgggtcctgggacttgaacccagatcctttgaaagaatagcacgtgctgctaacctctaagccgtcatttagccttattttgtgattcttttaaggcttcccaagaccaaagagcatagtagaaaacatgaaattagatcattggggctgtctctggcgtggtaactattagcgagcctttagacacccatagagagtccagcaggatggtgtgctcacacagttcaacaaagat

SEQ ID NO: 26156 - DNA, 1628 bp, Mus musculus
gaattatgtaaatcagtgaatggtagatttcctttacatctgtccttttcttcctaatagtttttatttttgaagtgcctcccacatagggttaggccatgactatttagggtatgagcacctaacttcttatgactcagatatgttgggaagtgcagtaactcctgggaattaaccttaatagcagatccgcatgtgaaatgttctgacattgttaagtaagggtaaggggactgaccagtggtctcctttgtccttgaacagttgtcatttaatcgcaaagacctgttaactactggtttaatcgaatcagtccttaattcttgcatgtttgtatctaatttttaaaagaaagaataagtatatgttaacaatatgtatactttttcttttaatcagagattctgaaaacttcatgttattttaatttagatttggtgaatttaagggttttgagcatgaagctggcacatagtgtctgcaggattattattctttaatcatggctagctatctagtaacgtcatagattttcaacagtcttttgttaccttgctttcctccagttctacatagcttttgaactttgagctgaggggggagagagaagagggagcttgaaacattttcctttctagaactccagtgtgagcttgtgaggtagtcttttagcactatatagagtggacccagggaggcccaagaaccagaggcccaagagtgtgctgaaatgtgccgcctccttagggtgcgaacctttgcgataggatgtgctgtgaaacctaagtcaaggttggttttgaaggctggggtgaggggcaaaattgttactagatattaagaccgtttaatgttccttagcgttctgaatccatctcatgcctcagtgagaattacaaggttttattcagagcgtttcagagtttcatacggaatcaggaattgaacaagttgctttttgtttaatgttggctttcaataatcacatgggatgatcttctggacataagtgaaaacatgtccaggtctctactgtcattgctgtaggataaagtgctctgccatcttccatggttatgaatatttattaatgttggaataacatttcattgtttagatcacagctcagttcctatagaaaacgaactgtaaacctatctgcagaccatgcaagaggcacaataaaacttgaagtgaatgtgtgctgtgctgctttttctctgggttctccctttttttccctcacatctcttgatcccttaggtatccgaagctatttcagtgtaggctggattgaagacagccctgccctcctgccttccacagcaaagatttttctcagaaaagtacatttgtttttgtttttaagtaagttgctctgtttactacaggtaaaatttgtgtgaagttggggggggtgtcacagagttcctcactggaacatggcttcatttccttagataaaggaattttggtggtggagggggggggtgggtcgcctaaagaggaggctgtactatgaacagtagttgatctccacatctgagtttaggtcttggctgtcaagcctccagcatgatcaggaagcggggggggggggggggggggggggggtgtgagtaaaaatg

SEQ ID NO: 26157 - DNA, 1223 bp, Mus musculus
ctgttctgtaccctcctcaaaatgtaaaatgtgacttcagacaggtttaagtcagttccttcatgggctgtgataataaaatgtctctttgcttcagtttacaattagaaaatttcatgatacgtaagcagttgttttgacttactgctgtgtgtaaggaatatagaaacttctgtggataacctaactattccttccaataatgaaagtgtagaactaattggtggtagtggtttccattaacagaaggaaggagtagaagtattgaaatgccattataaattttgaaataattattatcacagccttgccttgaaaccctggtttagaacttttagagagctatttccagtatgtgttagtttgttggacatttgagaccccaggaaatcccctttctcgtaacgttctccgcttggatctgatctcaacagggtgtcgtagtcactcttcagcacagttcttaattggagaccaggagccctgggcctttagaggtggtctagcaggagagttccaggtatcaatatgaattcacaactgaattgacatttttctttgttttatgagaaaccttatgttgcgcatctgatggctggaaggattggtctgccgaaggctttctagtcccaaattcaatttagttacatagctggattttaaatcaaattttcctcctctttcacagtaatttctgaaggagatgctgtcaatcccccgcgcctgcgaagcgcagcggctctaggtctacacttcacattgtttctttgcaggtcgcacagcatttaaatctgcgcccgcaatgcacaatgcgcgcatgcttgtccgccgtaggaaactccatgagcaaaaaataaaaaataaaaaaaattaaaaggctgattatgcaagtgattgacaaagggtctaaagggtagttccttggtaacttaataaaaagaatatgcttaaaacaacaacttgtcagctagtgacagcctgaacaaggtagatccgttcttgctgctggaatttgttcatggatttttcaggtgctctacttttctccccccaacaggtgctctgctgcgcacagcaaactgaagcgcattgctttggggataaagcgtctcctggacagataaccctcttcagaccaaacctctcctcctgacattctgttctgccatcttatagaaagatggttcatttaagattggtttttaaaacatatttatgtcata

SEQ ID NO: 26158 - DNA, 2060 bp, Mus musculus
gccttccacacactcagccaggaagccctcctgaaggagttctccaccatctcctgaggctgcactgcctgagagccactgactgccttacccatgaggctcctgggctggagggcgagcacaaggagtggggactgacttcaaggttggagagaagcgcagaccccgaggctcgtggtgaaggccgtacttcagtgagcttggacaagcaggggcaagcccaggatgctcttatttggggagaaatgggagggtaacgggagaggcaaccaagagtggcatttccaggctgcattccctgggtactgccccatgatgccaattgagattccacgtgctggcttctgactatacaggtgctggttggacaggcccaggctgctgccagcactctggaggccaatggctggtcatgactgatgatggctggtcatggcggatgccacatcctgtttccttttgaacctgagcaaggcccctgcccccactgcagtttgcccagtccttagcacctcagctctggcacagagtaggtcaaggatgggcgccttttttctgtctttaaattcaaagttgacacctctgagaaactggagattggatctgcctggtgctctgctgtccgaccgctcctttctggattttagttttggcaccaggagcacctgttcgctttcccttgccttcccacgttgactcgtcagcacaataggcccacaactttagccttgcctttttagtctgttttaaactgtcttaaaggagcgcgtgtgaaataaacattgacaggctttctggagccctcaaggtgcctactttgctggtcccctttccagcagctccccctccccacccacccctgcagtgggagcctagatgagctcctccacgtgttccaccccctcaccctgctgttgtttacattcagcctgcctaagaatttcctctggggaggaatctgttcctgctgtggtctggtgctggcagagaacctgctgggggtggggtgctgttcatagagacaggctaggtgagcaccacgcccccagcctccatcttgtctagccatattctagctgggccttgggcacatccaacctccgtgaagttggcctgtggattctatcattggatggtctccatggaaccactgtagggttttcccttccccacagctccccctgaaatagctgctgctctaagtccctccgatgtaaagcttcgtaaagtcccaggttggcaggggcaaaccgcacagtgaggacctgaggaggctgagagtaggcctggggcgtcctgggctcctgtgcattcagcatccgtctctctggaatccttgccctccctggaagccagccctgactgagcagaggtgtgatcgttctcgagaacctgttggcacactgacatgcatagatgtagaatcttaagccattgtagggtgggtcatctctaatcacgggtccccggatggataacttgacctgaggctttagtgtttcccatggtgataaaccccagagcagctggagctggagctggtggcaaatcaaagctattaaaagttgatttgtgtgtctttagtgtctcgttagtgtcttttcccctcgtcatctctttgatgcaggtattggtcctgtgtcataaaaggacctcttggccttgatagaggccagctgagttcagagaactgtggtttcccttgcctttgggtgaaagaagggagtaatgttatgagcaggtccctccggttccgtctaggacaagcagccctaagcaaagctctccttttttcctgactagaagcccacccttgccgggttccttcctgtacacctaagacgtttagcctggagtctacaaatcagcttggctggtgcctctgacagctctgtggaggtttctgggagcgttccttccagagacaggcctccttaaggcagctgcctgtcccagcctcatacaggaacacccgccacagttcactgactcaagtatttggaaagtaaatctgactgaaaagactcaatgtgttgaggtactttagctgagacctttgg

SEQ ID NO: 26159 - DNA, 1186 bp, Mus musculus
tttgatctattcacctgagaggtggaatgtagagaaaatagaatatggaagatgaagatcaggctagaggtgtgttaaaaagtattacaacatggcttagatttgaaacttagtttctccctgactcccccaactgctacagttgctgactgcatagctgccaccatgccttccttctctctctaaaaatagatttatttattttatgtatgtgagtacactgtagctgtatagatgattgtgagccttcatatggttgttggaaattaaattttaggacctctgctcgccccacttgaccctgcttgctctggtgggtcctgcttgttcagtccctgctccctccagcctaaagatttatttattattttacataagtacactgtagctgacttcagatgcaccagaagagggaatcagatctcattacaggtggttgtgagccaccatgtggttactgggatttgaactcaggaccttcggaagagcagtcagtgctcttacccactgaaccatctcaccagcccccttctctttttatttattttttactcaaaaatttttttttatcttatttgtgtgggtgttttgcttacatgtatgtctctgtaccacttaagtgcctgatgcctgaggaagccagaaaaagcctatcagacagatccccaggaactggaattatagacagttgtgagccgtcatgtgggtgctcgtaattaaacccaggtcctctggaagagcagccagttttcttaattgctgagtcatctttccaggacctgtcctcttacaaatgtctgagcaggtacatatggtagtcagaagatagccttaggtgttgctccgaacacactgtccatttctttttgaggcaggatctctggttggtctggagctggccagagaatcctaggaattccacatggatggctttatgtggcttctggggttggacttgggcttgcctttaccaactgaagcatctctccagcccctcctcttcttctttcttaattatttttattattatagaaaagtaccagtgcacatttttgctgttaacaatgccacgtgcacagcatggataaatgacagtagcaacattcgtctttttaaggtgttttgccacataccttcattgataactcagaagcacctccctgttctgcttgcgcttccctccccc

SEQ ID NO: 26160 - DNA, 1203 bp, Mus musculus
gacacacctttaatcctagctcttgggaggcagaggcaggtagaaatctgtgtgtttgaggccagcctggtctatatactgtgtgccaggacagccaggtgtttatagagagttcttgtcttaaatatcccaaacaatcaaacacaacccaagaaacagtataagcttggtttgtcctcgttgggtagtcttagaattctgaaagagctgaaagtgactaccccactggttaacacctgtcctgcaagctctcttgggttgctcgagacgctcaggggagagacattacttgattatatatatggtggcagctgtagctcaatggcagagtgcttggttgccagcaccttataaaagtcagcatggtggcacatggtgatggatgtggaggcaggaggatcatcttcagctatatagtgagtttgagaccaacctgggctttatgataccctgtctgaaacgattaaaaatatatacattactacttgatgttattcttcaaatgttgagctcattttgtgtaatagtataacaaatatccaactttggcataggcaggatggttcagtgaggaaagtgcttgctctacaagcctgagaacccgaactagatccctagctatcgacataaaggtagaaagagagacatgccctcaccttcatatgcatgttagaacacacgagctcagcaacaacactagtaatgttttatttgtgaagatttatttttattttatgtatgagtacactgtcgctgtcttcagacgcaccagagagggcatcagatcccattacagatggtcgtgagccaccatgtggttgctgggaattgaactcaggacctctggaagagcagtcagtcttcttaaccgctgagccatctctgcagccctggcccctacatttttatgtggtattcgtacatttgcattctaaggcagtacacacagcagagacgtacagcacggaggtgtcattgatatccagatctatgacagcaaattggatctgtttagaattgaaagccaaattccaaaatatcttaatgagaagaagcgtagtgaggattgcctacccatctgtttattcaggtcactgcataagccaatggaaacacagtacttcttctttaaggatgaagcttgcctagttaccatggatatccaaagccatatatgtgtggttgtgagtgtgagtgtgtgta

SEQ ID NO: 26161 - DNA, 1197 bp, Mus musculus
aatatgcactggagacctgtgggattttaagtctcagttgaaaaagaattgagagttccttgaagatgtaaagattctagaactgcttttctataggaccaaaaaataagtttaagtttgttctacaatagtattctaaatttatacagttaagtttgaaagtagcatattactattattttgaaatcatatttatttttggcttcttaacttctgttttctgcctatagtctctttcctaggacttgtgaagacagtcaagtgcagtgtgatttatgaggcagtgaagggcaagtgccctgcagtggtgaggacctgatcgatggagcacatgagtctgtagtggacttcctgccctaatggtcctcagcgcgatcaatatttgaaatttaatttcaccatcgttctgtgggcactgcgagctctgcagcctgccttctttcctcctctgatgtgtgtgtggccagacttctacaacgctttcctgtttgcttttagatcagccctaagcttcagccactggcactttctatggatttaaaatgtattgtgttatggggcaattaatattttaagtcttgatattacatgatctggggagggggctaatgaataagatctatagccattatttatcatttcttcttcataaaaaattcccattgaatgatatttcaatagattctgtagtatcctaaagtgtctggccctggccctgcctgtctgcctgttcaccctccctccctctctcccttctctccttccatttttttttttcttttaagatttattaagccaggtgtggtggcgcacgcctttaatcccagcactctggaggcagaaggcagaggcaggcagatttctgagttcgaggccagcctggtctacagagtgagttccaggacagccagggctacacagagaaaccctgtcttgaaaaacaaaaaacaaacaaacaaaaaagatttattaatttattttatgtatttgagtactttaggcagatgcacacctgcatgccagaagagggcatcagaccacattatagatggttgtgagccacttcgtggttgctgagaattgaactcacagccatctatctctccagctctttaagacagtgttcccatagctcagactggccttgaactctgtacagctaaggatgatcctgaacctttgatcatcttgtctttc

SEQ ID NO: 26162 - DNA, 2211 bp, Mus musculus
aggtgatcctcagagtagctccctcctctagtttaccactgtctggtaagcaggccagagactccagaagaccagctcttttctatacagtctagcaggcttccaggggacctcccaaggagctcaggggagctgtgccattctctctgctaggttgttcctcaaagtcattcaagctgtactcgccgaaggagcccccgaacggcaacgccttccctcccttccaccccggcaccatgctggatcgggatgtggggtgagttctttccttcttcctggtcctcattagacgggaaactgcctggaaagggccttctgcagtaatttctcttccactgtgactctcatcatctcttcccttacacagcccaactcccatgtacccacctacatacctggagcctgggatcgggtaagtggatcgcagccagccaggaagcttttcctctgcatgcgtctgagcagagaggggtggaacagcacggctcagccactgacctcagttccttccctccccaggaggcacacaccatatggtaaccaaaccgactatagaatatttgagcttaacaaacggctacagaactggacagaggtatggcagaggaagggagcggggtccagaggagcacccctgtgagatatcttatcacacccatactcatctctgggtttcttcaggagtgtgacaatctctggtgggatgctttcacaactgagttctttgaagatgacgccatgctgaccatcactttctgcttggaggatggaccaaagagatatagtaagtgccctctgtgggagacagtgttacgccttctttgtagttcgtgagtctggaagtgtgaagggtacgtcttggtcctttttctcttccactgtgagacttatctctgtcctgaaaaaatttctcccatctctatagccattggccggaccctgataccacgctacttccgaagcatttttgaggggggtgccacagagctgtactacgtgctcaagcaccccaaggaggcattccacagcaacttcgtgtccctcgactgtgaccagggcagcatggtgacccagcacggcaaacccatgtttacccaggtcagcaaaccagcaggatagggagccccaacatgggctccagcggtttccccaaggaggcgtggcatagtggaagcagccaaatgagaagggagggcctgtagagcaactagcagatacccgtttagtttattcatgtcagttttctgggccccgaggtatatggtgaaccagagcccgccctcatagagcgtgtagtagatggggttttctctgcctacttgggaacaggacgaggttctgttaagctttcctatggtgtgtaagtatatgtgagtgtgtaaaggccaggtgtgacaggtgtatgggatgggggcatgctgcgacagttatgcatccagatactcgcacaggtagcagaagtgtatgcagggggagagcctgttactcgtgtgtgtgtttgtgtgtgtgtgtgtgtgtgtgtgtgagtgagagaaagagggcagggatatgatacgacaaacctatccccaggtgtgtgtggaaggccggttgtacctggagttcatgtttgacgacatgatgcggataaagacgtggcacttcagcatccggcaacacagagagctcatccccagaagtatcctggccatgcacgtgagttgtgggcaggacctgagatgggggaggctggcttgagggactgtgctgtgcttagagagatgggtttgatgatagcctttttgctcagatgacctgataccactgcccttcctcctcctctaggcccaggacccccagatgctggatcagctgtccaaaaacattacccggtgtgggctgtccaattccactctcaactacctccgagtaagtctctgatgatcctggtgttgtcccagcctctcttatctgagctccaggtctcttccccttagagtctaatcctccttctggtctacccccagctctgtgtgatactagagcccatgcaggaacttatgtcccgccacaagacctacagcctcagcccccgagactgcctcaagacctgcctcttccagaagtggcagcgaatggtagcgcctcccggtgagtcccttgccccagccctccacagactcttgatggaacgcctgaggctgtagcttttatctcctgacatgaatttcc

SEQ ID NO: 26163 - DNA, 1204 bp, Mus musculus
taattgggcccttgggtctgctatctcagtcttcgtgggagggggagtgtagcagttccaggtaggccgtgaagttaagagtggtttgcagattcgagttgggggagcaatgcttgacaccccccccccagtgaaaacttgaggactcaaattcaaatcacaaccctctctaacaggtatcagagcttgccagggaacacctgtgtctgagagtgccttgagatttttcttgtacggtcggggtataaggccacaagtgctaggagggaacagttgagccatgtgatgggagaggttagtctaaagagaatcccagaatatagtcggtccccttccttataactctgtgtcctcaaactggccttccttccaggatggaggcagctttctctagaaagtcagtggtcagtgtcctgggtctagcctggctggatctcttgcccctctgtatgtcctgtattctgagaagcctaaacttcagaactaggagcccccccccccccgccgtatccccgcaccccaacattcatacaaatacacaatccccccagggaagctgctagtgcagaatcttctttggaaatcacgtgactctggccaagttggactgggttgggcccacacttcaagtggctgctgtggctgacattttaggggcatagggcccaggaggaggaaagcctgaggatcctggactatccgggtgtgggaatccctggctcctgctgcagagggtggagaagaggaggagagaagagcttgccaagctggaatcctgcctagcttcatagccttcccaccaatttgacttgtgtgtttgtgtatgtgttttcgcttttacaatttggccaatgctagacaaggtagttcatgctcttagcccaccggtgggtcatttccctacaacgtgatgtatgaagacccaaagtaaggcagggctttaaacaagctagtgggctgaaacttatttatttttttcccctcgaagacagggcttctctgtgtaacaatcctggttatcctggaacttgctctgtagaccaggaactgcagggctcgaactcagagatccacctgcctctgcctcctgagtgctgggactcaaggcatgcgccaaccaccacctggccgaaacttaaatttttattcgtagaggttttatatggagaagttgccaggctgggggaagatgggagattggtcc

SEQ ID NO: 26164 - DNA, 1144 bp, Mus musculus
ctggagaccctcgagaccaagacctcgatggggtcagtcccctcctcctcagcagcgcagtgatggggaagaggaggaggaggtcgccggtttcagtggtcagatgcttgctggcaaactcgacaactctgtgaacaatgtcctggacttccccatgcacctggcatgccctgaggaagaaggcacagccgagggagcagatgcgccagcgtcagcccctggtgacgagagcatctcctccttgagtgagctggttcgggccatgcatccctactgcttgcccaacctcacccacttggcatcccttgagggtgaacttgagggacaggctgatgctgacgctgacgagttgacgctgcctgagggctgtgttgtactggagattgttggccaggcagccacaactggtgatgacctcgagatcccagtcgtggtgcggcagattccttctggatcccagtctgtgctcctggatgagtctctaggaagcagtcctgccttgcagttactcatgcccaccatggagtccgagaccgaagctgctgtgcctgaagttgctccttgccccgatgaagaattaccactgagctccgcctgcttattggagcccagggaaatcatggagtcattgacacccaaggaacctcagagcctacctgccagtgcaagtcagggttctcagaaagttcccagaaagggtaggaagaagaagaacaaggaacagccaacagcctgtgtggaagcctgtaccaggcggctgaggtcatcttctcgaggacagtctactgtgtctgcagaggtgaactctcaggcaggcagttcacagaaacagccccaggaagagcttcagagagaggctgctgcccttcagagcagagggaagccacgggcttgggctcgggcctgggcagctgccttagagaagacagggtccgagaatttagagagaagtgcgggacaggatagtcctgctgaagaagacgcactggatctctgtcctaagctgcttgagaccagccaagccaaccccactctctcattaaatgactctgctcaagctgactccatgcctgttgactctgttgaaggtgattcccctgcagttggcaatgctgcacctggtgatcaggcttcatctggtaca

SEQ ID NO: 26165 - DNA, 1239 bp, Mus musculus
tggctcacaaccatccgtaacgatataataaataaataaattaaaaaaaaaaaagaatgaaaacgctaaggtaaattaggtagaacctggtcactaggtaggtttaggtagttgaatggctgacctcaggtagtgagagaagttgggctgttgtcgatgttagtaaggacccgctgagaagtggggacttgagcctagagtttggagtataaaactggatctcaccctatctccatcctcccttcccccacagggctcacccctccagctacccctccccaccagttatggaaacccctggctgctgtctcactcttggcgaaagccaaatctcctaaatccaccgcccaagagggaaccctgaagcctgaaggaattacagaggccaaacctccagctacagcctgcctccaagaaggggcccacagccctagtccagtccatgtgggctctggggaccatgactattgtgtccgaagcaggacacccccaaaaaggatgcctgccctagtcatctcagaggtgggctcccgatggaatgtcaagcgccatcaggacatcaccatcaagcctgtgttgtcattgggctcagctgcacccccactcccatgcacggctacttcccaggagcctcttgatcacaggactagcgttgagcaggcagatccttcagcgccttgttttgccccatccaccttgctgtctcctgaggcttcaccctgccggagtgaaatgaacgctaggactccccctgagccctcagacaagcagcagtcaatgcgctgttaccgaaaagcctgcagatcagtcagcccctcaagtaggggctggcaaggccgccgtggccgcagtagccgttctgtcagctctgggtccagccggaccagtgaagcgtcctcgtcctcatcggtgtcttcctcatcccgatcccggtcccggtccaggtccaggtccttctccccccccaacaagaggtggcgaaggtgagctttgatggcctgttagcttctgtcctttgggacgctcctacactctggttaactttgaaaaggccatgggttaactcatgtactttgagtcactgtggctctactcctttttctggattgttggagtctggggtactcctgaagtttctgtttacttgagatgcgccttgggtagatagcatttggtctaactggggttatttcatactattataattggtgcttatacatggtatttggtattttcttg

SEQ ID NO: 26166 - DNA, 1231 bp, Mus musculus
cttgaactcagaaatccacttgcctttgcctcccaagtgctgggactaaaggtgtgggccaccactgcctggtccccttcatttttataatcagaaggttggccattggggaaatgagaagaaacacctctgtgcccaaatggctcaccctctcctctagtgacaactatggtttcgtcacttaccgttatgctgaagaggcatttgcagccattgagagtggccacaagttgcggcaggcagacgagcagccctttgatctctgctttgggggccgaaggcagttctgcaagaggagttactctgaccttggtgagtgttggagacgggcttcttgacagcatttgagaggaaagcttgctctgggtttgacatacagagaaccccagagtgggtgagtgggaggggcctcccacgttcttcacaagcagggcagtttgcctccctctgcttcttggatggccatggctcccatttgagaagtgtggtaagagaccttaatttttgtccctttctgcttctgtagactccaatcgggaagactttgatcctgctcctgtaaagagcaaattcgattcacttgactttgatacattgttgaaacaggcccagaagaacctcaggaggtaaccctgggcattcctcccctacccattttctctggaggtgtccagcctcttccaaccccctccccaactctaggggagagctgctagtgtggaaaatgactgttttataaggaaatggagaaaaaagttcaataaaaatgtgttaaattgggatttttaagtggtatttggtttttaataacaggtgttgaacaaattaacttgaatttctatgtaaggtggtgggggggggaactctaataaacatgaactagagggaacttccagcgtgtcctttctgtgtgctaatgtctatctggtatttctctgaacacagtaagccgtcactcagttcctaggccctcttctataggtgtaaggtcacattgacttggcctctcacatctgtcacatgtaaaataaggcaggaaaaaacgtctcgaacttgaaaggcatgtgaagtttatattttgacaagactcctgtatcctcattctgtgtagctaaaggtgaccttgagcttctacctctccaccacccaagtgctaggattccaagcacccacgttaccacatctggtttatatgatgctgggcattgaacccagaacttagtgtatgtta

SEQ ID NO: 26167 - DNA, 1132 bp, Mus musculus
acaagtaggaaaagtcttaagatgtaacatccattttgagttaagtagggagatagcataacttttgagacaaggtctctttacataaccctggctgtctggaactctgtatgtagtccaggtgggccttgaactcactgatctgccagcctctttctttgaagtgctgggaccatgcctggctgacagattacatttgatcaaggagtaacagaatctgacccagaggagcatactgcttccttagccacgcctcctttcttacagacacagcaggacgccaatgcctcgtccctcttggacatctatagcttctggctcaagtaagctttcctggtgcacttgggctgtgttctcccctaggtgggttgggctgggctgtgttccttagtttgagaaggtcctgatccctcagaggtcagccttctctgcatcagcaggtccaccaaagccccaaaggtgaagttacagtcaaatggaccagtgaccaagaaggctaagaaagagacttcatccagtgacagcagtgaggacagcagtgaggacgaggacaaaaaagcccagggacttcccacacagaaggctggtaaggcttgtgaggggcggggggcgggggggggggagggctccaaagagactgcctggcacctgcctgagggcgacttctcatgggtacctgcactacttctactcagccgcacaggtcaagcgagccagtgtgcctcagcatgctggaaaggcagcagccaaagcttcagagagcagcagtagtgaagaatccagtgaggaagaggaagaggacaaaaagaaaaagcctgtccaggtttgtagcctcggttgtaaggatggcctcagaggagtagtggagaaatgaaacagggtcgggcgggcggtgggggctgctccgcattgcatgaattctgggatgtggaaggggaggctgaagttgaggtctcgaatgatgtgatccaagtgtagacaggattctcctctacccagggactttgtgttctttcaggatactgtgtagggccccaacaatacaagtgttttgctgggagctgttgacaagatgatgtcaggaactgttttatcaagcagttggactctgtctcaatattcatatgttgta

SEQ ID NO: 26168 - DNA, 2189 bp, Mus musculus
cgtttactgcattcttctctagggagaaagaagggcgtcttcccctttccgaagggtcagggaggaggagattgaggtggactctcgagtggcggacaattcctttgatgccaaggtgagaactgtttgccactcttgggaccctggagggaagatgagttttttggttcaggttgctggaacctcgtggattcagactgctttgaaggggcaatagagaaagaaggtgacagggcaccggattgtcttctgtgcaatgacctcttttttttttttaaaccagcgaggtgcagctggagactggggggagcgagccaatcaggttctgaagttcaccaaaggcaagtccttccggcatgaaaaaacgaagaagaagcgaggcagctaccggggaggctccatctctgtccaggtcaattccgtcaaattcgacagcgagtgacacgtggtcatcctttggcaaaggaagggtgattttgggagactggcactcaactccagtggacccagaaactccgtgttaggagacagttgtgacaaggacggtgtggagcaggtcctgaggtgtgtcagcctgcagtcctctcaggctcctttttctggacagctgaatatcaaggacaaaaaggatttttttttttaaagaaacccattcagttgtcaattgccttcctgttctgtgggtcttcatactgagagatttgtatattttatattaaatcatgtcatacagatttttgttgtgattttcagagatgacttccacagattaaagtcttagctgttgcctaaggcaaagcaaaacaacacatggtaataattttccctactggaggattctctttatgtgaaagccctggtgggcaatgacataagtcttgtgatgattgtctgctaagcatactctgtgctcatcttcatccattgggcccggcaccaaagcttctagaagccagcgtggatctaccaactttgggggataaaattgccattcttggtgcagtaacctactaattggcaggcaggattctcgagtgtgtgaatgccatgcagctgtctttgttttgttcttggtagctgttactgctacatgtttacagtacttttagttttaatttcgaagtaagcttttctgacagacattttgcaacaacttgactgttgtatattgacaagttcatggatgtatttgattcttattaacatcaaggacaggctggtaagtacctgcatggttgagtcactggtcaaggaaatggagatgacctatgaaccctggtgtgaagtagatacactggatctcctgggcacctggagcagcagcaggagacagcccaaggaggcaggagggctctaactaagcaggaccattttgtcttgaagtcggtacacaggagtaattatgccctgttcaagttggtcccctggactcactattagtaccttacctataatgttactgatacagactagccaggaggcagggaggcatagctgggtggtagtgtgcttgcttagcattcatagaccaagtgtgatctctatcaccgcaggaagtaaagagcagagagattcctgggccaagggagtggattataaagctgtaggatgtgaccattggcagtgagggcaggggtgggacgtggctggcctggtgagaaacggataccgggcattgcctcccctgtttggtgtccacgctcacctggtaacctgctaaaagctgtggcagctccttgtggaaggctgcatggtcaaagttctgtgtcttaccacaaaacaataaagtgaatggttcctaatgtgttcagagttatgtcgttgtgcacgtaaggccttgtagctttgtacgtaacggaacaagtagggggctggggctgagacctgcttgagttcactgtagaggctctcagcttgccagttctcaacccgaccctcacttccttttctggactcgaacctccccctaccccctgtattttagagatggtgtgtgccttgcatagctctttttcagggtttagttgagctaatgacctgtaagccaaaactagctctgctacttgtgtttgtatcatctggggactaaaaaatgatttttacattgaaatgccttattttatccaggtgtggtggcccacgcctctaatcccagcacttggggaaggcagaggcaggaggatctcttg

SEQ ID NO: 26169 - DNA, 1148 bp, Mus musculus
taatcctaatgcctgggaggtgaagggaggagggtcagaagttcaaagtcatcctttgctataatagcaaattcaaggccaacctcggctatgggagccttgcctcaaatcacaaaatgtatgagtagtgttgctaagaatgtatgcatatgtgggttttagtacctgttttcagttttttttgggtatgtactttggaatggaatggctaggtcatgtggcaattctatgtttgccaaatgattttccttcttttcctttacattctcagaagtacagaaggattccaatttctctatatttttgccaatacttgttgttttaagtatgctggatgtggtggtttgaataggtgtggcttccatagactcatgtgtttgagtgcttggtccatagggaacagcgctattagaaggcaaggtctcgttggagaaagtgtggttttggaggaagtttgtcactgtggggatgggctttgaggtctcctatgctcaggctacacctagtgtagcacacagtccccttctgtttggctcaagatgtagaattcttggctcctctagaaccatgtctacctggatgctgccatgcttcccaccatgatgataatggaccaaacttatgaaaccataagctagccaaaattaaatgttttcctttctaagagttaccttggttccagcaacaaaagcctgagacaatagacaagcactctacccctgagttatgtcccaaaccttttttaaaaaattactatcataacttcaaaagcttttgagacctaattagacttcgataataaagctcgttccagttttgttatcttggcaacatctttcctgaagtaactgggctggctgttctttggggcccaatgttttaaggttttagtttttgtgcttaagaattaagaatgtggagggctggagagatggctcagcagttaagagcactgtctgctcttccagaggtcctgagttcaaatcccagcaactacatgttggctcacgaccatctgtaatgtgattggaatccctcttctggtgtgtctgaagatagctacagtgtacttacatataataaataaatcttaaaaaaggagttagaatgtgttttgagttagggtgtggctcctttggtagactacc

SEQ ID NO: 26170 - DNA, 1138 bp, Mus musculus
catgcagacaaatatacatgtaaaatagaactaaataaatcttttaacaggaaattaaaagagaggcaagttaggggcttgccctcagacctacacgagagcatgtgtacacacacacactcgtgcatgcacatttgcttgggtgtaaatgctacctgtgtgcatttatactcatagaagccagaagaggacatcagaacccctggagctggagttacatctcttaagcctccaaggcaaatatttttataaagtgaaaataaaaatattttggaaagtattcacttattagtccgccaactgacccaacttgggttttgtttttaaacacttatgttattttaggaattctactttttagttaagataatgtgtttattggttggtactgggggttgaagccaggaccttgcaggtattaggtaagggctctaccactgagcttcatcagccttaactcagtgttgaaacggggtctcactaaattcctctggctgatcttgaactccatctgtagctcaaccaggctttgaatctataaacctcttacctccgtctcttaagcaactgagatgacaggcatgagctacacagctgcctctaatttggttgagtggctagactctgattaaacacgagtgattcatcagcttgcacatttaagggttaatgtccaaaagcctgaggattagaaatcataaacttacatttccttctaactgtcttgatagtttgcaggccatgttcacaagtacccagagatgatagagtcaaaaatgacataaaaactcatccttcgtagatatctgccacaaaaagtttcaagaccaccagtgaagaaaggggctcttgtatgtgctctctggctggaccaccttgtcaaacaaagtctccaccatctttctgtccttgcagcacagtttcccctatgggggagattagaggatgtgaaacacagcccaaccacacatgggccaataaccgactgctttccataaacctctgtgcctgaggggcttgaactgttttctgcagttaagtagggttaacctgtcttgcttgagatcacatttcacttcccctttaaaaaggtaaaacgtgctggagagatggctctatggttagaagtacttgtttc

SEQ ID NO: 26171 - DNA, 1151 bp, Mus musculus
gcccagggcagctgggcagagctggcagagcgactggggttgagaagcctggtggacacatacaggaagaccccgtctcccagcggcagtctccttcgtagttacaaggtgaggcagcctgtaccctgccctgaagcctgaaaccttggcctctcagagttccctcccccaccaagactctctaaccccacaccctaagcatcactcagacctcctgtcgccttttctcggcagctggctggtggggacttggtgggtctattggaggccttgtctgacatgggtctccatgagggagtcaggctgctgaaaggtcctgagacccgcgacaagctgcccagcacaggtaaggacaaccaccttggaaggtgtgtctgggctgaggggagaaggcatgaggcttgactctcccctgttccctagcagaggtgaaagaagacagtgcctatgggagccagtcagtggagcaggaggcagagaagctgtgtccaccccctgagcctccaggagggctctgccacgggcacccccagcctcaggtgcactgaatggccccggtcaacttccacccagatccctctgtacagcatccctgtctaatcgaaatcttatttaaacctcaagcccacatctcggtgggtcaaataaaggggaagacccctccccaacttacggtacagcaaccccaatgtgctgcccatcccagtccctgagcgagaatagaggaggaggcccagccagcaattcagagcagttttaatgagggtggaggctgtacaaagggtagggcccaccaaagaagggaagcaggccgtgccaccccagcctgtggatggggcctcaaagtggatgcccttcctctgtctctgcaaagagagaggtgagcccttggggaggaatagggggaccagctcagccccaactcctggcttctgtctgagccaggccccaggatggaggggtgttgctggtgtaagggtgaggtggtctcagcagaaagcagaaacttgatcaggcctcccccacgaaaaaaaaaaggaagaaaaaaaaaaaagaaagaaggaaaggaaaggaaacccccatcaaaaattaggggcatgggcccctcccacccttcctgtacgaaaaagtgcaaaacattatcacaaaaa

SEQ ID NO: 26172 - DNA, 1148 bp, Mus musculus
gtgggctgtgggtgtttgttttcctgtgactgccctttgtaaggcagaggacacccacattggccttgggggacaatggactcagcaggtgttgagcagaggcttgggggagggatctgcaggaggagtggcctagccttgttcttgggctcttgagctggagggaaatagagaaagcactcattcccaggatgcagggggactggaaaaggtagacaatacctgattgggcgaacctggggggtatgaggaccctggcgagggctttgagggagcaagatttcataagattgtggaagtggagccgggcagtggtggcgcacgcctttgatcccagcacttgggaggcagaggcaggcggatttctgagtttgaggccagcctggtctacagagtgagttccaggacagctaggactgcacagagagaccctgtctcaaagcaaaaagattgtggaagtgggtgcatggtgaaatgagaggtgccaaggtttgtagccagaacctgtttagaacgtcttggttaatggtcattaccaaggcttttagagtgcagtttctcatttgctgtggacatgaccataaagaaaaattcccatgaggtttttcataggctactacctgttgggaacatttgtttaaaaaaaaaagaacttcttggttccagcacctcatagcttgcgactgtgggccagttatttacctgatctccgggctttgcttgcgtctatagactgtagatgggaataggaaatgcactgtgaagggttcacagccgtggatgtggaagccaggcctgtcctgaaggtctcagagccagcacacagtcacagccagacttcgggttggaaggcagcgcgtgaatggaagtgtggaggtggcatttaaaacagaattgggagggtgacacataggaaggtctgagaggcatccatggtgaatattgcaatgtggtggcatacacctgtaattccagcaccggagaggcaggaggattgccgcaagtttgaagccagccagcccttgtctacaacaaagacttatagattagtcagaggagtccctaactgattttttttaaatgtatatttttggtgtatttatatcatgtgtgtgtacatacatgtttgcatttaaggatatccatgc

SEQ ID NO: 26173 - DNA, 1356 bp, Mus musculus
aacttttagtggtggcttaggacactcgtgatgtttcttttaccatcctatgggctttggagggttaactgggctgaccatgctcctcttgtgtgctctcaccccaggtcacgacctttttcagcaatccccaatgacccctgtggggagcgttcggccatggccagagctgccagccccagcccccgcccccgcgcaggctcccacactccgccagggctgcttctacctgctggtgtttgtccccatcacctgtgcgctgctgcagctcttcacctggtcccagttcacgctgcatgggagacgcctacgcacggtcaaggcccagcgtcagaacctggcccagatccatactctgaacattaagatggtgtgagaggcccatcaggaccactgtgctgagatccttggcctagtcccagcagtagcctctcgtgctgaccagcatcctgtttcctcacctctgggttcagcctagagaacggatggtgaagccgaaccaggagcatcaccaaggactgccccttctttagtcatgtgactcagcttgtgcaagggctgggccctgtgtgctcagggacctgcgactcctgtggggtagcaagaaaagaggaccagaaagggtagggctgagtacggtgcccaggaactgcctgggacctgtagctggggctggccatttggtgggctcgggagtttctgaagctgtgacgcccctcttgcccacgcagaagtcgactgaaagtgccactcgcctctcctcctagtcgtttctctcagagggttctctgcttctgctatgcttgaagtggcatgccctctgctgtagccccctcccgcccgcgcccccaaagccctgcaggcctctaaactctaaagaggttcatctcatctcaagtaaagccagtcattccaattctttgggtctgtgccgtgtgtgtatgtgtgtgtgtgtgtgtgtgtgtatgtgtgtgtgtgtggggggggggggcaggcagggttgttgggggctgggaaacagaaaagttccctgagataattttcctagagatactaggataaaattgtaaactgcaagctgaacctggtgatttttataattccagcatttggaaggctatggcaggattgcctcaaattcaaagttcgcctaaaaaaacagccaagggaccaaaggaaaaaaaaacctactgtcaccaacaaattaatccagcagagtgctgggtgattaggcctgcaaccggttccctcagcacatttcccacacagcattgcaaaacagtggtcaaggagcctctgccaggctaggggctctcagcccggaaatcacctgaacagcttccaaaacatcaatgc

SEQ ID NO: 26174 - DNA, 1393 bp, Mus musculus
actactaactgaccccttacaggaagagctctggcagaggcccactcctttctcagccaggcctttgtctggctgtgcggaactatggttactaccatagagagaccttgctgctgccgatctaggctgggctggccccaccccacccctccccacccgagtgccctgaggccggaggcagctgctgtctcccctgctcatccttctgtgctgtccatgcctctggggggcggggttaagttctgcccggttttgtttcagtttgggtttgggagactgaaaaagcagtctggccgtggttagagactgggttcaagagagagcagggtacactcgtgtccacctgggaaccaggtagggattaggaccacactgggcatttgaggacaggagatagcttcagggttaatgtacaagccccagccacatccaggggccctgagacactgtaaggactgtgggctgcaggtcctgctgttggcttctcctacgtcctggtttcgatgccatcatcacggttttatttattgacgtgtttgttcagtaaagggactacagagagggctcgctgtctcctacccaccggtcaccttgcttacactaatgtttacagcacctaagtttcccatagcatccaggcctctgtcattccctgctgatggagaactgacagtattcatgggcctcaggaccctgtgattggaggctgcacaggaaggcaccccagccagcctcttcctttctcctaaccccacttgcccactgccctggaaccaacaggctggttgtggttggattttctaagacagaaagtagcatctctctgtggcagaggccccttgcgagggaggtgtgttggagatctagaccctttaaaacaaagcaagctgcagttaaccatgttgccttttgccactctaattgaccagtggactaaatggcagggaggccccttctgggttggtcagattggagagaaggggctgaccaaagtgccaagacctaatgggtgccagccttgctctcagaagtggtccaagggcctttgcgcctggtacaagctagggtgagcctgtcttcaccggcaccctcacccgtgacaccaagtctcgcctcagttccagattccagacagtattctttctccgccatcctatgaccaaaggtccctgccagatgtaaagcgaagctggtgtgtgtggaatcagtgtggcaacccatggactgcagtgcgcataaccagctcacctcttagcccaagcctgtcccttgcacagcctcgcgaagccactttgcctggtggggcccagtgtacttaaataaagtcgttccaataggtacatcagtctgacctctttctgtgaccagtgcctggtaggaagagatatgcaga

SEQ ID NO: 26175 - DNA, 1446 bp, Mus musculus
tccaccctgtcaggaacctcaggaatgtctaaactcctgctgggaccagaccctgtcattcctgtgcaatggctctaggagagtggctaaactcagcctggtctgaccaggcctcctttccctggggctctggtttcttccagagaaatctcagggaaagaggttcaccacatcggatgaaacaagactgcccttactgtgacatgtgatgggtgctctgtagagggacccttccttcccctccctgcagcagctctgtggggttaacccatcacggggagggatccaggagtcttcctcactggctccacagacttcctcagcctttccccacccttcaaccttccaactccacaggaccagagattctgaaaggaagggacttcgactttctgtaactaaaacttcctggggcctgtgtgggctgccgagggtggcagtgccggctgccatgctggtgaaacatgttcctccttttctaagtgtgacactccagcagggcctgtagaagctctggggagtctaaagggctaggatacatacacgccagaccctggagccggggcttgggttttgagattgagagctgggagagaacctgaagattggtgcccctatggggcagatcagaaaactccctcagcggtatttttttaacctggtcttccctctctggcttccatgatcttggtgccaggcgaggtgtctgggtccctgttacaagtcaggagccctgtcaggagacccacttcttttgtacaaagatctgaatgctgcaatgaacagacttttgtacatttttatatcagtttttaatgtcagtggcgactcagttcctggggctacagctggctcaggatttttgtaagaaattttgagtgactcacttagattttgttcctacttgtccctcttcctctgtgtaatctaagtgcattaaacatatctgcagaagtgcctgagttgtgtgcttctttctgccatgctagggtgagtgtgtgtgtgtgtgtgtgtgtgtgtgtgtgtgtgtgtgtgtgtgtgtgtgtgtgtgtgtgtgtgtgttttcctaggatatgtatgacacggaatgatggaatttgtgaccttgccatactaagcaaatgccctacctctgagttatatccctaacccacatttgcttcttcctggatacctaaagtagaggaccaagatcagcaccctggcaacctcagagaagtggactgagtctgagaatgatcctggaagcccaggagtgccagacacaaacacacacaggcacacacacacagggggtcaaggggattggagctggaacacggtcttgggtactgggtgggtggtaccttctctgctattgtactgcttcattcctctttaggttttggttgctgctgtttgtttgagaaagggtctcatcacgtagcccaagctggccacagagtc

SEQ ID NO: 26176 - DNA, 1198 bp, Mus musculus
atgttggttataggtaaatactgatcattttatttagtcttgttcaattacaaccctcttctaaaatgaaaagatctgtcaggtggtagtgcacacacctttagttccagcacttggaaggcagagacaggtggatctctgtgaattcaaggccagcctagtatacggagtgagttctaggacagctagggctacacagagaaatcctgtctaggaaggaaagaaggaagaaaagaaaagtaaaggggaaagggaaaaagggaaaagggaagggaaagggaaaggaaaaggaaaggagaacggaccttaccctgtatgtgcccttccagctgtgcacagggtaatttggtagacacaagcaccagtaggggagaggtgacaggtggcctcctttttacccttgctgagtatggaagtcagtccttgtgcatagccggcgagcgctccacccacagaactacagccccagcccaggcgagcgctccacccacagaactacaaccccaactcagaagctttcctgtgtcataaagctcttcagcaaggacttttctgcctttttaaatggctcagagcacagatgttagaaagtcaagggtgggctggagctatggctcagcgggtaagagcactgactgctcttccgaaggtcctgagttcaaatcccagcaaccacatggtggctcacaaccatctgtaacgagatctgatgccctcttctggattatctgaagtcagctacagtgtacttatatacataaaataaacaaatctttgaaagaaagaaagaaagaaagaaagaaagaaagaaagaaagaaagaaagaaagaaagaaagagagagggctggtgagatggctcagtgggtaagaacacctgactgctcttccaaaggtccgaagttcaaatcccagcaaccacatggtggctcacaaccatctgtaacaagatctgacgccctcttctggagtgtctgaaaacagctacagtgtacttacataaaataaataaataaatctttttaaaaaaagaaaaaagaaagagagaaagaaagaaagaaagaaagaaagaaagaaagaaagaaagaaagaaagaaagaaagaaagaaagtaagtaagtcagggcatcccagtgttggtgttgggagctgtaaaaggggtgctgaggagaacaaatgggttgtatgtgtacactcatta

SEQ ID NO: 26177 - DNA, 1153 bp, Mus musculus
gctgggccgaccgataccagcttccctctgctccttgttctccttgttctcttctcttgcggtccccagcttggagcagcgtcccgcatcttcctgtccttcaagcttaattccgatactaccctctcaggcgttccccgcgcccacctaaaccttggtcctcttcttttctgttctgttgtcctgtagatacagatgattagtctttaaactctgattttatttgataatgaggccatatctagaatcttcttagttctgtttcataaagtatactagatatattcatttccaccccaagattccacattgtaaacgttctggattcctttcttcagctaccgctgaagaaattctggattgcctttcttccactctcctctctccttgagaactttccatttccgcatgtttttctcactgaggaaggcgcatttgttaggtaatttcctcaggtctgctctcagggttattacttgttttttttttttttttttactttgtcaaatctctgtataacctgtctactgaagtttttaaatttgacttattttatgtgggtaggcagtctgcatgtagaggtcagaggtcagcttgcaggcgttccgccctctgcgctgtgggtcctgggggtggaactgggattgccaagcttagtgacaagggtcttatctgttgagccattgcctctgcgtgcatttttatcatagatgacttttccaagtttgtctgcccgctcttgctctgactccccacccccacccgctccgccattcccgcagaagacctgggatgctttaggactgcatggcacggttgcctggggccactctgatctctgcagtttctactttctactgctgaatcaagcattggccactatctgtcctttgataatttctgtttctcacggcctgctctttcttttgggctttaattatttgaaacctcttccttttgtttatgtgtgtttatgttcaagagtatgcctgtgtgtgtgcgcgcatgcctgcctgcgtgtgtgcatgcttgtgtgtgtgtgtgtgtgtgtgtgtgtgtgtgtgtgtaggccagaggacaaccttagatagtcttcttcagagtccattgtcccttctgtttgagataaagtctctctagcctagaaccccca

SEQ ID NO: 26178 - DNA, 4010 bp, Mus musculus
acctttcatgagctttgttagagtgctgacccatgtggtaatttcttctcccacctgcctgttttagggtttttgccaaactctttgctacctccttatgaggaagtggtgaaccgacctccaactcctcccccaccgtacagtgccttccagctccaacagcagcagcagctgctgccacctcctcctcagggtggccctccaggtggcagccccccaggcgctgacccgccgccccagggctcccagggagcgcagagcagtcctttgtccggaccgagccgaagcagcacaagacctccaagtgtcgcagatcctcagtcccctgaagtgcccactgaccgggaagccaccaaagcctctgggacggagtctggtagccccatggccggccacggggagctggacccgggcgccttcctggaccaggattccgagtgcaaggaggagctactgaaagattcgcgttctgagcgtggcggcgtgtcccctgacagtgaagacaagacccccggcaggcatcgccgcttcacaggtgactcaggcattgaggtgtgtgtgtgcaaccggggccaccatgacgatgacctcaaagagtttaacacgctcatagatgatgctctggacgggcccctggacttctgtgacagctgtcatgtacggcctcctgttgatgaagaggaaggtctctgcctgtcctcggagggtcaggctcgggagcatgggcacccccacctgccacggccgcctgcgtgtctgctgctaaacaccatcaatgagcaggactctccaaattcccagcacagtggctccccgagctaggacacgccctgcctgcacctaggagctcaacgacaaccagggtcagggacacccacgagagaagcattaagtaacatggacatgtggcccggccactttgtcctcttatattttttccccctcctatcccaccttgcccacatctccaggtacaaattcagggtgtggatgcctcctctccccacaaaagcacagtgttctagaagacggagaagctgcttctgtgactcccgcacccccctttcagagctgtgtcccacctacctgcctggctgagaaacacaagtttgcaaagcccccccgaggactggggctggactgtgccctaaggtggtgctcagcggtgacagagtggattcacgagagaaccgtgtctcagtctaggagacaccacttctcagagagaagaagaaaaccctcagaggccagtggattgtcactgtggctgccagtggctgcagagcactggtctaaccctgtgggagggtgacagctagtcagggtggtgagggacttgctgagctgacaaggcccaggcagaaagtacacatctgtgcgttgtagaggggacccttcccagcctggttcaggtgtagatgatactacgttctctgggttttcctttaaaaacaagcaacaaaggctggcaggaaacagccagaccagtgggcaggcagggactctttgttacaagggaattctgctgcttctccccaggctgagttcccaagagtctgactaccattgggccaggaggagagagcctgaacaggcccggtggtgggagccttgggccttctgttgagtggagacccaagtctgaaggctgggagagctaagagcttccttcagttccgccctttgtccgtgcccacaggtggtcagtggtcctcgcccctcctgaacacagcctgcggtctctgtctccctgtcctctgtaagcagatggactgaggaagttgtgtgttcagggcaaggtggcctcatagcctggttctcacacagtatttcctgttgcgtttgacttaagtctgttgttttgtgtccttgtttgttttaaactgaccacttagaaggagcgccttggttacctgtggttctcgtggctgctctgccccagccttgtggagaaacatgactcactttcctgtacagcctgtgtaaaagagtcacctgggtaggaggtgaccactgcctccagcagacctcggggcctggttactgtcgtctggctccggagacccggtcatgctttgtcaggaaagaggagcagagacgccgctgagaggaacattccccacccagccctgctcatgcaaagagtttggttcctaccctgctcttgaacgatgatgcatagactagacttggcgccaccattatggtgagaaaggaataaaaaggcagaaaacccaagtccacatgtaaacacacagacccgaggctgtaaggtgaacgcgtgtctgcatttggataccacaaaccaaaatctttgtcgaacaaaagtgaagtctacacagtgatgttggatggcgtgtgtgtgtgtgtgtgtgtgtgtgtgtgtgtgtgtgtgtgtgtgtgtgtgtgtggtatgtgtggtatgtgtggtacgtgtggtatgtggccccgagccctgtgttttctgtgaagatactttgaatggccattctgctcacacattaaccacatgcctggagcacgtatggccctctcaaagtaatttattttacacatttactgtttaccgaacaatagtctgaccgtactcgggtgtatgcagcgatctccccgacggcatggcctgtgtttgccagcgacactgcccttcagagaggctgcttcctcagctcaccactgcgatttgcacactgctccatgggcactcagaggcctccattctgttccctgtgcgtggaaacatccggacccagcccccctcccgctggcttcagacaggagcttgattgggtcttgagttacaagcatgaagtggttgtggcccagacatcggcctgtcctggatcaacaggagtctctggccacatgcacagctcatcccccaagatccagagagagagagagagggctggtgtgtggtcagaggggcccgagctgcagccctcctgcacttcccagctgatagcttgttaaaatcccagacacctcactgcagtgtctcagaggagagttcagtttcccaaaatgaacccctcgttagttaactgttggtgagatgggaccctctcaagttttgttcccctggcagagtgaggggctggcctgagtgccgactagctttactgaagcacccaccatgatgcccgagccacagtctggccctgctgctgtaggccaccctgatgctcagagagaggacaggaaaagtgagttagaggccagggagacttgactgagttgggtttctaggtaggaagggttaggcagagggcttggtgctacggtcagatttgcagccgctaacacattcctgtgtgaggccaccaccgtctgccagttattgtgaatatgtgtattttaagcaataagattcagttgctcagactgccctgagcggtctgggtgacgatatcctgtgattgtccggaagacagagtggctccaaccactgtgagaaaccccaataaaatcagtctcaagtgttctacacaatctcctgccgctccttgttccctttccttccttctcagactttcaggtcacaaacctcaagcacctttgccttctccctaccaagacctaatggtgtcacacagcagttaagaacggggtcctgggccagcaggaggctgctgctgagtcagcacttggtcctgaggaatttccctcaaaatccatttctattaagtactttgtgatattccagaaatacattggaaaaggaaaaaaaaaaaaaggccccaggaagcagagacaagtttgtttgtttgtttgtttttttacccctcccagtttccccaaatcaggattggttttagagctttttaaattttttatttttttttttatttttttattattagtgtgggtgtttttgcctgcatgtgactgtgtaacatgtgcatgcagtactcatgagggccagcagagggcatcatctggaactgaagttacagagagctatcatgtgggtgctggggattgaacccaggtcctctgcaaaaacaagt

SEQ ID NO: 26179 - DNA, 1118 bp, Mus musculus
tagatggcacggagagatgtcttttcctgctcgtctcagacagtcctgttgtgttttgatttctagtgtggaacagtcgcctgacctgcaggaccagttgagtcacttactgaagtagcacatcagatgctaaggagggcctgtcctacacaaccatcaggccgtggccttggtctccatcttcatctccagagaatcatctagaaaagacttgtgaagccaggcgtggtggtgcacacctttaatcccagcttttctgagttcaaggccagcctggtctacagagtgagttccaggacagccagagctacaaaaaaaaaaaaaaaaaaaaaaaaaaaagactcgtgaaaagaagaagccaagtgactgagcatggaagcagttcttaaattgatgaactcatcttcaagttggtttatattgaaataaataggttgaatcattagcactaaaaaaagaaaggtacctcagcttgttaaaagctgtattgtctgtgattctatgtctctctctctctctctctctctctctctctctctctctctctctctctctctccctctcgcgctcgctcttgtatgtcttccccccctccccgcccccgtgtagcttgtgtggctttgaactcataatccccctgctgtagcctctcaactattgggattacaaatcacccccccctggtcactgagtaacacatagtctccgatacttgggaggctgaggcaggaggatcacttgtgcccagaaagttgagaccatccagggcaacacagaaagaacctatctccaagaagaagaggaaaggatagagggaggggcccttattgtaatcttgtgagaatgatttccattttaaaagatgtttattattcattcaagagtcttcacttagtggacacggagcaaggataatggctgttgtttcctttctcactacaaattcttatatgaaaatcaggccagtggtgtcccccctggccagctgcagctctgccttgacctttgtttctggcttctttctttctttctttctttctttctttctttctttctttctttctttctttctttctttctttctctctgtgactcttgattaagtgaccttggttcat

SEQ ID NO: 26180 - DNA, 1127 bp, Mus musculus
ccacgctcaccatcctgctggacgacattgcgggctcaggccttgtggcggtggtggtctccaccattggcatcgtcatcttcggagaaatcgtgccccaagccatctgctcccgacacggcctggcggtaggggccaacaccatcttcctcaccaagtttttcatgatgatgacattccccgcttcttatccggttagcaaactgctggactgcgtcctgggccaggagataggcacggtctataaccgggaaaaactgctggagatgctccgggttactgacccctataacgacctcgttaaggaagagctgaacatcatccaaggggcgctggagctccgcaccaagacggtggaggacgtgatgactcccctcagggactgcttcatgataaccggcgaggctatcctggacttcaacaccatgtcggagatcatggagagtggctacactcgaatcccggtgttcgagggagaacgttccaacatcgtggacctgctctttgtcaaagacttggccttcgtggatccggatgactgtactcccttgaaaaccatcaccaagttttacaatcaccctttgcacttcgttttcaacgacaccaagttggacgctatgctggaagaatttaagaaaggtgggcaattttgctttttttttttttttttttttaaattggcttgctctttctgtctccgtcctcctccctccttgaaccctctacccctgagaccaaccccccaaggagagttgaccggattttctccctttcttaattgcaaatttgaaaggatggcatggacttggggacggattgaactcgtgagcacttctaggtttaaaagcccaaaactgccattactttttcacaccatcaaaaaacaggctttgtaattccagtgtttgaaatttgaccctctaggggccatctacttcattcattcattgtaggtgaaagaaagtacagaccggctcgcttacatctgatcacagacatttggaaaatatttaagtagccttaaaaaaactcagtgcagtcctcctctttttttttttttgtttgtttgttttcttcttctttttccttaaacatccatgctgacatctcaaagactggaagtacat

SEQ ID NO: 26181 - DNA, 1148 bp, Mus musculus
gtgtattttcaaggttgtacaaacattactgtcgttctctcaaaacattttatacaccccacccccaccccagaattcccacacccggaagcagtcactccccacttcctgctcccacagtccccgctagcactatgtgtttgctgtctctgggtgaccctattctggacatgacatcagatgaagtgcagcctcagggctggtttctttgtctcagccataattattcgtggttcattcctgctgcagtgtgggtaagtgcctcactcttttccagggtcaagtatctcatcttgaggatttaacaagccttgtttttgcatttttctgtggatagacatttgtgttttgccctttttgccttatggataatgctgctgtgaacattggcgcacaggtttttgtatggccgtggatttcagttcttttgagtaacagtgtgggagtcaagtggttactcagttgttaacttctgttgttaacaactgttagcttagttgttaattaagctcttttccaaagtgactgccccatttttatatgtataagggttccagtctctacagatcttcatactatccctcctccgtccttattgacatcctagacaatgtgaagtgatatttcctgtggctttgatttgcatctttgtaattgtaaagatgttgaacatctcatcttgtgtttaaagtcatcaccatataggaccgtctgtatagttcctttgcccatttagttagttatagttttaaattgtatgatagtgtgtgtgtgtgtgtgtgtgtgtgtgtgtatgtgtgtgtgtatgaattcaggcactcacaagggtcagcatcagatcccctggggctggagttactggtattgtgagctgcctgacatgggtgccaggatctgaaccccagccaccctctgcaagagcggtgtgtgctcttaactgtgtgtgctcttaactgtgtgtgctcttaactgtgtgtgctcttaactgtgtgtgctcttaactgtgtgtgctcttaactgtggagccgtctccttttgacttttaagagctctttttatatggggaatctagtcagttatcagatatatggtgtgcaaatataatcccattctgtgagttacctttttactttgaaacaggaaagtct

SEQ ID NO: 26182 - DNA, 1152 bp, Mus musculus
ctcgggcccccttgtccggccctcctggacttggtctgaccatgacttccgctagttgagcttgtctgccatgctgcgtcctacagccttgagaccaaagactttgcccctttccctggaagccgcggaggacggctgggggagggatggaaactggacacgtgacatccacagctggggcatggctttcaagaattcggagacaaacttcttccacccaaatagaatcatgtttattttttcagaaccttttatcgtttctttcatccctcaatttgcatgaaatttaaaaattgtttcattatgtttttttccaagagatcatgtttttgtttctaagtgtcttttgcagagtttgaagttggtctttccaagctaactctgctgtagccccaccgtgtgaccccgacaggatggacttgcccctttaacggccttccctggccgtccccaggagggatacctttcctctgtgcccggtgggtgtcgctgtcgaacttgatggatgaatgaagaaaaatcatgtcactgcagaacgtgccaagtctgtcgtcactgtgggtgtcggcggaagctgcaggtgccctctctgcacgtagtgtccttttgaaaatatgatgtctaaccccatccctttccctcaggaaggattaatttaacgtttgcttggggatgtgatcttgttcccaccctaaggaatttttatcaccaaaatgaatgttaatgaattttaaacccatggtttatcattggcaggaggcaatgacttcatcccccattcctgtaacctctggtggtctgggacatcagctagcccccaccccaacccctcactcttgctaacccaagctgctgctacaggtgccaagtggaaaccttccatggggcttcttaatgaacatgtggtggtggcggctacaggatgcctctttcctgctgggacttgtgtattatctgagtggggtgggcagggtgggaggtggacaatatacttaggtatttctagaccctgtttctaatgaaatgcccttccttccatagagccaagtgcccctcccatgttgtccctgggctgtggagttcagcagtggccctgttcaaaggtggccctgcttcggatgtggccattgccagagagccacccatacagcc

SEQ ID NO: 26183 - DNA, 2599 bp, Mus musculus
cgcagaccttggctcgggcgtctggtgccatgcccactgacagtgggtagtggtcctgagtgttcgggttgagaaaggctggcccttagtggagggtcgttgagagtagcttttaaaggagctgagtgacctgctaccggtacctagcctgccactttgggatgaagttcctatcatggggaaccccacacagtgagtacccccttctcaaacacatccaggtgaaaatatcattttaataaggagcatattatgttcagatgtaagctctctgagtgtggccagggccagagtccttccaacaagcttctagctggccccttccctgaggcctggggagtcaggagcccagccaaggctctctagtgctaagtgttccactctgctgcccctcaggcatggtacacctctgcctcagacagccttgccccaggaaggagcctctggaagagaagcaccttgggcctctctgagttttactgttcctggatcctggagatgaaggacttgagggagctagctgggagagcatcagtcaccacccgctgcggcagctaactgtagagttctcttgcaaagaagctgaggagtggggttctcagagatcaagactgtggcctgccagcttcgtgttcattttccattaatgaactaattatctttgactagttacttctataataaccaggaattctgaatagttcctccatcggccgtagtttgagctgctctggggagaagtttcaatctttaaacagggcttgcgtccgagtgaacagtgtttccaagtctcccactcccaagttgactcctgaggcaactggctctttgcccctctgagtggatcttggctaggaatggcacataccatctctggcctcacctcatgggcttcccagccaagagagcctggcaagtagtagagtggccatggtcaggctccttccatgtagctctggcttggaagccctcctgcaatgctgcatgtgcaaacatggaggggaggggtcaggccagacagactcaggcctcgggagttctgggtgctatgggcctgcccctatgcctctgctgccaggcagaggacaggacagcatctagaactggatgcctgtgtgcagacactgtcactgctaatgggggtccttcatttactgttctttgtccataaggcaagtccaaactctagtaaagtcttaggagaagagaatcctgatatttccacatgagtattggggtgctagtcagctagcttaaatttgggttcccaatttgaaggtgccgcctgtttcatactctctgtgggcatagttgacctcacgtgaagggagctgagccacaaaccactttctcgtgttattccaagaaacgcgtacaggtgttcagtgcagaacttcacactgatacggaacactaactgtgaaaagtcccctcgccatccccagctctgtacagctaaaggaccagcttttccaaatctaggaaaacatggcaggtccagacgcattagaaaatggagcgacaggattttgagttacacagggaccatgatcttcagcccgcaagttatttgggttaagaagcaaaaccaagtaggtgctgggtgactcagcctgtgtcctggctagtgaaaacatacacaaacacctctgtccttctctgaaggctgccagggatctgccactgtcactgtgcctcaacccaggggatgcagtctcccagggacaaacccaagcaggctaaccctctggactggcgcagtgtacacaccttgtcccctggagcaagccgagagggttggctgcttcagacacaccatgtagtctaacctgctgtggcttggcatgagtcctccctctgcttttcttgtgcagggctgatggctgtttagctacttagctaccggtgtacccttttttgaggtaccaggatctttcttgggctatgtttgctttcattctgggccataggcttgtggtgcttctgtccaacaaggacaactgggtaagttgtaggctagcccagaattaggagttttgagctgaatatggaagtgattgtgggggtatttggaagtttttcccatacaaatttatcgatgaggcacctactcggtggacttgtatactcagggccatttacttgtgttttaggagctgacggaacggtgagcttgttgaggtgcatttgcttctagttgaaggatgagcagtgctccgacgccgagctgctgttacgagtcctgggcctgggatgggcaagccttcctctggcacctccgcaccctcctcccggaatcaatgctcatttactggttttccttctggagagtccccagtggtccagcacccccatggccacctcagtcaggcagagggagcaatccagacatagcagctaaagtgagcatctggggacctttgcttcttagttccctgtggctgacatagctcatgcaacctttttataccagagccatgggagacatctcaagtgcagttgttttaaatgctttttgatggagagtgccaggcagtacttgaagcaattatcaaaatagcaagagccaggttctaggtgtttttatgtccacagctgg

SEQ ID NO: 26184 - DNA, 1199 bp, Mus musculus
catttgaattgtagctctctgtttagcatgttgctagtgttatagtttgtttgtttgtttgtttgttgtttcctttctcttaagggtgtatgtgtagatttgtagtgctagagagtgagcccagggattagtgtctgtcgcataaacattccaccccttagctatgaccctagttcacctttgtttttaatgtttttaattaaaatagaattatataactttgccccctccagtacctctccccaaactgctcccatgtgtaacccttatttccaagtagattgcctcttttttctttattactgtattaggaagtatatacttatatatgcacaaatacataaatgtaacctgcacaatctgtgttgatgagttgtggtttcaggactgagtgctctgcattggacaactaaggctattctagcagtcactgtggttctttgcctaggatgggaccccaacaacttccccttgcaaattagatccccattgacattgccactgtttaggcttgttttgccacctttctagaaaaaactgactgcagactttgtcttattctagcacttaagagtttttctgccctctcatctttaatgttccctgtgatgtagatgtatccatctcctaggtgtcttgagacccattgatctctacattatatctggttgtagtttttctgttgatggtcttctttgttatagagagaggcttctttgatgatggagtaggtacacttatctctaggtataagggtaacgtttagaatatagtaagggattatgctagtctatcaaagtggtggtattagattcttttctaatgtcgtgacttcactagccctgggaagctggctaggttttccatatcaggtatgatttttcttcctgttgagtgggctttaagcccagttagtcagcagttggttaccactgatatgtgaatgacccttactgactttacagatacctagccatgctgctgtttgtttttctggtaccagtggaaaaaggttttcaggtcagatccaacgtgaatcattgagtcttgtgtccttggtggtgggtatcttcagcaatagagacctaccctcaatccctgagaagcagccaaggcatcagtaccttctgttgctttgaaaatcacttgggactacccagaccaacaattcaaaaggacagtttgtcctaactggtatt

SEQ ID NO: 26185 - DNA, 1102 bp, Mus musculus
cacgttccaggttgctggcaggtagtccttggagccttattttcatggcaagtaagtgtggcaccctgtgtgtagatgtctaacatctttgatgaacctcaaggctgtgaagattcacagcaaaacacttcttccaggtagaatccaggataaaagtgaaaagaacagaccatctttgaaatctctggaatccaataacaggccagaagaatccaaataaaagtcaaaagaattgcctttgtcaccatatctgaaaaactatgaaaagacataaagtaaaggatgttagaggtgaatctctcagcaaaaataccagtttcttatttcaaactaaagagaaggaaagagtgcacaaacattgggtcagttttctcctgcaccaagtgtagactctgcgtagcctgtagaagccttgccctagccattgtggaagctcctgtaaggcttcagttaccagatgccttatagggagactcttcacattgacgcattagatgccacgttgagtaagtaagtgttacacacacgcaggtacttttgagagatggggcgggaggatctgatgttagaatacaaaaggcaagaacaggatgactcagaaatccttttttaaaagttgcagatgtgagccagtcttacagtctgtttgaccttcaactgagcagtatcctgctataaattatctacccagagaccagtctatttgatgagataaaccatccagcatcaaagcaagcaggctaaacttagaattgagatgaacgacactgactatggcagagcccagtccaacttcagttgagggaaaagagatgttatgagtgttgcctacagaaatatgaagatcttgaaactgggaaattaaaatttgtgcttggcattgatatgttttaaaaaccttaatgcttctatgcgtacatcttaccttactattctgtttttgtttttgtttttgtttttgtttttgtttttgggttttttgagacagggtttctctgtgtagtcctggctgtcctggaactcactctgtagaccaggctggcctcgaactcagaaatccacctacctctgcctcccaagtgctgggatcaaaggtgtgtgt

SEQ ID NO: 26186 - DNA, 1161 bp, Mus musculus
accgttatagctactagtaaaaatcctgaagaaagtcttaatttgctagaaagttgcacctagttaattgggttaaaatttgtttttacctttcttcttgatagtttcacatagaccatgctagtatagccctcctgcttcagtttgtcaagtgctgtgattatagatatgcaccactacatctaggtttctttctttctttaaagatgaggtctgctgtgttgttcaggctggccttggatatgcaggccaaagtgttttttcagtctcagccttctaagtagccaggacaactggtaataccatgcctagctaagactgaaattactttttaaaagcttattgatgatgatgatgtgtttgtgtgcgtgcaggcctgcatgtggccatgccgcagtgcacgtgtagacattagaggacagttctgtgacttctgttctccccttctttctatcttctgtgtgtgctgtgatttaactcaggttaccagggctacccagcaactgcttttacctgcttttagaggatgaaatacttaactgctgcttgctataaactgattataacttgtaggtagaatttagaattctgtttactcaacccaggtgtgtagcacatacttgtaatctcagcacttgggaggtagggccagcttgggctatttgagtcattgtctcaaaaagatgataatacaaaatacagaataataattttgtcacaatattagtatttattttaaaagtgttacacatttctgaccttggctttctacacagcaaagagtggacatgtcagttggtttttattattagctgatgatacttcactagtcgtaggtcactatgtagcatttctgggcattaggctattgttcctgaagccctgcaaaagtgaaaacatttctggtttctgtcaagtctttaaattacatagtgggagttgatgattctcctttctgtgtggtgtgttggtatatgccatagaacagaattttaaaacttttaaatgcttattgtatcattgtgagtgtatgtgatccgcatgtgtgagagcatgggtgctcatgtatggaggtcacaagaccctggtgaggagatgattctctccagagattgaactcagggcaccaaggcttgtacccaatgagccatctgtctgtct

SEQ ID NO: 26187 - DNA, 1656 bp, Mus musculus
aaggaagtcagtaagaaaacatccaaggtaggggaaggtttcgaagagacactgggggaagcggtaatatctacgaagaaaactggaaagtcggctacagaagaaagtaccagttcaagccaaaaaatgtaatgccgctgcttgagaaaaagtcgatgcctgggagggaatgcacttggctcattcacggcacactcctgaaccacacccaccaccgctatagaatgtctgcaaggcttcagcgtcattgtaccgaccccttacgttctccagtaggaaggccactgtagacgggcgcaagctgcagtcctggagcagaggaggagttctccaagaacacagctttctcacccacagttcaggcttcctggtgacaggtgactcaggtgcagaggaagtgcaaatgaaggtgctaaatctgctcatccctcactgggagctgaaacggaaacctatgtttatccactggaccccgccaggccccagccatagaaccttactgtagatgcctaaaagcatacaatcactgcagaggacaagctagtgctccagacaccgctccccagccccctccgatagagccgagtcaccacacacgtctctcatgggcacatgccttccactcttcaatcccataattcctttctcgcacccaagaggaaggaacagagtttagtgtagcatccccttctagccacgcatagaacgtatgccctttagctagctcttcttcactctgtgggtaaaattagctgcatgctggccatccctgtgatttgtgtaactcacccctgcccatttcatgtcctttcacatctgtagctttaaaaaaaaaaaaaagaaaaagattaatgataacggcagtgattagttttaaggattttcctaaaaataaataaataaataaacataaaagggatctctaggctttaggctttcaggttgtccagatccacttaattagaggggaaaaaataccttaaatgatgtagcatttcactttaactgtagaagcacggtgataattaccctgcgctgtgctttagcgctgaccttagacctcgtagtgtaaatagaggaagagtactctctgaaggggaagaacaaggtctcctctgtgttgggttccatgtagtggcgtagaattcgctttctcgtacccttgccctagaatctacatagtccccttcccattaggataggtcctcaagaggccttgcttttttaagtatgctatgtataggacattttatcaccagacacaatgctaccacccaaaagtgaaaaaacacacaaaaaaaagccacatctggtcaatcaacaccaccagcagatattaaagaaagaaagaaaaaagaaacaaacttttcttcagagtctttccccaacagggttacattgcttcagttggtgggtgtccctcccccaaaggaaaggcagaaacattcaggatccaggaggggtatacacacttctcccacctcacggaggcaggctggaaagtcagctctttctgcacccaactgcggcatccacacgaccagtctgcctcatgtgccaaatcaggctttgccctgtctctgctcacttccaccagagctctggaactgtctgtcctgtccccgcccactccatcgcaagctctgtgctgccaag

SEQ ID NO: 26188 - DNA, 1155 bp, Mus musculus
ggaggaggcagcagtgctgctgtcaggacaaaaagaagggaaagggggaaaatgcatcaataaggagtttttggtgatgtcaataaaaagaagttatatgtatcttctaatttttacattaaagaatttctcattattgttagattatgaaaattaagccagttttggtttgattatatattatacataactaattttcaaagaactataaaatatccttctcccctcttcaggacggtctgcttgttcttcattatggtcttgtggtttctcctttgaaaataacttgaagatgcaaaggtatatgaggagagaaacccagtcggaggcatctgcatatctgcattgcaccaaagattctcacaaagcacgtaactacgactactttccgctgttaagagctggcttctgttgtcaccagaaccctagcattgtgtgtgtacaacttgaaacaatagaatgtatttgctacactaaagactatggaaacagcactcataactcaggggaaaaaactgaaaacactgaattttaaaattccttgtgattccaaatatgaggaagttgctggttgcttcccatctttgaggtgggtgggtcagtttcccagagctgggactctgccctccagctgcatgggctgggtggtttccttcagaacagctttgctttgagttcagagccagtctgttaaacctcgggtgcgctccgcaccgaaactactggccacttacaagttcctgtcctattctgaacttcaaacaaaattccactgataccactaaagccctgttcctcagctctgaggctgagactgtctcctgttagaaatggctcttcttaactaacatcccttaaacaaatatgaggtgcttctttctgatgggacactgggtcaggtgtcacaaaattccctcagtgtggctgtgaatgatggcactgcttctaacagtagcaacaaatttcaggtgaatgaccagaagtttacagaacccttattgttcctcagtcacttaaatgatctggttccatgttaatgtttctgttttcttgccatttggataaagaatgagagtctttgagaaccttgctttcacagagacttcattgtaaacattactttgcctaaaattagcatcctgatgctttctaaaa

SEQ ID NO: 26189 - DNA, 1232 bp, Mus musculus
gctgctggggcaggaggcagcaggaatgtacaatgatcaaattttgaccaaactgtgacctgatgggtcattatcttagttctggctcttgaaggtggttcagagcagttttaatgtctgcggagacagacagttcagttcctgagatgattgatactctctggctggagatgtcctcacagtggggtgatcttctgaggctctgctgtgtctagaaatctaaggcgactgcccttttactggagaccttccaatgcctctgaggatcctagaacagttattataagatggcagcaggagcaggggaggtgctcagcaggcagaacccagagcattcttgccagcaccacactctgtaactcaagccacctgtgactagatttattctcattttaaaatttaaaaagaaaaacttctctccctctccctccttctccctcctctcctcctctcttttcctttttactctttggagataggcttgtggcttaggctgtccttagctcatagcagttttcctctctcagcccctggaatactgggatcacaggtgtgagctaccatgccttgcttaaaaagcaagtgtccagactgtctcagctcttagacttaagtaaaaaccccctgcctcagtctctctagccgaaactgcagacatgtcttaccttgctgtggagttagtactcaagagatcctcctgtgttgccttcccaagtagttggaacgacaagcaggcactgcagtggcttggacaggatgccaaccgtcagcttaggctgatcgtgaatttacagtcttcctgcctccccctgtcaagggttaggatgtcaggcatgtcccattgtatcgggtgttttgttttacatgagctttaaagttaactaacacgcctttctattacaaagtttgttggtatgtatctaaaagatttccagaatttctactttttttagactacaaattgactcaaaatcataaaatcatctttgctttaaaatctgctctataaaatagcttgtacgttttatgtatgtatacatttacataatctgaaaagtcttctctgtttctgcagccattggaaaagaagtttgtgcgtgtttcaggagaagcaactatcgggcatgtagaaaaatttcttagaagaaaaatgggtcttgatccagcttgtcaggtacagtacatgtgtgtaaaaggaaggtgaggttgcaggatgacctttgacagatgga

SEQ ID NO: 26190 - DNA, 1197 bp, Mus musculus
gtcccgtttttttgtttgtttttgtttttgttttttttacattctgtaaaagtctttgcgtaacgtggagggagttagatgtctaaggctactggcaggtgtactcttttttttctgcaggatgttgagagggtttgggacccctcccccattaaaaataaataacaaatgtgtgaagaaaggcatcccggggatagggtgtaggccagttgatacagtgtatctctgccctgcaggacgctcggagttcgagtcacagcactgtctacactggatgtggtagtagacacttgttactaccaacattcgtgaggcagaggcagcaagttcaaagtcatccttggtaatgtggggagaccaggcaggtttaagggctttttgtaaaccaacaaaagaacaggtgcctttcactgttagtttcctatatgtcagagaactgggaccgcttagatacagtgttttctttagattggatattttgaagggttggagtgcaattaagttacactgcttataatgaaatcttgggatcatggcttaacttgttttgaaatgagaccttgtagtgttggctttggactgggtttgatgttgtgattttaaaaagataaaggggtattaatatatgttctatgggggtgtggcgaggtgtgggggaagggggtgccccagcgggcccatgccaaggcatcccttacccctgagggaccagccacacgacgatatagtatagaatagagtttattcagggcatggggagggaagttaagagggtagtagaggcagagagagagagacagagtagagaagtggaggagggccatgaccacgtgtagagagggcgggaagggaatggggagagagatggagcaagggagggaagaggcaagggagagaagcaggagtaagaggagggggcaagcagtcccttttatagtgggccaaacctacctagctgttgccaggtaactgtggggaggagcatacctggctgttgccaagtaactgtgggggtggagtccagaccctaccaacactcttgggctcagatgtcacagctgacttgtgtaagttggaatataggcattagacttcctacttgcagctagcttctgaatttgagaagggaaaggcttgtatcctaaaatggttactgttgcacttacagcgcctgataaaccttgtcgagctgacccc

SEQ ID NO: 26191 - DNA, 1201 bp, Mus musculus
aaggtttctctgtgtagccctggttgtcctgtaactcactttgtagaccagctggcttcaaactcagagatccaggctctggctctgcctcctgagtgttgggattaaagaaagacgtgcaccaccatgggtcaaagatggttttcaaaagaaatacatactggtagtgagtcttaggtctgctcagaagccccattcactgcataattccagaaggttctcctgaagtgcttatcatacgtttcagtagagaaatgggtggctttagaaactgagttataatcattttgaaatatattactattgatcctacagcctagtcagggttatttatatagttccattattacaaatatataattatatgctagctaccgatgattctgggatggtttataaatgtatgagggagaagctgattaccttaatgacacattgaaaaatgactctttaaaaatcactaaaacaggttccatggagatcaggaatgttactaccaggatgacctacgagtgttatctagtcttaccaaaaaggagcacatgaaagggaacgagaccatgctggactttcggacgagtaaattcgttctccgcatttcccgggactcgtaccagctcttgaagcggcatctccaggagaagcagaacaatcagatctggaacatcgtgcaggagcacctctacatcgacatcttcgacgggatgcctcgcagtaagcaacagatcgacgccatggtgggcagcctggcaggagaggcgaaacgagaggcgaacaaatcgaaggtacgggagctaacctagaatgatgtaatgtgcaggagcaaactgacaacaatgtcatgtgagtttccattatataatggaaattatgtatacattcttataactaccttgggaggaatccagtactgcatttaaaatgtgttgttctgaagatttgtggtatatgtgaggatttgggaatggtttcgagtaacagagccttaactgcagaggctaagacgagcaaggtttgtttgttttttttttttttttttttgcttttgcttttgcttctgagacccgcataataattccaaagtgcagtctatacctcttggcttgtggctcctggccaactgtctttagagtatggtgcatgtgtgtgcacgcacttacatggctctcacgggaatgcagctggatccagggaaaagtag

SEQ ID NO: 26192 - DNA, 1388 bp, Mus musculus
ctgatacagtgtgttcacttaggtttagtagagatggtgaaattttggcatcaggtaagttatttcatggctgtggggtaaagaaaccacagtaaacacaagtatccatggggagttgtgacagcggcacactgatggcttcctttggcttccttttaggttcaatggataatacagtccggttatgggacgccgtcaaagcgtttgaagacttagagactgatgactttactacagccaccgggcatataaacctacctgagaattcccaggagttgttattgggtacatatatgaccaaatcaacaccagttgtacacctacattttacaagaagaaacttggttctagctgcaggagcttacagtccgcaataagccaacggtattagagaccttttggaagctactgtttggaaaagggagactaaaagcaaatacctcagtgattagtatttaagctacaaagaatgtttttgtctacatggatctggaagtatgctgcttggaaaatctgaacaagacagttccacgtttctatagcaaccacatttaactaatttccgttagttgaataagaggtattatgttcgtggaggggacatttatggtgctttggattgtgtggaaactatgcattttttttttgttgttcaaatgctattttaatttattgtgtttagaaaaaaatcaatttgatttaaacaattcattctgcttcaagattcaagttaagaaatatagtaccaccttgagtagctgaagagttctatgaacgtgtgtgtgctgtaatgaggttattgtacggcactcaagcagcgtgttcagtgacccactaacatgcttcccttcacccaccattagtggactgtatggaactgagtagggaccacacttcctaagtctacatgtacagccatccaccaacatctcagttcctaccatgtaagtttggcgtgcaatcaaacacttacaaagcaggtgaggagatttagattccacactctacttcagctaacatggctacatatgacctagtacacttgaagtcagacagacatttcagttgcttacctccaatactgagccttgctttggaaaactaagagattcagaccaagtcactgccagtttttgcctttgttgcattttgtacagttttatatttttgatatcttgtaaataaagacaaccagcttttccaggttcataatttattgtacaaattgagtattacatgatgagttcacatcagcttcttcaggcatgggacttaacaggtgaggtcagacatttcaaaatcctataaacaaagcaaaaacagtttgatttaaatgtgttctactgacaatcagtaatcaccacaaattccccaaagtaaaatgtaca

SEQ ID NO: 26193 - DNA, 1147 bp, Mus musculus
gagcttagcacccagcacatcccggacccagagacggtcttttacactggccaggtaacccttcctgcacaggcctcccgcccttagtgactgtgaacgcaggtttaaaggagcagtacacatagagttgcttttaagaggaagaggagggagcacaaataaagtgggccctagccagtaaaaggagggtgagtgatagataacccagaagtactcactggaatccagtggatggaggcccacaccagagaagtagtgctggtctagtgaggttgtgtttgtttctcttaaaaagcttcttaaaactttaggcttataaccagaagttagttatgtcctcattgtagaaggttggcttgaggggcttttaatatagtctctgtatccatcatctcttctctgcctttggatctgacctaaggtcttgatggatctcccgggtccctgcagagctcatggagggttctgaaggcctgctgctgcaggaggtgacagacacgtgtgatttcccaccaggtggtaaaggtggcagtgctgagctgtgagccttccaaggagaggatgctcctgtccttcagactgttgagtgactcgcggccaaaggatccgggtgttgagagcagtcagaagaaaacaggagctgtgcgcatcgggcaggtacctgggcagtgaccttgtcttacagtgacagtgttcctggagaggaactggaacctgtgggaggaaagaggggtgcaccgctctgagattctgggcctctttcctgcctgccttagcaaacagaagctagcgtgagagagaagtgtcacggcatggccttgccagtctcttctcttactgctaaggccagcctgcacttgcttttttcctccagaaatcagcagaggaactggcaaggggaactccagaggagtcccggtgtggggtgtggatggagatgtggggtctagaggaaagtgcctttgctgttagcctcctgctggccaggatgctgggatgtggtacctctgagctctgcctaggaggggtgttagtttttacctttctgattccgagcagttggtggatgtgaaggtcctggagaagaccaaaaccgggctggaggtggccatcctgccccataacacccctgctttcctccccacgc

SEQ ID NO: 26194 - DNA, 1083 bp, Mus musculus
agagctttataacggatgcctccctgagggaaagctggtcactgccaaggtcctgcggtaggtgtcttctctccctgccctcttggtccctcttcctttgtgtgaatcagacccctttcgctgagagccctgccctgggaggagggtttgaggtaaactcagaacataaaggcatggggagatgatgcaagtagtgttcagatgggtgacaaaccttcgattgaagcctttgacctcagttccagccttagtccaggagtagacatggcttctgttattgttgatcaagcatgtccatcctagatgctccctggctttttccactgagcaggggacatgtgtaaactgtccctgagaatactgagcatctaaggcaggtgggccggggcccagccctgactgacaaggaaagatggcctaagtgctgacgaggcaaggtctgctcgcctgtggtgcccagacacctctgcccttactctctgcctcttctcctcctacctcagcgtgaaccccatgaagaacctgatagagctgtcgctccttcccagcgacactgggaggccagacgtgttctctcctgctccagaaccaaaacaagaggagaggagcggaggggctgaggagggccagaaaaggaaagagaagaaccagaagagacgggaggagaaggaagagccccagaagtcacagaggggtgggcgaggcaagcgggagcgccaggagtctgagagcgagcaggtgagtccccctccccgggcagcatcctgcctcatctcacccatcagtgtttgagaagtgagctgcagctgcccagccttctctgaggaggcactgtgagggcgaggagaaacttcccatcccacacccccaccatttcaggaactagtgaacaagaggccaaagaagtctggagccgcagaagaagacgacagtggtgtggaagtgtactaccgggaaggagaggatgaggtgggggagccgaagctgccacccagggtaaggcgcgccgccagccgagtgggggaaaggctttggggaagagctccttgtcttcccagggctgagctgttcagcccatcctgt

SEQ ID NO: 26195 - DNA, 1099 bp, Mus musculus
agaaggctgtctggatcaaatatggtgcctttgttttggggaggagtcaggctggggccagtcaccgagtgctgcagcgagccctggagtgcctgcccgccaaggaacgtgagtgcttttcctgactcctgatcacactcgggactgatagatacttaaaggggcagttggcagcttgtaacaggtggagtggcttctgtcttagcaaagccgatggctgtgctgtggtgaggtccttgggttgtcttggctctgacttgtcctttcccacagatgtggatgtgatcgtcaagtttgcccagctggagttccagctcggggacgtggagcgcgctaaagccatttttgaaaacacactgagcacctaccccaaacgcacagacgtctggtcagtctacatcgacatgaccatcaagcacggcagccagacagcagtcaggtgagggcgacagcagggctcattcctgttggagtgtgggctgggaaggggctttggccgtgttgatgatgatgggccgctcttggcagctcccagttgtctgacgtgacactgacaaacagctctgacatggttccctggtccacttgatttcacctttccaccagtggtctgtaccgggaaccaggagacttggtcccacatggctcacactatgccggcctcttgtggatggaaccttcataggcacgctctcacttttgtcccctacaatccctacaggccatgagtttaagtgtgcttctgtcctcgtgtgtccccatcccaggagtttgtcctctttttccttgtaacttaaggcaggctaagtctctgtctctgtcaggagttcatactgatgataaaaataagaaatggatgctggatatcagagggacctggtacctgagagtaagctggggagtgccagccaggagtcccatggtagggcccctaaggaaactgcttccctgttcttcctcatagggacatctttgagcgggtcattcacctgagcctggcgcctaagaggatgaagttctttttcaagcgctacctggactatgagaagcagcacggcacggagaaggacgtgcaggcggtcaaggccaaggccttgga

SEQ ID NO: 26196 - DNA, 1129 bp, Mus musculus
taaaggcatgcgccaccacgcccagcaagcagttcttaacaacctatgtttcagatgaggtaatgagggtctgagagttttagttcacaaggccaaagtcacataaccagtaacaggcaaggcaagctctgggtacccgccattggtctttctaactacatccttataaggaagatgctcattggatgcttggattcttactgggtatcctttctactatacggaagcatccatggctccacctccacccaggctcccaattccaccaccaccaccaccaacaacgcctgagccagcccgtgtccatcacagagcatttatgagcccattacaaacagagaagctcctggactccagggggccctagactcaggtgtgaaaaaaacagagggcctcagggaaacactatattcaacttgcttggatggggagcctgggtgtgactgaaaaagacaactgtaaatggtgggaatctcgtctacaagtgatgaggattttcatgtttgtggatctgggtgggtggggtggggaacctgcatctttggaaacagacaggaggagggttgggcaaacacaggctccagcatgagagaatgtcttctagtttcccccacggagggcctaacacttcccttttgtccctacacccagcttaatagctcacaaaatatagcatcattgcaagaaaatatacacaaggctgggtgtcttaggtttttactgctgtaaacagacaccatgaccaaggcaactgttataaaaacaacatttagttggggctggcttacaggttcagagattccgtctgttatcatggggggagcatggcagcatccaggcaggcatggtggaggaagagccgagagttctacatcttcatctgaaggctgctagtggaagactgacttctaggcagctaggatgagggtcttaaagccctacacccacagtgacacacctattcccacaaggccacacctcctaatagtgtcaccgcctgggccaagcatatacaaaccatcacaccggttaaagagatgaaatggttggtgtgtataggtgagtaggccataaacagactgaagaagagtatggatgctatggtgagtttagctaactgctttggctc

SEQ ID NO: 26197 - DNA, 1163 bp, Mus musculus
tcgtcggcgggctcggtccccgcccgcggggacggccgcggcgacgtgcgtggcgccctcccgcccgcgggtgagcttgcagcgcccggctcgtgtggaccgcccccgctcccgccaggtccctcccgaggccgccgcccccaacccccgccctagcgtcgccaggactccggggctccggttgttatggcgacagctgcgcaggttaatgagcgtcttagtgacacgcgcgcgcccgctctgccagatgtgggtctcggggcgcgccgcgttcccgctggctataagttctcgaaggcgcgcgggacccagggttgggggcggcactgctccggacctgacgtcaggaatagatgggagcttcggaggttgagcgtctccctgtcctgggacatagaacctgaaaacaagaggaagaggaccgccacaacgctgggagccccggagccagggcgtggcgaggtagccctaatggaggctccctagcacgggattcagggcctggcacgtgttaaaacgctcaggagtgagtggataatgaattaagacaattgagatcaggaatacagtcacctccccttcgctgtagttggaacttccaatcagaaccccagtcagaccatttcctgactgttcaaacatcctttgcatgttcaagaacggagaaccacaagaccagaagcaagccgatgggacccagctcaggtacaaaccatgagagagatatcggttccaagttgaattattctgtcagctggaaaactaagagattggggaagggatagagggggtgctatagcctatagtagaccaaggtggcttcctcgaggaagggggcagtctgtaaatgtcctgttcacgtgactcttccatctgtgtagctcagcactgctacctgcaggagggaccaggaagtcatcttggatctggggcggttatttctcccagtgtatcatgggggagaagacagtccgtctgtccatctcacaccttcatcagccttgctgcttctcggggccatcgctcactctaaccggactttcccaactcggatccagagtgagccctgggtcatgagtgggacacagacatctcctccatccttttctggaagtttctccataggacccatcctcaatgtgtaggcacagctctttcctgac

SEQ ID NO: 26198 - DNA, 1199 bp, Mus musculus
ttaaaatcaagtaatattctactgcatgcataagccacatcatgttcatcagctgatggacatttgagttgattcccacatttggttattatgagtaaggatactatgggcatttccatataggcttttaaaacgattaattttattgtccttatatgcatggctgtttgccatacttgtatgtatgtatgcatatgcaccatgtgcatgtcaagtgactgtggaggccagaggagagcatcaaccctcctggaacagatggttgggaatcaccaggtgggtgctgggaaccaaacctgggtcctctgcaagggcagcaggtgctcttaacaacagagccatcgctccagcccctgagtgtaggtattttgggtaagtgtcctttggggctgtgtggactagctatcttttacaatataatacttaatgaactcgtcccttcactaagtactggttaccaaggagattgctgcccctcccccaagctccagctagacacctgtgtttcctgaggctgtgactcctggtggctgagggagaagctcccgaggcccaggcccggctaaggaatcctgattgggaggcagagtggaaaactccctggaggatcctctgctgctgccctgtctctggatgtaggggagaggatgggactcccagtagctctccctggaccagtcctagccagttttgagccttgtatcccggctgctactgctgtgatgttggtccttacaccagaaaccgtgatagctgcttgtttgcttgtttgtttgttgtgagaaatgagtcccgtgtagctcaggctggctaccaccttgttatgtagctgaagatggccatgaacttctgatcctcctgctttgctgttttgtttgcttgtttttacataataattatgtgtgtgtgtgtgtgtgtgtgtgtgtgagagagagagagagagagagagagagagagagagggagggagggagggagggagagagagagagagagagagagagagagagagagagagagattctgtcagttttattctaacacatgggccctggggatccaactcacgttgtcaggcttgctggcaagcatctttacctgctaagccacctcacctgctcttgtatgtcttctagaaggtctcactctgtagcctagattggcattaaaattcactatgaagcctaggctgccctgtaa

SEQ ID NO: 26199 - DNA, 1129 bp, Mus musculus
ggcggggatgaaccacatagtgagttttctggctgtagagcccaccccttcccctcggtcatcttcccggcttggcatctgtgtacatatatattcaagtgtgtgcttgcaggcatgtgaacactacatacaggcaaacctgatcaaccctcaacttcctcatctggaaaatgggccactggaagagttataaagttataaaaagtttttttttgtttgtttttgtttttgttttttggttttacaagacagggtttctctgtgtaaccctggctgtcctggaactcactttgtagaccaggctggccttgaactcagaaatccgcctgcctctgctggcactgttctaggtatcaaagctatgtctagcggacacttgctgcttctgtccccatccccacatcctttcccttgcagagagaaatgccataaggggtggggggctcaaacctggtttccggttcccttcctgacttctaagcctagaagttgtgagtgcttttggaatgctttcccttggatgagacaggaccgtggaagtaaaagcactggcctgagtaactgcccgaagcccgtgtgttatgttccaaacatcgggaggctgtttttattaaccagcagtttgggaactttctgtttttcaagtcaataaaagtgtgcctgctttcacgctgacatattgagagcccaaacgagctattcctggtgacagctaccgaagaagggtatccgggctgactgggaggcctccccaacttcctctatgtactgggtactgacgcctctctgcttgccagaaattatgtgccttagccagaggctggacagatctgggctggatcctggtccagcacgagggtgcctgcaccaggttgcgggtccatctgtactgtggggcagtaataactgcattgaagactctttagaattctcaaaggatggaggtacgaggatcagctgatacacagtagtggctagtggctgccagtcatcccttcctatcctggggaagacgatgcttaatccagggtccacaggagtcctttcctgctgtcctggtgccccctgggtctcacattgtaaggcagtagaattccaaagtttaagtgtgggccccagcccactcaca

SEQ ID NO: 26200 - DNA, 1105 bp, Mus musculus
tgagcaggtggccttcaggaattagattgcagtgttctagacctttctttttaggaagacgcagtttgaaaggattagaggatgtgggcttgtattaagccacactccgtggcttgttctatatataggataggtatccctcactgtgaccaagcacctgaggagagggcagccgaagggaggatgggctttgattggcaaacctagtgagggggcggagatggccagagtgtgagggctagtcacattcagtcatgcgctgtggctgtccgagaggtgtgtctgcatgtgctccattctcagtattccctttggcagtccttagcgtgggaaatctgtcctcgtcatgatgtcagccacagctagggtgggtttaccttgctgggcatctctcactagcctcactgtaaacgaagctccggagatcctaattctgtagctgtaggataggttctggacctccgattctgttgttgtttgtgtttgcttgcctgatttatttgagacaagatctgtctacatagccctggctgtcctagaactcattctgtagaccaggccaattctgcacgcgcgcacgcgcgcgcgcgcgcacacacacacacacacacacacacacacacacacacacacacgcgcgcgcgcgcgcctgcaaatctgagctgaagttagttagagagaattggctgcactcattgcttcttagagaagggaaatcacagaggcaaagcccgctcctacatcagtaccacctaataatagctaagtagctttccagtaaggcttctgccatctaagggtgtttatgagactggagcaggaaggaattaaaacaaaacaaacacaagactttttctgtcccaagtactaagtgggtcaaggtggatgttaagaaataccacccagaacccagtgactattaatagctcctgagttgtttggagaattgggcatgtctgtcagccaacaaaatggtgttggggaatcctgaccctaaggggaaaagaagccaggggcagcatgtgcagggtcaccgttcctcttacagtaaaggcttggctttgtgaaagttccccatgagccaataagtaagggtcgtttcctg

SEQ ID NO: 26201 - DNA, 1476 bp, Mus musculus
ctgagtggctggttgccatccctcgagatctcggcagatctctaggttgtgcagcccggcagcccgtgcggcatcttggagagagttagcagacatgtagcttcccccccggcagctggggaggaggccagtggaccttctcccaccctgggcagctgcaaactgcatgccatgtttctttctccttacccaaggcagggaaacagacaggctgcagactacaggtccgaggtccttgaccttgggccaacctgccatgttcaggatctcccgtttgccatgactttcgccaatcatctcactggtgccgtttcccagggtgcccttcagtgtaggctgatgtgagcctttctgttgtcagggtctcaaaagagcaggtccacagccacacttaaggcctgtcctccctcatctcagtgccagtcttggcctgggctgatttgccattgtgtgcccaggagggacaggaaccctcagtggggtggggtctccctggcctatggacagcccttttccttaatttatttatttgctttatgggttatgttccaacctggggtctcctgaaatgctactgttgcagggttgccaggtgaagggaagcaaggagtagccacttggaatctatccccaatacaaggctcatggcagtcctgctaaccccgaggaagaattccaggctggaggcctcccaagaagtggataagcctctcttatgtgggaagtgcccacttccacctgtgtgcccttcctccctggatgggagccctgttactgtggctggttccaggacatccgtctctatagagacatcagaagttctggaaagttgtcaacatgtgggtcagggaccagaatggagacgcttgttagaggagggaagatagaccctgaaagccagcctctggtcctgctaagggggtgccccttacttatgggctgtggcccctgtattcctacctgccttttttagggttactgtggcgtcttagcctaggctttcccagcctttcagtccttggccctcatatggctggttttatatcctcagaggcggcttttgccttgaaaggcagggtcttggtctctgtcctggccactggccagtcatgtggctctagccacagccctctgcccctaaaactccagcttcccctgggtaaaagtttgggggtggaatactttccgtgtatttcctgggagttcttctcaggtgtctctgaggaggaatgtactggggaggtgttgagaatggatgccagggtgggcctttgcctgcactggggaatctgggccaccctcagtcttgcttctccagtcactggccctggtagatgccttcaggctggagctggtaagttgccccatctagctggggcttatcctagagatggagcaaggtcctagtacagagctgtgtggctggagttgggaaaagaagccattgtccattctgctagttcagaggtagcactg

SEQ ID NO: 26202 - DNA, 2242 bp, Mus musculus
ggcatggtgctcttgacctcctgggccggtccccagagcagaatgagaacatccactcccgttctcctgttttgcagtcagctgctcatagagaccggcagccccctcgccccagcctcctgatgtgtgtgggctatgaagctttggatgtgtgcttgagtctttctaaaactgtaaaacctcagttcagcttgtgggcaggaatcctggccataagcaaactcatctggagggtgcgtgctgtaagccccacttacccagtgagagccagttcctacaggcctgcagtaggcctggagctgagtcctggccacccattcatctcagtgacttgggcaaaaggcatgagcctgtctctaataacaggaactcctgaggcaggtgcacacgagcatcctttctcatgcagcaaggaaaagaggcaggaaaagatggcttcttgggggcgaggagcaagttccagaactcggctccccaaggatagcaagcacggccttgctggtatgtcccgtttatatagtactgtaggcctgctgctctgacccatcttgtgtgaatttctatacagataggaagagggaccgggcccctttttgggtctctcccttggaatagatatggctgcatagccgtaattggaatacccatgcagctctctggaaagacaacagtccacatcactaaccaattaagattccctcgcttttttgagggctgagaatgtgtgtgtgtgtgtgtgtgtgtgtgtgtgtgtgtgtgtgtggtcatttccacgagcatgggaagttcatgagtgcatatgtgtgtgtaagaagaaagagactggtggtaattctccacttgaatagcatggggttagagagaatgagtaccgggcaggcagtctccattgaactagtccttggcattgggcaggtcccaagggacgcgcagcttctgacaacatgtgtgtcattcacacgattctggctggagagtgcaatgtgtctttaaaaatttttttgtaattattttattatttagttggaaacttcacactggtattaacagagcgaacagaagcagcccaggcaggccattgtcccgggcaccaagatgaagacatggaaaagatactgttgagtatggaagtgctgaagtgattaaattagggcacccacctccatcctctccttggcatgagacccccggggattcatgagctactgggttacggtttgtttctgaaggacaggcaggctggcagatgaggagtgagacagtagggcctgcagctgtccacacagcagtgcctcccgtctccacagcgagccttccgtctccacagcgaaccttagatcgcttcctgtgagtgtggaaggctcctcatgaccggctgggatttttgataagtcccgtttggggcaatctgatagtctcatgtccccatgtttcctaagctcggtgctgagagtgacgttagcactgctagtcacttcgttctgtgcatctgggtccccagaccacaaagtaggtacattggtgcttgtagattgaaggaaagggtctttccaaagccttgatcccaacctggctgcaagggattggcaggtgccaccctctcccctctctaaatctcaagtgaccttgacagtccgtgcccctcccctattgcactccaatgccttagagtgcccccccgcaccccccccaccccccggtgctgaaggtccctgccttattcccaaatcatattctggacagttggctgtgtctttggaagtgtgagagagtcatgttagtgcaaacagacgtgtctggcatgtgggaaagctagtgggaggcatgttggcaagaggagtgcgcatgtttggagttactggcgcttaccgtccttgcacggggtggaagcttccagagatgtcttttaggtaggtgtgggaaggctgagagagagagagtttggaacaggaaaggagtcagttcttggaggttgaaaacgagaggtttccagggatttttgctctcaccagccaagagtccagccagagaaaacttgttcactgggccccatccgggcttccagtatcattgtcttaaggaagaggtgctgcaagtcatacgccaatctttgggtctgcgggcccagtcccatcccggattccccatagtttttgcccagtgcattttgtcccatgcagagctagcctgtcaaaccatacaaaatagacaccactgaccataataggccacaccgtaggga

SEQ ID NO: 26203 - DNA, 1641 bp, Mus musculus
cgagtctcctcctaatctagagattgctcgaggatttccgggtaggcaattccttctgcatgtttgggaaatggttatcggttggaggtttatatatcaagcgtttggtttggggtttattttagaagttgtttgggggcccgaggggctcagcctcacataggagacgggtagtggtgggtggggtttccgttgaattcatggagggatgttttatttgggttttggtttaatgtcttttgcctttccataaaccagattgtttgtttaggtttccactgtgtacacagtgcccaagcatggcaccttagcagggagtttggaactgggtaaagccaagtccccggctcggtgaaacaaagtgttcaggttcctgcccaagagggaaagagggcagcctgctgggtggctaatctgcctacttctgcccactttctccaacctgggcagaagggaccctggctgggtcagcccagagcagacactgtgcccttagcctgctggcaaggtacccaagaagatggaggactttgaagccaggagccaaccctatcttcctgaggggcagcaccccccggggaacagagaagcaaaagagagtggagtggaaacagtcctctgtctgctttgggtcgtgagtcagtggttgacatttcagaggggaccctccggaaagaagcccgcagtgtccttccaggactcccctcatgccaggagtggatgccatacgtgcctttgacttgggacagatcctgtctcacagcctgtggctgagctgccagcatctcctctgaccaagggctgctggttccaacagacatgggaggaagagcgcccctcaccccacctcccaggcaggtctgccttcagctcccaaccctaacctcctggatccccaagccatgtttctcccacaggtggatgcaacccactagcctcctctgtcaaaagcccgtggtggtgacattgttctattttccttttctgtgttcatgagtttgtttaaaattgaaattagttaattttcttctgctggacagtattaaatagagtggggttgttgagttaatctgctagattgcagtactaatgatagtggtatagtgtcttcatgatattatttgtacttatttgaacaataatgataaagaagtggttcattatttcttcattaatgcactttaaggtggaatggaaagcaacctggagagcgaagtgcattacttaaagatgcagcatatacacttctcattttaaaacagcacgtatttattaaaagaggaaaaaagtaatttatgactatttaaaataaaatttaaagtagagtggctgtcaggtgagaggaccttcgacgtagccgtctgccagggggaggggccacagcctcactcctcagatgtctgcattgagccagctccattagtgcgcccgcctggctgccaggcacagagcatctcagttggactggaccaccaggatccccagagccagccttccccacctcccctgtccttgccacatcccaaagattctctcacaatcccccgtgtcctgaaatcatagatccttaaaagtgggacagggagggtgggggaccttagaggtcactccatactatccattcctgttactttagcccaa

SEQ ID NO: 26204 - DNA, 1130 bp, Mus musculus
acgcttctggaagatccttagaaaatgaacacattccagtgggcagagggcagtgtggggtggtgggcagggacgaggcactcaaggcagaagctgtgtggaaagttgggcagccctatgtcaattagccacaggcttccctaagcaggagggctgcctgctgcggagagcttggcgcccaccttgcagagcagcaggagcaggtgtgggggacaaggagactctagaaatagtgcttccttcaagctacacgagccatggctgtgttaggaaggcatccaagagtttgtcagtacccagccaggaaccagctgccaggtgacagggcagggccacagcgccgagctttccctcggtcgcacttcctacctgctcaggttggacaggaagagcagccagtcaccttcacctgacgctgtctctgtagacagaggtgactcttcggattcagcccactctggcttatgagtgggcaatcctggagagcctgcccacgtcccaaaacacgcacgcacgtaagtacgcacgtacgtaagtacgcacgtacgtccggatcctttgtccccggtagaagtggcagcccccactccccagcagaagtatagggacaaactcttcccagtgtcctccctcggctcttacgtaatgggctttagctaagtgcagggtactttgtggggagtgtaatttgtcagaacctcagggaatttgggttgaaaacttgccccttccctgttctctccccagcttacccccgtggctactgatatcacacacttcagcacttaggttttcagtaaccattgtggtagctgagggtagaccacggcaaccaccctcattcctatcagcatcttttcagattccataacctcatcctctaggtgtccagcgctgaccgagactcctagccttaaggtggggatcgactcgggtgacccagttagctcacatgacctgaaaagccttgtgggagtcggtgttccatggggttccccagctgggagcccgttgaatcccccaaagcggagggaaccttctggttcctatagctcaagtttatctctttctgattgaaatgtgtgatatgaaactgtcgtttgagtctcactagctcagcctgtgatatc

SEQ ID NO: 26205 - DNA, 1232 bp, Mus musculus
ttcagagatccgcctgcctctccctcccaagtgctgggattaaaggcatgaatcaccactgtctggtgcatatgtctgtgtgtgtctgtgtgtgtgtgtgtgtgtgtgtgtgtgtgtgtgtaattttaaatatattttatatgaaatatatattatatatacacacacatatatataatgtatatataattttcttaagttaaaaagtatcataaactaaccaaacaatgcagaatcatagagagacttaagttcacctgggaaaggattgctaatcacaagaacaactgctaccccccttaaattgagcatactccccaattcttgatctcccataggcctgatgtgttgtacttccctagcacacctgtgaggtagcagagacaggatttgaacccagctcggtctagccagtcactgcaacaccgtttggaacctgtttcatgcaatcaattatgtgtattttagaaaaaaatgtctctggtaagccgtgacctgctgttactgggatgtctagagtctgagtagaggcctgtaatgtgattatagcacacttcctcatcattactgcagagagctgttcctactgagagctgtattatcgcttctcatgatgggggatgctgctaggatccagacaggttaattaagtacccttgaaaatggcagagctaggcatgaactcagggctctgccccaaaccacgaggggacactgccctctggttttctgggacctcaaggcagtagattctgctggttctcaggacagttcccttcacggaggtcttcctactagattaatgctgaccctggaccctcacaggccagccacctggatgagttgtcagttagacattagtggcccacggtcattcccttctgttgattgagagcaggtacctcacatggggagtggcctctaaaggccctctgaagggtgttcttacccgacccttacagtgggaaaagctacacatcttcagggcctcatactaggcttatagagaaggaaccggctctggggatccggagctaagagcctatatagtttgggcaagacaagaactgacctttgagagcaagtgtctcacccctgcttcctccatcggcctctgagtcacaagaccagacagcgactttgcactgagtccagggcatttagggtgtccaacatctgggtctgcaacatccttaaattcttgcaacagtttggatgctacacccacccag

SEQ ID NO: 26206 - DNA, 3297 bp, Mus musculus
gagctggagttacaggcagttgtgagccacccagtattaggtactaggaactgaactggtccatctctccagcccctgggcaatggtttagtcttggttgtcagaataaattctatgtacgatgtaaaacagtgcataattgtctctctttcccctcttaagacactggaagaagagtttgccaggaaactgcaggaacaggaagtgttctttaaaatgactggggagtccgaatgtcttaatccatcagcacagagccggatctctaaattctaccctattcccaccttacattccactgggtcatagcaacagcaagtgtcctcatctggatttggcttctaagtacatcattgtattctcttcatcttccacagtatgtatgactacaaagacaatcacctgcttcatcttcttggtggttttaaaaatttctttcttgaattttattgttaaacaaagatgaagggcagacgaactaagacagatgctcggccatgttggtgacgtagcatctcgtggtaattccctaaggtgattttgtatattgaccttaaatattgtattctttagacactgttattgaaaactgccagagacataatgtttaaagttatttggaaaatatatctgttacatcactaagtattaataaatattgttttacctgatttctcaatgatgctaaattctatagaaaggactctgctatagaattgggataattttcttttggtaaaccaactcttacttttaaaaagccatgagttagagaatacgttattgattcagtacatagatatatttttatcactaaacaggatcaaaatcttttaaaagagaaaagttatttcaataatttgtcgcaaacattagcctgtgtgggtaggagctaattattaaggtgctaattttattaagatagtgcctaaaacactaaattttaaacatatgtaaaatggggctttccttttggtcatgaggaacaaagtccccttctcactgacatcactgttttaaaaacttgcttatattaccattccgtagaaaattacatcctaaaacagatggtgtacaaagcctgggaagatgggagaactggctttaacatgtgagttggtgagcccctttactctctgagagatgcccacagctcagggagttctgccatcaccgagagctcagccctgagctgcagtcacggctacagttctgaagctagtctcagcagtgtttgtccacaatggattttctttcatatcagacacacacccaaggtgacactgggttgtttccaatgaggttattcaagtgcattttggttttattttattccatgtttaaattaattactttgggtaggaaaagcctgaagtctctatcatgtggttactggtacatgtgattttgatgaaatgttcactcttagttccttttgaagttcagaatctcagccacatgtcaggtcaacagtgttagaaacagcacatttgtaaatgatgctcactgcctgccattggcaacctgttctcttctaagagtgctgggtaccaaattgttaccagtatttagttatattttgaggttggtgaaaagtagtgtaatgtgggagcaggagttcatgtaagaaccgtagatgtctgtagagctttctggccgtttgtttgaaactttggatgctgagctctatctggttagatggtttaaaaatgcatgtgtaattttaattttataattattttggcaagcataatttttctggacaaccttgtaggtagccttaacttttagccaactttgttttttatataaatatatataaatatatacatatataatgtatggttgtaaattcatacacttatcacatgaatgtgttactatatacagaattcataatgctttattttcagatgctgggttgaaaactgtttgaaagcctttaaatatatatctttataaagtaatattcaggatgatgatgaaattgtttatattgttatgataaaagatggtattatgttacctagtgtatttaatgacttatttgaagagggagaggggaggaaggctctcataccactttctcctttgagtttttacaaattaattcttcagtcagtggattttcttttcagtttcattcaggtaatttagacatgatctgcccttccagttccttgacatttagagcattgtgtctgggagggaggaaaagggtgtctccctgaagcctgccctctagatttcctgctcctgcttggagttttcttccgagcatggctgccttcctgtgtgtgcagggactgttactggagcacacccatctcagcacttcaggttatgataggaagtgttttgtaacagaacgtgctgtttctaaacaaacctgcctactcctcaggccttaaaccaagtagataatagtgactgttctttcctgcatgaagtataggtggggaggggctgaggggcaaaggcatccattcatacagtcagtccattcctgattaggtcactcagttgctgtggcagaatgtgccatgcagcgcataaaggagtttgtcagcagtcacctccccattccctgcatgctgtggatgcgccacacctcctcctcgcctctgcaggtccagctcctagagccctagtaacagggcttcccccctaaccctgttgaggctcaggctgtgggtcgctgaattagctgttttaggtggagtcatagtaagctctttcttacctttcctgtgtgtgaggaggacatttggagtgtttttaggatgctgagaatcttggaagcatctcacctgacaggacatggcaagttgtacctaagcagggggcagaaccagagctacctctccagtgttttctcaggcacgtgaggcccatgggggctctctgatctctcgagcatcagcaagtctcagaagtgattgtcttttgtactcttccaggtccctcctaccctcatactttcccccattctacactgtgcttattaaatgacaaagactcttctaagaagccaaattcggccatattaatagctagaaacattgcagaatgaaacatctagaactgcagtggaagacgagagcatcagctctccgagagccttctggtcctctctgcgtggtgattgtgtaggatgcggggtggtgattttcatgtttctcttcagtcagaggcaacagttgatgtctctgccgaactgttcttcggctgacatggttttaataacgctttaaaatttctgctacagagcttggagtagagtcttaccagtttcaa

SEQ ID NO: 26207 - DNA, 1937 bp, Mus musculus
gtaaaatagaacatggatgtctagaaggagacatttattatctttgtagttcttacccaggtaacacctcattttatcccaaaactggagtaagtgacagaatagcatgtcttatatgtgattttgaatttttaggacttttctaaatgtaactgaataaaatgttgaaaatactttaaacttgaatatttttacctttaagaagtttgcggtacatggagacattagaaaggcacaacacaacgtcgtatcttaaaaagtatagttatataaaaggtgtactgagagcctcagcttgttcttacatctaacatgtgaatttaataacacttttctaaggttaaggtttgtccagagcttgtactgccctttatacctgttactggcctttaaagttagacaggaactagttaattaatttagctaccttgatgatgtgagttgagccccacatctgatgactgactgactttttctgtttcagaacgacgtgactgagttagagaatctaataaagaagtggaggaagtgtggtcagcggctgctgtgtgagctgcagtctatcatgtcggaggacgaggacgagaagctgacgctcaccgagctgatcgacttctacgggatagatgacaacttgctgcactacaatcgaagtgaagaagagtttacaggggtgtgatacattttccaggctattttctccctctcttctttgggtgatgtgatcatacctagggcctcaaaacatgtgctctgttcctgagctatacacttggcccatttacagattgtctttgagaatggcaatgcaaagagaaatgttttaaaggggaaaaaaaagatctaagctgttgtggcttagagggaggaatgttgaacagtttgggatattctgacaaaattataagacgaagcttagtattttggatatgtttgctaaagaaaatatttaagtataaaaaaattaaaattgtgtttaaaaggaagtttggatagttctagaaaccagggttaattcattgatttggggggcaaaaagtttatattcagtattagaaagtagtatgttgaatgtctaaatctcaagtggcataaatgtagcctgcccttcctaagtttatggacctatgctcatctgcttaacatatctgtttgctaatctagcaactaattaaacttaaatgtctacagttttctccaatttgttttcattttcctcatgtactaaaatgaacatctgtttcttgggatgcttcatatccttatttcctacatgaaggtgttcttggcatgaacggtcttcataattccctttgtagctttatctgtgatgtaaattggaacggtctgttgagttcagagccatatgtaaaaatgtggcttaagctggcccagtagctgagaatttagaatgagcccatggggaaagagtgttgctgttgctgtagctactgtatgaacttggaagacacagggctaacatttttaagaatagcagggagagccttgtggcctccttcttctatctgctaatcattcctgaagccttcatgatttctgccttgggatctagcaaaagtattcgtttctaaatggccagtattctagagcctctccccagaagttcgtttttatttgagcacactccttcccttctgatctgaaaacccttgctgtttgataaaacagggattcaaacccgtacacacccacctaccatatacatgtataaattccctcttgccatctgtatttgtgaatctgtccttcctctacataaggccatgttatgcttgacctaattgactatatcactagttagtaatgaactataaaaacttatgaacataactgctgttgagcagaagctaagaggtgttggtatcatgaacagtgtcgatgggtgggttagagcccttgcaaagcatctgtcagac

SEQ ID NO: 26208 - DNA, 1297 bp, Mus musculus
tctgcaaaaacagacaaaatggatttctcttcacttaaagtgcttttctactcattaatgtgcatgcatgcgaatacacatcaagtgtgcacccatgctcgtgcgcgcacgcacgcgcacacacacacacacacactcacacacacacacacacacacacacacacacgggtatgaaatttttctctctcaatttttacatggcaagacaatcattaaaagttgctttatggttttccaaggcggctgccgaagatggcagaggggcaggttcttgtattggatggccgagaccatcttcttggccgcctggcggccattgtggccaagccggtacttctgggccggaaggtggtcgtcgtctgctttgaaggcattaacatttctggaaacttctacagaaacaagttaaagtatctggcctttctccagaagcggatggataccaacccctcccgaggcccctaccacttccgagcccccagccgcattttctggcacactgtgcgaggcatgctgccccacaagaccaagagaggccaggctgccctggaacgcctcgaggttttggatgggatccctccactctatgacaagaaaaagcagatggtggtccctgctgccctcaaggttgtgcgactgaagcctaccagaaagtttgcttacctggggcgtctggctcatgaggtcgggtggaagtaccaggcagtgacagccactctggaggagaaacagaaggaaaaggccaaggtgcactatcagaagaagaagcagatcttgaggttatggaaacaggcagaaaagaatgtggagaagaaaatctgcaagttcacagaggtccttaacaccaatggactcctcgtgtgaacccaataaagactgtttgcctcaaaaaaaaaaaaaaaaaaaaaaagaaaagaaaagaaaaagaaagagaaaaagaattgctttatgaacatttgcaagggatgggtaactgctgcctaaattcaaggctagtctacagaagccagctgtgctctgaatgggattttgtcttagcttaataataagttagtttttataggtaagtgagtgttctatgatcagttaggatgagttgatttccttctttcttttttatttcttcgtttgtcttttacagagctagagagtggcaatttgagaagaaaggctactttttctttgggaaaattacaaataatcattgtgtcatctagataataataactgtactatatgaggtcatttgaaaatggaaattttattacttttaattttggagaatatgtgtatgt

SEQ ID NO: 26209 - DNA, 1195 bp, Mus musculus
agagagttaaaatgctaacgagacatgtgatgcgtgaaatagtacacaaaactgtatgtaacagagcatgctcagaaaggcccgtgctatgcaaatgaactaaaaaagcccatgttatgcaaataacccaaaaagcctgtgttatgtgacataaaacccccaactctttgtataggagactattgaacctataaacattctctctttgctcaacctgcttcaccatccctggaaatatactacctcctaataaattgtctctatgctattccttgtatggggcaggtgatggaggggcagggacgggggcagggggaggggcatggagatcccgggatcctcccacaagtacattctgaagactgatatccagctatatcaacaccacgtgacaagtagcccctgtgacgactgtcctccgttctaggcatagtattctgcgttcacactgacctcagtcttagggaggaaatcccaccattctctctacccgcagctcccagagggacttctaacaaagtggatctgtaggaacatgaagacagctgaccacacagacttggggggggggtgggtaggggtaggagagcattctgcacgttcacaaacacagcaggtaaaaatctggcagggtgtcacctgatagaagatcagatttacagaacttcctcgcagaggccatgggaataccctgtctaaggttccactgctctctgacagcaaaattggggggcggggcggcaaaggataattccacttccaccgtgattctccctggtgggaagcggtcaggctctcctgaacacaccgagctttcctgaatggaatgctgcctggccttccaaatggatgctcgcagcaaatcgtctctgttattcttgatttgtctctttgggcaaaccgtttctacacaatagcaaaattgcagcagttaccatcatcataataacatcagaaggataatcaaatgctattgaagcaaaaatgctccaatttaatccaagctttggctaccttgatgtgcatttgagtttatgcacatttatgatttatggtgaagtttgtgccccttcatggttccttggtagctatgagagactggcctctacattctggttttgtttggcaatttatctgccctgttctctatcctccattggaaggaagggaccaacatggtggttgcgatttgagc

SEQ ID NO: 26210 - DNA, 1529 bp, Mus musculus
ggtaaggcgctcttagcttagtgatgaccccttctcttgtaattaccagtgggtgtgccttccaggtgtccagtgaggagccctgcgcctggggaagcccagagccttgcttgcctcccggttatttttggttccctcccagtcactgctagttcatgttggcacgctgcacccttcagccacttctggtgaaacgcagccttctctctcctcccctcctcctccccgaggcccctttttccttttagacactaagaactgacactcttcttacccactgggacattttcttgcaaacagtcttttatgaagcttgaattgttaagaatgagccaagaatgaaatcgctaggggatttccccagggtagcagacatcggggatccaggagcaaaaggacgaggtggcgtgcgcatctttcctctcagctgtgacggtggcacctgggtcccctcactgttggcctcactgtgtagcttccataacagcgtggcgtccttctttcttcccctgcagtgtgactggctcaacagctaccaccagacctgcagggacgtggttgggaaggagctgcagagccagggccgccaggaagctctcgagtggctcatcagagagacagagcctgtctccaggcagcattgatgtcgcctggcgttggtttttcgtaggatgctctgggggaaggaggacacaaggcagacccctgacttctctctcctcacctcctcctcctccccgactcctctttttacttttagacactaagaagagctgaaactcttcttacctactttgatattttcttgcaaacagtcttttatgaatttttaattgttgagaatgagccaggaataaaactgctacaccagaaggaggggccccacgaagccgaagacttgacaagggggagacaccccaagccctctggccagggatggccaacactgactgctccgcgatggtctcgttccaggtgctaggacctcagtcacggtcaccttgatgttcatgagaccctcctatgatcagtgaataaaaccatcaaaactcggctctgctttgtctgcctctttctccgaggtgccgtgtcctagtaagttaggctgctggtcaagaaacacaaaacaccccctctctccccctacaaacaaacaaacaaaccacaaagatggcaagcaaacaaaagaacagtaagttaaaaaaaaaaaaagcccaaacaaagcaaaatgatgctgaaagtctacaggatatcattgagtttgttctgtgttggccagaggctcctgtgttattagacgcgttctcacgaccggccaggaagaacaccacagaccagaatcttctgcggcaaagctttattcttacatcttcagggaaagagagcaagaagcaagagagcgaaaaagcaagagagagaagcaagagagagaagcaagagagcgaagcaagagagagagaagcaagagagcgaaaaagcaagagagagagaaaacgaaaaccccgtccctcttaaggagcattctcctt

SEQ ID NO: 26211 - DNA, 1154 bp, Mus musculus
caagcattagagctggcagccaggaccagacctgtacaggctgcttgtccaccaggcttctcaagtgtttggtgacctcatcagactctgggcctggctcgggccaggccctccacccagctgagtaacagccctgtgtggctcaaccacagactcctgactcactactgaagctctgtgtccatggagcgcagcggggtctctaggtcaccacctccgtctttctgtcctaggtctttgttttggaatggaaagaatgctgtgtcctccttatatttgttggggcggggggtggtggtggtggtgccagaatttgtagtgcagcagcactgagcttggcaggtgcccacaactaggttagcagtttcagctcttagggggacactggttagggttttctgatcttgctccctcctcggcttgcatcatggccaactagggaacagttctggtgccctcaggtggcagaacccagcagctacagctccaagacaaccaagacaattttccagagatttggagccctgtgtaaggtccctccctcctttctgagagatgtggaatcctttgataggagctgaatttctatgcagaaactcttccctcccccaaaacctacctgttaagcttgatctgggagccaggcagctgacagaaactatttttaagaaaatgctttcctttttagggctgttcaatctccgcgggtcagatgtggaacacaatcctgtgtttttctcctatgcgatcgtaggcctagagacgatcatgtaagtgtcctctctcacccaggctccccttcctggtcctcgccccgccgttactatagctgctttctcaccacgcaactcccgctttgtccttttgtccttgtctgccctgacaggtgtttatttttatcctgccttcttccctccaaacctctaaatgtcttgaaatccacagaagtatttatagtaacacgagactgagaaataagtacacgagcctatcagaacataggttcttcatgaggttcctgctgtgtgatcttgcccaggccacacaggtttcaggtttcccagaaggcagtgcagagggagccgtctaggctcagctgtgtggttctggaccccaggcgtcctaaaggccagcagtgacgtgggggatcctgg

SEQ ID NO: 26212 - DNA, 1110 bp, Mus musculus
gaagatgggtgggtagaagatgggtgggtagaagcaggggccagcccccctggcagaacttacatggtctgggcagggctggtagaatgctttggggacccaggatcttagtgcttctcctgacatcttggatcctttgaaaagccaaggaaaaacaaaaaaccactatgctgttttgtacacaccaatgtatactcacttttagaagagccaaggttcaaaattcccagcttcagtttgcagagagaaaccgactttggggtctgcaggctgaagctgtcgggtctggtaacactagagtagggtgagagcagtaaagtgtgttccgtctcctatggaagtgggagtatgtcaggtctatggtgtggggtggctccctgtcccctctcagtgccgctcccgtgtcctgtctcccattcctcaggtgtgctacagtgtagagaggttctgcaggatttatcactgcccgtgagtgacacagccctagggttttgccaaagatctggctgctgggaagtcatgtgactccatcctacagatgttacaccaggacttccaaggaaaactttgttaatagagtggcttatttagtggtttgtttaaaaaaaaatgggaaagagtcaaatcgcaaaataaagttccgagccagcctgcagtttgtaaggactgggagtcctgagctttataaaccattgagcttcctgtctgtcagaagttagcagagaaagcccccagaaggcacgggctttaactctgaacaggcgtgctcggtgccaggatgttaactgtttagcagaaatctcattggttttaaaaaacgttgtccccaaaatactggctggattaaaggaaaactgacctctagaaactgttctagttctcttggaggttgcttattatttatcgtcgtcttgtagaaggaagaagctgtctgtccattgtggtagggagccccaaggttgcggtaggctcctgtgtgcaccacttggaatccccagaaagactttttgtagccaagacttaggctcagtcctccagtcagaggctggctgtgggcaggggctttgctctgtgctcttggccttgtatgtgaagggagagcacttagct

SEQ ID NO: 26213 - DNA, 1099 bp, Mus musculus
gcccaaatgtcagcggcgagggagggagagcgagcagtgtggctaagaccttttcgagggaagcggttctgagcggtttctctacagaagctttgttctccagagggggctgtgcagctaaattagagtctttcacactgtgtgccaactttttgttgttgtcttgccttttccgaggcagggtgttgctgtgtagcctaggctggcattaaactgaggcagggtgttgctgtgtagcctaggctggcattaaactgaggcagggtgttgctgtgtagcctaggctggcatcaaaccgaggcagggtgttgctatgtagcctaggctggcaccaaacctgagattgtttggcctcagtgctgggagtacaggtgtgtgccaccatacctggctatttaaaaaaaaaatgtttggtttgcttttctacctgtccctttggccccatgagtgaagataccaagaccctttcaactgttgtaatgcccataagctgtagctcggggcatgaacggctctcgtctctgttttccagagcgagtacattgcaccctgtgactgtcggagggcgtttgtctctggattcgatggctctgcaggtgagtcactaaactttctgctctttgtctttgttttggttctgctccggaggtaactgaattgtgttccagcctgtgccacagaatcaaaaatagaacgcaaactggacatcccccacctgagcctgtgcagtggtgtgggcagtaattttatccgctcatcagcgccaccttttagtgaccctccgttcttttctgtgtctttgctgttccagataaaacaaagcaaccttctattacaaagaacagccttgcgctttgtagtgcttatgatatgcacacagaaagtagtagtaattaaactgaacatggctgcctagctagtgccccggaacatgaaataaggaaccttaatggtcttataagttctcccacccactgtagcttcctggtccttctctgtgaccttttgatacatggttttaacagcgttagataacagtggctgatgttgaggtcctttggtgttatgccctaacttttccaaaactgttacacccttg

SEQ ID NO: 26214 - DNA, 2194 bp, Mus musculus
gaggtcctgtcgcctgatggctcaccttcaaagtcgccctccaagaaaaagaagaaattccgcacgccttcttttctcaaaaagaacaaaaaaaaggagaaagttgaggcctaagtagtccttttgtaatttgtatattacattgtggcattgcacacttaaataccatattttagttaatcgttaatatactgtggtagatcagattgggagtatgtagcaaactggactttaaaaaactggaaagaggttttactaaaagaaaaatattattgaaaactttcaaattcatctctttttatatgtccgaaaacggccgagcttttcagcagtggctggcttggccgactctgccgtccctggcagagcgttgttactgttgctccttagcagctgctgcctggtgcctaggcctctgcagcacatgtgctgggaaggagctgccagtgagcacgagacaatgcttacttgtcactaatcagaccttgagtttatcatcgtggttattgactgtatctttgggtccccactgtttccatgggcattaatgggatgttttaaaagcttctacaagactctagagcattagtatacattggcacatcattttttaaaaaatgttttaagaaaagatttgtctgggtttttactcatagtatgaaattcccctacctgaagtaactgtttgccaaaaagtcattttaataaactataatttttgaagaacttccttttttattagtttagaaaaccccttatttttcatagaggggattttgtacacataatatgagttatttagtttaactcttgcaaaaaaacaatttttgtatgttaaaacgtttgtataccttcagtataaggtgtcatgtgcatgttagccaatcagtcaggggtaaagcctgcccgagtgccatccaggagtccaggggcgtggcacccaagggcatatcaaggcctcgagtcgtatttgaaccatataatgtatttttctcttagtattgctgatggatgaagaggctgaggggaagggaagagtaagagacaggacaggactgagtcctgtgtccacagaagaaagaacatggagatcgacttgctgaaaataaggcccaagtttctaaaatcctgtttcctgccaaaatcaatgtcttggttgacatttgaattttaaaagagttaaagtgtacatccttttagaagacggcactagaataaatcagcaggtctaatcccaccagcgagaaaactaccacgtcttgatttttgcaaacttaatcttgatttttataaacttaaattttcttttaacttcctttctactgtaaatacaaatttaagcctagatttaatatagttttctccatttccccaagtaatgtcgcagatcaatgtaaatggatgaccccaatactccacgagtggaagtaaagcgccctgcgggtgacttggcacgcaaacgtgacgtgacgttggccgcagtgctctctgggctggctctgtctgaccctgtgattgatgctggtcctcttagacctcactaactactggagcctgttaatctcgtagtggaaactttgagttgctgaattgtgcatctgaggattgttttatgtcctacatcatctgtgttgtgctacaacgtgtggagacacagttacctgtgaactctccttttccataacttttaaagaatatatatatctaaatgaatgcaatgtgcataaatattttttaaacacaacagtaaactattgcacctttcgctaacgcttctctttacttgctttgacataatgaatgagccagtgaactcagtgtcctgtggaaaatgtataaaagttatctgatattgctcttagatgttatgctaattaatgttaaatcacaataaacggtattttaaatatatgcatttggtataatggggtttccattcaggagtggtttcctaggttagactttgtgatctgccaaactttaatgtggaacagtgaagtgataaaattgtcctctgagctaaggagtcttgataagcttgttttcaatttagttaaaagttcatatatatatgtgggcttagtggcacatgtctttaatcccagtaccctggaagcagaggcaggtggaactctgtgagttccagaacagccaaggctacaatagtaaactgtgtcttaaaatacttttatat

SEQ ID NO: 26215 - DNA, 1226 bp, Mus musculus
tactttctccgattttatttatttatttatttatttatttacttctgtggccctgccctttgtagttgttactttctcctcttttagagggtgagagaaccgaggcattgaagttccacaagaaagcaatagagagaggactttaggccctgagcgtcatttaagaaatgagtgtccttgggagcagacccaagtcttttcctcagaagcaaagtcatgtaaatttttagtctccccatccttggaaccaggaaaggaaagccaaggaaagactacatctcccggaggccatcgcggagtccaccatgcgcaggcgtactgaggcggcccatgtccctcggcacccgacgtgcactggcgggggggtgggggggcgggactacatttcccagggggcagcggaaggggcgggcggggcgggtcttgccgctgctccggtccctcccccgtgctcgcgcggagaagtaaacaaaccgcgcgcgggctgcaggcggcgcggcgggcgcggcgggcacggctagggcggcggagagcgcgccgagccggggccgagctggcccgcccgcccgccgcacatgtccggagtcgtcgtgggactgtagccgtctgtggcgcctcctgtcggccgggggcgggagcgcggagcccatggagcgggtgcggatgatcaacgtgcagcgcctgctggaggccgcggagtttttggagcgcagggagcgaggtaacggctggacgccgtcgcttcgaccgccgcctcgggctccgcgcgtggagagcggcgtgactggcgcggctggcgaggggaggtgcgcgcgtgtggtgttggaagtgcgtgcaccggtgagggtgaagcgcgtccccgcgcgcggcaagaggagcacgcgcgcgcgtggggagaaatgtgcgtgcgtgtggggtgcacgcgcgtggaagtccgcgcgcggttggagaggtgggtgcgtcgggacggtgggggttcttgctcaggagtgcaggtgagttccggagaggaggcgagcaagaagctcgcgagcgagggcaggcgtgtgtgtgagtgtgtgcgcgcgtgtgtgtgcgtgcgtgtgtgtgtgcatgcatgaggtgtgggcgagagcttaggcagaggagagggggccttaggggaggacccgtgcgtggctctgggctgcaagggaaggactctcgagtcgcgcaggggcggctgctaagcggaccggaggagaggg

SEQ ID NO: 26216 - DNA, 1461 bp, Mus musculus
ctcagcctctgtttatcatgaagcctgtggatgatcagttcttttaaacaaaatgaatttttaaaaagctcatatcgtgctctacaaaaggagagactccatgaagccttttgaaagaggccctgacgcagcccggctttctgttggattccatgctaagccagctaaccttacctgcattgttagctctagagcagccgaccacccgctcgccacccttcggccacgtaggggcagcccatgcatgacggcctgaatcacaggaggaaaagctctgtgtgcctcggtgtctgcgcggagctgaggaggtgcgcacgcagtatagcagccaaggtctgagccaccgcagcatttttatttgagattttgataactgtttgtatgtgttgaaaaccaaaatgacatctttttaaagcttgtccataagtaaaaacatagatgtcttttatagtggaataaaccacgtggggaaatcatctattttgatgcagcatttgataatgataaacacctcacgcctcactcttcacagtgcgcaggacagacagacggacgaggtctgggctgggtagacggaggtcaatgctgtttttgttttctttaggaccactcccttttaccagctttaaccatctgatatccatagtagacatactatcctagttaacatagttacgttcagcacttgtctcatttaatgtaaagattttctacaggcagtctcctcccccacaatcccactgtgcgggtgctattgttgctcttacaaatcccttcagaaatgttatcttctaagtggaacttctagcctgcactctgatgtcatgtgttccctctgtctttcaaactctcaggtttccctctgggccactgcttttccctgggaagccttgctggagaccttaccccaagctgtttggactttgtattctttaaataatttaactacccttaattacttaaaaaaaaaagctttatgattttcataacttattgctgattttaatgggttgttaatttcagtcctgtagttttattttatgtttagatagggctgggcaaggaaaaagaaaataaaaacaaccatatttagcagtgcagtcgagttgtgtgttaatgtcagagctatcttccgtggatagcacgtctccatacaagaaacataccgccttggtcatgcataaggtcccagcacacactacccagtgctctttttgtgcctgcaaaagcacttcgccgttgcttgggctgtgtctgaatgaaaaggttctttgaagtagctgtttgtgaaacactgcatgcctccagacactcggctgaaacctgttgcacttgaggtgctgaggacagaatgcagaaaccctctggtttcccttgcagtcactcccagacaggtaagatgtgtgtgtgtattggctgtctttgagctttctcttaaagtttgtccttaccatggaaagt

SEQ ID NO: 26217 - DNA, 1217 bp, Mus musculus
cacagcaggtctcaccataaactcccttacagccagagttctgtatgacaagtaagctttctattagtaacatgtagtgatattttctgcaaaatagttttgtaagcattgaaacgtgaattatgttaactttaaagtttgttagattatatactagagattgatttttggaaactcatcagaaatgtttttttgttcctaggtaaagaggagtatttttgcttctccagaaagtgtaacgggcaaagttggagtaggaacttgtggaattgctgacaagcccatgacacagtatcaagatacatccaagtacaatgtcaggcatttgatgcctcagtaacctgaaaaactgctgcatttcatctctgcagggctttactttacactctcctttttatccttgtatttttctaaaggtaactgattgcttagatgctgagtaaggaagatacattgttgtcattgtttggctttggtagaatgaaacttgaagacatttgataactgctctcatttaacttcattactacttaccacagcttcctcagtgtgttgaacaaggcaacttttctaggtaagtgctgcttaaatcagcacttagatgacttctgaacgtcaggcccattgaactgatgttgtgtagaccgtttctaagtcctaatttggaattttcagatgctttgcacttgacatattccaacagttcattggaacatggaggcaaaacgccagcctgctaaagagagcttcagttttacaacctggccattgtccagacaagcccaagtataggttaatttataaacggcaaagtttattttgagggtttttttttccttgaattacttatttcctgggcctattgactcactttgtattttttgtcattgagtttgaaatttatattaaaaaaccaaacaaaccatgtttaggatgtgcgccccttctctggtgtttatttggtgttttgtattgttttttcctttgttgacttcacttgtagtggtaccatttttgggatgtgtactgtttctatgggaagacaaaagctgatgtacagccctgtgtacagtgtagatactatttttgtaaaaatacaaggctaaattaatgaacaagagtactcagtgtttcatgattaaattttcctgtatttcttgtgcattaatctgaccataatttccctgtatattatgttcatgtagctgagtttgtaa

SEQ ID NO: 26218 - DNA, 1127 bp, Mus musculus
aaaccacatggtaacccacaaccatctatactgggatatgatgccctcttctggcacacaggtgtacatgcagatagagcacttaaatgcataaataaatcttaaaaagaaaaaaaacaaaaacagctcctgtttgagttcatttgagtgcagccaatgggacagcacattggtggcattccctcatccttcttccttaaatgttactttattattgcttgtgtgtgtgtgtgtgtgtgtgtgtgtgtgtgtgtgtgtgtgtgtgtgttttgggtgggctgcatgtgtgtgttgcagtgcctatgtgggggggagggtagccttgtatgaggggttgactctatgtctaccttcgtgtgttccaggattaagctcaagtcaccccacagtgtggcaggtgcctttaccgactgctgagccatctctggcccttaacagatttcttgacacattttaacgctttctaattttttcttctactattctaggaaaacagacagctgctaaatgaaagaattaaactagaaggcattattactcgagtagagacttacctgaatgagaatctgaggaaacgcttggaccaagtagaacaggtatattgttttccaagagctctgtgctaatcataagtgataggaagtgtggcagtgagcactcactggaatgtcaggccagaggacacgctgagtatgctccttaggttgtagtgggagcactgccgcctagtgtgtgacctgcgcaagtatttcatatttctgttgtgattccctgtagtgtaaaataagtgtaatggtagcatcgactttatatgattacaatcatgaaaagttctagatgttcacgcgattagtgttagtttatcttagtagtcaggcactcagatttcctagtaattagattattaagtttttctgctttaatggcttctgcgattacatccaaatacatacacatatacgtacatgaggacaggcgcacaacgtttgcttccttgaatgttcatttaaattaccagttataacaggtttaatatacgtatattttagtgtatatataactcataattcatactttgagatttaatctcattaaattttattcttttgtattgcaggaacttaatg

SEQ ID NO: 26219 - DNA, 1136 bp, Mus musculus
tatccttttctgtgttccatcatggtgcacgtgaatgtcccagctgatgctctcaggagcattgctactgatgaaaggctagtgctaggtccttatcaggccatgcaccagcggcactgtccagttcctaactgatgattagtaagcatgcatggtctgaaagaaagtgtatcatttactgtatataaatataaatataatgtatgtatgtatgtatacattatgcataatacagtatagatatgcaaatgattctacaagttttcctgtattagtgctcaggtgaaaactgtttggaattaggtgatttgtcaacttcacagtaaaatttaaacaccacgaaaacgtaataaaacttaatgaagaaaatctgaccattaaagtctactcagataagattctgattaagaaatgggtcttaatgcccttcattttgttgcccctcccccaccttagatttggacaattccattgacaaaacagaagctggaattaaagagctccagaaaagtatggagcgctggaaaaatatggagaaagaacacatggatgccataaatcatgatactaaagagctggagaagatgaccaaccggcaaggcatgctgttgaagaagaaggaggagtgtatgaagaagatccgggagctggggtccctcccccaggaagcgtttgagaagtaccagacactgagcctgaagcaggcaagtctacgtgcactttcagtttatagtaacctcgcaagactccctgtggcctgtgagtgtcttaatttacttatttctcttttagttgtttcgaaaactggagcaatgcaacacagagttaaagaagtacagccacgtgaacaaaaaggctctagatcagtttgtgaatttctctgagcagaaggaaaagctgataaagcggcaagaggaattggatagaggctacaaatcaatcatggaattgatgaatgtacttgaacttagaaaatatgaagctattcagttaactttcaaacaggtgtgttctgttgataatgagcctagtgtggaggtggatctaatgtgtgtggactaatccagctcacaggccaccaacatagtaaagtgagtcggggttgtgcagctctggaaagagttgtgtttggcaaa

SEQ ID NO: 26220 - DNA, 1261 bp, Mus musculus
atgttttataaaacatctgatatgtctagtgaaaacccctttgaaaagtgaaggttttagtgtttttcaatgagtcacatttttaagtgcttttgtgtttgttcttttcactacaggggaagaaagcgttttgtaagtgaaggagatggaggccgtcttaaacctgagagctactgagcacagcaactcttacagtcttaggtgttaccaagaacagatctcaactgtaagagttgtcagtacaggttttcttttccttttgtttttgttattgttttttttttttttttttttttttttaaagaatttgttttgggtacaaggcatttctaaaattttataaacttaagtttaatgggattttttgaaggattttctttctttttctttttctttcttttttttttttttgaggggaaattaatggagggacagaagaggaaccaccgaagtgtgggtgttctgataagctactttctaagtgccatgtttaggacctgatcattccaagtttcacgttcatgtatgactgccgctcctttctttcaaggacagtgttttttgtagtaaaatcactggtttattcaaagctttagttaggggtgagtgaagctactaaaccccatgttggctgctgctgtggaaatgctgtgctttgagagtaaacacacacacacacacacacacactttttgttttaaagaatttttaaaaaaacgagttagtcatgagactttttcatctttccagggaacatattgattggtcttaaatattagacagttaagtaaatggtggctggaacatctatttttctacaaaactggaaaaacgaacccggttctacaagaatgtacagcaaaataaaacatgtgaaacactgttgattctttagtgggagtgcatttattgtgtcttttgaaacttcttttaggtttcctgtttaaacctcactaggccttgtgttcaatcctaacagtgcaaaccaaacaaaaatgtttcattgcttcttgagacagaacctgctctatagctctggctggcctgataattgtttaggtagtccagtctttctgcctgggaggcttgagtgccaagaataaaggtgtaggggatcagctgtcttctcgtgcttccatgggcacctgcatacaggtgcatacacaccgacatgtattacacattttaaaaactgtaatagttaaaggccttttaaggttatcctagggaaatacacatgcactttaattttctgtttatt

SEQ ID NO: 26221 - DNA, 1109 bp, Mus musculus
aaataaactttaatgtgaatatattgttgggcttgtacactacccaaaatacacataagcaagtgtgggccacatcatgctgactgctacggagcctgaccagtgacagcaggaataaccaactggtctttaggaaaccttcaataggtctggagagatggctcagaggttaagagcactgactgctctctaccagaggtcctgagttcaaatcccagcaaccacatggtagctcacaaccatctgtaatgagatctgatgccctcttcaggtgtgtctgaagacagctacactgtacttagatacaatctttttttaaaaaaaaggacaccttcagctatagacagaacgctcaggaactaagctcctaattacaccaatgttaagaaacagagaattacacaactgctactcaagtcccaaatacaaaccctgagctgcttattatagcaaaaactcaggtgacatgagcctaaaagagccgtgaagtttgaacactagagggtttctttctaagagatggtacctaaccctgtaaccaaggaactgtttggaaaattatacatgtaatgattttgctgcagtcaccaaacaccttcagttaccacagatcttgaaaccttgctaataactaggctttataaagaggctagaggtaacttatttattggtagttaaatattggtaatttagataaatctaagctttaagtacttaagagaatgcttttttaaaacacgttacaatataagggtaagatctatttatatattagacaaatttcactcattaactctagttatataataaacagaaaattaaagtgcatgtgtatttccctaggataaccttaaaaggcctttaactattacagtttttaaaatgtgtaatacatgtcggtgtgtatgcacctgtatgcaggtgcccatggaagcacgagaagacagctgatcccctacacctttattcttggcactcaagcctcccaggcagaaagactggactacctaaacaattatcaggccagccagagctatagagcaggttctgtctcaagaagcaatgaaacatttttgtttggtttgcactgttaggattgaacacaaggc

SEQ ID NO: 26222 - DNA, 1149 bp, Mus musculus
cttcccaaaggagagtcacaggtcctcccttgagctctccttataacgtagcttctttggaaacaacttatttttaaaaggattatttacatatattaaataagtaaatattttaaagtcattagaatggtgtttgtacatagaatgcaattattagctattgtgattttgcttacttttgacttctcaaaactgtgtatatagttaacttggattctattttaaaccttttcctgtgagatccaagttctacgaaagaaggctgatgtgctctccagcttctgtagtttgcagtggatgtttcatgataggggggactagactactgtataagatacaggaaaagtgacaagttctataatgattgttttgagacacttcacatatgttcgtcataacttaaggtaatttaccacttatttgttgtatttcagggactctaatgagctgaccaggaccattttaccagttgaaatgagttctcagaaatgagcatagtgctgttagagtcaccatgtaacggacggatgtgactccaagcgcaccacttcttcatgccaaccctctttgactgggaaggatctttgtcttttcatcgttgatctggattgctggcgaggaggaggagttcatgtagtgtttgagtgaagcttgagtcaccatgagtagtagtttaggaaaagaaaaagactctaaagagaaagaccccaaagtaccgtctgccaaggaaagagaaaaggagtcaaaagcctcaggaggctttgggaaagagagcaaagaaaaggaacctaaagccaaagggaaagacgccaaagatggaaagaaggagtccagcgctgcccagccaggtgtggctttttcagtcgacaataccatcaaacggccaaatccagcacccggcactagaaaaaagtccagcaatgctgaggtcattaaggagcttaacaaatgccgggaggagaactcaatgcggttggacttgtccaagaggtctatacatatactgccaccatcagtcaaagagttgactcaactcacagaactttatttatacagtaacaaattgcagtccctcccagcagaggtgggctgtctagtcaatctcatgacgctggctctcagtgagaattcactcaccagtttgcctga

SEQ ID NO: 26223 - DNA, 1199 bp, Mus musculus
cctttcctagaataagtatgtttcactgtgtgggagcagaaatctgtggtgaaaggtttttcttttcttttctttttattcccattcctgaaagttgcagatccacaaaaatttaacagaaatttggcaaggaaataaaaaacacataaacacacattctatatatgtatatacaatgctatatagatatgtatttattatatcataaactacaataggtaactttaaagacttctccctccacttgtacattgagatgaatgtctctctaaagactgcagtatatgtgtgtttcgaggttaggtgacagtgtactatggttttatatcttgactcgccatgtccatctgtctgttcgggggtatctgtgtctaagcacaatatcttcacactgtgctgtattgctgctgaactaaatgcactttccccatccccggggcactggcttcaaacaattcagttcagtactgttactttcagtctcgtcacgccatggttagtggtggtagtacagatacggagaacggcacatggcattgatgccattgggagttctgtgggacttatgtagtatgtgcatggactctttgataatgttttcttttgcttttctgcctttatgaatatcaactgtaaatgtgtgccccttatgtagtattcttatttttggtagtgtttgtcttaagtcagtttaattattgagaactcccccacccccagagcaggcgcatcctagatataatcttgaaacacaacttccatacaatgaatgactattacacataaggaaatattgctgcttgttcttttgtgcaaacccccccccccccatttttaagtattttgtcctaaacaactgtttttaaaaattaaaactgtaatatcaagataaacatttggatttttgcttttcctggcactcaaactcaagactgggtttgaggtcaaatctgtgttcataattggcaaatttgtaaggaacaactaagaaatggaaggcaggtaaagatataaaaccctagaatacctaaatgtgctgtaaaactattgtagatgttcactggattttacaaagtaatagcctttctccttttccatctactgtggcttttcagttaagattttgtttataaaaggaatttattacagttctacctagagcttgtgtgtgtggtgttttaaaaataatctcgtactct

SEQ ID NO: 26224 - DNA, 1243 bp, Mus musculus
agcgtgtggttgatgtcagtgtgccgtgaaagacagcgggcaaggcaggactattttctctgccttggctggaaaataccggggtctggtgtggccagggaagggaagtaaattcctgcaggatgggaaggaacagggccccccctggtttttctgggttggaaattgagtaaattaacaatcatcatctcaaatgatcgttccttcgggggcttctgtgtctctgttttctgatcagaagaacaagaacagattctgaactgccctctaggagacctgttggtgtcccttaaaaatacgtgataatagagcccagctatttttcctggccctacttgagccaggggtggaggaggaacgcaggattggaaaacctctgactttatcacggaagggtggcagcatctctgtgtacttggctcctgtagaaagttgtccagagaattcccagctctagcctagagtcaggagatggcaagagtaggggctgagggcgtggagcccagagtcacagtgtggatgactttggaccctggccctgacctgctttcccaacagctttggcctccccactccctgggcactccactgttgtcactgcagacactccactctccaccttgtattctgcagtctccaggcctgttgctatagtgcccacctgaatgtcaataaacagcggccgaagcacctgaaaaaaaaaatacatgataaataaataacaccaggaagagggtctgaaagaatggctcggttggtaaaatgtttgcagcacaaaaatgtagaccttaggtcagtccccagaagtcatatttaaaaatcagggcatcgtgcatcacccctttcccagatacctcctaactaactccagctagtatccagaccactatcacaaagagccccacttctctccctaagattctctgcctccacaatccttaagactggcagtgatatggggtgcacaccccaagttagcaggtatcacaggtttctcatttatagttatactctgatcccttatcttacttctaacagtaaactgagtgtgggtgtctttctctggcaaagtgccccctaggagtccccacagtccacagatggttttcccacggctgctgatctagatagaaaccatgcaagtctacttgatccaccatgatcatggcctcttgtagccacagagtggcactgttggaagcagaccccatgcagtcctgtgcttggccactgtgctcctgac

SEQ ID NO: 26225 - DNA, 2846 bp, Mus musculus
caaacttcctgccatgtaaaggcgagtgattgtgaaagcacctctgttgtagtgggtaggtgcctttctcatgagcggggagcataactgttagttatttgtggtgattatggcagatttcaagatcacgtgacaatgcagtctctaattgttcactgtccatatatatgattttacggaattatgaatttttctgatgagtgttgtatagatgatttgaattgataaaagtattagggatgaggtttgtactttcctgaacttgaatttcaaacactaactgtatcctatgagtgacgtgtgtgttgggggagggtgggcctgcctggtgttacacagagcatggcgtggctggtctggagcgcatagcaataatactgtgctgtggtgacctccgcccttgccttgtgcatgtcacacctccttttcctttgcttcacttctgtcaactgtagcgactttggtgtgcagtgagatgctcacctttagcctctgctcccctaactaggctggcacttcccttggctgtacttgggggacacccagagaggctggtgtactcccttgggtttatctgtggggactcaagcattttattggtctctgtttttttttttttccctctaaatggaaactgtaggtggcttcctctgatctgtctgccagtgggtgttgctgccctgcttgtcagctctgcaaatgagcgctgctccccagcttgcgcagagacgtgtgcgtcccacgtcccttgccgtgctctcccttttggtaggtgttactttaagaactgcagtcagacttgctgttgcctgacaattaactcactgtgaggataggcacgcacgcttttcataattaactggtgctttgaaacctttcttatggaagaaaaatctcaaccaaagttatgctcttcctgacaagctgacccttgagttaattttagcacaactcattcttcagtgcctcattatgaaagacaaaaagcatcacaataaggcttccaggtagccctgttccctaatagaaacattccccttgttttccagcagtgggtggcttcctcgaacgattaaacaaactaggtgcttgtatataatttattacagtttactctactgcatttctgtcaagttgaaatgcatgcccttcaggggaagactgtgagtcaagtttaataaataaaaacctaatactaagcaatatgaagctgcactctgcttttaagtgaggccaagccaagtaagccagagggggaggggcatttgctttccaaatcctaaggaaaaatgaaggcaaaacaagtgttatgtccattcagccaggaacacactctagccttcctgactctcttaaactgtggacgtcaggaggccgaatgcagaaaagtatatctgggatggatggcagggaatagaagctaggactggagttcctgtcctgccgccttggttcctgcagtatcgtgatgccctgagatggggatccgtgggaacatgcagtgccctgcagtgccctgcggtgcggacaggactgcatctgatagtacacagactgatgcacgtagcatttcccaaactgtttggacctcaggaccttttcccctctgggacactgcatgccgtggaaaaccttttcagaaactacattcattgttctttaagcagaccaaaagtcacaacagtggcaggcaggctgcatgctttttgtatcgctcacgatgcactgtggtgtgctcgggtatctttcctcactggagagagcaagcacaggaagctggctgcagtgccttcctcatgaaggatctaccacaaccctggcctttttaaaactgagagtagcagaattaatagagaaattaaaaaattaaaattggggtaaataataaaggttttaattcagatctagaagaaaactgcacagttgaatgcagatttttatccatagataactgtagtgttttgaaatgataggccctacctttgaagtttctaagacttattatgggatgtaaatctgttttttaaaaacactttttaggggcttgagagctgccacctggcatttagtttagtgcggccagtgactgcttcaagagacttctgaccttgcttcccaacagctaaagggctaactgtctttatggaaggcacttgttacagtatttgcccattgtacagagcaatgctacattgttgtaaaaagaattgctattgtaaaaaagcactgtgtgactttgtgaaggacactgccttggaaatgttgactgacgtttatgcctggtgatagcatgtcccgagaagcatggacatggagttttgttttaataaaccagaaaaaaaaaacccgactgatttttaatgtcttggatttggtaagacttttacctcactcattttgccctgtttgtttaacttcacaggactttgttaggatgtaacctgaggtcaacttgtgggttgctagcccagccctgactttatgggctcacgttccttcaaccttgatgaaacatttggcaatggggatgcctgctcacatcacagagacactctgggttcccgcagacccctttagtgtgcgttctgccatctgtttgcatagatatttaactttacaaaaaggacagtgaagtcctagatttccactggtttataatagttgctcaaaaacattagcgcatttttttaagaataaaggattgaccttttgaaagcacagatattttgtagctcctctgagtgtacccagatctagcctgctgtaggactgaatcaggggatggtggcagacataggcatgatgagcatgcacctagcctttgagtcccagacagcccccagctg

SEQ ID NO: 26226 - DNA, 1144 bp, Mus musculus
cactcaaaggtgccatatctcgattgagacacacacactctctcaatttttctttaagcattgaagcaggcaacaaagaaagagatgtgtggtctgcatcctacggttgtcgccatgcagggtgcaagggtcctgtgatgatgcgatgactgtattaaagagtacatcaatttgttttaaagtgttttgattttttatggtggcattaagagagagaacattgtggttgcagctttactagaaagcaaagagttctagaaggagggaaaaaaaaagtgtttctttgaagcctaccagggctttgaatcttgctgtgccaatgggcgcctaagtactcctgtaactggcaacctcagatgcaccatcagcttagggacttccgtcctccaaatattcatttaaaggaattgggggtggggtgtaaattgacctaagccatattaatgattatggagcacaatttaaaaatttttactaagtgacttaatgttttggttattgcttatattgatgtacagattagacgataaagaacagaagcttctaagtcttcccccagtacagactgttagtaccgtttcatttaattgtcttagacacagtaatgaacaccttatacctgggagacaacctaactaataagtataggctgttgaaggtaattctgcggggttgtagcctgagacctcaccatcttctctgcagaggaaaaggtagagcaatggcccgggaaacctgcccttttgttcctcacatctgaagtttgttcaccgcaggcctccttcccacttcaatgcagccacagaaggggcttgcctcttcctccctcaccctctgtgctcccccggtgctgcagtcctgctctgccaccttttcacagtgacgatctcttcagcagctattcccccttcaccccagccactcgccactaaccaatcagggagccttttgacttgagtgaaagatttgttctgtgcacacagatgtgcatggccattcttggtgatgctggtgacagaacaggaagcacctgttgacacagataccttttcttacatgtatcctccaaaagacgtcacctttgtctggggatccgggagaaaacaatggaaacagtatcatttcctgacctggcaaagatact

SEQ ID NO: 26227 - DNA, 1113 bp, Mus musculus
atacataattttgagcctgttttaaattctgtatcagacacattaaaaaaaaatagtgaagcatcaggctagtcaggaaataaagacagataggaaatcctctccagtctcagcccacactccactttctatagcttaatctaaagaaaaacgtggaatttcctgcagagtgattaattggctggctgtggtgacatacagggtctctgagcttgacctcgcaggtaaaggctaactggtatgttaagttgattacacaatttcctctaaatatgttgacaagtggtttgcacagttgccttgacctttgcccttataaatgcacatttataaatggcttgctttttaagccaaagcaatccctattttagatgtgacatgtgttgagtaaacagcctgatatgcaaccctggatgtctaaccctgtcagccaggtcagattatgggagtcactgggaggggttgagatggctggattcactcgggatagccagccccaaagtgtctcctcatcctacatggtgtgttggaaatgtgttctgaaaatggcttgagctgttccaggagtgcggctgctaaacggtttgcagcaaatgacaagtaggtttagctccagtgcttcttacggctctccagtccatttaaacacccgtgcacatgcgcatatgcacacacgcacacgagcacacaaaccaacttttcgtttttcttccaaagtaaggtggagaaactttccagggagcatttctgtgctgcgagtgttttccaagatgttatatccgtaggtactctagagaatgtcattggaggtactttttgttttagagtcatgctgcttgcttgtacataaggaggagttaccacacttattataaatgaacaggaaatgtacccttgggtagtaaaacaaactgtttatctgctatttcaaaaaacagctgtttatttgtaaatgtatacactgagcacctttcccaagcctgatatatcctgatttgataagcaaaaagagatttgccaacactgttgatttagctgggatctatctgcacatgtcttcctgagtgagttaagcaattggaaaatgaattgggataccgtttatgctctcca

SEQ ID NO: 26228 - DNA, 1196 bp, Mus musculus
cctatatgtgctcagatgaatcatttattattgtgtaaataaaggtgtagtctcagttttggaaggatggcgtggggtttgggctgaacaaagtaggacagcagaggagacaggctggaagctgcgccacctttcctgtcagcgaaagggacagcttagtgagaaccttttatcctgataactgaattctggccatcctaaatgtatcaaagaaaccattaaaaagcaaagaggcaacctcagtctgccgtgctgatgctggggaaggaaatcgaggccccggtggcctctttgggaatactggttcatagttcagagcagacctgagtcctgagccgtctctcccacctccctccgtcctcccaagtcacatcttcccaagaccacctaacaggtgaagcactggctcttgctggcccctaaggagttcaccagaacccacgttgactctgaagccgatgaaatgagaagaaggaagggaggcacctgccactcacctttcatgactctctctgcttggtgctttccttgctatcgccagtgatgttggcccagctcaactgtgggagtggaaatctgtgactctatagcccttggcctaagggctccctcacatcccctggatagtggacaccccattcaccaagggtggggactggtctgaatgtccctggtcggccctctggcctcctgatgtcatgggaagaacaaggaagagccctaggccagggcgatacctttcccacctccctacccaccacggaagggagaaagcacacagctctgaagcaggtgtctctgtgtggaaggttctaggttcttattatgcagacctcggttgttgagcatttgtgaagctgggagcctttgtttaaaagtgtgtgggaggtggggggcgaaatgacggcatgggggaggaggaagaggaggaagccctcaccatataaaattcatgcagactaaacagtttctctgacggcataaataaagcggaaacaaccctgctccagaatcaaaagcaatttaattaaagtctcttaagttgtaaagagttttaaatgttccgtgttgaaggcggatgcctgcagatgcagcgcgcctgacgtcagcgggcaggcctgggctgcggggccatttgcgattctctttcaggctggctggattgtcttattttggaaccagcttggtggggggtt

SEQ ID NO: 26229 - DNA, 1202 bp, Mus musculus
acctggtgcccgacacatgaggaatgtgggaggctgtcacagggtctaacctggtgcctgacacatgaggaatgtgggaggctgtcacagggtctaatgtggtgcctgacacatgaggaatgtgggaggctgtcacagggtctaacctggtgcccgacacatgaggaacgtgggagtctgtcacagggtctaacctggtgcctgacacatgaggaatgtgggaggctgtcacagggtctaacctggtgcccgacacatgaggaatgtgggaggctgtcacagggtctaacctggtgcctgacacatgaggaatgtgggaggctgtcacagggtctaacctggtgcccgacacatgaggaatgtgggaggctgtcacagggtctaacctggtgcctgacacatgaggaatgtggaagggtgtaccacacgctgttcctgaggtatggaaacgaggtgtgcctctgctttagccatttccaggttccctcccctatcatataagggatctggtatggagtcagtcttcctcaagtgagtgtgctagagttgctatctgaacagaaggaaagagccacagtacaagagattgtccaccataattgacttcccggtgtagcggtactggacacagtcattcagtgtctgatgggcgtgaagttggtgactgcaggacgggaatctgtggccttccggccgtggtgtcccttccctggctacatttctcttgctcaggtcttcgttaaaaatataaatttaaaagccacacatttctgattcttgaaaacagacttgtagctcctggcttgtgaacttaacagcaaatttgtttctttgggagggattttcctactcaggctcttgtttgtctgagtcttaatgagtgtgtaacaactcctccttccccctcctcctccccctccttcctcactcctcccctcctctccctccccctccttcctcactccgtcccctcctctacctccccccctcctcccctccccctcccctcctcctctgatttgatttgcagataccctgtgcattggttgccagggataagagatctgggaaacttggcacagatgttcacctttgggcccctgggcaccatctctatgggatgaagtgctgacacctttgtggctgggcttgagtgcttagcacaggccagcttgctggaactttcttgcggttttctctga

SEQ ID NO: 26230 - DNA, 1612 bp, Mus musculus
tgaacatgtgtaaccatggtttctccacatacgcggaactgactgtctttctccatccagggaaaagtcttcagcttctgcctttgcctctggcttggcaaagatcagagttgttaactcatttggaagatggttctttgccgtgcgcagaggccctgggttcagtcctcaggaggaaaatgaaatcacgaaaagctatgttttgtagtgaacagtaacataaagccacgtgcaggggccgtgtcacctaagctctaaatgagcaagcccgtgctgtctcactgaaattctacctctgagaatactcaatggccagtactttagagagtaatctaatcttctcaaagatactaaaataatctgaattgtaagcactaataatttttctaaagccacttctgttaccaaagatgggggtctatttagagtcctttcatttaccagtttcctttaaaattgtagttggtgaggacagggataattacggtgttttattgtttagcatggtatagtggcaggagtatagactctagcagtgtcttgccctgcagagctgggctgctggaccaagcctgggcttgccgccaggcttcagtaaaatgctcccacggcatttagcagggagtaatttatgaactgctacttatcagtttagttctaataatgacaataatttatggccacagacatgggcttgacttttttttttttttacaactccagtttctaaagcaaaatctttctccaccatttgacatgttagcagtcccagtagaatctgggctcgagaagaaaaagaacactttatggtagaatgtattaccatttcataaacaatattgtttataaagaagcacctctctactgtattgaagtatttaaaaaggccttctggagctttaatgaatacggcttttccatagaggatccagacatagctggagacacaccacactcttaacagcttgtacaagaatcttcagattataacctgcgtgccctggtgggtgctctcaccctggggcggtgccctctgcagtcttcaaagtacttgagaataacgttacagactaggtgtgaatgttccagagaaggaagctgcttcggcatgttgggtacgaagctcctggggtagcgtccagtgcctagaacaggacctagtatgtgggtgctggctgacagcagcagagcttaaccgaggctccctacagtgtggaaagtggggacctaccccccggccttcagacgagggcagaaggaggcttaccttcattgagttctcgctccctgctgggagtttcccttctgtgtgctgaccacacgcaatcctcacaacagccttaggatagagtccctcctccttgaacagtcacatcagcactaagagtgtacacagaggaagtggacagctgtctgccccactgcctactctgtcgtctcccaaacttgcaaggtcacatatttcattccttcatgtagtaacttatcagtccagaggattccaggagccctgggaatgcgtgtttgtaaaattcatttaaattcattaaagtcattcaacttacatgacttctcatagattcttatcatctgggccttggaatggtctata

SEQ ID NO: 26231 - DNA, 1955 bp, Mus musculus
tttaggggcatcccagtgcagcgtctgtccattgtgaagtagtgtggtcgtgaagcagtactatggttcagtgagcagcgcactacatgggtcagaaatgacagtgtgacagagtcacataccttgaggcagacctgcgtgataatcaccaagattgctttttccacccgtgtttcaaagccgacatgaagaatgagccctcgcctgagtcactgttttaacctggcttaatagaatttcctttttccagtttctttgcgttagggtaatagacagaatggtcgttaaagttagaggcttggtaatcaagcgaggtggcattctgtggctaatcagccttgtctcctgcctgtgccggcttgtgtaggctggcgccttggctctcgggtggccgctatgagcacacaggctggcccagaataggacacagccctgcctgcaggctctgctaggatagctttcgccatggcgtggtgctttggtttaatcattgtcagaggtcagagttgaaaactaaaaccctagacgcttgtggaatgtgcgtctaggtgtagttactcattgtgtggtgtgtcctttgctccccttgcacgtcactcctgtgtgcctgtggacactgctctcgacagcctcccgacccaaggaaagaaccgcaaggactttccagtacacttccacctgtggccgccctcagctgtgggttagaaataaacactggacctacatactagagtgcctggcctggctcagacgtgggcgtgagcagtgttgctgtttgaaagtgaaatctgaagctctagtaactcttgggttgcttagtttcagctttccacatggaataaataaaacaaaataaaacaaaagggaggtgaggttccgccctctgagatacagactctttaaagaggatttttattattctgaacctagtttcatgagaaaatatgttgagataaataagatcaaacaatcaaatgatgccagtggggatgaaagcacatacgttcctagtgtagccattggggtatcttctattttaaagactgcttgtctctatttttagttccaccagaaacataattgttggcacagggttggaatgtattgtcggtgcatgcctgtgatgtcatcattgcaagttaccctcaaaaactaagccagagccccaactcagcccgtgacctccgccctcagctacagaaacagctgtattcctgtcgagcctttgctgaggagctgggcttccacagggactcaagtggggaacgtgttgcagtgatcatttttctaaaattcctagtaatttctcagtgttctacagcagagaacaggaccccgtgtgactgacttcagattggcttctctttgaagtagggcttcctcactgtccatgggctgatggtatagctttaggtctctctgtaagagacgccgttactgtcattacttcacgccttaaggaatcaagacctccaccagtctgttactccttcaaggtatgcttcatggatgatcacgttagagactgttgccatcttgtgtgggtaaatgatgtcatttgtgagcatagaggtgctctgctgtgaggatgtcatgcctaaacaatgcagtggaaatccagtatacaagttcagatactggtatttctagacatggcttagtcctgaaagaatttccttgctatgcattttaaagtgtttgtagatggattaatatatttttatgcaatgtattttacacttatttctagaccaaactcttcagtggcttcttcaagtgcattattgggtggataagagcttgacggcttcactaactcgaggagcgtggagccaagcgtctgggaagcgtgtgtgttcctactgtacttgcaaacctaaagctcttccaaagctttgtactttttttccatgaaacagattaaatatttttctctccaaagttgtgtttctgtc

SEQ ID NO: 26232 - DNA, 1257 bp, Mus musculus
aaaaagttttattttctttttcattaggcatctcctatgtcctttcatatatggtcaagactgagcaaaagcatgtgtaagaaatgcatttatgtccaagagaacctccactgacttagggcgcgctcctggggtagatttgtttctgaggttcttctcctcatagaatacgtggaggagagaccctgagacgacagtgtgtattgatcattgttagttacaaatgtaaatgactatttatttagtaatattttggtatccttgggcaagaagttggtgtgcgtgcatgtgtgggtccacacacttccctggctttcatctgaaagtgagtgcttgggactcctttttttccatcccacttgagatttttgagtctgttcattttcaaggcttgaacatggtgcgtttggacacaatgaacagttggtggtggtttggtttggtttctccataaccatttaaagtgactcactcaatcaggctacacaggtcatttattcattaagaaatacatttgcctaataaacactaataaaccggcacgctacgggtgtcatggttatcactctccagtcccttggcatctgtgctctcatgacagcagcaggacgggtcttcaggccttactctcaggctgccctttgtcactgggctaagaagagtgctgttctgcttgcacaggtagatgagccaagcgcctcagcctgagctcgggcctggggaaagtgctgttcccatggtgctctgcccaaagactgtaagaagacactagacttttagcatttcgtaaccgcttgactggtgcctgttccgtgctcctgaaatgagtccaatccagtcgggcagccttctgaagtcccttgtacaggctgttggttattttctaaatatttttacaagaaaatttagtcttaaatttggaagaagaaaccccccccttgaaactatcaatactgtaaatgtgacacatgttgccctggtaaggatatatataaaatgacattcatgctttgggactattgactctactgatctctttttcaagaatttttttcagttcattttcatactgatattgttaacacttaacaccaattggtggcactagtgactgaaaattgttaaaggtgaacaagagaaataattgaaaaaaaagcaaactaaacaagaacttagttgcatattgaaatgtatgcatatggctatcattcatgcctgctgctctcttcccttcccgagtgcagggctgtctgcgtt

SEQ ID NO: 26233 - DNA, 1129 bp, Mus musculus
atagtcattagtacaagggtttaaaaacaaacaaacaaacaaacaaggtaaccaccgtcctttccttagtgacatcagcctgtgaaaagtcttcctaaagagaggcgttcatcatgcaaccgctcaccattttcgcaacacaaagagaaatctagaggaattataaaggttttcggttctgatctgggcagtgatcacccctgtgggcctagctacttcgaaggctaaagaggatctcttgagctcatgagttcaaagccagcctggaaacatcttaaaaccccatcacaatcagccgccgtcacggaatagccttgggttgtggtgtaaggatgtgtgtgcgtacttaaatcagttctgagtttactgacaaatagacaggaaagctggctgtagggaattagccctggctgggcactgtttgtcaggtctccttatatgacataggtatatttttcacatttgagttactaattaaaattttaaaatctttagtgatgtaaactatgattttaaactctgaacttaaaactttcctgtggatttgttatattttaatatgtgaaatggatccagtcattggaacagatgtgtgaagctctggggctgaggtgctttctgccatgccttggttttactgacattgtgtacaggggaatgtaaagggcttgggcggaggctcctgtgtgcccatcacatcaggagatgctcagtttcctcaagtgctgtttctgtatgatctttaacacagttatgtcttcagccgaagggactttggagctgaattgtgtatcttgttggatgtttacagtgtttaagatgtacgtttaaatgttgccaattgtagtatcagcacttctgtcattgaaggttttctcagttggtagcatcttacctcccagaacctaacacaccgcatcctgggaggctgctacgtttgggtttgggtttttggggttggtttttattttttgttttttggggggttttttggtttgtcttttcctcttaaagaacttgggctttaggatacatagctttaaagaatggtatgagctctagcctggcatggccgctcatgcccatcatcccagccctcaggaggtgacggcaggagagtattacagac

SEQ ID NO: 26234 - DNA, 1121 bp, Mus musculus
agtgtagagtttgttatgaaatatttttactatgactccttcaacaactaaatacgaactgcctgttctctaaacctcaaggagaaaaactggagttaatgggtaataaggtgcaaaataaaggggtaaggggggagttttctatctgtcctgttctctgttatctccaagtcctgattctgttgcctccagcccgagcctcctctcctcttctctcccgagacacagcctcacccgtcatttcattctctatccactgtctgtcacctccagcatggaaaggttcagctggagacatttctgaaacagactactttactttgaagcaaacgtcttttttttaaagattgcttcaccaatgatgctgtcagatatatctgctttctcaagtttaaaagaattcaaattaacttcctttgagtctttgttaaaagagaaaataaaaaaatctcaagcaaacttggagtggcagtccagggcatgtcgcaggagcaggagtggctccaagctgtgctctccatgaactctggctctggggagatttctagtaactcttcaatctgtactttctgtgcccgcctcggttttgagttgcattttttttttctgttgttagacaaaccagggctttgtatgcttgaagttcactgttttgtgcccccctttgaagaactttctatgcagaaatagatggtcagggtttcggatttgcagtgatgtgtcttccggtggcaatggacagggaaggagcacccatgtccactggaacgggagaacaagccttcggcatctacagggttactgtttgcattttctacccacaagcagaaggagacagtgacaatgggcagtggatagccctcactcgtgagtgtttaatgttgcagcaaactcaccaagaaggagacaaatggctgtttcgaatggaagctttctcagcagacaatgtgtgcacagtaaacttcagcagagtccacttgttctcccggaagcttaatgtaattgaatggcagttatcactaaataaaattcttttctgagtctctcccgagagtggcagtcctttgaatcgcttcccagggtgaaagatggaaagagatgagcctaaggataccaggttc

SEQ ID NO: 26235 - DNA, 2273 bp, Mus musculus
ggagacagtcggggggggggggcagtcaccagctgagctgtacagccacagccacggccgcggcatggctcggagcttgtttgacactgtgctcagtctgtttttctagggtttcagattcattgtatagcttggttttgctactaaggaacaaactaccagaagatgaagagtggcctcatttccagaatgttcatcattgtttaaaaaaaaaaacaaaaaacgaaactactctatatttctaacacaatgggaatctttctcggttccttcaagaaatccgttaagtcagaaagagaaccagagtgggaggcagcggtcccctgtgtggccttccttccgtggctctgagcagcgagcagtggttccctctgttgtatttattgacaagtttctgcaagaatcccccacagctcttcctccttcagatgttgctaccgtcgactttgatggtggtgattttgagataaggcattgagaggtacaggtgtttgttaatgttctcatagtgctctgtgggctaccagtgaggtgagctctagaccaaaatactcacacttcgcttctcggctggacctatggcgcccacgccatgagctcggcaaagcttctcccctgcgtgtttgctgctcccgacgatacgcttttcccaagttgtcctaatgacctgccctgcagccagctcaggttagcctgtttctcatctaagtttaattcctttctcatatctaatccagacccagagtcagcacaagtcacggagctgggtttgagttgatttaaagaaaccacgagccacacctaagatttttctcacagtctccgagactgcaggatttcttccatagactgtgttgagtggaaagtaccaccttagcaagtggttgtcagactgagttccagcctgctttgtgtttgtagaaacaggaaataagcatgcacattgtttccccactttctaacaatgtagtctggtttcttttcagtaatgagccatttttcacttgaccgaatcagatttgtcttcgccagtctctactgttgtgctcacataagtatgtaatgttctcataacttacctgtgcaatatgaagctgtagattcacagcttttggcctaactgtatattattgtgtgtacatgtgtgtatatagacatgtgtgtatatgtatatatatatatctgtatatctataaaaggaccaaagtcctcatagcttgcttacactgttgctagtgtaaagattgttacattcaattttacagggcacaaattatagaattatttcatacttttcatggtaaagtctccataagttattacattactatctagttaccatttaattatgaagtttaccgtgtaacagaagaagttacggtgaaatgccaaacccacaaactatggtaattttacatttttggttgatcaataaagtaagatatgcatgtcatcgtaacacttagataatcctcttctgggccctgtaaaatactgtcactgatactctgtcggcctcctgccttgtttacattaaacagaatatttggcatatttttccacgcgccatgtgggtcactagcagtgctgtgaaggtctggattcccaggccaccgatgaggaagctcttcgggtgactgtgtgcccaccgtcccctccgggcaggtggacgtcagcttcagctcttgcgctaacagtgcatgcaggacaaagagggaaatcaagaaaaataaatcaatgtaacttaaacagaacattgtcgtatatttttgtagaattctaactgaaaacgttttacccactgctaagtgtgagattggtaggattcttcctagctttgacatcttcccatggatatggtgtactctggtcacttttcaccccgctgccttgtctcatcccctgcccactggctggacactttattcccgacacagatctcctgggacttgtgtcctcttgatccactaaagttagacttgctggcacgagcacacgagggtgtgaattttcctgccccttagcagaggctaccccactgaaggacgagacccaccagccattcaccaggctccttgaggagagtgaggagtgttgacaggttcccaggtgaaaatgtaccatcacgccgaaggacacggcaacagctattctcttcaccctagcgatcaaagggacactacagccattgagtcccatggttacccttcatagggagaacgccacatatcatctgtgggagagctcagcacccatcgttgccctgggtcaat

SEQ ID NO: 26236 - DNA, 1426 bp, Mus musculus
caccaaacaggggcccttcacacttgcacagcacgccctccccgaagacaggtggaccatcgatgacatcgaacagtccctcgagcgctgcacgtctcttctgccggaggagctgacatttaaaaaactaaaatctgacaactccagtgaccaggttataagctgtggatatataactctcagggacacaaagagagaagatgacgcagttaagacactgtgaggccggcctgggaggatcatttcctggttggtgtctgtcccgaccaggaatgcccatacacctcttgagttctttgcaagatgtcttaatgtctctgaatgatggatctgattggattcagataaataagttttctgaatttgatcttcccttagtctttttcctatgaaaaagttaaacaatattctaatgacagaatcctgaagtctgagctgcaggttccactggtctcacagaagtgtcaaacttgctttgcttagactcggggagggggcgttcgttgttttgaaattctctgaatacatttgaagtgttcagtgtcgagctgtcctgtgtgtttgcagagcctatggctgctggaaggtgctggtgggctgtactcagctgtgactgtgtttcttaaatcccgggaatcaatacgttgtcctaatacatatctgtaaatgcacaaactcctgctttggccactgacagaatgtaaatagcgtgagacgtgattcatttcagatcctgtattcagcagagctcagctcctgtagccgtggactgtggcagctatttctgtggtcaaccacatggtatcaaagtaccaaaaatgtgattttctagaatataaactaaagaatgtatcttgaattaaaatgctctcctgcctgttcgttagcgcctctctgtgactgcggaaccctggtccagtgacatggtttctgtagttatgaagaatatgatcacattttcaaacagcagattttatgagtgcttcattgttttgttatagtaatatctattcttttattgtgtgttttgagttcttgaagacaaggaaactgaggacactggagaggcgaagacacactgcctgtccagcaggcacggagtgtagattctgcacccacccacagcaggcggctctcgctacttcagctccaagggacccagcacccacttgtggcctgtgggcccctgtgaacgaacacccatgcctccacacacatacataaaataattactttaagatatcgagatttaacgcaggatggccccactcattatgtagccaagactcctcctgtatctacctcccaagtgtagaggttagaggcataggccactgactcctgcaggaatgtggaaaggtattgtacagctgtggcaatagtcaaggcttccctcatttactaacgtatattttcaaaaagaaga

SEQ ID NO: 26237 - DNA, 1332 bp, Mus musculus
caagtgtaaattctcaagtgtttattagtagtggggctgtgtattttaagttagttaatcacttgccaattttgtgtcctcagaaagtgctttgaggctttttccaacttaaaattttaaactaaaatcttttcattttccatagtgatagttgtagataaatggcatttaaagttcagctagagaagtcaaatatggcttatatacagtgctttccacacgagactcatctagttctgtgactcagcataacagagctgagcaaaagatacagaaagccttcccccacattagcatagctctccctaacaacatttgccagaatgaatggtgtgcctgttaaaactggcgaacctacatcaatagatcactgctacctaaagtcatggtttatattagagttgtattggttaaaggtaccatggcatccacccaccttacagtatagcgcagaagcgtttctcacaccctgtactccgcctcgtcataggtccttccctcagctgtcagcagccagtgaccttcttctgtctccgtagttttggctcttctgaatgtgatatggagtctctatggcactcttggtgtattctgagaagtttatgcggtttagtagtgcacaagtgaagatgggtgtgctctccttaagtgatacaatcattgataccatgttgtacatatgtggtctgttgttgatggcaacattgttctgtgatgggtgactgtagcagaaactatgtagcatgtagggttaaggggtaccttcttttacttggcattctgtgttaaagtttctctcctgtgctccagtgacttgcagcccatttatttgtagaatgagcaatgttcattgtgtggatgtactgcagtttctctgttgattcattaggacctctcggttccttcaggtatttttaatgtaatatcatttcttttaattttatgtatcttttggaacaggattcacaatgtagctcaggctggcctcaaacttttggtgatctatcatagacccttgaatgtatagaatttttcaaatattaaatcacattaggaaaaaggtgttttggaaaacgtttatctcttaagtttatctgtaataattggataaagaagatattttaaaactaaataaaaatcaaaacataaaaaatttactttatgttcacgtgtaaagaataatcagtttctcaggggcctccaagatgtggcaatatgctatagcaactgcctcaatccaagtggctttcagttttttcctttatgtgactttctgaatccttgggcttttgttagagcaacataagtatttaaaacttgattgagcagaag

SEQ ID NO: 26238 - DNA, 1191 bp, Mus musculus
gagggatgctcagatgcccatgtttttggtgctggaaaacattgaattgtcgagagtggcaagaacggttaacataggtgatacaatgaaagtgtaaccattggggacccaggacattcagatgttgagcagactgtccatgagtgatggcagtcagtgtacggtgttgcttttctgacatgtgggagccatatgttgttaatacttaacacagagtttctgatgtgttttaaaacaaaaatatacttaatagagtatataatgtggacatttaaattaagacacattaatggaacttatggaaccatggctaagctttccctttcgttaccattgatggagtgtgcggtgagcagtttccaaaatgtagtgtgtgagtaagttaaagaactgatgcaggctgccgagaaattcctattctgtgcactaatgtgtgcgtttaactcacaggaaaacatctttatgtacggaggcagaatggagaccagtgatggcaacgtcaccgatgaattatgggtgtttaacgtacgcagtcaatcatggagcacgaaaacccccactgtccttggccacagtcagcagtacgctgtggagggacactcggcacacatcatggagctggacagtagagacgtggtcatgattgtcatatttggatattctgcaatatatggctataccagcagcatacaggaataccatatctgtgagtttctttaaaaatgtaatttctttaatggttgggagcatccttattttaatctcctaattactttgtcaaaacgttaagttattttagattggaattataaggcaattatgttcataatggttttttgaatataatctttttaattattctaaaatgttgtccttgaatacttgggtatcatctctcagccagatgaggggggtgttatgtgctcattttccaatattttaagctatgatgcattccagcagagggtgctgttgccttggattctgcctatgaacccaaagctgaaattacctcatgtctttgtagcttatgaattttagagttttcatttttggtgtcacgtcttattgctaggactttagctactttaaggtagattttcaaggataaactgttgctttctgagagaggttgttgtttagtgtgtggaggtgacttgattttctctattgctgttttttttttgtgat

SEQ ID NO: 26239 - DNA, 1106 bp, Mus musculus
gcagtgtgtgcatgtgtgtacaggctgcagtgtgtgtgcatgtgtacaggctgcagcgtgtgtgtatgtgtatagcctgcagtgtgtgcatgtgtgtacaggctgcagtgtgtgtgcatatgtacaggctgcagtgtgtgcgtgtgtgtacagcctgcagcttgcttatggaagggagaagatagcttggggtagctggttctctcttgaaccacatgagttctgggactggacttagcctgacagacatgacagcaggtgtcctgactcatggagctgtccctctggacacttgtattgttttcccaaggctgcagttacatgtcaccacgagcctcatgcctttaagaaacaggaatgcagtttcttacagctgacactgagaatgcgcagcgttctggagaacatgcagcagaactgagatcctggcagagaccctggaagtggtccctgcctttgcagtgtttcgtacatctggggctttctttgctgtaactatatccttctaatctaaatttcgtctatgtgcgacttgctttgtagagactccagtcagtgaatttagggtccgtgtgaatctaatattaatatggcctcatttatataacttaaattgtgacttcattttatcttagccacaaaccatttgcagagactccatttccaaatgaggtcacattctggatttgaagatacatattaactttggggagggtactgtacattcaatgaataccgtaattcttttttctgtttttaccttgatggaaataagactcatatttatgttttatgtcagggttgctgattttagtaattatctgtgttagtattttttgttcctttacagaggttggtttagattctacatgggtagtgtgaataagatccttctgggttctacggctttcagtgtcgtctttttgtggccactgcgtcctcacctcggtgaagagcagagcacagtgactcttctttatcagtcctcagacttaaagaaacatttcactgtgtctccagtaagagctgtgtgtgtgtgtgtgtgggggggggaggggtagaaatctttattagggaggtttagtaaattatcccaataatgccca

SEQ ID NO: 26240 - DNA, 1237 bp, Mus musculus
attctgtggtgcacaaaagagggttacaactcatgaagtaagtcaacctcagacctccacattgcagccataaacacacgcacgtatacatacacacgtgtgcacccacacacacatgaacacgcatgcaggcacgtatgcataccacataaatattcgttacactgatgaaaaaaattaatgtagaataaatagtaaacatgttgggggttggttctaatgctgtttgtgttcattcggctcccaaaatcacacgagaatctgcgggttcagatgctgggggtccctgcccccagttggctctcattggtgaatcaagttactggcagccaatggctgggtagggagtcggaggcgggattttaggattcctgggaaaggatagagaaggaggaagaggagattccgccacgaggatgacataggagatggaccacacaggaaaaggtgcaggagggagcgcccaccgacaggtaggtgaaggggaaaacagccccaggagggctccccagcaaggtccggggcagcaaagataaaatatagattttagaaagtgataactcaggaatatcggaagggagtgtgtgttagtcacatggagataggaagtgtcccagccattgcgctgcttagggtatattaaaaataagccggtgtgtgtgtgtgtgtgtgtgtgtgtgtgtgtgtgtgtgtgtgtgtttcattcggggactccagagcattgggcagcagcgagaagcgcagctgcaggcgggagtccagagcagattaacaatttactgctacataaacacacaggcagaatatgataaacacctagaggataacatgggagaaaatccaggaggtgaggttgatgatgaattctttagaagtaccaaaaagcacaaaccgtgaaaactaactgctgaggccttaatttctatttttgttttatgaaagataattctaatgatgaggtcttggttaatttagataatgctcaaagaataaaagtgcaagccaagaactgtcataagaaattttgtaacaaaataccatcacataaaaacagtgcaacaaaaaaaaaaaaccccaaaagaatggtttccaaatcatacaaagaaatggaacccaaaagaagtgtactgccccatatgtaaataaagacagaggtgtcaaatacatgtctaaaagttccgcgatcactgtgtgttctcagaagtgcacgtgaaaataacagggagggcttcagtac

SEQ ID NO: 26241 - DNA, 1222 bp, Mus musculus
gtatttagtgatacatttaataccacgcgccgtgtaatttcaccccactcttgctttctgtaaagatctttccccagtctatgtcaggattctcctttctccccacagacagtcttctgattgactaccagtttaccttcagcttgctgcaggaagatgaccggcaccacactgccatcaacttcatcgccaacccagagcaggtaaggagtcgccggctcctacacagaatgcccctcctaccgaggcatccacgttttacataatttttcttgtgatttcactccttagggctattacatagggggaattctgtagaaattactaaaacacttaaattttccttttgtaaaacttagatgattgtcaagctagtatttttgatctctactctcctggtttaaattatattatccacagttttacacttaacattcaggaacttcttattttcaagtaaaaaacacaagaattcaaggcgtgctttccagactgctgttcgcatgcactaaagcgtatcattggttccacggacttgtttctcagtctcaggtctgactgagcgacacacacaccagcttcaccttggtccagttctgcaggcttctgaatagcaaacacattcacaccaacagtaaagctaaaaaaaaaaagcatatgtttaagaaaagtcttgtccatttttttaacatcaaacaacctaagcatattccctggcgctcatctcgcatgagaagcatctccagggatactgtgtccagggtggattttcttgcctaatcctttttaactgagaaagaatcagggacaatctgtaaagttaaaacgactgatgacttaacctggaaaaatgagcaaggagatgactcagcatttatagactcccagcgtgtttacagcagacatcggcttaactcaccggttattacctcagtttggcacgtccgtatgaaccgtgtctagagtgcgccgtgactgtggagagctcccctgtaggttaaccagctatcacagctttccttgctgcgcggcactgagtgcacctgtggcttcagttttgcgactttgcatttcctcagtggttaagttttgaatttgcagagggcgaactaaaacatcaagacggtcttctccgccgagattgtccattttgttgtgaacttttaatacttggtctcctaatcaccctacccagaataaagttaagcacaggatatgaaga

SEQ ID NO: 26242 - DNA, 1109 bp, Mus musculus
ttctattatttattgctgtagtaaaggataatatatatatatatatatatatatatacacacacacacacacacacacatatagttattttttttgagatcataatgtaattacctcattttatttccccattccctttcttctctcaaacctttccaaacacccttccttgctctttcacattcaaatttttcatggttacacgcatatatattcctgaagacataaaagcactctgctcagtctgtataatgatgtttgtatgtatgcttccagagcacagctggtgtggttgaccagttgctcttcccaggggaggccatctgctgccccagctctccttccgtgtctgtggttcctggtgtaggtttaccacctactggcccttccctgtccactttagtgggttcatattgcccttgttcagcttatgtgtagggtttgtgttggtgagattttataggcaccctttcttaagaattcccaagattctaagaaggagttgtaaactcatacttattttggtgtagctcttcaaaactttatgaccctttctaaagtttattacggtaatatagaaaaatcagcacttcagtaagacatttggcatacaagagccaagcttaaatcatagacctttaagtgagcatactgttaaactgtttcatgcaatatatgtgtgtctgcacacttcatatgttggcatagaaaggttatatagtgggaaggttgttatattacttatttataaatttttatcttttttgttgttaaagaatggtgttaatgtctgtctctcaggcggtggttgtccactgtgtctgtctctcaggcagtggaatccactgtaggtctttagaatttactacattgccctaactggttttaatgactttgtagcattgactctttagctaccaatagctgaaatgaccagaatattaaaattaagtttacagtggtcaagatttgaaaattatgtgcaccttaaatcctgagcagtcattatattatctggaaaccttctttgactttcttcgtgactaattactgttctctatcaacattttctattcgtgcaaatatttttttttcttcaaaaatgccca

SEQ ID NO: 26243 - DNA, 1202 bp, Mus musculus
tctgttgatttagctcgctctctaattatggatatcttgagttcatcatttgatatcttatcctgagacatttagctaaatggtttggaagggaaacttaatttactgactaaatcaaaagttgtgtggacgcacagagattacgatgtgttttctcttccagtccttccactcaggaagggcagctctgagctcatctcctcatgtccttgtccgttcttttcagcaacaacaactggcccaactggcagttgtttcctgacttctcatttacagcacgtcccttgtgcatatgcataaattatagacctgccgactctctcctattggataacagggttccaatgatcccccgccccccactccttagatgtggagctgacaggtaccttaagtgtcagctcactctcacctgtagcatcgactctgaaatctaatagaagccacgagtggtatgtggctgtacggtagccaacagattggttgttatctgttgtaaaggtcctccctctggcaagcttctgttgcatgagcaaccaccggagaagacatgctgttctgaagtttaggactagtcagagtcaaaccacgcagctgcagaggctcctgtcagctcagggcatagagcattatctccggatatttaatgggccaaacaaaggagggctcaaccctgagatcatttcagagaagagcacttcctggaccctttgctgcaagagtctttgtgatgaagactcattccagagaacaagacttttaaaaagcagtggacaacttagtttttaggaaaacaagtgagatgatgtaatgactacctagatatttaagtgtttcagagcaattctgtgtggcttatgatcatatttgttagccttgtaaaacaaataattccctttttgggagggaagtagaggcattttagatgtgagttggtatatagaaagtgaaactcaaaatggctgattactgggagtatgaggaaacaatatttttaaaatttatctggcttctgaattaaatagtatgatttcactttctaaagctgtttgagacccattaagagacattagcgcattagcccttttagaatattataaatctttgaacgggtgccaatggataaatttcattgagctgagtttgttttaagaatatataattccattttatcccaaagagcttaccaaatcaagtgactc

SEQ ID NO: 26244 - DNA, 1201 bp, Mus musculus
ggttcacccaggctgtctcttcctaacaccagggaagccttatgtagctgagccagactcttcttccaatctctctagccagactaaccttgtcagccatcatgggtcctggtgtggcctgtctccaaccctgtttttctagagttcaagtcctccaggagactccagttggcagacaccagctttgtgagattacccaggctgtttaaacacagtacccagctgggtggcatcaccacacaggaagtccagatctgtaggtttcgtttgctgggaccaaataactaagatagaactcaagggagggagggtttactgaggctcagggtttgaaggttaaggatgcatcatggtggagaaagcatggcaggcaggagcatgaggtggccagacacattacattttcagtcagaaaacctagggccctccctgaagtgacatgcttcctccagggaggctccactgcctccgtgggcctcaccatttcacaataacaccacttggaaggacaatgttcaagcactggtgtcgccacaaaccatgtggccttcctcctgtcactcggcattcttcctgtgtgttgacacactgcctcaacagggacactggccacgttggcactgggagctcactgtgcttcaacctgatgtcatcctaaactaatcaagtccgcagagaccccgtttccaagtcaattgtattctgaggtcgttgtttctaagcaacacagttctgtccctaggattggcttcctgcctctttcctctgactggtggctctctgatttcatgtggcagctgtcagaaccaaaaggaatcagagagagactggagggggaagagtctgtccatgggcagcaaaacattcagagactcgcagagcctaaagagacagccttttctgggagttcctcacgaagcaaggtcatccgtgctgcacagtgcatagctgagttctctgcaggggaaaaaaaaaagcacacaggggttacgggatgaatatgaattggttcaaaggtatttttagggccagaaagatggctcagtagtaaagactcctgccattaagcccgatgacttaaattcaatccctgggacccacatgatggaaggagagaaccaactcccgtaagttgtgttgagtgcctaaatacataaaaaaataaataaataaaaatacctccaaaaacatattggagttt

SEQ ID NO: 26245 - DNA, 1283 bp, Mus musculus
attaaaagcaagactataacataaaaaggtaaattcattatctgtaagacccacccccgggacaatttttcaccatttccctcaaaataacatgtaatcattacaattagtaagggtaaaacacaactatttatttaaactggatgctgaatccctaagtgttatagcatcgccacaataaaaccatttaacaacaataacaaaaacaaaaggactgaggggactggtgaagaacttagtgttaagctgcaaagtaaataaatgtctctccatcctgaagcacactgttttcacctttgttgcttaagaaagaaaacctacttaacaccaggaccaatgtgaccattgtagtccccaatagcaaagaataccttgaacctggtctgctggccagcccgagtctgcttctgcacgggcatgattttcagaacctcatcctttagggatgcacccaggactctgtgtggagaggctactgggggaattggcaagccccacactgttccatgcaaggtgacaggccgctgtggctctgtgctggtgcgtctcatccctgcccccagaggcactggcattgtctctgttcctgtgcccaagaagctcctgatgatggccggtatagatgactgctacacttcagccagaggctgcactggcaccctggacaactttgctaaggccaccgttgatgccatttccaagacttacagctacctgacccccgacctctggaaatagactgtcctcaccaagtctccttatcaggaattcactgatcatcttgtgaaaacccacaccagagtctctgttcacaggacccaggctccagctgtggctaccacataaggattttgtacaagaaaaataaaagaattaagcctgctagagagagagagagagagagagagagagagagagagagaggaaggaaggaaggaaggaaggaaggaagaaagaaagaaagaaagaaagaaagaaagaaagaaagaaagaaagaaagaaaacctacaaccaaagaaaacacatggttggccttgaggttccagctgcatatgtagcagaggatggtctagtcggtcatcaatgggaggagaggcccttggtactgtgaaggttctatgccccagtgtaggggaatgccagggccaagaagcaggagtgggtaggttggtgagcagaggaaagggggaggggatagggggtttttggaggggaaaccaggaaaggagataacatttgaaatgtaaataaagaaaatatctaatataactaatataataaat

SEQ ID NO: 26246 - DNA, 1201 bp, Mus musculus
ccctttccttgcctctccgttcctagctgctctttctgtctgttctcacatgggacggtgagaattggggcctggaaaatagaccatccatgcctggtgtttggttacagaggttaaacaggatgccgcacattagcacatctgtgccaccttgccacataccaggtgcccagtaccagtggctgaactctgccttcccaagtggtccatggctgcagaatatgtgtaattctcagcctctagtcagtgaacctactaagtggagatggagactggccactctgagctgtgcttcttcagagcctgtcatagaaggtccttggggcatcctggaacaagaaaactgacaggattggctctgctcaggaaggaaacatggagaaacctgggcttattcaagcagtttcctttgtttaccctgcccagggttgccagtgaaggggctcctccatcactaactaaaggtcttatcctatgctggttcctctccaccccaccatgccacagtgtatttctttctcttcctcgtaggtgatcttttccccgggcttctcattgttctggggactgttgtttattttctagtgccttttccaggtgtgtgtgacttgaactcctaagaacaattctaagccctttctgggctctgcctcctacacccacctccatcttagaatcttggctcttgaagccactactgcagtcagcctcctctgagggagagagattgttgtgtggctcttgtaagtgtgaaaaaaacagccacttaagagccttcttgtggatatgaagacaggtatttaaaaatcatggggaaaggattagtggtagagaaaaccttctatagcatccaagtaaaaatggaaaaaataagctatttagttacaaaaactaaaacaaacaagacacttgtaaagatcacagagcaaggatcacgtggctgacagcagtggagtttgcagtaactggccaccacagcggggactctgggaaggtgaaatcatgctcagttaattttattctctgaaaggcagacctgacttgtgttattacattgctcagcccttgagcatttctttgagcaacattcagtgttatattatgtaagcttgacaccaagaagaaggtactattgtagatattcaatttaataacagggctctaccactcaagttgcatgctggatatcacatggcttaca

SEQ ID NO: 26247 - DNA, 1199 bp, Mus musculus
aaaactggagggtcttcaaggccctcatcgctgctcagtacagcagggctcaggtccgcgtgctctccgcaccaccccacttccactttagccaaaccaaccgcacccctgaatttctccgaaaatttcctgccggcaaggttccagcatttgagggtgatgatggattctgtgtgtttgagagcaatgccattgcctattatgtaagcaaagaggagctgcgaggaagtacgccagaggcagcagctcaggtggtgcagtgggtcagctttgctgacagtgacatcgttcctccagctagtacctgtgtgttccccaccttgggcattatgcataacaacaaacaggccactgaaaatgcaaaagaggaggtgaagcaaatcctggggctgctggacactcacttgaagtctccaacttttccggtgggcaagcgagtgacactggctgatatcacagttgtctgtaccctgttgtggctctataaacaggtcttagagccttcttttcgccaggccttccccaataccaaccggtggttccttacctgcattaaccagcctcagttcagggctatcttgggggaggtgaagctgtgtgagaagatggctcagtttgatgctaagaagtttgcagagagccagcctaaaaaagatactccaaggaaagaaaagggttcatgagaggagaagcagaaaccccaggctgagcggaaggagggaaaaaaggcagctgccccagctcctgaggaagagatggatgagtgtgagcaggcactggctgctgagcccaaggccaaggaccctttcgctcacctgcccaagagtacctttgtgttggatgagtttaagcgtaagtactccaatgaggacactctctctgtggccctgccatatttttgggagcattttgataaagatggctggtccctgtggtatgctgagtaccgcttccctgacgctgccatatttttgggagcactttgataaagatggctggtccctgtggtatgctgagtacggcttccctgaagagctcacccagaccttcatgagttgcaacctcatcactgggatgtttcagcgattggataaactgaggaagaatgcctttgctagtgttatccttctttggaaccaataacagcagctccatttctggtgtttgggtcttccgaggccaagagcttgcctttcctc

SEQ ID NO: 26248 - DNA, 2626 bp, Mus musculus
tttcctcctggttttttaattagtgttaaataagatcctgtctagattcctgaaatattttctttcattttcatcacggttataacagcaaatttcttgcatgcctaaattgacaataatcattgagggaacaggtttgagtcttcttccttctacgttttgtggtttgtcagctgtacttccttgatgtttttgttatacggggcttgggggatttttgtttaattttattttgcttttattgttgttgccaaatgtaaatgaaagcagaccctacagctttaatctgttatgcttatataattttttttacatatattgcttgcttcttacgcttctgcgatatttttaaagcttttatgcagttgaaatgtagtaaaattacagtgattaactaggagaggttgcattgaatagagaataagtgcaaagtccagttggtcaagaattttgtaggcaggataataagatttcattacagtaggattttgaaatatctttcaaatgttgatgctttccttttaagtggaaattacggacactcatgatgacttcatctgtggttctctcataggacataaagcatatgcaaggacatttacaatcgcacaggacttattctgaaaatgactgtattgataactggctttgtttgtatgatgtggagagcaattatacagactatgtttactacatcatctggtgtcttgtggccttaaaggactgtcggtcattctgaatactttagtagttcagaccatctttattcattgtaaagaaaactaaaaatagacagtatgcatagttcactaaatgaaggcctgctatgacaaaaatgaaggcctgctatgctattgggcccatctagtggatgctggtaatgaacaactgagagaaatatatgaacttaacccctattgatatatcttaaaagtctaagcttgttatacctatagaatagaaaagtgttttccccctttacaggtaacttctatgataacacataaaccaactaaattaaaaaatatatggaatagctctttggctgcagaaaaatgaatagtataatagtaaaaaggcttgcccaggctgtagcccaaactcccaacaggagtttcaggtcaagctccttagtgagctgtatagccacaggcaggttacaaagggttctgcagcttccccagctccaaaggtccttacacttctcacaggactgttgtgaggaggacaggaacatcactgcaaaggcgctttgaagagtaaatgctgtaaaaataagaggtattccttacacaagaaaacatttctgagtatagaaaagttactccagtcataaactcaatagctaactctcacattattaagtgaaatattggggcacagacctacctttgtcaagtttatagcaaggctacatctgtgtaacctcacccccactcttttactgtttatttaagcatgctcacagtttaaaagaacaccacaatagaaggacttcccacaataaatcccagaagctaaagtgttcctccattttacacttgaaacaatctgcccaatgtatagccgtgtttcatcttgtaaacaataacttgccattgctaccctgaaggtggtatggctgtaactggctggtgtgttgatggatcaaactatggaagttttagtggtgcccaagcatgctcctgcactgatgcatttggaagagctgtagaaataatgcaaagctttagttctaagaatctactcatgctttaaagtatttatctctgtagaaccacaatcatggaaagctcaacagtgctgctaatcatgtttgtaaaatatacctttaatgtagtgcaatatttttctattgggagagacagtacaggcatcacagttgggagctccaataccctcaagcatagtaagggataaggcttcaatttaagagattgtgttatattacattactcatgtaatcttgctgccatgctatgttatcaatagctaaaataataataaagactaccacggaaaataagaatatcttcatttgatgacatctaaaaacaggtgattggttctctggcattattacctggtataatctggccatgcagacaagctaacgatccacttttactaaacaaatatgtagacctgtctcagaaaagaagaaaaattaaactatttgaagtgtacgctcttcattgtttttaagttgaatggctgagttagacaaaatgaataacattttagtattattttgcaatcatttatttgtttttttttttttttttttttttatttatcgtgttgcttttttgagacagagtctctttggcttcaaactcagtagagatctgtctgcctctcctctggagtgctggggttaaaggcatgcaccaccatgccaagttttactatatttcttagcaccagacttcgttcagtaacactagaacttactgtgtagatactttctcattctaagaacaggctaaaactttgagagtaaaatctaccttaaaaaaacaaacaaacaaaaaaacaaaaaaaaaccctataaagacattttaaacatatttggttctaataagtaagatagtggagtttaatttttaagtcccctaaagttttt

SEQ ID NO: 26249 - DNA, 1150 bp, Mus musculus
cttgtgccaggtcttagcttgtctgcccttgttcagatatattcatggacttctttcctgttccattcctggagagttccctgttgtttcaagttctcagtgtcagtagctttccgctgtacttgatggatgtgaaacactcatgggaaataagagtgaactagagaaaccagggtattcttcctcctggcagctggtttatccttcttggcccactcttctcacaggacaaaccaccattccagtttccaccacatatgtctatccttcagtctgaggttgatagtgtcctcttacttttgctggtatctgggttttatcctggaattcagtttttctcttacccacaagttactcccttttgctcttggtttcacatatttaagaattttcacttgccacagcaatgtcacctacctaccataatcacttctggggaccttccctaactgacacagactcgcgtgttaagtacttgtcacagctggagtattagttatatttgtataattgtacaacttgatccctagtgtctgcagcagaaccttctgttacagtaagtacctggataggtttggctctgcatattctgggaagactaagtctaactatctagacatcaatctccaagtaccttaccgatttttctcccagactgccgtggtttcagcatgacttttagtcaggccttgatttcctttttccttcccttgaatatatcccatctcttttaaggaaataaaaatacttaggatgaggaagtctaccaaattagatttattaatcaacattgcttatataaagagctgtttcttcagtgtgagaatcttagtttacaattgtagttcccagtcatgtactttctttctggcaggactaaaaacaaaagaatgcctcatgagtgtaattcagcataactgaaataaatgacttgatgtgatttaaaattgaactatcttcattttgtttttagttttggacaattttagaagccttgttggataataatgaataaaaaaatctacatttccagatttctctacatattactgacagtccccacaaatgatttaaaagggctttctgaaaaactgtaattttaagtaaaaacatttgacttttaaatacattaggccaggtgccttaggac

SEQ ID NO: 26250 - DNA, 1168 bp, Mus musculus
gagcgatgcacacccagtggtaactgcgggatggtgggtggagtgcagagttccaatccttcatctttttataatcagaaaacaagcagatgtcccatgtctttctacagagtcaaaatgaaatagcacagtcatggaaaaagtgtcagactctccataaactagaatttgagcaaaatatacctctctatgtcacctagcctctggtatcttgttaaagcaaatacaaaataagctaacaattcagcattgattgagtaccttctgtatacaagcactttgctccgaggtaacaaactgagaccagatcttgccttgcaggagtagagctgaagagacaggagatgacctcctgagagttcagtgcagggtcaaagagtcgtgagaatgacaaggagggagtctgctcaatttggatagcttcatatccacccctcacccattctagaaacaagggaattactggtgtaaggtgtgaaatgctggtgaacaacaggcttgaaccctgttctctacctcctctttctacaatgcctcgccactgccaggagcactccatgtgatttccctacagttagcacaaatgccaagggaatattgagcaggtgcgtgttgtattcacacctggggattagcgaaggctgcaggtgcattgtgaagcaattttaaaggcttatgttttcagcatgaggctcctgagtcacacaagaagaaggggagtatgagcactgagccaacaagacagggagcacatggccagagctagagctgcctgacagaattgcattggccctggatattttcaatcacattagatgtgactgtgcccctctgtcctagagctgcatgggcttctccaggaataaagatgcctctgtgtgtgtgtgtgtgtgtgtgtgtgtgtgtgtgtgtatgcatatatgatctgtctgtctgtctctgtgtatacatatgtagtctgtctctgtgtatgcatatgtgtgtctgtgtgtatgtatgtctgtatgcatgtgtcaatgtgtatgcatatgtgtctgtgtgtatgtgtctgcctgtctgtgtgtatatgcatatgtgtgtctgtgtgtatgtgtctgtctgtctgtgtgtatatgcatatgtgtgcctgtttgtgtgtatatgcatatgtgtgcctgtctgtatgtct

SEQ ID NO: 26251 - DNA, 1178 bp, Mus musculus
gaaatgagcatcataccactgtgacatggtagctctgtcttgcacttaatcttaatgaccacctttgcactaaagtaagtgtcactaatagacatttagtgtcttcattcttcaaggatattctgtgcatgtcagggtcactttgagatcctatggctcctgggggattgaccattcattctcatgtgtaaaccctggttgttgactcttgtggtctctggctatttactttcaaccaagaaatgaagatttgttaatgtcttatttcattttgtattgataatacacatccagcaatacttgttaacatgcattgacaacctgcatgattgggttaagtgcgatatttctacttctgtatataatatgcacagatcaaaccaagcctcacttatctgccctccccaggaccacttttctcaaaccctaccagtaactgttatactatattcctgtagaattgctaaaaagcattttgagagtcagacatggtagaactcgggaggatcttggctttcaggcccacccctgctacataacaaggccctgtctcaaataacaagacaattattctgtgacaatgtcaagtggggagtttgggtttctggctgaatgcctgttgccttggatggtttggggccatggcaagtcagctgtattctgccacaggctctcacagtgccgtggccttgagtgttaattcctatgtctaaactggtgacatcacggtgctgactccgcctgtgctttgagatcgaggtgtacgcacggtggggccggtgtataagcaggtagtgaggaggtatttttgttgttcccggttatcatcatcactatactcccaacatccttgaggacagacaccctttgctgtctgtgttttggggactcgtgttcatacacacgctggcacacatatgcatcctgcttttctggcttctcagacatattgagatgcatagctcacatttccctttcttgcttcccatgtgcctgctcccagctggcacatcattaccattgatcctttggctgatcctggccaagttcttgcctctcctttctgcctcttccctccttgccaccccgtgctagctctcagcagcccataatcttctgctcacacttcatccatccaccacctccccacacgcgacgcattccccacctgccttcca

SEQ ID NO: 26252 - DNA, 1207 bp, Mus musculus
tttaaaatgagaaataaaaaagaaagacctgctatctctaagtagctgtaataacttttacacaaagcttttgttcccccccccccccaaaaaaaagcagcttaccctggattggagaagcaggccgagactccttgctgtctgtgccatcgtctgtctctaggtgcagtaggtgtcactggtgcgtgtgggtgaagtgtgagcatgcccagtcatgtgatctcttctcagagggaaggactgcactgcaagctcgtggtgctattggagagggtctgtcagcacatactgaaagcccccattttcacagatttataactttaataatccagatgctgtccttggaggtatttaatatgcaataggtagcacctttactaattaatctgcatatgaagggtttcctgatgtatttaataagatgtgtagaagctcttcaagcattaaactaaagttgacgttttatttcattgacttttcactgtcaaagaatatcaaccacttacaatggaattgaagtctgttacctaatggtatttgggccttttaatttctgaagcttctagattgtttgtattgtgaggtacaaaaaaaatgctgcagatctaggaatgtatgttcttagcaagtgtttgaatgatgtaagcattatttaccattgaagagtacgacccctatgttcttaagtaaatgcttagtaacccatatacatttttgcaggtacaaaagtatataaacattgtataatgtgacagttgtataatttatgtactctgatgcatgagtcagaatttttatatatgataattgatttgttatagttgattaaagtgtttaaacttaattcagtcatcagaatctcttattgtaggtaaatctgttcccatcatgcatttctatagacctctttattgtctcttgatagtgagaccaattgtgttggagcatgtgttcaaaaaggcctctaaacctgccttgtagagaatatggttctgaagagtcatgcagaagtgaaatatcttttctgttaatgtgtgtgtgcataagggggagagagtgagagcacatgcacatgtgcacagggcatgctaaggttaaagacccttacactaccatgtccagcttttacatggaatctgggcatcagactcagacttgtatagcaatcctttttatccctgagccatctacctagccccagcaaaat

SEQ ID NO: 26253 - DNA, 1184 bp, Mus musculus
agcatagccagtgacttggcttccttatctgttcttagcatgactgtactttttctaggattgtatttttaagattggctttgtttatagtggattgatcataaatagaattttcaattgttactaattttacaaataattttaattactgtaatgctttaaaaataattactgattcttttttagaggtaaaattaatattacttagtaacagtaaaagcagttgatttattttttttgtgtgtgtgtgtaatgtcagtggaaataattagagtaaaagatggacatagtatctggagaatgatttaaattcagatttgcttagaaaatgcctttctccatatctcaaccatgtcattctctatgattatttatgaaaaggaaatggtctgattgtgctagacagacagttgtaactcaagataacataactttggattgtcttgttttggattggcttgtttgttttacaccccccacccccaccccacccctgtcactccttggaggatggaatgaattaatgagacaaaagagagaactgatacctgggaagtcattgtccttaggtgtgtgtttgtagtcctaagggaaagaggctttggaagtcttttgataactggcaaggccgtgtgtggatatgtggaaagtgagtcatgaacatggttaaatcctttagacttaaagcattgtattaactgatggtgatatgtacattttcgctctatgaagagtaagtgagtaattaagagccagcgtatcgggggctggatagacagctcagtggttaagagtgctgaatgttcatccagcgatcctgaattcagttcccagcaaccacatggtggctcacaaccatttgtaatgggatctgatcccctcttctgctgtgtctaaagatagctacagtgtactcatataaattaaaacaaacaaaaaacccaggaagccaatgagtatttaaaaaaaaaaaaaaaagtagtccaaatatcaaatcttagcttcctttagttgagaagaaccagtggacaacaagcaaggcctagggaagtggatatccactgacccatcttaatgaaaagatatcttcatagatgttcctgagtactgttcacctatagcgacctactttggactcctagtaggtgaatatgtgtttaatgatataggatttttttttccac

SEQ ID NO: 26254 - DNA, 1146 bp, Mus musculus
cattatgcaatgaatatgcactaatctgagataagaaacaactaaaaaagaaaaaaacaaaccgtgcattagctattcatctgttagagtttgttttttaatggtatattcttgagcttttagcttggaatattgtttgcttttatccaagtataggtttcttagggggatgttaaaattcaaggttggaatgtgacacccttaactgacatctgaagtatcaactttttctgttgatgactgcttttagtataatactgtgcaaaatgttcatttttaccagaatttcaagcagaaatcatagggaaatcttagagaaatggctctgttgtgcttttattaccacatggaaattttccttggcttctgaccccaagaatatttggaaggaggtgtttgttctttcccaaaggaaatgctccctctctggtcccctgctgcttagctgcagtcactgcctcatccctcctgcactattgaagaccttaaacctccttccagagtcagtgatgggtctgcccccttcgtgcaggaccaatctctctgccttgaagatcttttaggcttggtctgctggattacacctcttggaaggttgtcagcatggctcttgggttaagagttgagtgacttgtaaaacaaaacaaaacaaaaccctttgtattgattgtgactactaaactcagtaagactgggtgttctcctcaaggtggtgatgctgttggttctttttagtcttatatgttaatgttacagccatggatattcagagaaattatttgaacatcaagtcctgggaaattggctcaaataaatgcttatacaaaatttggagatcatgtgcaggctaaaggagtttgccacccaccagcatagcagagcaaatgaagcattgctgtcttttttcctgacatttgtcatctggcactgtcctttactacttatttgctgaacgtgactaaagcgcttcctgagctggggtacaaagctgctggcctgggctctctccttataaacatatggtagattttgaatcgctcctctgtattagttgtatattctcactctaaagtattgtggttaatgaaaaataaatcttgtacagatgtcattaaacttgctttttaagttttgtgcaggtgttcc

SEQ ID NO: 26255 - DNA, 1185 bp, Mus musculus
gttcttggcccatctcattttaatgggtgcgtttaatacatataaaaggtcagctccactctgtatcttgtaaacatcatgtttgatatttgaatgcaccagggagagtgtgctgtttgaaggctccggtaaagctatattacctgttttgctacaccaacagtgcaacaaaacaacagttcttcgcaaaagtctgaagcttatttagttgtgtctcaataataaacaaaactagacatggcaagggaaaagtattttccttctcagttttgcttgaatgtgaagtgagcgttggctttgtgctaccaggctccatctgacagtgatgctgaccattcagagaatgcctccccccaagctactgctaccatctcagtgggcagcagagttagaaatggaataccagggacaagaacattacccagtagcagtcctgtgtttgtaaacaatgttccaggggaagaacagttaaaagctgatagcttgaatctttcaggtacttgtctgcagttggtagaatttatgggggggggggggttaattggcttcattccatttgggttatattgaagaatctgagtagggacaagtggactcatactatggtctgtacagccttttctgctctaatgtcgaggggaaagttttcattttatcaaaaagcccagtttacttttctgatggaatgctcaccacagagttgtaaatatcattttgaactggtttcttctacacagctttaatatttttgacaatagtaaagttggaacacttcttgaaacataataggttagtggttccgtgtcttaattataccctcccccccccccaggagagagtgctcttctttttctctaaaagaattttgcctatataaaagcattatattaaataaattggcattaacgtgggtgctgttgtgttagtaaattaatggagaaacagtcatactaattctgtgttagcacaaaataggcagggaaaacctgtgaagttcttgttctctgagtcagagctgggtgggtaccactgtgctggtactgaaaggcgtggggcaggaaagtgagtgtgctgctgatggattcgtcctggtaaccagtaagttaagcaaggctttacagtttgtaaaacttcagctgaaatggacacttcttgttaactgaaatctctacaggagtcttagtc

SEQ ID NO: 26256 - DNA, 1158 bp, Mus musculus
ttcctgttttgatgggttcatgacatgggccagcttctagggatgagtatggagaccatgtgggtaggagtatagtctagatggcacagcttagcatgtggagttgggttcattcaggccttgggcttaagcaggtgccaagagaccacccagattctttatcatactcagctcaggggtgaggtgatgccccaagatcagtccctggtgatattggttcattgtcacttttctcagaactgtgttgcttttcaaagtttttaaaataaacacaccagggcatacagatcaggaggaaaatgggcttgcatgtgcagagtgtctgtccctcatggtttttcttcttctgactttttttcagacagtccatctgcttgtgcaagttccagggggtatagatagtgacggttgaactatgtttctcccaagagaagacacactggagctacagaaactgttccaggcacagtgaggcctgcaccactcaggagctctgtcaaaggctgttctcagagaggataccggacttctttctttgatttttcagtttttaaaaacaagaactaacaaaaacaattgctgctagactggggggtgattatgaaatgggacaatcttttatctacagagcaagtgtcttggagagtggccgttgataaagtgaagctcaatgtttgaatcagcttcctccagaaatacaagaacgaaagaatctttttgttttgttttgttttgttttgttttttttaaaagcactcatcttgttcatttgtggacttggaacatggtgtctcatgtcaagatatctttgcttaaaaccaagcagatgttataatacagtgttttcacccatgccccaaacaatctgttttaaattcagattggtctgtgtttagcagttagccttgtggaggaaaatgctaataactgcttttactatttctttccctattaattcccgttttcaactgtgtgccttgagctttgtgcactttgcagctatgtgaccatgtcatcaatctcacgatgcttcctgaagaagttgatgtctcagaccggctcaccaaagcctctggtatggctttgtgtttgtagcagaacctgattgagaaaatggaagcacttgaggctggtcagaatttaccctgctgtcccagc

SEQ ID NO: 26257 - DNA, 1652 bp, Mus musculus
gactgaagagagggatccacctcgtcgtgttcctcccccagctctttcaagagatcgagaaagagagcgagaacgagaaggtgagaaagagaaagcatcctggagagctgagaaagatagggagtcccttcgtcgtactaagaatgaaactgatgaagatggatggaccacagtacgacgttaagtcccaagatgatggagtcaaacttgtggcttacataggtttgatcacattcaaggattattatacttgtgcttcaaccagtctaaattgaattctttaatgttgtctcaccataacacaaaaagcatgaacttgtattaatcatatataatagattgatcatgcactgtattcacaggaggttggaaaaccatgccattttctggaacttaaggtgttgcattatttcatcaatcatttgttaaaaaaaaaaaactaaaaaataaaaatgtgaacccttcaggtgtaaacaccttatcttggtatacaattgatctttttgttttgttttgaagtatcagatattaatttggaataaggtaaggttctcttgaaacatttgaaaaccctttaagccaactgatctgacagctttcccatcagtagaagtgggaacataccttcttaggtatttactattaactacatgtaggcagtttatagcttctgatcagtgtagtagacattacaaacactggttgtaatggggttttctgtagactttacttgagaggtgagtataaagcattttttagtcatcatcatgacgatgctgctcaagtgcagatccagaacagtacagcgttgggttcctagagcatttggtaaactgttgtgggttttttctttctgttgccaaaactgcttttccactaattcatgcctttcaagcattttaaatatgacaatatttataaatgtgtggtttggaggaattgtttaaattctttttcctaattttcttttttcaggatagattatttcaacaagtaatttgtagtgatgactgtgttgacttcaattttggagtgtagtagctgtgtttaaaaaaaagagtaataaccatttggtcttattgaagccaacacggaatttgctgctgtgtttttttctttggtgataaataaaatacttacataattggtgttagtgttttgtcaatggtgctatattccatatattaattttctgtgaatttttatcactgctcttaaaatatgtcattgttagtatcaaaagaataacaacacaaaaagcaaatagtagcagctagcaagtttgcgaagtgcccttgttcatggaaacattaccttgaatccttctctgaggtggtgtgcatgaggtatcaccttgggtttcatcaggaattaggaaagaatccaataacatagttgtagaggatttttgccacaaacttagaatctgtgtaagcctataaattttactaagtagtggtttaaaatactacattgttaaaactgtcagcccagaagagatgataatgatttttttccctttgttactgaggactgaaatttcaaatatggaagtttcttgtggctagagggcttactcagtcaaaacgagtaaaagtacttagagactactggtgttttgttattggttttttgttttaaagaccactggc

SEQ ID NO: 26258 - DNA, 1387 bp, Mus musculus
ctattttttatggtaactgctagtgatagacgggaacagtggctttaaaaatatgcagaaattaaagtttagaggaagctcattgtaaaatatataggtaattttttcaagactattatctggttgttagtctatattgatttaagatactgaattttgcatagtttttatttagaaaacatttttaaaggaccagagttaatgaatttagacttggcgatttgtaagaaatagtgaaatcaagggtccatattgtttttaaagctgttccttgtttctccttagggagtggagacgagaaactcgggatgatgagaggcctcacaggagagatgaggatcggctgaggcgcttggggggtgacgatgaagagagagagtcttctcttagaccggatgatgatcgtatccccaggcgtggcctggatgatgacagagggcctagacgtggtcccgatgaagatagattttctcgtagaggaacagatgatgaccgtccttcctggcgtaatgcagatgatgataggcctcccaggcgaattggtgatgatgacaggggaagctggcgtcacacagatgacgacagaccacccagacggggactggatgatgagagaggaagctggcgtacagcagatgaggacagaggacctagacgagggatggatgatgaccgggggccaagacgaggaggtgctgatgatgaacggtcatcctggcggaatgctgatgatgataggggtcccaggagaggcatggatgatgataggggtcccaggcgagggctggatgatgaccgaggaccttggaggaatgctgctgaagataggatttccaggagaggtgcagatgatgaccgagggccttggagaaatatggatgatgatagggttcctagaaggggtgatgatgcaagacctggtccttggagaccatttgtcaagccaggtaagattctagttttaaaattacgatgttttgtgacttgtttgatagatttgtttacatgtaaaaagtgaaattattgggctaaatgatagttgtactatattctttttagatagatagatagatagatagatagatagatagatagatagatagatagataagagataggcctttttctttgtgcccatgcagtggcttttacataaaaattactctttttaaatgtccacacaactgctgtccatggggtcatacttaggagctcatttttgttcttctgggagtgctcactgacactcttccaagtacacacctcctcttatgacctgctgtctcaaatgtgtaaattaggagttctctcctttcttctgttttagcctgtatgttaagtctgccatttatctcggctccttttttaaaaaattcattatattttt

SEQ ID NO: 26259 - DNA, 1100 bp, Mus musculus
gtagagagaagttctgacacaacgaagtaagtacaattttgcctttgtgttgccatcaggaccttgaagaactggatccagattttattatggccaaacaggttgaacaactggagaaagaaaagaaggaacttcaggaacgcctgaagaatcaagaaaagaaggtaatgagagggttgattgatgggttttaaataaggtctccaaactggacttaaactgctttgcagctgagattgcccttgaattcttgatcctcctgcctagtggcattgttaatcttttcatataacttaaaaagaatctattttggccaggtggtatttgtgcattcctttaatcctccacttgggaatcagtggcaggctgatctctgagtttaagttcattttggtctttagaggaagttccagggcagacagtatatagtcctgtgtcaaaaaacaaaacaaaaaagggggttgttttgtaacactgcatttgtttctatcccattcagattgactattttgagagagctaagcgtttggaagaaattcctttaataaagagtgcttatgaggaacaaagggttaaagacatggacctgtgggaacagcaagaagaagaaagagtaagcttttcatttcattgtggtatcatagatcataagctaagttataagtcagccaggaaaagtttttaaattcttttgctagatgtaatgttttaatgactgcttaatggaaaaagaaaggttcaaagtagaggtttaataagaaactattaattacagccttatgtgtacacaaatgagagaaaggtcatatttgtggggccctgggcatctgaagtttcagggtctaccatctggagacttaggattatattgttaattcttactgttttttaaaggataagttaggattttgtgataattctccttaggcatacgtatttaagcagaaatagaaaacacttgggacagtatggacttgtataggacttccattagggatctgttgggatgttctgttttcactgcaaaatacaggggaaggagaagcttctcagtgtaaggaaggtgagcatcttcctggagtgatgctttggagattacc

SEQ ID NO: 26260 - DNA, 1173 bp, Mus musculus
tcctttagcagttaaactttttactttcttactacaggtcaggttcagtgtgctacagtatgttgtcccagaagtgaaagacctttacaactggttggaggtggaattcaacccactaaaactctgtgagagagttacaaaggtaggctttgggataggcattttttgctctttactagatggctgtcataattgcagttgagcattgtacttgtgtaaagaacattgtcattgttcccctatgtgttgaggatggcacattttattttttcatatcaagagaaaagatatttctgatgctaaacaaagtttgggaggtaaattagcagcatgactactttagccacttctgtcagttactttcagacaagaattgatagtgttgttggatgaattttatatgtttatatatgttttgtataaagaaattaaaaaaatgtgaactgtccttgtgtctgctgcatatgaacttttttttttccaacttaattgattttataggtattaaattgggttagggaacaacctgaaaaagaaccagaattgcaacaatatgtaccacaactccagaacaataccatactccgccttctgcaacaggtaaaagcaaatgatttatggagaagctgagatttgtgcccttgactttgtatgtatcatgtagtatatatacatactcgttttgtatatgtgcacgcaagtatatggagactagatgtggatattggttgtctttactatcttctattttgaggtctctgtcactgaatctgctgctcacaaattagctaaactggttggttctgggaatcctctgtcatccatagccacgtgactctttattttgatgacatgactgaaaaaaaatttagatttaacaagtgaaagcttcccaagttccactcctgcccaattctctgtatttgtaattttaaagcagagtcattgacttaaccacttcttccctcctaattttcttcccttgccagttttcatttggaatgggttactgctcccctgagtcctgagattaaaggtgtgcatcactatgcctagacctgagttttctttgttaatatagggcgacctacaggatttttttatagtctgaaagatccatagtgtacttgctcagataatagtaatgaaaacacctctttccagtgccactgg

SEQ ID NO: 26261 - DNA, 1211 bp, Mus musculus
aacaggaggttggtcttaaaactcacagagatctgcctgcctctgcctcctgagtgctgggatgaaaggtgtgcaccaccactacctgccctcccaccccccaatttttttataacatgaatcataaaatggggactatttgggagctaggcatgaaacagctttccacaaatgctttaatactgttcagacatttacttctgggcactgaaacttgtgctgcttagcattctatagtgctgactttttgtgtttcagggaaatgaaaatttagcttttctctccctttctattctctgtcataattgtgtttacttaaagtctattttcttagtttctaaagatacctttagttagttattttagtaaggaagtgtttctttactgctgttggaccacattcaatgttgatgagattgagtctgtaaggattcatttcctccaagttcagttttcatgatatgctatatataatctggtatacataagtaaagaaaagcacatttatggtctcaacaaacaaaattttgttcaccacagaatgtctactagagtccttttggcgactctttccattcctattactcctgagcgaactgatattgctcgacttttggatatggatggtattatagttgagaagcagcgacgccttgccacattgctaggtcttcaagccccacccacacgaatcggcctaattaatgatatggttagtataagttctaagtatctttttgtagagtaaactttttgtggaaagttttaattcattgtcaggcttctgctgtgtgaacagggttagggttagggttgaaatgggtacattgctcatttgaggcaattggttaaagcagtggttcattgggtatatggtgaatcaagtacttagtattttcatgatactgattcagattctagtgaacatcaatgtgctagtagtctggaataagtcagtggttgtatttgcatgtaatctacataaaatcatataaaattgaaattatctccagatcacttagaatactcataaatcatttgccatgattaggtgacagtgacaagaaaaagacatttaagacagctgcagttattttcttgagtattatttaaatatgattgattgactgaatgtatgtagagcctgatgataagaccagagctgttagatgaacatgttcctgtcctgttaattgacattgagcttttta

SEQ ID NO: 26262 - DNA, 1127 bp, Mus musculus
agatatggtagcacacaccttttatctagatgaagaggcagtgaatcatttttgagtctagcctggtctacaaagtaagtttcaggacagccagggctattacacaaaaaaaaccctgtcttaaaaaaaaacaaaaaacaaacaaacaaaaaactagaatctttgagctcatctttgagactactattatgaagttcctcctaaaagatttaatttttttttttttaattttcagatcaagccaagtccaacagcttccaaagagtactttgagaaggtccatcagtaggccatcctatgtctgcaattacctgaagcttttcaggccaaaaaagagccccagctggaatccttccaatgccttgaagattatttatagaatggcaaaacctcattatgtttgtgtttataagtactgctccacaggctttgtaattttaagacaggttcaggctctctaaaggtggctagctgcttccatagctgctcttactagggacttcttgatggctaaccaattctccccgagtgcttggcccccatttcttggatcatgtccttagagggtaagcattctttcccttagcctgccctgaaccttggtctacagtgaagtagcacatagtgccagtacttggtgaaatgaagtagcacatagcaccagcacttaatggaagcttctgatcaaggtcctaaaatttcctcttgaatttttgtgaattatgctgaatttcccttttttttttttttaaattgtagtcattaactcacagtgtccttgtgtgttctgaggtattgaagaggtataatcatgaaggactatgtctaatccataagtcattttcttcaagagctggatatatagaataaaaataaacattaaaatatttgcgtttttgacttattctggggcaccgtttctcctttgataagttagctcaacaaatatttattgggcatttgacacagggctggctccactctcaggaaactgaaacttagtaggcaagactgatacctactttcattcattattttggtagccatgaaaaacatatgccaggttggactttggaggcattggagtgaagaaaaataaacctttgtgtttatgcacttgattctag

SEQ ID NO: 26263 - DNA, 1698 bp, Mus musculus
caaagtcaaagcaatgtccattgtagcagagaatccccaagggggggaaatgcaagtctgtctaccaagagttcccatcatgaggtcctgaaaggcctgtacatggaaatgtgcctgagtgcctgtgggaggtaaggaaagtcatgtgattcagtctttcactcatggcttcataacagaacagtgtgtgaaaactggctctcctccctaagtcttcctcctgcttgtgtttctgtagctgcatttttagaaggttttttttgtttaatgaaaacaagccttctgccctttcacctgtccaggagaaagtgtgtgtggctaatgaacagactgtgttgtgtatctgagctctttgcaaaagagcctttcttcgagggtggcatttttctcaccaaatttccactgacttggaatgagaagcttctctgcttttgctgtttgggagataggcctctgctatgatcattctgacttacaattgtccattaaacccttcaggaggggactcagaatatcaagaaggcctgatccctaccttccaggaggacggtgtctatcctctacttgagccaggctccatgctcacccagctctctaggggctgagtctggcagcagccacagggctagtctctgagatgtgttgttctcttggaggggcagccagcaagaggcttgccacacagatacaggcaggtagctccagtaacaagcatgcctcatagttactgacccttgatgtttctgatgagtccatgtgcgtggggacatgaacatggcacatctttacattagaggagcaagtaagatgggaatctgcctcataactgaggccagccccaaagaaagctgagatcagaaagtttccatggaacttagccccactgttgaaatccatttttttttgaaccctgtactttcttgaaagtctggctctactttccatcaaattcactgagctactaccctcaacatagagcaagcaatgcaacttcctgtagcttagcattctaagccttgataaaggaaatggtggcagcttctttggacaattagagttcacaagagaagaataggaaaaaatgattcaaacaacactggactcttctcatgagctattgtgtgcttgcttttctggctgtatccttatccctttccgagggtctcccatcttcataacctaataccctgagataagaccttattgcttcttaggttttactatggaaaggcagtataaagcctcttcctccaaactacaattgatatgcctacccttggatcaccttctgtacctatttatacaaccagccacccagttattgaagctgacaggcatgtaggccagattctgcataggcacatatgatgcctcctctgaaaagtcttgactcaggacaatggtttaacatatgacaaactagctcaccctagggaagaagtaccctttaccctaaaagaagatgctgggcatttttccagttcaatgacacaccatcctataatagatcacaagtaaatgttgtccattagaaaggcattgtggctactggcattgttataataataactctattttccaaaagtttctatttttttcccagggagattttagcattaatgaatgaatgtgggtccatcttggaggttattgtcaatgataacagcttctgttgtgctgctctgaacctcacatgtt

SEQ ID NO: 26264 - DNA, 1206 bp, Mus musculus
aggtcactttggagtcagttttctgttgctcattaaagagaggaattctctctctttaatagaattagcctcaggcagggatgagttcccctttgaatattcaatgcaaagtgttcatccccaaaaccatatacacacaaccaatagaagtggactcagcatgttttattcatatattagtgcatacttaaaaggaagaaattggaagggatgaattttgggaagggatggagaaaagacagagaagggggaaagtgatgtgatttattttatatagaatgtataaaaataaaatttaaataaaagaagcggctagagacataggacagcatttaagaacactgggagttgttacagaggatacaggttccattcccagaaaccacctggtagctaaatctcctgttactccagttactcctaaggaatctgatgccccttctggcctcggcaggtactgcatacagacatatgcaggcaaaacacccaaatacatagcataaaaatgaagcttaaatggatttctctaaagtgatgtcttagtcctgagacagacagaaatcagggctagtaaatgaactcctttgggtcctgcatgaaggcagctgtggctttcctttgagccagcttacccagaggcaaaaccaactttattctgaggttagactagctcagtacagccattgacctaagaactgcaaccacagtgctgttagatcaaaggtgagaatgagtaaaagtgatctacacttttccttgatgttttctgtatttgagttctctgtcctttatatgtgtgagaattgtgtcattgatacatcttttaaaactacctttttgatcgtacattattatttagacgatagatttcctctgtaaagcaatatctacctcagtgggtagacttgcagtgtcctgtccctattaaagtccaaagtataccctgagacctgaacctaaaagagacttaaggatgacagtatatgtggaatgcaaaaatctgttttcagctagctcctcttttagcattagacagagctgaatgtatgctatctgccaaggaccagccccagctaggtcctggtttctaaaggggtatcttggagcttcgaaaacaaataattcataagtcagatcatggctccaagctgatggcctatgttctgttcaagatggctccctagacagctctctatagatagctct

SEQ ID NO: 26265 - DNA, 1140 bp, Mus musculus
tttcatcatagccttgaaggaaggatattatagaagggactactgggacaattgatgttggttagctggagctaagaaattagcagtgattaagaagagaccggaatcattgaggtgaaatctgggaagtattttctaagaatacaaagaaactgtgtttcagaaatagctaaggtcatactttgtgttgcagttggacttggtaatgtgtaagaatcacccaggtggtattggttttgaaggcatgaaggggacaagtagagcagctgatgcttggcactctgagaggctgcaaggtctggcatggtcgcagagggaaggtatgacatagtttccatccctggagcagagccagcaggatgtgggtcatcttgagtgctgatggtggccatagtcataaaacttgtttgtataataatgtacatattttatttcatgttcctttttcaggagaatgttctctctgccaaggtcagtgactccatgataattagaaatggcatgattccaggaagcaaaaatgtctctggtgatcctcaccaatatggtgatactgtgaccttcaggaccccttaagactgtgggaaagaactctgaaaacatgagttcaacagatgttcaagaatatataagtcagtgtaagagctgtcctttacaggatttctcaactatgcaaaatataaagatgcaatataaattgtatgaggggcttcacaaacctgaaagaacagagatagccgcactaatgaatgagctctgtcagaaagatactaaagaagaagacaatgatttggtcaatagacaaacaaaaacaaaaacaaaaacaaagcaaaacaaagcaaaaaaccctggatcacaaaagagaaaggaatagttaaaaataaggatcagataatagtggaaaatggttatctcctccacagaagatatcaacaactaaatttgatcccgatattttacttcctaagggaggtagttatatgtgcaatccaaatagaggttggggacaggcaaaagtctggtgtcaagaaaaaagatgatggcttgataatatttctactgttgagcatcacttaataataagccttggagttcctgagataaagaagaaaaaaaatccaaagattaaaaagaatatat

SEQ ID NO: 26266 - DNA, 1203 bp, Mus musculus
gtggaggactgggacttggttacgaggcagaagcagttgttccagctccctgctaaaaagaatgtcgatgccattcttgaggagtatgccaattgcaagaagtcgcagggaaatgttgataataaggagtacgcagttaatgaagttgtaggagggataaaagagtatttcaatgtgatgctgggcactcagctgctgtacaagtttgaaaggcctcagtatgctgagattctgctggctcaccctgatgcgccaatgtcgcagatctatggggcgccacacctactgagattattcgtgagaattggggcaatgttggcctatacaccccttgatgagaaaagcctggcattattgctgggctatctgcatgatttccttaagtatctggcaaagaattctgcctctgtttactgccagtgattacaaagtggcttctgctaactatcatcgcaaagccctgtgaaggtctactgaccactcactattgtctggtatctgtaaacacttctgtttagtcctttcatggtataattgatgttctttaaaactgtcagtgtaaaacagggcttatgtttcagtttgttttcctgttctgttgtagacagaaaataaaaggagtgcccagctcctttcctcatttcaaaattgctaccagtgtatgcagtaattaaacaaagaagaaattcagtagaccattttattgcctagttgacaacattgcttgaatgctggtggttctatctctttgacactacacagttttctaatatgttaatgctacgtgatgagatgccctggttcctagtgccaaaggttcaacttaatgtatatacctggaaacccatgcatttgtgctttttttttttaaatggtggttgacatcggtaaacagcccattctctgcaagtccatctttgttgttccttaggtattcattctatctttgctcaaattgttgaaggatggtgatttgtttcctggtttttgtatttgagtctaatgcacgttctaacatgatagaggcaatgcattattgtgtagccacagttttctgaaaagttgatattttaggaattgtatttcagatcttaaataaaacttgtttctaaatttcaaagcaaaaaagaaaaatgtgtgtattagtcagggttctctagagtcacagaacttacggatagtctctagatagtaaaggaattt

SEQ ID NO: 26267 - DNA, 1177 bp, Mus musculus
ggaacaagcaccatgttgctcagggaggctgagactgcttctgtcttagaagaaggctctatgaagttcttggggtagccagttggccagctgccagggaaaagttgggtgtcatggctccttttccaagcggctgtgcctgtatttggtcatgctgtagggtcaacctgtttctggagcagatcaatgcttgggagggctgtgccagctgggttctgaaggggctctggctagcaatcagactgctgtggcttacttagctcagggactgtctggttcaggagtggagatttctcccctgccggcccggtggccgaggcgaagcgcagttaccttctggacctctgatcatgtcgctacaagtgtcgaggagcttgcaggttgtggcctacagcctgcgcaccaccgccgtggccttctgctcatggtggccctgggcgcggagcgccgcctctgtctgctcactgcgcaccggatctgctttgctgttggtgcgtaaattcacagagaaacatgaatggataacacagaggaaggtattggaatggtgggaatcagcaattttgcacaggaagcgttgggagatgttgtttactgtagtctgtctgaagttgggacaaaattgaaaaaacaagaggagtgtacttgccaaaaacccagggcttgtcaacaaatcctgttatgaagatggttggctgatcaagatgacactgagtgacccttcagagctggatgaattgatgagtgaagaagcatatgaaaaatatgtgaagtccattgaggaatgaccatggcacccctccactccagatcaaactggatgtgacctgctccagcatgcttgtcttaaactagtggagaatagaggacttgaaataacttttagcaatactgatggaaagaaactgttcttgacagtgctacttaagagccacccccaacttcctaaaggatgcagataaacacagtgtacaggtttttgataatcgccatactaagtatttagtttaggggttaagccctggtgtttagaattcttaggatcatctgcagtgaaacatggttatgaggctggttttggtgacggaccactttctaatcccagtactcaacaggcagatgttagttcaaggtcggtctacacaacaagttctagaccagccacagctacatggtg

SEQ ID NO: 26268 - DNA, 2088 bp, Mus musculus
cccggaagggaaggggagaccctttgtctctccagcagagccacacacctctgcaggagcaccagcaaaaagatcccagagctcccgacagcactgcctgcacgcagctcctgtaccttgaggacatggacccgagcggcagtgagtgtgcagccacggtctgcacccccgaggacagtgcactgcgatgcttgttggaagggtcaggtcggaggagtggcgggcagctgcccagcctgcaggaagagacaaccaaacgaacttcagacgttcccctggagccattagccagtcccaaccagagaagatccgccaatgatgaagatgaagatgacgatgacgatgacgatgaccaaggagaagataagaaaagcccctggcagaaacgagaggaaaggcccttgatggccttcaacatcaaatgagccatcgataagcccctaaaatgcggattataaaattgccaaatatcctttctcatggaagtgcatacctgcgtgtggagaagctgaggagtgaaaaccatgcaagtagatgcttactgccttgacatgggaattacggttatgacagaacgaaaggtgactgacaggtgctgcccctccgagaaggtggctgcgagacatgtcattctacggacctgacttgtcacagtagagatgctgacaaaccacatgtgggattgctatgctccaaggatcacctcagttctctctcagattctggaaacagatgaaatgctctttgcattgtctgaaccctctctaattctatcatgataacgctactgtgacgctctcactgggaagctgggtggcgagaactttctggacgtcgatgttatctcaaaggaaagctatgcattgctgcttctttgttaccttgcttatgctttgctttaattaggcctctctctctccctctctctctctctctttctctctctctctctctctctctctctttctctctccacacacacacatagggtgttgggttttttctctttctttaaagtatgattcagtttcagttgtaaacgttttgcttccttcagttctacttctctgtggttggtttcggtgtcgcccttcaggaactcagaacccgggtgtcagctcttaacatctctaagccttttaataaaactgtactgaagtttttatcagctaagagtcagttcttcaattctggtcccattatctccaagtgccttttttacagtgacaacagacagtccctcggtttcatgtcttttcgtaaccctttcaattgaactgcctggattttatataaagttactaaacgataccttgttcttggaactgcatgctgccaagtgccattcgtactgagcatcctcatttcaacgcagtatacgctctagttatcatgtgtaacgtgggtctgtttagctgagatagactagaggaggacactagagatgcccattcctactccctccctttggtcactagccaccattatggttccactggctgtttgtatatagggttatgtattaactctagaatcccgtgtgcccttcttgctcaccgaacgtgagagtatgggctgagcagggggattgaatgtgactgttaaaaacactcatgtactgtccaaaagtgccagaatgactcttctgcgcattctcctttaagagctgcttggttgtccaaaaatgaaaactcaaaataaacttggaagaaggaaaaaaatatgtgtttattctgattcattctttgttgggaaattgtcaataagacgttgctgttctttgactttggcattgaagggagacttcaatgttggggggttatggatgcataaataccaggaattaatagtaggattaaaaaacccacctttgtctttagtctcactcaagaatgaatggtaacatcctcgtgatgttttaggtaaggagagatagctgaattttatgagaaaccactgggggttttttggtttggtttttgtttcttatgctggaaatcagtttgtcttgcaacagtttcaagaagagtttgttaaatagacagaactatcccagatatataaccttgtttatcagatttattaatg

SEQ ID NO: 26269 - DNA, 1105 bp, Mus musculus
aaaatagttttattacttttactggttatatgagtgaatcatgcagaataaaattgaaagataaaatagagagcaaaattccttggctattctatttctttatatcctagcttaattaaccgtgtaactgattcacattttagtatgtgcccaatcaacataaagatgatcagacttcagattaggttcattggcaactgtgtgtttttccaccatggccattggctagcaagtagacattactcacatagagctagctgctggactcccgaatgtggatagagtgtgattgaggaactaaaatttcaatttaattgtatttaaattctttaaaaaaccctttcacagatggtgactatcatattagacaactcagatatatgtgcctttgaattttctgtttttatgtacttaggtagccagacttttgctactttgtgggttctttcttccacccttctccacctgtttagcagcctaacactaggtaggagagaaagagatcactgaatcttaagtttttttctttttgtttctttttaaccaggactactattaaacagcaaccaaccttcccaaatgaccaacccatctcttgggaccctagcatttatataccctatgaaaagttcccagaatttcaaatgttacagattcacagaagctatctggcaaaatcttgcctctgctagaacacgaggcaaatcatagttgctggacacagtctgaagcagcctcctgtggttaaaatgaatacctttttttaaagaaaccaaaattctcacaacataatatattataaattaaacatttatttttcctttcttttgcagagtatagtgttcccatttttttttccttctaggaattgtctttaaattttgaacatgcatgttttaaacaagtttctctgtcaatgccacatttttcactactatctgctaggcatagcaacccatgcctgcaagctcagcacttgggagatggaggcagaaggatcaggaatgaaagttcatcctcaccatagaaggttggaggccagcctgagctccatgaaaccttgtcttagaaaaacaaaaacaaaattgtaaccactttcccaaac

SEQ ID NO: 26270 - DNA, 2655 bp, Mus musculus
cagtgtgctcactagagagtacacagctgactgatgagaccttgcggctgctgtgcaatctcattcctcagcaatgtgaaggatgtgtgagggaaaggaagtcacagctctaaggtcagattaaatgcccagaggagtggagtcagcacacagatggtctgaatgtttttattatgcaaaattgcacatgttcctttatgctgactttaatttatcatgaaaattgtcatgctaatggaaaatgtcttacttgtaaataataagtattcataattttgttactgatgttgtttttacctagaatttgaaaaccaagtttcacagtgtacatatatgtgtatatgctgccactaatccaagggaaaataaaatactaaacaaggccattgtatagactgggcctttaagtcagatgccacaaagtagatacttcctgcctttactacagtgcctccgctccagtccagacaacatggcatttccttccctactagaaaggagtcaccaaatgtgactgtaggctgtctcacctgttggctgttctatacagctcacaaactgagaatggtcttttttttttttttttttttttttttaaatcgttgggggaaatagtccaaagaattgacgttttgtagcatgcaaatcttaggaaatccaaacattttatcagaatacagacatatcttcattatgtcctaactatggttgtctcatgctacaaagggaaatcaagtagttgtgacagactggactgtatgtattgcctgcaaagttaaaatgtttgctctctggcctcttgtggacaggtcctaaataggccacaaattgtgccattcctgatattaccacgagagggggcacctgggccccacaagtggtgcagaagtgggaccagtgctggacacaggacagatttctcattatacatgtccaactgtcacatttctaacagaacaccttcaggaaatgaaactacctattcattacagcactgtgtggaaagtcaagcagtaggtgagtgagtcagtcaatctggatctacagctctttggcaattattgcactcatttttatgtcttatacaaattgaattttcaggttagaattttgtcatgggcttatttattatttacctcatgaggaaactgttaaaaccattcctttagagatttgtttattgcacattgcagttgttatagaactttaaatacactaatagttaacggtgatgtcttcataagttaagcacatgagcagttggtattttagagaattagtagccagagcaactgcttggatataaaataactgttaaaaccaaatgtaaaagcaacaatctcaagttacactgccctatgctctctgtatccatattgtgctgtaaggtttcttcccttcagaaacaggaaatttgtcagcaagtggaacaaagtggtacagtccataagttcatccaaaacttgggatgaaaaagttttgctatcccactcacctcctaaattccacaatgacttccagacagagtggattagtaaagtcctgacagctccactcccagccagaaagacccatcactgtcttgtctgtcctcgtgccacatgtcagctaagtactgctgtaataagttctggcttaggttttgtttttagagttgttagctttgatttttgtttgtttttggtgctggggatcaagccagggatagtatgtgctggtaagcacatattctgccatagagctctgcccctaatgtactcttgatagatgttatatattacaaggaaactgatgatgcgcagggagagaattcttatgaaacaaccttatcaggcttttgttctgtatcaattaagcctttctcccaagcctgccttgatgcttacctacaaagaaagccaaattaccacaaagtaaaaatgacatgccgctctgaaggcagtgtactgcttaacatttagtgtctctctctctctccgttgcaactgaggactttcttcagttgcttcacccaccttgctagaccatgtctgtggcccattttccaagttcggtagagaaatgttaagtgctgtaggaaactgatgttcttgcaagcaagcattgtaccagcctttaaagcagtgaatttatatgcgcatggacattagtcttaataaactttggttttgttaatcattgttttgagtgttttctgtacttcatctgccccacccaaagagaaaagcacctccatgcaggatcctaagaatatatgtaagttttgattttatttctttcagtgctcatttagacattagacatagtgacaagtcatacaaaactacttggaaatggactttttacttttgggtggttttcttatcttactagggttgggaatgagcttttttattttaaggggttgtaatgttgcagctgaagcttgtccaccttcagcaagcttcctcttactaagttttgtaaggtcatcaaatgacgtgtccaaaatctcgttgtcctggctttccgagggttcagtctctaaactgtctgtgggaccttgggttctgtctggaagccatggcacgtttaagctgggcaccctgggaatgatggcttctacttcatcagcaaagtccctggtgttctttctgaaacccaaggctagcacac

SEQ ID NO: 26271 - DNA, 1111 bp, Mus musculus
ttcaggagctcagcatttcctttatcttcctaactcttggcctggtttgagagaagctacagtattactcaaaatcaccttcatggggctgctgttcacaacagtacatgcagaatatcgccttcatggggctgctgttcacagtacatagtattcagtgtgcatatttgaggccttgtagtatgtctgctacccaaagatttccgaatttgtcaagaaaaaagtataattttaaatggcatttcttttgttttgagaatcttaaaagcaacacgggtatcccgtcccatccccccgtcccaccccctaacaaccccttggccaagctcaccttgaattattctcaggtttaaagattaaaaaaagacagacaaaaccaaaacccagtgtttgactgtctagatatttggtcttatttactgttaaggttaaaaggaaacttaggagggcaagaaggaaaatactgtttaataaatatgtggctttgttttgtccttactaatagaaatttaatgtgcccttaagattttgtggggagtgggtaggcctttggacagagtatctgtagccaggttagccttgaatttactgtgtagctgagtattatcgtgaactcctcagctctgcccccctacggcccagcgctgggattgcagacacgtgccaccatgccagcctggagatttttacctttaaacacaaacagacttcactctgagtgccacacatgtaatggtcattgcttcccttcactattccattactctttcctgcctctcaacattcccccattacatccctctcagactgtcacctcatgttagctatttatacagggtatgtgtatgtgtgtgcacattgttgtgataaaagtgatcaattcagctggagcctgattcctcacgtcacacgtcccaagtatgtagtgtcttcagcaacatgtccttggaaataatcatgacaggaacttgagcagaggctggaaccatgtaggaaagctaacgctgcttcttggcttactctcagccagactcatgctcagctaggtttcttagatagcccaggcccctctgcctaggaatggtactgcccacagtgagctagaccccgc

SEQ ID NO: 26272 - DNA, 1099 bp, Mus musculus
aactaaagtaaagttttggttttttttttaaaggtaaagatttgtgtgtgcgcatgtgaatgcaggtgccatggaggccagaagctggagtttgaggctagggaggtggctagcttgaatgttgggagtgaactctggccctccaaaagaccacagctaccctttacctgcccagccatcttccagcccctgttctcaaatatatgtttctcttcctgtatttccaggttctggagaagcatcttcagactccattgaccacagccctgccaaaaaaagggtcagaacccaatgtaaatgtggagccgagacttgcagaggttacctcaactgaagtgtcaggaaacggagctcatgaagaaaaagctcattagaagaaaaacaaaacaaaaactaacaattgaaaaagtatttgggactcctttctattacctacatattgtattatatgatgttaatatacagttcatggctcaagtcattgccaagtatattactgtttattctgaaaaggactgcggggcacataaacggtagatatttggtggttaaatggaaagtgaactatgtataaatcactgtttgcttacttgagaagtcggaatagacaattattccctttagtgtttgaaaagtgaggctaccacagttactatgaaaccttttatcttgactcaaacagataatccaatttaggcaaatgtataaattttatttttttactatattatttctgtttaatactcactgatcagagacaaataagtgctgaattttttactatattttctacttttacataaaaacattggcatcttaatgatatatttcaggtgtaaaaatgtgaaagacttacttctagcttgatcttattttgaagcaatagataccattacaaaggttgtatatctgaacctgaaattcttaaaagattttttttagttgcacagaagaaaagcccctaatcaccttctctagaagtctatagtggctggccattgtgcttctttgaacacacagaacagtgactaggagggcccattggagtgccaggcagagtgagccactcagcgagtgggaggtccgcactgagtatctc

SEQ ID NO: 26273 - DNA, 1106 bp, Mus musculus
tattggctaaccgttctgatgaaaggcggcatccttatgttgattggctgcgacttgggaggccggcgcagcagaccggacgcagtaggcgggcgggaacgtgaagtctccgcagtgcctgatgggcttgttccgaggaagctagctgaagctgctgaagggtccttcgttgagctgccgtggtctccgccgccttatggcggcgatcggcgtgcacctgggctgcacatcagcctgtgtggctgtctacaaggtgagcctgggaagctgtctccgggttccgtggcggccaccctgttttctgggctccgggtcatcggcccgggaaccgtgcgtgcaagcaagtggcaatgttgcgggttctcggctctccctccaaggccaagcacgctgtgtggagggtggatacagagagccggatcttggatactccagggtatcctggacgtcttggctgtttgaggagttttagggacgaaaaggcctcaagcatgcagggtgcacttaggagaccgggccataggatgcccagaagagttcaaaagacgtcagggctccaggatgcctggagtcctcggggcgggggacatcgttcttgtaaagacgcctagaacaaacctggatgtcaggaccccctggatgctagagaagtcctagtgacaactgaccgcagagtccctaagaggtcacggtgacgtcactggttcggggttcccggaggtgggaggtatttgaatttctgagcaaccagagcactgtgtaactgccctcgagagaagggttcctagttaagaactgactcttgctgtacacacttgattctagaactgagaacttaacaaggaactatagctttttcctcctcaatatcgatggagaaggaacaatgttaaggaatttaaccgatgctatcttcggttttaagtctcattcgatttatcaggaaagtcccaggggagtagctacttcgtttgtagggaagcaggtggaaaagctgtatttgtgggagagtcgtgtaatcatgcttgctaggtatagaatgttgtatacatttgatccagcttactgcacagatctaaacgggaaaatgcatgggctagaagaag

SEQ ID NO: 26274 - DNA, 1281 bp, Mus musculus
aagtttagtgggacacagagccttccttgttaagagaattgtttggaatccctccttgggttatctgttagattgttttgattgcatcaaaatgtatttcatctgttacatccagtatttgtatttcattctgagaacccagatttccccccaccaccaccacattataaattaagaaaggaggctattactgtttatgtttaattatacctattactttggttgacattgaagttcagaaacaggataagacatttgaacatgtcagcacccatcatgaactaactgtaattcccttaggttcttggcatgacagtatgccagatattgccttttcacttctaagaaggtatatacagcttgtcgattcctttctcgccttgataaccatagcctttctgttccattttagtttgtcatttcttgctcaactattcctttcagttgaagcaatttctcagttctttttcggatgaaaccagagtgtgtaactcaacttctgtgtcccatatagagagaccagctcttttgagttctcctgagagcagtgtagaggagtgtatattaggactggtgatgaggcctttagagattgtatggaatgcaaatagagatctgtttctaagagactttaggggaaggcttgatactttttacattttgaatattttagacttgagctttgaacatctccggcggatggtcacaagtttctttcccttttgtttcctgtgaagatgaccatcttggcgctcttggcatgatgctgttggtaggatgatcctgactactgtgttgcatctctcaggaaaagctgaggtgctgggcaaggctgctcagttccctcttgctagctagcatgctgttcaaagagacatctaagttacaaataatatgaaagttctcatgcaaaatatattttgtactacaggcatgagattttttttggctttttttttcttttttgtatttagtacttctccatagagatgatttaaccagtaatttctacactgaagacttctgtttcctttcatgatgcatagaatagcagatgtagcgctttggaatccttgcttagcacactagatgctagttttctctgggaccacttcagtctggtagtttacaggcccacattcccttccagtctgcataagaagtaagtgggtgataattcactgctagataagaagcctgagagctgagtacagcagagcggattcttggtcctatcagcaagtgctatctaaataaaatatgagacgctgaagataaggt

SEQ ID NO: 26275 - DNA, 1159 bp, Mus musculus
taagatgttattgctaagcaagttctctaccactgagctttgtttttagccctttgtgtcatttaggagtcaattctttagccttacagacaggtgaggaccaagcccctccgtttggacatcagatgactattttctagctccgtgacctgggtaggtgtcttaggacacggttttgctttctctaattagagaacagaaaaggaacttcctgacccagattagtagtcagtgaagtgacatgatgtttatgaaatttctttaggaaatagttttactttaagaaaattgtgttttattaacatcacgattaagctaacccattcccttgtctaatgctgcatggagtttaaactttctgagaagccccacattaaatcagagatggcgaaacactcggtaggaattacattgtgacatggttcatttctgagatgtcatgtggcccatctttggtgggcaccatggactgtgcgagtgagtgtcagcaggtctgggatgggaagcttcagatatttctggacagccagtgtgggctggcatcctggcaaggcttggcattctactgtatggggccatgccaaccattcctttctctgaagagctcccagcatagttcaggcctcccaagtgatgtttatcaaacccagagaaacaagtactgtctagtggtttgagtcagcgtgagcagtagccaagacagctcacgggtctcctccctgacatcagcttactcttcttcagagtcagtatgcaaatcactttgaaagcctcccctctctccctctgctctctctgcatttcttcctttcccttcccttcttcttcctcttcttcctttggctccccagacatgtacaagaagggaacattctactgtcaaaggcagagtggagggaagctggctctgtagacactaattataattgatcacgtatatctgctgatgttaaagatcagagatgctgtcaaaaggatcccgtgacctttgcatcctggaaccaaagagtgtcttatagactttaggggaaagtctttgaaagctcacattgttcagaggaactgatggatgcttttcctctgacctcagagcggtgcgctctgcggttaatgtgcagacatctttcctccttaatcttttatttttttaatcattctt

SEQ ID NO: 26276 - DNA, 1194 bp, Mus musculus
ggacagacctcgcctgtgtgtcgcttagtcagagaactcacgtacgcccttaggtaggaagactttttacacacgtctaccagttggcaggcagagcagagttgcaacaactcagctcccaaagggcccagacccctccagcagtatctgtgacctcgatacaccacctccgtccacagataccaagaggataaaaggcaaaaaacataaaagcacgcgtgcaagctgcttgtttacatgtgttttgagctatgcttaacacacaaccaaaaagccatcaatctccaaaggcctcagaaccacttctatactaactaaccagtgcacagtcttagtggggcatggcactaacgatggcacaagagtctctgtggaggtagtgtggcttgcaggggttaccttgtcatgacttcctgtggggaagacatctaggaccaggagccagggtgggaagaaagcaaatctaaaagttggctgtggcatcaaaagaaaaaaacttcctcatgtatttaaatccaagaataacaatagacattaccagactgggaaggtaagaaatgaacagcagaaaggactgaccctcactttgcagtggcttggaaacctctggaagtcaagtgggagcattcatcccatgtggcctgaggccttttctctcccattcaaggctgggtaccccagagctgggcatggttggcgtgatgagcccagcttccagaagcagtactcttcccagacacttgagggataaccctgtagggtgagtggggacgggatatgatggtacaaaatgaccctggggctccgtggagacggggctacctttcttgctcctagtatgatagtcggagctacataaagcaggtttatttggggactatttcttccttccttagctaatggaaatgtgacacattgtgccccattttctttcttccaaaaggagatgcctgaataatttgcctgaacagaaaacgtccaaaaggaaacaaagaacaagacaaggttacatggttacaggttataacagagacagcagtttgaaaattgattctgaagtccttcggatctatgagagatgcagaaagaatctaaatgtaatagatttggggagcagagggaaacggaatgggagctgtgaacaccatcacgatagtctggcagtaaggacagagatttaagtaaaacaggttt

SEQ ID NO: 26277 - DNA, 1149 bp, Mus musculus
gttgaatcagtgttcccttgcactccagctgaagccttttcctaagatgaaagcaggtgtaccttgggacttacttgacaaagaagaaactctcataagatgtgcagcaaatccctactgtgacatgtggtttggtcataaaagtcttctttataaatactatcagaaatgcccaaatcactcattcttcatccactgttaggccacacagcatggtaagtcattttatgttgtcttctcttgttaatattccacataaaggggctggagaaatggctcagcgggtaagagcactgactcttcttcctgaggtcctgagttcaatacccagcaatcacatggtggctcataaccatctgtaatggaatctgatgccctcttctggtgtgtctgaagacagctacaatgtactcatatacataaaaaaataaataaaatctttttttaaaaattccacataaagaagaaactatatcatatgacatcagtacttcctaaaattgatctgtgtgggctggggttttgttttgttatttgtttgtttgtctgtttgttttttgagcttgctttgtctgcaggggaattcgtattctccaggactgggactgtggccattctgaagctgggtggagagaagcatgttcacgaatgtggctctcagtcaagtttttcataaccgaaattaaaaagctatgtacaaattaaagaagctacatagaaactcctgggatatgtaggaagatgacctttctttcattaaatggaaattttacttttgcctatactatatatttttgtttcaagattgtttttaaaacaacaaagatttcttttaaacaagttacaactctattgactgtgtccgtttctctcctccccatccttccatcacaagaactgggattctctgtattcacatttagtaaaaaaccctttccttagaaatcaatacaggtgctgcttgattcattgcgggattcatcctgacatagagtacatctgaatatgtatgtatgcatgtatgcatgtatgtatgtatgtatgtatgtatgtatgtatggtgaacatagagtacatcagaaatgcatcaaatgcccctaatgattggcttgacttaggctgctttaagtgctaggaacccatccatta

SEQ ID NO: 26278 - DNA, 1508 bp, Mus musculus
cctagggactgaagaggttaatgacaatttgccagaagcactttcctacagatccgtcaaaatgtgtggagtataatgcactatgagatctgcacacagtgtgtgtgtcaggaagcctccgctcgctcgatccctcgcagcatgaggactccggccttaccacagctacgagggaagagctccaccgtggggtcttcctggtgcagttcttgttgactttaagaactgtgttggctttcacatggaactggactgcaaactaatttttgtgtcttgatttcattttaatgagttgaaaaattaagttgtaaagatattatccgtagtttaagtgtgtagacaaccaccactcaggaaagggggttggaaatgaccattgtcaagatcccagtgtgtcgttgatacttaggaacatttgaaggtggctttgaactttctgtaaattattgtgatttgcacatttttctatgtggtatttatagaaaatattttttatatttcagcaaaagtatgggtcattgaatgctcctttagagttttctgtggtcttggaccttctgccatcttgtaatagagtgtgtggaatgttgctgttaagtgttatttgtcttgtgtttcagacttgcttttctttctaagcagagtatggttgtcatctttctggacagatgaattgataggagatagaaggtcgaaagatggctgttataccagcctaagttcagaacaccagcatatcaaggacagggtgaggaagtggccgtggatccagctgagagtggcagcctcgggactggatgccggagagttgtggcgttcctggcttccctgtgcctcacttggtcctcactcgcctcacaacatgacttgctctagggcttacagaatggagctttggtcaccgtgaccactctgtgctgcaatgctgagaggtctggactagttcactgatgtgtgcagatgggttgggtgtggtgtcagagaaggaagagggagtgggccaaaccaggactgacagcttctcaaggacatgctcgatctaactacagctttgggcatgtgggtccatctcgctgagctttggcttctttgtctgacattgatgctaagagtccatacctcacatcgatattgtgtaagatgctgagtctgctgcctggcagatgataagagatcattattattgcttattacagtgtagacccagggcctttacggggccctgtggctaccctgggatagtatgtactcatgtaacaacaacaacaacaactgagttagcagcaatagtaagtgaaggagtcattattaggtttctctaccccccgccccccatctttactttcagtcaggtccaagtttaggagtgcagagaacaggacctgggggctgctgtaggtggctcagattcacagttgcttatgctggcccctcctgagaaagccactttgggctccttaaggtccaaggcatgcatagataggatagcttctgccagttgtttgcag

SEQ ID NO: 26279 - DNA, 2386 bp, Mus musculus
ttgctggaggcccaggaagccgccccctctcccggccatacagagtaactcttctctttctttgccaggaggcctgctaatctgtctaccccgtgagcaagcagctcggttctgtgcagagatcaagtcccccaaatacggcgaagggcaccaagcatggattattgggatagtggagaagggcaaccgcacagccaggatcatcgacaagcctcggattattgaagtcgcacctcaagtagccacacaaaacgtgaaccccacacctggtgccacctcctaatccagacagagctatttgattttgtttttaaatagatctatttcctttatcatcacttcaattaaagactctaagaacaacaaaatctcattgtgtctacacatctggtgaccctaggtcggtttatgagtggatgcaattaataaaatgaaatccatggccgccttttcctgttacattaactgaagatgcacccgacctccaggcagcttctgagttgagagtgatcctgttatccaatcctgttgattcattttgaatctttagctgtgtgtctcttgccgcataggcgctctctaaaggtgcttttctgccactcgggcattgctgagaggagtgccactagccttctgtgtcttctcatttctgcctctcatctcagtctgatctgttgtcaagtgtctcagttgacattctagaaagacagaatggtaagtgacatgatggtctccccgtagtcagagggttgcatggctccttcgagtgtttgatttgtaaagttgagtcgaataactcgagggacttcttatccagtagctctctcagttcagtatggcaggtgctttgcttggcatggaatgcacttggaatacaaaaaaggaatgttcttttagaacaaacaaagctttcctgagacttgcagtaataccattaatggtttttactaatagggaaaaggatactttttgcagtgttctttagatgttctatagtgcgacgaggaactgccttccgatgcgggggttcatgtataatactcatttataattcaatatataatttacttcgcaaataatttttaaatataatcaatactaaggactgttgtgtggatggtagtgttgaatacattttatattttgtattgtgattccaggcctcttgtttaaaatcagcagctctttagcccaagtcttagcacatcttgtcttggcacatcttgtctttgtgcacgaattctgtgatttgtgttaaaaacctgcattgtcaacattgcagctccaacataaaagttgttattcaaataaatatttaatttttttaattgctcttgtataatcagatgccctttttagtattattttagaagcatttgggaggattttgcctaaaatacaatttattgggggagactagattttagttttataaacttttaagtctttcatgggacctatattttcttgaattaaattttgtagttctagaacaaataggcaatctacaaaggtgttatctgtgtttcttaaaaccaggcttccttatcttccttatctgttaagcagctgggggattcccgtctttaagcacaagggcactgggtcctcaaacgcctgacttcaaaagagaaaaagcaccaagtcttcaggtttcacagggcttcctactaacaggacaggccccaaagctgagctctgcaaactcacccaacctcactcctcaacacggaacaccagaaaaccgccactggaccagcggaactgcggaaggaagaggctgccacgtgcttgtgtccccagaatctcctgtaaatgcacctcttactggaactgaagccaccagagtctggccccagcagaggaagctgtcacagaaggacactaattggacactatataggaatctataagatgttggtccttgaaagtatgcaccagtggtctgcaaaataaaacatgttggaaccctctgagtgcagaaactatactgttggacttgcttctattttgttttgttttgttttttaaatagtaggtgaaattggagctaactctgtatgttctgttccccaaagccactacttttcttggaggcaagcctgttgggaggaagttagatggttaatgttctgagcaaattaaagattcatataaggagaaaatgccaggggcttaagagatccatggattcgtgatctaggaaaagccttgtcttgactagtgttttcagggtgctcggtaaccgatgcattagaatcccctgggtgtttgtggaggaggcctttctgcactttcctgagacccagagtcagttctggctgtggaaccaggtagtccatctctccaatgtaccctgtagggctctgcataacaacccttgaga

SEQ ID NO: 26280 - DNA, 1180 bp, Mus musculus
gatctgcagtccactttctctgggggacggattccgaagaagttccgcaaaggcaccagcctgaaggagcggctgtgccaagatggtttctactatggtggtgtttcttccgaatccttcgcagcgtccaggtgaggcatctctcctgactgctcttgggaaaggattttgcttccctcttaagagcaagcgggtggtggactgttccgcaactgtcctagggtgcttaagtgagcttctgtcttcttagatgaagcctgagtgatcaaggacatcttttatttctagggagagaggagcacattgggaatgagtagacagtgagtcatgtgagcccctgctttacatttagccagatgtgaagtcttgtacccgcaatcccagctctggggagaccgagacagaacacgagtccatgaccaacctaagctgtctagggagagcgtgccccaaatggagaaggcagtctggagaggtagctcggcagttcagagtgcacactgttcgtcagaggacctgagcttgtgtccgtacccatggcaggcggctcaaccgctgtaacgctagcttcaggaggtcgatgctctctgttgtcctctctgggtcagtgtacacaaacgtactctcatatacacataaagagtaaatgaataaaacctttttaagtgaaagaacaaccaagaggtgaaggcagcagaatcaggagtccatgccagccgtggcaacattccagaccagcatggcgcgtatgagttcctgtatcaaagcaaaaaagggttgattttcttgagtggctgttattattctctgttgttttggtggtgttatcgttattattatagaaggagtttgcagacctcttagaaaccacttctagcatcatgaacacgtgtgatgtggctcacgtggggcatggtgatgcaggacagatgatcatgaccctctactgggattctagactgtctaaggaaccccaggtggtgtgtgaccatgtcatcttgttcctcaagcaaatttgtaggatctccatcagtgatttaatgtataaaccagaactcctgggctaccaagctgtggccggcaaagcctgcatgcatggggcttgaggatcttggcccgttggtaacaggttcattgggaatcctcatattgtttgggaagacaatgaggctcaagcact

SEQ ID NO: 26281 - DNA, 1165 bp, Mus musculus
ttgttttcctgacccagggtcttactatgcagctaggctgagtcatctctccctctgtctccctctgcctcctgagcgctggagttacaggcttacgccaccatgccccactgagctcatggctggctcaggtgtcaaaaggttgattgctagggataaaaaggtttcttaaggaacctctctgaagtatataacagttactatgggattgttttgtgaatctcaaggtctgggtgggggataacagaagtatctccagtgtttgtgtccagtacagcatgttattctatctgattcttaatatacttttcttttgtagatgaattaaagaagttgcaagagcaaatgaaatccttacaggagcagctaaaagctgcatcaattaaacagcctccagggacagcacccttgcaggaaccacctggtaatgtgactgtaattgtagcagtaatttgcatttttgttaccaagaaacaatagcgttagtattttcacccagctcctgccaaaactgtagcattcctaatttctttcattttcaatcgggaagattcatctctgcagccactgcttaaggagaagagaattcggagaattcaggagtcagcgtgcttttctgcagagcttgatgtccccactttacccaaagccaagcgggttgctcggaagccaaagactcctgcaggtgtgctacagggcctgcctgggtctcactgctcagctctgttgaaaataatacatcattctactggggcgcgcgcgcgtgtgtgtgtgtgtgtgtgtgtgtgtgtggtttgtgacagagttgcaggcaaatgagcttgtgtgtatacagacacttatatacttacaaaaggttggggtccctgggggctggagtcacaagcatttgggaactacccagcaattgccacacacaggtctactagacagcactgcagagacctggatgagtcacaaagtggccttgttctctggcgaagtttgattacatgaggccttagacatccagcatttagaggaacctacattctaggccagcctgagctacagagtgagacccagtctcaaaataacaacaaaaaagtatcctatatgttgattatgaaaagaatgtggtaagtaggttttatggctctcagtcattctccacctcttatgctaa

SEQ ID NO: 26282 - DNA, 1237 bp, Mus musculus
tctaggtaaatcttcccttagtgggcatcttgttgtgtgtgtaattctgtggaagttccatgtggctctttctgactgaacactgtggtatctgttgacaccaggacaggtgagagatagggacaagctcaggattggagtccttccctcagctgttcggtgtgacattaccctcaggctccgtactggagctgtacaggatagtacagtacatagtttaatttttaaaagaacagctattttctttgcagatgaagtagcagcttacagatgtctgagacactgagagcctaacagtgggtagcaggacaggagggaaggtgtgggaagagtgagagtgctggccgatggcacagcgtctcaggagggataatctgtacagaatagtgactgtaatcatttgtatattaaggccatatcaccagtttagtaaacaccttgcaaaccctctgtgtgttatctgatttatttaatctgccatctgctctaaggccttgttgcatgttacaagtcataggagttttgtacgtattattttctttctttctatacagggttgcgctgtatagccctggctgtcctggaactcattttgtggaccaggctggcttcaaactcacagatacctgcctctcttctaggtgctggaactaaaggcatgtgccagcaaacctggtttatttgtgttacattcctgcctttacagtcgtcactccctttttttttttttttttttttttttttttttggtttttcgagacagggtttctctgtgtagccctggctgtcctggaactcactttgtagaccaggatggcctcgaactcagaaatccgcctacctctgcctcccgagtgctaggatcaaaggcgtgcgccaccacgcccagcgtcactcacattttaatagcatggttagctgcatgtgttaatcagacttttgctgctgtgacaaaatatctgaccaaaaatggaaaaggaagaaaagtttcttctggcttggggtgtcaaaggttttggtccttcccgttgggaaggctgtggttgaactgggcagcttacaccatgggaggccagtgttcagtcagaaagagccacatggaacttccacagaattacacacacaacaagatgcccactaagggaagatttacctagaaaaacactgcagccatctggctgactgctcacagtgactcatgagcagaacataaaaacactggctggcttatgtggaa

SEQ ID NO: 26283 - DNA, 1176 bp, Mus musculus
acaaaaataaaaagacagtttgggagctgagtcaactacttgactaagactaaaaagccgaaagtttgttccatgctggtcaggtgagagaggtgccctgggagcagaagcagttttcagcattagtggagaaagttattgatcaaagatctatgtagagttgggatgcatttcaaatctgttttgtaaagaacgtcatgacagtttgaacatttgtaaggaggaggctggtcacatcgtggtgggcaggaggaagagacaaggccagggccagggctctgagccccagcacacttgccatgccctacttccaccttccaaaggtcccacagccttcccctgccgcacccgaggatcagcacaggagcctctggaaaggtgtccttcctgacagacagggcctagctgcagagccagggactctcaatcctgcgggacccctggggcccgacgctgtacctgctgcatctccacctggcttccctacctcgtccatagcccagcacagcagtactttagagtcctggagggctctccatcaactgaatcaggaaattgctgtctgcgtctgcgagagacggcttgtccttccaagaatactccccagctcctctcatcactccctctttggtttatagcctcaccggtgtcttactctcctgcatatttaagtcttagtagaccatgccttgtcctgtccctagaagtgtaactgtgtttcccagaactgttgcggccgccagatgggatttaaggaacaaacactagttctagtttctctgtgttcatagtgatgatttccactagtgacccaaaagtacgtatttgtaccccactcaaggctgatttctaagtctgacagatgctcacatccgtggctaagtccaaagtgctcttgggatggagctggctgacggcacttgtcacttctcatcctcccaggagccgaggacaggagctggcagcacgggcagcagcctcgcagtattccgattcactcctgccccaagtgcggggaggtcctgccggacatcgacacgcttcagatccatgtgatggactgcatcatttgagtgttctctccagtccccaaagctcttggtaaatgccagatttctcctccaacacttgtacttctgtcttctttattgtcacatatatcacaaatatttttga

SEQ ID NO: 26284 - DNA, 1215 bp, Mus musculus
cagtgtgtagtgtagagcaacatttgttgctgccatagaaagaagcactagctggcgtgactggctaagggaagttgatatttcagaaggccacaagagttggaaaatgtctttctgacactgtcatggagaagactgcaaatgaatgcccaaggccatcatctaaatggcttcctgtaactagattcacattctatctactgtgatgctgaatttttggagtgaactcctggaaaaccaataaaaacataaaacaacccctcctttccattcaggtggaagccttctctccactgcagagctgagcatccttcttttccaagaatctgtgatttcagcgtttccttcccctagcagagttgcttgctcttgacataagatggagtttcactattctatcaaagaagtaggcatgagtttcatcatttctggactatatttgaccatgcagccacccaatgaggtgagtcttctgtggaacccattttgggaaacactttgcagtaggtttatagtaacaaagacacagctctattgtccatgtaactaccatagataggaagaaccagcctactctgacgagaactcactcccagcagcccagcctcccctgctcttagcattcaaaccctagccatctaaatttgttcccatcctccttatcctaaggcactcggcactccaccccaagactctatcttccacatgatgatcctgaatggtctgatttctgttgttgtgataaacaccgtgcccaaaagcaacataatggaggaaagggtttatttcagcccacacttccagactgtagtctatcattgaggcaaatcaaggcaggattccagcagaaaccatggaggaatactgctaattggctcacttatgctcagctagctttcttacacagaccaagccctagtgaagcctagggatgctgcctcccacagtgggctggaccctcacacgtcaattgtcaatctagacaacaattcacacacatggccagaagccatgttcctcaatggaaggtttcttcagaagagcatatgttaagtcaagttgcttactgaagctaactacacaacgaagtcttatgaaatccagcatttcttccctcaaatgctcttttctcatttccaacacgctctgcttctacaggatttgacatgaggatgtacaaaataacttaaccaagtaagaccaaggcaggatcag

SEQ ID NO: 26285 - DNA, 1156 bp, Mus musculus
cgtgtaccccatagaagtatttgcataacaaacactttcttttaataagagtgctttcactatccttcccatggccatgtttgatcatgtcccatttgtgttactaagaagtcaatggagtggctgctggttcatcgcctctaatggtggccctccagatctaatgccgtgccacactgttccaccaatagaaagaatccttcagctctacaccattgaccacctagaacccattccagacacatgatactgataaaagtggtcattactgtcacactgccgcctttctgcttgcaggaagtccaggcctctgtgagaagtccctcctgtcacatgagtattggtaggggtggggataagtttgtgcccttggctggtcagggcatgatgggaaggaacttctattctgggaccaatcttcatccactctcccccactcagcctctttaagcagtgctattcataatatgctacagaggtgtgccttctcattaattctccctgggagcattaagttaaagcgcttttgttacctcccaagggaatgaatggcaagcttaggggtgatggagtcaggactcggagaactgtggaagccgaagatgtcttatgttctgcttttccaataaacatgagcagtgcttccaatggctgtggaaaaaaagaaaaaagtgagtgtgtctttggatcggggcggcttgagggtttccagcttgagcctggaaaagtcatttggagcctttggggagatggctggagtgacccgggaacactgaggagactcttcaaggctggtctcctgcccttccctgatggatgtggcccgagtctccctccccgtgagttcacatctctcaggacacctgtgctcctgctctgctgcccccaagggacaagcggtatcattaatcaatgtcttctgacgtgcaccgaagtcttgctaaaggagacttccctgggtcccatgatcttctgccttgtcatctcgccacagctcttgccacctgtcaaccataccagtgaaatgtttaatgtgccataaaaggcggactccaagcatcactcggaacatgacacactctcgccagtctgtcctagcaccttctgtggagtgcaggctattgctttatttcccttcaaggcaccagagacaaaa

SEQ ID NO: 26286 - DNA, 1995 bp, Mus musculus
ctcagagtctggagacgtaagcggagaagtgcaggaccagtgtaatgaatgaacataccagtgtgcttggcagcaccgtgtggccatacaggcccccctctcagactgggttgctaacaccagtctctccccacacctccattatattgccttttcacatttgctaggcaagtgggcatgcatatccttacttggttatgaaatattgaaatacttccaggagagtctctccctctgcttcctgcctgtcctccccccaaggtcctgccctttacctatacttgaggcagaaagagcagctaatactcatccaagaccaaccgtgagtggacgctctcactacgtctccacagagccaacagcttctcattctaaagcaagggatccctagagtttggagcttcatgttggggttaggaagtgacagaggcagtgggaggctagaggggcagggaatgccacagaatccctgagggcatggagactagagtgactgagataacaatcccagtgttgtaggtagcctttgtaacaagccccagcaaggttttaccccttcccactgcctctaacccaaaagaggctctgacgccaaaagatcagctgacattcatatttctgtgtgaaagaaaaggactatggagaaggtatttcgacaaaccagaaggtatggattcctgccctccaccttgattctgggtcacttctcaacactaccttgagtctccagccgtaccactttgattgtgacagatatcaatgaagattcctccttttaaaaaaaaaaaatagccacctccacttgcacaccaactggtagtctagagacactacctctctttaggtatccctaagtgtggtatctggaaacacaggagttggctcagtgaatcccagactctatttacctatttatgctttttgtttctatacttcagtactggatagcttgtcgatggcagagagaattggcctttacaccacaggccaagtacaacatggacacaggagatgaaaccaattggtcctctcaagagttttgacccccctcctataggatgcaaaacttgatatggtcagagttcctgggtttgatgatttttagcatgtttaaacatgtctaaagaacaggaccctgcctcaaaaaacaaaaaaacaaaacaaaataaaaaagagcaggaaaagcccacccagtggaaatgactatggattttagagctttaggctactcagaactgtgaccaaagctgacttttcacactgaggagaccaaacaggtgccaacactccaggctgcaggcaggaagcttaggggcagaacctctctgccttgaagggtttgtgaaaatgctgtgctgggtttttctgggccatgaggaatgaaagtgaagataggtgaaggacagccccttccatgtcttataaccagaaatcactttccccagggttgcataaccacttacttccagcaagtgagatgtggggccccccttgcatgtcctccaaaaccagtgcccatcccttctcacactctgacaacttccctttcccttaaccacattccagaccaaacactgttcagtttgtttccaaaattaaaaaccaatgtatatatctgtatgtactccactgctctgtagggggtttcctggtcctagggtggggctgcaggcagaaaaggtattccaatcctttggttttcagaattgaacgttttgaagtgatttgcttggttggttggggtttttttaattttgtttttcaagctaagctgggaaagtagattttgaaaggcaaacttccttcctggaaactccacaaacatttctgtgcggaagagttagtttgaaatcttcaactctgggaggtaggcaagtctaaaagacaaggaagaagaggaaaagccacatcccatctaccaggtcccttcttggtggtctcaatgcatgaacgtctgtctgcagctctggtgtgtgcacaggaacctagccccac

SEQ ID NO: 26287 - DNA, 1217 bp, Mus musculus
tcagctagcatgagttgtgtttggctggtctagagtggtctccaggcctctttgataattttctcgacttcctcaagatggtgtccatggaagattcaaaaagttgaccacagatgggttaagatgctcagagtggttgtcctccctacttctccaagtcctggtcttcagtctagctgtgcagaaccttcaggactgtgtttccctttgccctctccgccccgaatctttccctgatccctgcttacccattctcaactctcaagtcattgaggacatttaccagtgtgttctagccaggagcacatgccttcagtctctgcacatggctttactgtgtgagccttccctacgttctcccacctgctcttttctcagggtagaggagtagtgtggggggaatgcatgtgctcaaacagatgcttacagaattgagatgcatattcatgagcctcattgaccctctaatctaaaccaggattatatatgtgcaaccctgttttgttcactaatgggcactggtaataagtacaaaaggtttgtttgctttcgaaagagctttgttttatttaattattgtgaaagtcaatcatatctatgataggatgactagaactcatattccttaacaccccccactgcccccttcattcaataaagcttgctaaatttctgccaaaggtcagtcaagacagaaagacttgtagtggttcctggtaccagcaggacttagagtccaaaggatgctcatccttggttgaagccgctgctgctttttagagacacactgagcctggggtagccttatgtggcctagctgctttgcagataaatgggggggggggggggtgttgtagtttcagtcatttctgtacaatactttttattctttctttgatatttgcctacatgtatgcaatctattctgattatatttacatctggatgcactctcagcccatccccctcccaccttcacatcctcttccatttctgaaggaaataaaccaccgattccaactagtgctacccatatgtgcatcgctctggggccaaccaggggagcctgggcaacctgcctatggccatgctgctatagaaagagtatgccccttctcccagtagccattaacccctgacaggacagctcttcagctgtcattgccgctttgggagccccccccccacttctgtgctggaatttgactgacttggtt

SEQ ID NO: 26288 - DNA, 1199 bp, Mus musculus
ttcttttaatatgcagaggttcaatagacacaaagaatgtgatccagcagttggctgagcaatagacaggcaacctttgggttgtctttgctcttttccaagctatgttaaggctttctttgtttatgtaaatgcatatgcactggaagatgttctgtagagatccacactagctgagaagcttcagagcaaatgcaagcacgtacagtccagcctaattaagataatggggaatggggctgaagtgcatcctttaggtgtaacataaaatcgaggttatcacttttttctttagattctgagtctctaagcacatgtgaattgtgttattgttctccatcagttttggaacaccctaacccaggatgggccaccatatgctcccggccagctggcagtcctccacatgggagctgctgcttttacagactctgaaccaggtcctgtcccaagactcattccagagcctattcctgttcagtttttagctactgaaagaatgcaaattttctatcatactataggaagtatgataaaacaataatcatgtgtctatgatagcctgtctttattgtcaacctgacctgattgagagtcacgtaagagatgacatagatcatgtcagggcatacctgtgaggatggttccagacattagctgagggggaaaggtcctctcaggacacaggtggtcctgttaggctgggggttagagctaaatgaagtaaaaagagaaaaggaagaaaacccgatgagatgtaaacattcccatttctgcttccttgtctgctgaggtgtgagcaagttactccacagccatcctggcaccatggaactacctgctaccataccttcctctccattatgggctgtttcctttcaaactgagagccaaaataaatctttcctcccttaaataacttcgtgtcaggcatttggtcacaccaatgagaaatgtagttaatacttctgccaaataaaatcctcctaattggaactaattgcagaagggctgatgtgtaattgtcaaagagctaattatgaaaattttccagtctcatatttaatacgttcaacaccatctgttgtcacaaagctcatgctgaatgagtttatccaggtcagttgtcatctggggctaataagaacttcattaacctagcatcctaggcaacatgccatgctggcttgatagccttc

SEQ ID NO: 26289 - DNA, 1176 bp, Mus musculus
atagcttatgaatacatatccattttatatgaccgtttatggttccaggctagaagcttggccatctctgcatgcttagcctggaactttttgaagtgggtgaggatgtttgtgactaagcagttcatttactattgcatttgtgtcggtttttactgaacttagagggtaaaacatgatgctaaattcattataacatttattcacttatcagtcagatgatcagcatacaaagtagtagcttttcttttttctttctttttttgtttttttttttttgtttgttttttttttttttttgttttttttttgtttttttcgagacagggtttctctgtgtagccctggctgtcctggaactcactctatagacctcgaactcagaaatccgcctgtctctgcctcccaagtgctgggattaaaggcttgtgccaccacgcccagcaagtagtagcttttcttatagcggtttcaaatgtacttagttttgattggtcactcacatttgctctgcccagccttctccttgtccctcccatcttccttccatcttcctgtcatgtgtgtctgattatgctatcctttaaagcccatttttgtcctctccgtgggccggccttttgctagccttttggcctttatccacacgtattcccacataaatgcacttcatatataccattattttttttaatcctggcttaaaggtaaaatatatatatatatatatatatatatatatcaaaggaaggcatattcattatataaaatgaaaatctagactgtagaagaaagtttataataaaatttgagacaaatagaaactgagtacaccttattcaaatacttggtactgggagtatctcagatttagaattattcttgattgggaaacattttcatatgcatgtaaaataccgtagggatctaagttctgagtgtctaggttctgagacaaaaattattttatgtttcatttacttatacagtttagcccgaaagtaattttatagtactggtgttgcgttttgagacaggtctcatgtagcccaggctggcctcaagctcactgcatagtcaaggatgacctgggactgatcttctgcccctgcctccggaaggatgggacttcaggcatgtgccaccatgcccagcgtctctgttttgatggcagct

SEQ ID NO: 26290 - DNA, 1147 bp, Mus musculus
ctccagccctgcaatagaaacaaggcctcctgaccttgtttctattgcctatcttctccccccaccacactctgtgtgtgtgtgtgtgtgtgtgtgtgtgtgtatgtgtatgtgtgtgcaagagctatttctatactagacatgcttggtaatgtccttgagtgtcagctggctggaataggtggacatacccacagagtaggaaagagagaacacctgggattgctctttttaatcatcagacatagatgagggaatgaatattatgtaggcatgttctagccagtagtgcacagatgtagtacagacagaaatccaggcccatttttaaattataatccggcccatatgtgtgttttcatgtgtgttgggatgggatgcacaggtgtatgtggccatgtatgcatgcatgtgctccctccctcctccctctctctagagagagagaaagagagagactgggtctcactggagaaggctggccagtgaactttgggaaccttctgtctccacctccttaatgctgggactacaagcatgtaccaacatgcatttagaatatagatcctgggagttaaatgttcggtccttactctttcgaagaaagttctttattggctgagccatctcccagtgtctgtgttctggatgcagaaggtcaagtgaaggtcaagtgaaggtcaagtgaaggtcaggtcaagtgaagcacacactcgctctgcctggcactgttggagattcagcttctgaaaccccgattcctagagtaaggttgttttataccagggattgcaggtggttttagaaactcattagaagatcttctccctctatctatctactgctttttgttgttctctcttttgtcttcttttacctccaaagttcttgaaatcatttctacatctacagctcatcttcctcagtataaactcacccacaaatccccctacatcctggcttcttctcaaatatagtactgaaactgtatcctaaaaatgcaattacaaaattgaattagttttgagtcaccaaacattgtggtcttttcatagtgtagggtctccttagctcttctaaaacatcagagcctgttgatcaacacttaaccaacttacttcttaaaactcccaggccccttattgtg

SEQ ID NO: 26291 - DNA, 1134 bp, Mus musculus
catgtatgtatacacgtatgcacatatatatacatgtatctaatgtctatacatgtatgtatgtgtgtatgagtgaatgtgctattggggtggaaccccagactttgtatatgctagaatgctttaccaatgagccataatccttgcctggccctttatctttctatcttgtgaccaaccagaggacttcctaaagcttctctctatttggatggccaggtgtgatggcacacatctgtaacctagaaatttgggaggcaagagccagaggaccactgaaagtttgagggtcattattgtctacatagcaagttctagcttaggcagggctacccagtaagactctgccccagccttcagcaccacacagaaatgtgtcagagcatttggtagaatcctgagacattggtgaggccacagctaccctagctcagggagtcctggggaaggcatcgttttgggcttttgagctgggagtgtattagtcatgtgggtgtttgcagaatggacaatgttatgcacacgcgtgggctttcctgctttcaggattacagctctagctgatcatgccatgtggtgttggcaggcgcccacagtgagcttattgtgaaaaattagtttcctggatttcttcagaaaaaacttcctaattgacctggagttctgagtactcgaaaagctgaggcaggaggatcacaagttcaaaagatgcctgtgctgtcttaagtggaaagagggaggggttagagctcagtggaagacaccattgcccagcaatgtggaacaccttgggttccatccctggtcaccattaacaacaaagcttgcattatcctaatatagaatgagaatgggaaatgctcccacgatgggagtggttcagcttcacaccttgtcttctggattcacaccaaacatcaaatgaaatggtggactgtgctggcacagatgagattggaaacaacactttctgcagacacacttgtcaccgtatattcctcaagggactgggatttccccaacttattatgctggagcaatggtatggatttcaaagtgcttcctgactggtcaacctcttggcagtgtgcaggtttcattactgttagtcctctcactaattagttatgcttg

SEQ ID NO: 26292 - DNA, 1174 bp, Mus musculus
ccaaaaataaaagaggaacgagttatacctggatagtccagcagataccagagactgctagcccagaggtcattggcttgattggatcccaagcatcccacaggatctccattgagcatgaggttcttaccctcctcagcaggtgtgggccaccgtgatgcgagaggtgtgttgctggggtaccagacccgaggacctggatagaaccattctctctctcacttgagctctgagccagttgggaagtagggctgaggagccaggcagatggagaacagaacagcagctttattcctggtctgtgatgtgtggtgatgaagagcttcctcgtcttgaatcaggatcagactgtgacttctgttgccacaccctcaatcctgtgtagaggagagacatggtctgtgggtctgtggcacggtccctcaagctggagttccagaaggaataaataaagaagagtcagcattagttcattccctccctccctccttccatacccccttcctttctctccctttcatttcatgcttctcattagtccttacatgagatgctctgttctgacatctcctccctaccactgatggattgaaaccttggaaaccatgagccgagatcgatcttttataagctgtttatattttcacagtgatgaaaagctcacttacttaggaagcaagggttatgacatctaaaagctttatttagaagtattctggacttctttgagaggtacatgttctgaactttctctggctcaatggccatcatccactgaatcctaggggccaggacaatgtacatgctggggtcttgagggagcaatcgtctgggatgcttctcctcaacaaagtggccaggtataaggtcgaggaaaaccagtccaggatagttgagaagctggtgtgagagaggatgtgaccagggtgcatagagccagtgatgtttgctgatccatactttctttcagttattttacgagaacaaagatggagttgcacagtgacctttcttcagcttaatggagcaaatgatcgatttcatgtatttgatcatgaaaatgattataataaagtatatgtagcagacaatggaccactctaacaatttcaaatgtacagttcagtgacattaagggcattcacattgtgtgtagctaccacctcctaagccc

SEQ ID NO: 26293 - DNA, 1209 bp, Mus musculus
tgagatggggctatgcatctcctccagggtgtgtcctgtacaccccactcctcattggcttggttttgtagtgtccttggagggaccttccagggactctgtggaggacccttggttctgctactgttgcatgctcagaactttatctttgacctgggcttgccctggagccagagctggaaggtgtgttcatctcactctgtaggggagtgagctgggtctggacactgactggggatgtgcttgccaaatcccctctgttgaggaaacaaatgtgcgtagtagccattttatggctcaggaagacattttgttactgttgtgttatttctatcctggcaaatgaagcagatcatttccttgtgtatctctgtgcacatgtgtgcacatgtctgtacatgtgtgtgcatgcacacaggtagctgtgctcatgaacataggctgtggaagcacagccttggctgctggccattgctgcttcccatatttgtatttcgagacagaattctgaatttattttttaattttaattttttaaaattttattttgtattttgagttcattggcttggaaactcatctactagaacggactggctggctagcgccatctacccagcagtgtgcacctccagggctggtggttttgtgtgggttctgggaattgaattcaggtcttgttgtgtctaagacaagaactgtactgacagagtcttcttccaggcaaagaaagtaatttgtagcattggagatgtaagtgaagaaaataataataaaaaaactaaaataaataaaaaaaagaaagtaatttgtaacacatctagagaacagaaatttccagctaccgtgcacaccaactatggcaacagcagcagagacaaaaccctaagtacagtcttccctgaggattccggcaagcaaaatgttgcaggcattggaactgggcacatgcaccattgactatagcttaggtgtccgtcaacaaaggattctgggaaattcaatcatatatccagaaaggcagaggagtctggacagtttccttaattggctaaacatgtacaggactaccatggctgtccctgtcttttgcgtggcctggtgttgagctggccacttaccacaaatgagtataacagatcagttttgagaattaatttgactgggcggtggtggcatatggctttaatctcagcactcaggaggcag

SEQ ID NO: 26294 - DNA, 1134 bp, Mus musculus
ctgaaacaatcagactacacaagaaatgcagaaatggtttctagtatatgctaggcctaaagttcacccaggagttgttccagtgttctggctctgctctggtctgatgagctctgctactgtgattacctcagctgattacatcagctcaagaaaggtcagttcagccaccagcagcagtcggcatgatgcttgttggccagctcaacacgtttgcaacctaggtccagggtagatcctgggaaccttataaaagcgcttttcccaggtacagtaggtatagacgctaagtgttattgccgacacacatttttatgcacaaaaatgtaagctctttatacaaatctttatactggacttcttaaggatggaaataattctggaactttgtagtccaagtctgcattcctaatgagtgtgaaaattaacacccagtatagcacagtagccttccctgtgactctgacccttccaatgttttcttttgtgtttataatcatggccctgtctccccaaatataccaacttttgcctgtaagttccctaggacatctatttcactgtgtcgtttccttccctcttttgaaatgaagacacaggctccacacattcgtcctttccatagagcaggtataggaccaggtgcaataaaaaaaaatggccttgagtatcggccgagatacaaggtgtaccccatcttccctggcccctgggtctctttcctgtgggagtgtaactgagaagtgacagctacatcttagacgtgtcagtagcacatttcattaccagggtctgtacctcagaggtagagccagatctggagctggccatctggtgtcttcactcctcacaactttttttcgttcatttggaaaactcagaaagtgggttctaaaatacagggtgttctccagtgtctgaccttagctcaagctaagttagccctacctcctgttcctactgaaaactgtacttttgaaaataagtaaaataaagtatgtacaaagaactgggtggtgtcaaatgaagagtaaaatgtttcccaaggaccctagctcctgccattgagtaatttagaactaaaatatgaccatacttgaccctctcaagcatatgcagatctgctctgtagaa

SEQ ID NO: 26295 - DNA, 1228 bp, Mus musculus
accagctgccttaaaactgaagtttacattatttgttgacactgtccatctagtgttagccatgacgctgggaagcagtgtatctgcctcgctgttggtcagacagcaagacagtgatgtggattagcttcgcacacaacattcagaacactgaatattcccttgtttaaaaataagtgcagtgcagattgccactttccagtattttgagcttccctaatgagttatggagcatttatatctaatgtatattttagataatttttatacttttttaactcatcagccccacccctacttgattcatcctatccccaaactgccactcagcctggatgggcaaaaatcaagcattgaagttatttctgtcactggacacaattgcttccaattcccttttctgcttttcatttgtcctcttttcctggtgacagctacgagtgctgtccagctgtattggccatgccttctactccaatgcccccaagtatttcctctctcccctcgtccccaaagcaagacccagttctcaagcagtgtctgtagttgagtggaagtgagcaatgagtattcatgcaaggacttcatgtctgtgatatgcatagcaggacccaagtgtaaacagtagacaataaactttatttaagaaaactgttgcagttgtgatgaaaaataaagagattcctattaagtgttctctaagagtatttctgtaggttcactgtatttctacagagcagatctgcatatgcttgagagggtcaagtatggtcatattttagttctaaattactcaatggcaggagctagggtccttgggaaacattttactcttcatttgacaccacccagttctttgtacatactttattttacttattttcaaaagtacagttttcagtaggaacaggaggtagggctaacttagcttgagctaaggtcagacactggagaacaccctgtattttagaacccactttctgagttttccaaatgaacgaaaaaaagttgtgaggagtgaagacaccagatggccagctccagatctggctctacctctgaggtacagaccctggtaatgaaatgtgctactgacacgtctaagatgtagctgtcacttctcagttacactcccacaggaaagagacccaggggccagggaagatggggtacaccttgtatctcggccgatactcaaggccatttttttttattgcacctggtccta

SEQ ID NO: 26296 - DNA, 1515 bp, Mus musculus
aattcaggtggtagattattcctcctaatctgttctgttattatttcttcttcacttgaacaaggtaatagggaatatgtgatgtgtaccttcttaatggaacagagcagagctctgatgtactcaaatgtcacttgatttcttctttgctccaatgacagctccgtcttgtaagccgaccccctttgccagcacctgcggtaggaattggcacagtgcaccagcagcagcacgaagacattctctccaagaccttcactcagtaaagtgctaagcaacagaagaaagtgcgctcctccattccctcccctccccctagcttagcgtggaagtctgcgttcccctgaagttctggactgatttgaacaactgaatctggagtacatggactacacaggggaactgattttataagtacatgaaacagacagtaggtttcacgctttgcaggacaatagtgtttgttatgctttcgttcgatgtgagtgaactggaagagggggtcattaggcagtcgggttcagattccactgtaactgcctgtaaatgagcagagaacggtctttgaccagaacgtggggctgtgtataggcagccccaacactacctcttaattggttcaatacacataactttccatatctttcctcccttttaaggtcagcaatattttcgttttaaatgtcatcttagaaccgctctacaaaaggttccaacagataccactaaaactagaccattctggattcatgttctttcaggtttgatccattatccttaaaagtaaatgctgttaaatactaactgctgattgtatggtcgtctaacgctgtacccatgcagtctcctgtagtccaggctggcctcacaatcactgtataactaaggatcaccttgaacttctcatcttcttacctctacctcccgagggctggaactgcagacttgtgcgaccatgcccagttaacgctggtaatgagcatccatcaagaatggtcgaccagccgggcggtggcacagcctttaatcccagcactcgggaggcagaggcaggcggatttctgagttcgaggccagcctggtctacagagtaagttccaggatagccagggctatatagaggaaccctgtcttgaaaaaccaaaaacaacaacaacaaaaaaagaatggtagacaagctctctaccaaatgagctccagccttggcccctaataaatgttaagttatgaggtattaactgtattaaggtggacttcggttttttttttctattaatttcccctttccccattatattgctatgacatttccttttttgtttgtttgtttttgatttttttcgagacagggtttctctatgtagtcctggctggctgtcctggaactcactctgtagaccaggctggccttgaactcagagatccccctgcctctgcctcccgagtgctgggattaaagacgtgcgctaccactgcccagctgctatgatattttctgatttttaaattaacttt

SEQ ID NO: 26297 - DNA, 1235 bp, Mus musculus
tatttgtaaaagatttcagtttagttcccagtacccatgatggggggctctagggcacttactgggatgtctggaggaaacccctaccagcagccacatttcaggggaaagtttctttggctgaagggtctatctagtctcttatggattctgtgggtgcctgcactcatgtgcgcatacccacacacaggtgcatacacatatatataggtaattaacaataaaaatatgtaaaaaatgttgactgtcatttgattctgaggaactccaatgctgagtgacccagcagttagaggtctgtgtttgtctttaaataatgcgtgtttgcaataactataaaagaatttacatcatgcttatatttctttaagctcactttagacccctgaaataagacttgtttcatatcttgtatttttgccctaatagctgatgttccgtaaaatgcgaggcttaagcgagtttccagagaatgttgccaccattggtgatgtcctgtcccacctgacctcctcagtggacctagacttcggtgcccatcaacccctccatgtgacaatgctgcccaacccctcacatctggaagctgttaaccccgtggctgtagggaaaactcgtggcaggcagcagtctcgggaagatggggactactccccgaatggttctgctcagcctggggacaaagtcatatgcctgcaggtacgtggagtttttttggggggagggggggacctgaaagaacaatggattggtagatatgacaggctactgtagctgtttaagaggaaagtggaatgacattttgagaaaagagaattctgggctttaaaaaaatatgtttgggggctggtgagatggctcagtgggtaagagcacccgactgctcttccgaaggtccagagttcaaatcccagcaaccacatggtggctcacaaccatctgtaacgagatctgattccctcttctggagtgtctgaagacagctacaatgtacttacatataataaataaataaatctttaaaaaaaaatatgtttggtaaaaattttcatgatacatttattatttgcattaggtttttggttttggttttggttttggttttttttttttttttttttttttttggtttttcaagacagggtttcgctgggcgtggtggtgcacacctttaatcctagcgctcgagaggcagagggaggcggatttctgagttcgagttgaaaaaaaaaaaa

SEQ ID NO: 26298 - DNA, 1194 bp, Mus musculus
tcctgcaaagatcgctcgccactaaagagaggaaagaaggcagtagaccgtgtccctgccgctccccattgcttcagcacagcagacttagcaacacttcactccaggcagaagcaaagtggatggcatcaaagtgcgttgaagcatttgtctgcttgttttgtgaaagctgacaaagtccttgagatgatgcatctcgttttgtttcctgaagagattgctaaactcctgggcagaggttctcactgtaaactggtgaaaccaaaccatcagggctgtggtaaggactcaggcaggacaaaccaataaagcctatttccaccactgtatctggatagcattagaccttggtgagaaaatactgtggagcctctacaaaaactgctgtttgactaagcagcagatagccaagtccgcccttaagcctagaaaagcaaatagagaaggtagctgttcccagatatgtgatactctttacagctccttctgggtcaagggtccttagcagagctgtactatcccgtgatgcctctctccatggatatgtagtgaagggacacagctgggaccactggaatgaataatctggggccttcttacaccacatgggccatatctgcctttcgcctgagcacttgactgtcttccggcagctcatatgtctgttccataggagtttgaccactttttggccaccaagtttgccacggtgaagagatacggcggtgaaggggcagagagcatgatgggcttttttcatgagttgctgaaattgtcagcctatggcggtataaccgacatcattatcgggatgccccatagagggaggttgaatttgttgacaggccttctgcagttacctccggaggtaaggttcctctctatgtgtgctttgtttgtttgttttaatgtccatggctactatttttacctttaattgttgttacacagtcccctccacgtaaccccaaactcctatattcctagatgcataaatgcagcccactcagtgacatctaatgttaccactcggtcctggagaaacaaccggaggctcttccctggggaagatctttctcccactctgggcactccccagctgcccacgactcttagtctgcggctgaggcctctggagcctctggagccttcccctttccataatggcatgttagttgatgtaggcgttcaggt

SEQ ID NO: 26299 - DNA, 1192 bp, Mus musculus
gaaaactgggcatggtgctataagcttgtaatcccagcacttgagagagaaaaagcctggaggagcagaagttaggatcatccgcagatgcttagactgtccaggcctgagatactaaactcccgtctcaaaacctttttttaaaacattgtgtcacatcttaaactctgagaactggacttcattgtctaatattaccttaaatgtttaatataatagtttaagttggttacttaaacattgaaagatgaaagtatattctaaaatctaatcattaaataattaattagtggtcagctatatgttgtaactattacaaaagatacaatataatagttaacacattgatttcatttttgtatgtgtatagagcttaaaatgtacagggaagatggatggataattcttagcttcatcaccaagaagaaaagaaagccgggcgtgggggcgcacgcctttaatcccagcactcggaaggcaggggcaggcagatttctgagttcgaggccagcctggtctacaaagtgagttccaggacagccagggctatatagaggaaccctgtctcaaaaacccaaaccaaaccaaaaaaaaaaaaaaaaaaaaaaaaaaaacaggaagaagagaaaagcctttgaagtagagaacaagtggaatttgaagatttagtctggggcaactaactagagaaggctctatgaaacaagagttgtgtagttggaatgccaaggattctatacaaggatgagcaggaagcaagtctagggagacagcagtctgtgtacagagactggaaagaacgtggcctcaagccgtagcacagcacaatccctatcttgaaatcctgcctatatatgaaggatactgtgttgttgtatattgtaagctgcaggaggaggccgtatttgctactttatctctagcacttaccacaatgcctgacatcagaagttgataaaattatatgacatgtttaatgcccttttttatgcagtttgtgtttgttttcagattcaatcttaattcctcttgtaaagtcctggtgtgtatagagtgattctatagagtgacctgctaaatactctgtcttcttcacccctgggattggagttttttctaccatatgagatatatatatatatatatatattgggaatggtgacttaccttgtaagccttagtacagtagctg

SEQ ID NO: 26300 - DNA, 1123 bp, Mus musculus
gtctgaccatatcaaaagtgtgggggtgaagattagctgaagaaaaggtgtaggagccatacctctactggagagcatatagaatcttcaagaagcactaactctgcatggtggctgctgatgactgacactttcctgccagtgcggtaaagttcctaatgccatcccgtttgtccctttaggagacgttgatccagcagcacgtgtcatttcattaggtcctgtatctgatgttgtggatagtggagtcctccagcaattgaatgagagcagcggacacatctcagcatgtcggtctagagagttgcgaatctaaacctgggacaggctggggccatgaggcagaaacaccagcctctgccaacaccggaacaagccgacgcttccagacaaggcagaaaggccttttgtaatggaaatcacgtgagggttaatcttctcttgagaatggcagtcaagaaatgagaaggtgcacttgactactgagcagttacaccaagaagagcgtccacgaggtgactgagccggagaagaaacagttgagatgggaatggtatgggggaaatgaacttgagttttaaacttgatttaagttacagtgtctctgaatcgaacatcccatgttggaagaagatacacttgggggctccaggactacagtagaaaagtatagagcaagcagtaaaatcttctagtaaaaacatacatgcaggacaacaaaatgatgaaagagatccaaatgccagataagccaccaggaaaggtgttgttaaggagtttgtttcaagaggagcaagggatgagggagaaaaacctgtgttaaccatcagagtcagtgatgtaaagttgcctattagagtgaaagaaactgtgaagactgttaatatgcaaagcattaatgcagatggtttagaaggtctgataccagcctaagaacggggatatagttgagcccattgtaagtatcattgaaaacaaacggtgccagtgagcatgtcacagaagaacgaaggacagcaagaagcggatcagagtattttgttgaccttcatgggtttacagcctctgtgtctaaacaagatatggaaacaagtagagcttttactttgcttttgttttcgtt

SEQ ID NO: 26301 - DNA, 1152 bp, Mus musculus
ctgtatcaacaagtgaattgaaaaaaaaaaaaaaaaagaaatgttgaagtgctgtggtagactgtcatttaaaaacggctcagtatattaattttacactagctatgttactagggatggcaaatctgcgtttcagcacagtgggagtgcagggttcttgcacccatgctccctgggaactactgggctgttcactttgttggctttctggcaggttaatttatcagtgtatatggagtaagataagacaaggtgaagtgaaaatcacaaaagaaaaaaattgaataggtgaggaggatagtttcgaaatctgtcttacctaggccgtttattcctaaaattcattcttggtttgccttgagtttttaaaaatgacatctcatttttctttccttccttccttcctttttttttttttgtttcagtttgggattatagattttactactctcaagtgtttacctaaattttggtgtatcattttattattacagttttgtgtgtgtgtgtgcacttatgcagacggtgtgggcacctgattcaatgtgggcccatgagcatgctggagttgcacctcatgaatcgttccttaggaaccacctgccctgtgtttccatagagtgactctgacctgccttgctgttaggctaggccggctgcctatgagcctcaggtaccctcctgtccccctccctaggttatgcttgggtttagtttacttccaagttgtcctttctttgggggtttgttttcttgaggtcttaattgaaatcaagggatggttcacctagtctttctgacactgtgacactttgcctttagtgttgagggctgcctgcctaagtacagtgcaccctctcaggagcctgcctaagtacagtgcaccctctcaggagcctgcctaagtacagtgcaccctctcaggagcctgtctaagtacagtgcaccctctcaggagcctgcctaagtacagtgcaccctctcaggagcctgtctaagtacagtgcaccctctcaggagcctgccgaagtacagtgcaccctctcaggagcctgccgaagtacagtgcaccctctcaggagcctgccgaagtacagtgcaccctctaggtgcctgtctaagtacagtgcaccctctcaggagcctgcctaa

SEQ ID NO: 26302 - DNA, 1231 bp, Mus musculus
gccctctagtcgaattgaagtccttcccattgacatgggtgccaggggctacggcagttcggggtcaccaaagaatggacagttcatccttcctccggtggactatttgccagagaacagaaaatggtcagaagttagttacacatacagaccggagatgcatggccaatcatggactcgggatgctcaccgtagccacttaagcaatttaccaaactatgcagcctttcagcacataccgtttcaggcccatggccttccagaagtgtctgtagacagtccagtgaggtataagatgtctgcagctgtggaagatgccagtcctcctgggtatccatatgcagggccctcaccttccgcacatcactacagaaatggagagggactttctgtgcaggaatcagtgttgctgtgagcgtgtggctgtattcactgacaagagaatagaaacaatatgcccacattgctatgtttataattgccagagcagtattttttatattgtaaacagcgtgcgcagctcagtgtgtgtcagtgataagagtgtgggaaggcttcatcctctgcagaggctgctgaagaagagtgggtcagctgcatcctggctgaacctttaataggggaccctggggacccagcagtagcacgagggctgcacacacagggcggctctctgtgctggtcccttcgtagctccccagacccgctctgttccgttgctgttagaacagtagactactgaccgctatagagcagatactctgagggccgaccctcgccttttcatagacagacgaggcaactgcatataggttttgtctttaaaaccacctttaatctagatacatagactaacagtggattttttttaaccctttatctttctgcccaccctgcccaaacatattttaacccaggttctaaactgaaactgactagagatgaatccagcgcctgacagaatgtcattctccttcagttgctgccattttatctcctcctgaaagctaaaggctcaccacttgatggtgcctaaagtgggtcggttacccgagtgagcggctgcacagtgctcactgagtcccctcatctccagcagtcttggtgctgctgtgccccgggctctggtctggccgggtgtgagggaagtcagaccttgcagggccccaggccgcagaagattgcatttcacagtcgtggggaagcagctctaaccataaggaaggctgct

SEQ ID NO: 26303 - DNA, 1100 bp, Mus musculus
ttattttgccactataaaattttattttaaatttatttttaaataaaagaaatgataagagaaataatattgacaaagtgattcaaaatctatttatagaaaggcttgctggggacattccaggcagatgagcagccatgccccataacggcgtgcccacagtggccgggccatggcttaggcttccctcatggtcactttgcccattacgtcagaagtaagtgtctgggtgtggtagtataagtttcttaaggaattgtcctgctgacctgtatctaactaatgaacttaagggtctgggtttttttttcttttgtttgtttgttcattttgttcatttgtttgtttattttgtttttaattatcaagtctcaccccagaccacttaaatcctatctttggtaaaacgcaggtatcagagaagcatatttcccttgtgtctcttaatactgtcatcttgaaactctctctaggaaaaatgcccaagttgtcttctgtttctattgtgggatgtttaaaaatggtttgttgttgttgttttggtttctgaagacagtattgctatatatcccagtctgaccttactgtgtgtttgaggctaacctagaaattgaggtggaaaaaaaaaaaggccgggcggtggtggctcacgcctttaatcccagcactcgggaggcagaggcaggtggatttctaagttcgaggccagcctggtctacagagtgagttccaggacagccagggctacacagagaaaccctgtctcaaaaaaaaaaaagaaagaaagaaagaaagagagaaattgaggtgaccctccctcagcctccagaggactgagatatgtgtgtgcacctcccatctcgctcagcacagggtttctgtgggatgagtttgattctcttgttctcactgctgaactggtgtttaaaattcttcgcaggtcagaagtttgggaactcaaaagtgacatcaggaaagttaggaaaaagtccactgtcaacattatcagctctcctcatttcgagctatctgctagtcacagctgaatagctttgaggaaggaggtgtggccccctcacacccagacacccagacactta

SEQ ID NO: 26304 - DNA, 1101 bp, Mus musculus
catttgagaggtacaggcagaagagaagacaatcatggtctgattagttgagtgacaggagttaacagtgatagtggtttgagctttgtgtctgtgactcttgtcttcatggagattccattctgacccacttcctcatgtctaaactgaaggtggggtgtttttttgttgttgttggtttggtttggttttggtgttagctttgttgttgttcggttggtttttgattgttgcatttttcctgtttcttaggattgagttgattggtttgacgtgtttggttcagtgtcacgcactgatacatgttctctgtaattacatgtcaccacaccaggctttagtggccaggagggatttgaccttgttcccaagggattgagagtctagtgagcagcccaggggcaaaggcagtcaacttgcatgtgatacaagacaggccaggcagagctggtgtgacttgaggtggcgccagcctctcaggcatggtggctgggttggtgatatacagtgcagcagagctgccctcagacgtgggactgcagagtctgtttggatttgacacggggagtccttgctgacctcctgtctccctagagcacaaacaggagggggcaagccccttgaaggtttggatgggatgagatggacagttactgtaatgaaggacaaagggaaccagggacggggaggaggcatagtctgtggtgacagacaatgctaaggagggatcgctttgcctgccgggttctcaaggctctctacaggttgcctcttgtactcagaagtattaaacactgattattaaaccttctgcgatgcagccttgacttatttgtgggaaatcgcaatcagagtacaaagcagggagatggagcagattgcacacgagcatcaacttggtagagcagctgttcaaacactgccatcatgagccatacaggaggagcccagaacaaggaaagggtccatgtgcacgagtgggggtggagaggactctgccacatgataaatgtcacgtggcagcaagcaacgacttgagggagttaaggacctctggtactgatgagtggctgcagtcttggcaggtggcagagtccttct

SEQ ID NO: 26305 - DNA, 2498 bp, Mus musculus
gctactgtaagctgcgtcatgttggtgcttctgtggattaagttgtgctctcatcacaagtcttaaggtcttaatgttatttgttgataagacaagcttagaattggtttacttaaaacaaaaaaaaaaaagaatttcaaaaaaaaaagttgtttgcttaaaaaaaaaaagttcatgtgagagaaaaaagaaaaaaaaagaaaaaaaaaaaactattccagactaagttttgtgttggcctgagaagcattggcgtcacttttttttattgtggactattagatgtgtttgtgttcagcaaaatgtgatgttttgttttttcttttaaagaaaaaagtgaaaactatctagtgccaaattccaaaggtacttcctccctagagcttcgcgtgtttcctgtgagaagtgatttgataacatggtattttattatgtgttttgtataaatccctaatatttaaaacaaacaaaaaaaaaaaaaaggttacaaagtttgttaacttgctattccgtggtcttgttgcctgaaattgttattgtttgttatttctctatgctgttttttgtaagacattgtataagtgccgtgtgtcacttttctaacctctccacgtcaatgctgtgacggcagccctcacaatgtattctcttcataatatctggaaacctctaaggtgagaaagtcctgaacttttaaccctttctacccagagctatctggaatgttggtgactttttatactgtcatccttgggtttgttttggggtgtttagatatttttttccatttgtatcttctgagttattttttgttttttgagtcacacaccttcccaaaaaacccttaagtctttttcctaaaccgttttttattttcttttttatcccctccttcctatcaccctgtgctccttcagtttaaatataagagactgagtagaccctgggaagggaaaaacaggtagagcttagccctacacaaaccctaaagaccgtgtctgctttttgataagggtttcatggtatgccctcgtgtacaatatttttatacaccctggagttaaatggctttttggtggtccaatctttcaagaagttttacttttgtttcttaaacacccctatgtaatgctgagtcagcctttggctcgggattctcagacgcatgtggacacctgaatatgcaaggtgtcttcctgaaaagcccacacatttcaagtggttggccatgtaagaggagatcagctgctcttcaccacaattactaccaaatactaggactagttcctgctgttgctctcgaaagtgccatattcctgagtctggcttcatatgagcagatgtcttgttctgacagaccccaatgtcatgcctacagtccaaacacacacccagcctctgggaaaacacaccctgcaagcttctggtctcagctcccttttccttcacaccctccctccatttgatttaatgtgtgtgtgaatgtgatagccctgagatggaaaggattagcctctcacaatgcaaaaaaaaaaaaaaaaaaaaaaagttccctccttccagcacgcgcacttccagtgacatgattggtgttagcccactgtttaccactgccggggccttccttcatccttgagggctattttgtactttctgcagcactcagctcactaacagtgatcacacacattctcagtctctctatggtggtgtgtaggtacacgtgtagaaacacaagagaataccagttgtatttcatagaccatctcgttcacaatctatttagttattaatgatataaatctcaaaaaaaaatcttgacttttttttttccccccatggaagccaactgccctccttcctcttaacccacctgcggcccccgcagaggctcgggtcaggcaggtactttctgttgagctcggtttctgattttgcaggcgaccaagaccgtccattgaggcgagggcttggttttgcatgtttcattgttagaaagttagccttcctcagagacagactgtccttcctctctcagtatcaaaaggaaacgctgcaagggtgcgcagggcctgtttccggaagacaaaacacagggaaactgcatttttaaaaatcaagtgtaaagcatatagacttttaaaactcactcagagaactctgatcagatggcacctccacggtgtgacaagttcatctttccttcaccgcaggggttctagttccttggcttgtgctactctggaatcatttactgtttctgtctttattatcttaagtgctaattaaaagaaaataaaacttaaaaaaatgtagtttcattaccttttgaataatgtcatacaaaaatgtatttgtgtttttgtgctgtgggaattgttgtttgtagattaataataccattttgtttagaactacaaaatagtttttaaatattgtctgagaaaagccaaagttaatgcaacctagtggaaactgtaagaccatttgagtattgt

SEQ ID NO: 26306 - DNA, 1102 bp, Mus musculus
gtatctgtgtgcatacatgcatgcgtgtgcatgttcataatgctggggtttggagccaggcccgaggtatctgtgtgcatacatgcatgcgtgtgcatgttcataatgctggggtttggagccaggcccctcgtgtatactgagcttcctaccatgaactgtgcctataactacctgtaatgttaaacaggagagaaagcagacactgaggactacatattcttgtatttcagtatattcttacctgagtacactcttaatggcagtgtcactccaaaaggatggcattaccatctgcagataaatagacacaacctaggcccacagcaatttttggaagctgggctttggcagtgatctggtaggtatcccaaccctaccactgcctggccatcatgatcctctcgtatcttttggggtctttgcttccttccttacctctgtctccacctcacattcattttgggaagagacagcatcactccgcccatttacttctgtttaaaaccagctttggaggcaggactgtagctcagttgttagagcacttgcctagtgttccaagctctggctctgttccacagcactgcatcaattaggcattgcagcccctgcccttaggcttaacaatcagtaggtagaggcttcaggtcatccttgcttccatagtctatttgaagccagactgggacatgagaccttgtctcaaaacaagcaaacagccagggctgcacagagaaaccttgtctcggaaaaaaaaaccaagcaaacaaagaaaacaatgtttgtttcataccttctgtaagaatactcaccgtgaaagccacccccatagaaaatgctgagcaaacactggtttatgttatttaaaatgtgtagatgactgacagtttggaatgttcttacaaataactagcaatgttgatcacccatggataattaaaagaaaaattttttatgctgaaaaacttatggactttaaaaagaatactcaaactttgacctgactaataaattgtctgatttgagctacaatggctatttatgaatgggctaacctagataggagtgatgctgtcacctgagagtatatttgtgtggc

SEQ ID NO: 26307 - DNA, 1192 bp, Mus musculus
gactccctagatgttgtgttgttagaagcacgagaacccctcagctctataaacccacagaagaccccaccagtgctctctcctgtgcgtgtccaggacagggctgatctggcccctccatcaccacagcctcccatgctggctccatttgcaaagtcacaactaccaattgcaaagccgttagaaacaaagtcgtttacaccaaaaacaaagactaaagctagctctccaggtcagaaaactaagtcacccaaggctgccctatcaccagcaaggcttggaagtcctattcggtcaccaaaaaccatcccaaaagaaaagaagtcacctggacgctccaagagccccaagagtcctaagagccccaagattgtagctcatgttccccaaacccctgtcagacctgaaacaccaaataggaccccttcagccatggtggttgaaaaaactgttaaagagaccatcccagtgatgaaaccaacacagactcccccagaagttgtgaaactgaacattgaaatgcagccgaaaaagcctgtggtgacagacaaaaccatcgatgactccatcgatgctgtgatcgcacgtgcctgtgcagagcgggagccagaccctttcgagttttcttccggatcggaatcggaaggagacacttttacaagtcctaagaggatttcaggctcagagtgcgccactccaaaagcctccacttcctccaataacttcaccaagtccctggccactcctctgcctctctccagcggaacctcaagttcagataactcgtggacaatggatgcctctattgatgaggtggtacggaaggcaaagctgggagccccttccaacatgcctcccaccttcccatatatctcttctccctcaatttctcctcccactcctgagcctctacacaaggggtatgaggagaaagccaagctgccttcgtctgtggatgtaaagaaaaagttgaaaaaagaactgaagactaagttgaaaaagaaagaaaagcagcgagacagagagagggagagagagagaaacaaagaaagaagcaaagagaaagataaaatgagagagagggagaaggagaaggaggctggaaaggaacttaagtacccgtggagggagctgatgaaagacgaagattctgatccctataagtttaaaatcaaagaatttgaagacattg

SEQ ID NO: 26308 - DNA, 1108 bp, Mus musculus
aagagggccttgtctcccttggagctgaagttacaggccttcctaagctgctttataagggggatgagaactgagctgagtcctggaagagcagcaatcactgaaaatctctacagatttctagtaaaatctctaataaaattgttttcattatccttcatatatacttctgtaagttatacacaaaatgagtttacaaatataaagattgcatcgaatccatttgctaaatggtagcaagggctgtgtttcttaacacagtgaagggttaaagtgagaaaacgcatacttgtcagatctaatggcattattccattttaacacctctcttcagagcacagccctaattatggctgacagatacaattgggaatagttagaaaaaatggtagttctggaccagtcatcagcggggcgaacactcaggaagtcccagcaccgtggtgaaggagaaacgctcatctctcatttcctttcatgcacagtgtgttcggattaactttaaaggagcatgagaggtgggtcagaagattgtgtctacaattgagtactacctgtgtgtggagcccagctcagcaggcagccagtcatcagctaacaagccttgccaggccccgtgacaattcccagatatcctgttgcaaattaaatatgaaacagggatagacttagcttcgcaattgaaggatttcttcacattcagcttcaaatgcagttgttggtgcatgcatttttattaaagctggctttgtggagaagggagtgatagcttgactgtctatgtggtgttatagaaaatgctgtgggaaaacgaatgccgtgcagttctgtgcctttccgcgtctacatggtgcatacagtaactctccttgtaaataaacatcacagggtcggcaagcccacgcactaaccatgcagcctgttcgtgaacttgtttgcagtgtagaaatgctaaggttttcaacaaatgtttcatggcaggtgtcttctgaagctttgctttttcaagtttattttcaatgcttttgtagtaacagaaatagaacgtggtgaattagattagacattgagggacagaaggccaggttgtggatctgaagagatgtga

SEQ ID NO: 26309 - DNA, 1230 bp, Mus musculus
ttcttccttcatttattgagacggtagctcacactgtaagctactctagaatgtatcccaagttgacctggaactcacagatgtcctcctgcttcagcctcctgagtgttagggttatagcatgaaccgtcattgctcagcgatatagtccttgtttaggaaattcttcgcattctctcacgaggttagagttcaagtttgctcttctctcatttctaatctttatatgatgagaaattaggaaggcaggaacttggtgtcaatattttgcttatttagtgtgttacttcattctaagttaacagatcatttaatagtcatcagacagcaacgtcgctgtaactaggtgacgcatcagctgttcctaaagtacttcctgtgcgtctcataactgttaactcggtgtagctgtgtaagcactgtccatctcaggtctgtgtggaccaagatcctgttgggagtcactgcatgcatagtgtgcagagctggaatgcttcgcctgtgcactttactctgcatctggacggtcacgctgttgtctggtttttttgtttttaaggcttgtgtaaagtggatgagacaccgaaaggctggtacattcagtacatagacagagacccagaaaccatccgtcggcaactggaattagaaaaaaagaagaagcaagatctggacgatgaagaaaaaactgccaagttcattgaggagcaggtgagaagaggcctggaagggaaagagcaggagacacctgtttttacagaacttagccgagaaaatgaggaagaaaaagttacgttcaatctgaataaaggagcgggtggctcagcgggagctacaacatccaagtcaagctctttgggaccaagtgcactgaagctgctggggagcgcagcatccgggaaacggaaagagtcttcacagagctccgcccagcctgcgaagaagaagaagtcggccctggatgagatcatggagctcgaagaggaaaagaaaaggaccgcacggacagacgcctggttacagccggggatcgttgtgaaaattataacgaagaagcttggggagaaatatcacaagaagaaaggggtcgttaaggaagtgattgacaggtacacagctgtggtaaagatgactgactctggagacaggctgaaactggaccagactcatttagagacagtcattccggccccggggaaaagggttctagttttaaatggaggctacaga

SEQ ID NO: 26310 - DNA, 1134 bp, Mus musculus
tttagtaaaagatggggtgtgaggtcaccaaataaacaattggctgggctgaagacaaatgtggaagttaaatgggataaatcaagttgttattgcagtacttaattatgaagagtcggtgaactgagttgttgagcagaattgtggctttggcttccagtaccaccccctcccccaatgaagaaaggaatagaaatgggtcattttaaagagacttctcactaaagtttcatatacagtgatctcactacctcctatccatccatccatgtgttgctgtatcttctcccattccacctttccatgatctaccacttctagctggaggctggggatgtttggcaagatgaagtatagagataccacttctgggccccaaagtcaccctgaggatgtggaaatctggaaaccagagactgcagccaatggttttttttttaatcaggaatcacagtcaatatttacctgaccttcaggaggcagagacaggcagatctctgattctgaggccaacctggtctacatagtgagttccaggacagccagggatatgtagggagaactatgctgagaacctgtttctgaaaatccaaagtgtgtgtgtgtgtgtgtgtgtgtgtgtgtgtgtgtgtgtttctgtctgtctgtctgttcttctgtctgtctttgtgtgtgttataacctgaactgcatgttctcacagacaaattaagaacagggttctttgaataaataaatgctgtggactaaaagcatcctttcaaaacacacatccttaagcctaaatctgctctgtaacggtccctccaagtggagtctttcagaaggggtcaagtcctgagaacagagctcttacacactggtttagagtgttcatgagaagaaatttacatgggagaatctgatgggagggagtatggaaatgctttagatagagaattcatatgtgaaattttcaaaaaatgtttagttaataataatcagggaggctggttggtaaagcattctcttgcaagcacaagaaactgagttgagccaccagaactcaaaaaagtcaggtgtgggtgatgcgctttccattcccagtactgaggaggctgaggcaggctgatccctggcgctcgctggccagtc

SEQ ID NO: 26311 - DNA, 1152 bp, Mus musculus
tggagtcctcatcaatgatgtaaaccagaagacaatgaaatggtaactttgaagggggaaaagaaaaatcactatcaacccagaattgtaccacagtaaaaccacctctcagagacacagatggacagggcagatacaaaagaacagttacaagtgcggccatcataaggaaagcatggcagatgtccgactctgaaggcacaaaaagactgtggtccccagagttcctgttgggtcatgaatattagtactgtgtcctccctgataagaaaccattgttctttggttttctctagcactggctctccagtcgctgatatattttccaaaatcctctactttttttcatttttcactttgtaataacaaatctccacaataaattagggggaaacctctaggctttgcaaccagaaagtcatgggtataattcctctaagagagagatttctcacttacaatttttttcagctttatatttgtgactactagatgcttagataaattttccaaatattaatttgtgttttaattgctcacatatgtactgaagcccagagaagttgacacaaagaagaacaccctgtctcctcctgggattgtgaatgtctaggtaaaccatttccttcatgcgcacaaactagctttcagttagacttttgcacgcgctcttctgaaagaatgcagtactacccactggtttgtaaacgattagagaaggctgatgttgcctttgatgagatcataccaatttgtaatatagacagacataattgaggaaaacaggcatgtaacaaagaaaggaacaataaagaaccgctcaccgacgtgagcactcgaagccaaaaggagatcttttctaaatggctacaattctaattaactatcccctgggcagttagctttcatctgtagattctttcaacaaatagtagattggctgttacaagaaacgcactgtaggaggtgtcccctgccggccaccttgcagcaatggcatgcccctctcttactttggaagcagtgtttttgcttttggccccaccctaaaaacattaagatcagcataaaaatagacttcctttcattcacaccccatagctcaatacacaattaagatccctcttctctgtttattttgactctttctct

SEQ ID NO: 26312 - DNA, 1184 bp, Mus musculus
cctgcacatacatctgcatgcattcagttaatctgtatatgacagggttctggctgctgttagatgtacggtgacctcttaagaagtcgtggtataaatttacagccctatattagatacatctgtcaatttgaagagaaaagtagacattttgttatcagttgttcttgctctggtgcatctgagaataattttgctaaaaacatgtgctaatttctaataaatgcaattttatttgggaaggttaatttgtttgattaaaacaatggcataaactgttgctttccatccacttgtgatttttgctgttggaaatggtgttggtttatggatgtgtagaggaggaagggggttgggggtggcggctgtgcaggggatatcaggatgtttgggaaccgcttggatgatggcgtgggaaaaaatgattatcttctgctgtcatctgtttccatgggaaccttaaaaaatcaagtttaaaatacggagttttgcttctgtttgaacagcctctgcgagggaaaggccctatagacctcattacagttgattccttaatagagctgcaggactcccagaatccctttcagtactggatagttagtgtgactgagaatgtcggtggaagattacgccttcgctatgtgggactggagcacaccgaatcctatgaccggtggttattttacttggattacagacttcgaccaattggttggtgtcaagaaaataaatacagaatggatccaccttcaggtgagaggcggcattttctttcctctgtgacgtgcttgtgatagagatgtcaaactcctgtgggtgtgtctcgggacacacctgctcatgtgtcttttacatgccagtatgtggaacctaagtgtgtcagtgtcagagtctttagggtagaaaataagatccaagatacggatcagaagcattctcaaaggagaactccatgttgatgacaacatcagtcaactcaaccagcaggtcagattccaatggtgtcaatggctcagaaaagaaaggaaggggtgatcagctgggatttcgcatagtctccccatcccttagggaccgtggtcttggaagcatattccacaatctgtttgcatgcccatctttctgactgcctgttttctgttcacccttccaccccttcttctgtccatattcatctgtccacc

SEQ ID NO: 26313 - DNA, 1124 bp, Mus musculus
ctttgtgtctgtctgtccacatttccctgtgctgatactgacactggccatttgattagcactaatgctaactccgaatgagtgcagcttaattacacctgtgaagattctgtttgcacctgagtgtcctcttcctgggttccagtagatgggaacctgctgggaggaccgcttctacccaatcccacctcttgtcacacacagtgattgtataaaaataagctctcctgtgtccctctactgaacacacacagaggtgagtatgatcagaggaattgcagggacatgtgtgatgagggtcagagtgtctttcctcttccttcatatttctctctctctcaaatatatttttaagagtccctcagtattcatttgcacatctctgtaagactgacagcccggctcccgtacttccttcttttttttttttttttttttgtagtgtgtgtggtatatgtatgtatacatgtgcacatgggtacatgtgtgcatatgtgttctagtatgttttgaggacaaaagtcaacactggctaccttcctcggcttcttgaccccttattttttgaggcagtatttatcactaaacctcaaactcactaatttggccagattggttgaccaacaagctggggaagcacctctgctccatagaaacagaaaccacattctaggaaatcttacccatcatgctcttgaaatcttacccatcatgctttagaaatgccaagggcttaattcccgaggagagagctcaggcttgccttcagtgactcacgtctagtctagtgtgtcattttttttttaagttctaaaacctctcctggattccctctgcatactaatttgcacgcgcccacacaacaataacaaacctaattaatagtaagccctaaataagcagcttcgtgtgcaagtgtgtgtgtgcttgttcgtgtgtgtgtgtgtgtgtgtgtgtgtgtgtgtaggtcagaggtcagtgctttgtttcttagttgctcttcccattcgttttagaggcatggtcttgcattgaacctggacctcaccaattcagctagctgaggtggctagcgagcccctggcctccatatgtccctgccttgccagggcaaggatttcaat

SEQ ID NO: 26314 - DNA, 1194 bp, Mus musculus
tcagtgtccactctccccgctggccagctctgtgtccactctccccgctggccagctcagtgtccactctccccgctggccagctctgtgtgtactctccccgctggccagctcagtgtccactctccccgctggccagctcagtgtccactctccccgctggccagctctgtgtcctctctccccgctggccagctcagtgtccactctccccgctggccagctctgtgtcctctctccccgctggccagctctgtgtctactctccccgctggccagctcagtgtccactctccccgctggccagctcagtgtccactctacccactggccagctctgtgtcctctctcccctctggccagctctgtgtcctctctccccgctggccagttctgtgtccactctccccgctggccagctctgtgttcactctccctgatggcagctttgtagccacctactattctctgctgggaactactgtctcacagtcacctctctttctctttcaggcattttctcggggcttctcaaagaacatgaagcttgaagctgtgaaccctgtgaatccaggagaggtgtgcgtggccactgtggtcagtgtgaaagggcggttgttatggctccatttagaaggtatgtgcaatcagctgctgtttagaagaacttgggggtactctctagagggtggggtagaaaagaattcagcactctcataaataccccctggttacccttctatttaaacataccttaaattattcagtgttcttaaataagtgaaactaatcaaatacaaattcattccaaggcgctcatcttaactaataatttcatgaaatgagatgctggtgagataattatgtttggaacacactggtctttttacatctatgattataaaagctaatgttgcaattaaattaatatgagtcactaaaaatggtatttgaggtcttggtcattatgagaacaaaatgatatatttgcattttaatgtgggcatacccttcactttggtttcttctattggatgttttatttttcctcaaaataacaatggaagaatggtttctctctccgaataaaattagccttttttccttttctttcaatgatgttgagacagttctttacagatactatttatgttagaatattcagaacactcagagaaatgtattttgtgacta

SEQ ID NO: 26315 - DNA, 1475 bp, Mus musculus
taccttctccctgctcctgttatagaggaggctacgtagaccaaaatgagaaaaggaatgtggccacagaatgtaaccgtccagtttctgcctttcactttcttgggggttgcttgtgaaattaggctaagtcatttgtagactaatcagtgattgtaagtttgcctgatactcagcacacatctatgttttcctatgagcagttcaacctgtgcctgcaaagccaaaggggctgaggtacattagagcatggaggacacctccacatcttttgaaatccaggcaaggagaccaaaactttcgctctgttcacttgtgcctcactttggaagcttaacttcccacctatctgggccttactggtttacttgtggttttccatagttttccataattacattcatcttctttctttgactagaatcacaaccatcccagagcatgtatgacaagcttgtgttttggcagcattttaaggcatggtggtccctcaggctttgaaaacgcctcttgcctatgttagttacccattctcaacactgggccatggctgcagatggaattggaaagtaaaatatttgtggctgagcctctttagtcttccctgaagctggctttctatggtcaagctataattctttggtgaataggtatgcctaggaacaactggtggttagtctgtgtcctgtgtggaactgtaaggatggagctgcccctgataggctctgtggagttggcttgcatttggatttctctcttctaaggtacatgttaaaccttcctctgccttctcagccacatgcttttggccataaatactcaatctaccagttggaaagggtatctatttcaagatggggtggcgtttttcccatactcactccttcttgattcttcactgtggtcttttccagataagttacttcttttgcatctgaaatgggatgtggccatggcattgctagaatatggtgtgcttttagaacaaatgtggccttctcatgccatttccagtaatgacgcagaggaggacgtgttgcctcagaacatggggacttcctagaggtctgctgagcccacagaaagagccaggaaagcattaacagaaaagcctgtcaggacatgtccaccactggtcagaaactcttcttcccgtggaaccaaatgtcccagactctcttcatgcctcagccttgcagtgtagcataggtctctctctgcacagtgttggttcctccagcctaacctttggctttgggaaggaagagatgaccgtaatcttgcaacaagagtgcccaaccagggaccactgtcatcatagtggctctcaatgtgcatgtcacaccccccctcagtagacttgagtattttgatgaccaaagaggatgattttcctcagagagaagtgccagcgccctccagagctgtgatccaggatggcatgctcacgtgcggaatgcaattttgccaccggt

SEQ ID NO: 26316 - DNA, 1156 bp, Mus musculus
ggtaaatgtttgttgtcttgcttgcaaagtggcatttgtgtgtgtaagtacagcatacaaactttttctgaaactctttagtgtgttcctcagtcccgtttggagagaaggtccttctttcttcctttttcttcagctcatgagggcacaactcagtggacgtgcccaacctgctggagggggtcaggttttttcagttttttgttttgtttccttaaagatctcattgctgttcttgatattgttgttgctgttgttgttgttgttcttgctgttgttgctgctgctgttgtagttgctgttgttgttattgttgctgctgctgttgttggggggcctgttacatttgtttgggaaccagggactcagctagacaaaccctgagctctatccccagcagccctactactgttttctttcccatgtggttctaaaagtgctgatccttctgcctcaacctccccagtgatggatgctaaggaactctgagttctgggattagaagctcagttccttctttgtttgtttgtttgtttgtttgtttgttaaaatctggtttcaaagctgtagtcttcgtgacctgaaaacttattgtattgttcatgctggcttcaaactcacagaaaaccttctacctccaccccctcagtgctgggattacaggtttgagctatgatgattttgttgttcatttgtttttgctttttgagataggaggtggaataccacactttagccttgaatctactaaggttgaggatgacctcgaactcctcatcttcctgcctctatctcccaactgctaagcttacaggaatgtatcatcatacgcagctaattcttcttaacatgaagaccggggacctaatgaagtagtcagaggttaaagcgcttactgcagacacaagaggatgagagttcagatacatatgcagcacccacataaatacctggtgtgcatggtagcatgtctataattcctgtctcaaaaggctgataccctttcccaaagcaaactggctatttagactagctttaacagagagctctgggtttgactgagagaccctgcttcaatgagtaaggtggagtgatcaacgaagattcctgataatacccataggtccccacactcatgcttgcatacatgcctgca

SEQ ID NO: 26317 - DNA, 1192 bp, Mus musculus
aacacctgacaaacaataaaccagtttctgccgacagggcccatgtatctgatgtcttgacagcttcctgttgatgctaatgcacaagtgggtaatacggtccttatggtcctgactttaaagatgggttttaattgtcattgcggctagctaaaatagtgtctagagcaacgcttatgctatggggctcttgagagttgttacactgcatctccttggagcacacagagatcttacagtctagaaagagatgtcctttaagtaagggcttgaacaggtgagcagcatttcagaaagatgtgaaaaaggacacttgggagcatatgcccagtagaacggagaatccccttccacttctggttttgaaaacgctacacagatcctgtaaaccaaaactatgagatagggacgctgttctctaggaaagaaagaacataacagaaaggtaggttatgtcattcacggttgagagtggaagccagtgaaccttctggggttttcgcagagctgagtgagcctgctttgcttttcttcaacagtaccccgcgattttccttatgaagaggactcaagaccgagatcacagtcttccaaagctgctattcctccccccgtgtatgaggagccggacagaccaagatctccaacaggccccagcaactccttccttgctaacatggggtgagtgctaagtgtcctgtctagccgagagaatgttgaagtgccttaagactctgaggttgggggtgtggctcagtcctgcagtcacagcaccctgaagatgggggcagaaggagtcttgagttttaggctagcctgtgaagtgtttgctgatttttttcaataggtggaactcttttgaaaatgaatccacttggatttctagagcaatacttgtttggtcatatgttgctctataaaggattagtgtttcataccatgctgagtgttttccaaaacagtgagggtttgtacaaagcagccttctatataagtcagggataatctaaacacattgtgctccgcaggagaagtttctgttgatgatatcatttctcataatatgcagataaagttgctctaggaattggagatgcttcatgttctctccaaaggatgaggggcactgggttttcctgaggaaatgggttgtttgccttagactgtgcttttacacctttgcttctaagaa

SEQ ID NO: 26318 - DNA, 1152 bp, Mus musculus
gaaactgctcataaagatgaaatatcagatgtgtaaagtggaaacatcattctttaccatgtatttagttgacttttcccttgctgggacagtaatttttacctactctaggtgtttgaccagggcagatgtggctgaagagatggctcaacagttaaaagcacttaccactcttgcagaggacctgagttcagttccccacactcaatggtagctggcaaccgcctctaactctagatcccaagtttcaagggacccatcactctcttctgaccttagtgggtataacctctacccacacatacaaacgtggtccacatgcaaacgtgtaggcagaatagttacatacagaaaataggattaaaaaaaccttttaaaataatgagcagagtaagtaagaggagtaagagttgtgcttgttttaaactatttatttgtttatagtacaggataaaacccaaggttttgcaagcactcatgtttagacaatgagctgcttcctctgccaaagtttcaattatgcactaaaatgttgcgactgtctccattctctccccccagcaatgcacggctgtttggaagcagtccaggtgcttcttgaaaggtaagcacaaaacggtaagttggtggaaagtatttcttagttataacaaggagctagtcttccttttatgtagagagctcagagcccgcaagcaacaaggcctgcgtaccaatgagcgttacaaggaattcagtgtcccccataggagtgtgtggtaggaggacccagtatatattaataaagactctaaaagagtaaatgtctctgcaccagccaagccaaggctgttcacctgaggataacggctgcagatgaggggcaagggagctttgtgcatgaagactggaggtagttcacagtatgcggaagtctaagcattaaagagaatacagtagctgtagactgttgtgaagttcgcgttttattctgagcatgtgaagtaccattgaggagttgagttggttgtttggttttgagaaggatcttgctatgtagtcctggctgcaggaactacagaactcaaaatgtagaccaggctggcctcagacatacagaacgcttatctgcttctgccttcccaattctgatattaaaggtatgcaccacca

SEQ ID NO: 26319 - DNA, 1198 bp, Mus musculus
tgggctacacacctcatgtgcacacagtcctacattcagtccctagccctgaaaataatgtctcttccttttcatttgtaaaagctgttggcgcaattggtactgacatcatgacttttggttttgcttttttgatgaagattttacagatagatagatagatagatagatagatggatggatggatggatggatgaagattttacagatagatagatagatagatagatggatggatggatggatggatggatggatagatggatggatggatggatggatggatggatggatagatagatagatagatagatagatagatagatggatggatggatagatagatggatagacagacagatagatagatagatagatagatagatagatggatagatgatagatagatagatagatagatagatagacagatagatagatagacagatagataccttgtattggtgttttgcctgcatgtatagaagtgcatcctgtgcctgtccctgtggaggccagaagagggtgctgagtcactttgaactaattgtagaatgttgtaaattaccatgtggagccaagcaatgatggcacatgcctttagtcccagcacttaggaaacaggggcagttggatctctctgagtttgaggtcagcctggtcaacagagtgagttccaggacagccagggctacgcagagaaaccctgtcttgaaaaaataaaaaacaaacaaacaaaaacaacaaaagtaaattaccatgtggctgccggaaattggatccctgggtcctctagaagagcagccagtgctcttaactgttgaaccctctctcccttattctttgtttttgagacaagatctcagaaaaattatgtagatctggctagcctcaatgccaggattaaaggtgtaggctaccacaactgtctgacatcatgactatggtgatgaacactaaccaccaacctgtgactgtggttgtttggtttctgtggatttttttccccagattcatttatttattcttatgtgtatgtgtttttgtgaatgagtgccacatatgtgcagatgccccagtggccagaagaaggcatcagatctgttagaactggaggtgctaggaactgaactctggtcctccgtaagggtaagaagtgctcttcactgctgagacatctctccgacgactgctattt

SEQ ID NO: 26320 - DNA, 1126 bp, Mus musculus
atagtttttttttctttttctttcttcctttttggtttttgtttgtttgtttgtttggttttttttgagatagattttctgtatgtagctctggctgtcctggaactcactacataaaacaggtagacacctcgagctcacagaaatctgcctctcatttgctggaattaaaggtgcgtcccaccgatcctggcaggtttgttttctttagaaacaattgtaacccagtcagtttaaaattgccctccaacataggccaccatgggtgggtacgaaagtgtaaaatgtgtgcaactggggagagagcacatgcagccaagcctggtggcctgcaccaggaagagaggcggctcctgtatgttgtcccctgactcctcacgccacaggcactgcggcaagtgcacatacacatgtattcacgtccagagtgcagaaacgtaagctcagtagaaccgaataatccactatttgttcctgagtgcagtccatgttctcagcagattcccccatgtctccctttagtcctgcatctggcctgcgcaggtcagcatgtggcttgcaccaggctcctcctacagtcgggactgaaggattccgaagacctcacaggcaccttggcccagcagctcacgagaagcgtagatatccttcaggactttgaccatgacgtgaaatcgtaggatgcttgaagaaggaggcgatggagttcaaggccgttcatattctgctccttctgttgctgagagacagggtatcgagttccttctcggccagcgttttcatctcctcctgctgcctttccttctgcatgctcttcggtcgaatgaccaggagtctggattcctggcatgttgtgtgatcttgaacgtagccatttgttttttcatttttaaactgtaatgagggttaaactgagaactttcacacactcagcaagtgctatgccactgaagcacatcaccagccccggatcttggcttttctacgctgcaaggagaatcaggttaaacatagaggtttgtgtatccttagggagtgaatgtaatatatgtgtctttaaatatataaaaatctaataaaacaatataaactgatgtttattcaagctctaaaacatagttggcct

SEQ ID NO: 26321 - DNA, 1183 bp, Mus musculus
cagttacatctctactgtgctcttaaaagagtcttcctattttcatcctttacaaaagaagcaaactttatagttgtgcaagaaccagagcttcctcaggctcacacaggtctgtgtagcatgtgcctcttcttttcccttttgcctgttcacacttctttctgcctctaaccagcccttcagctgcattaaatttccctttgatccaccagcgtttcctgctcctatagccctgctcccttcagtactgatgctcggcatgcttgaacattatttgcctacccttgtttcccagccaaatgccctgccatattcctcctccaggtcatctgttaatgtttgacttaggcagagtaagtacactgttcctttttgcacccaggagacccttcattcttctgtcacattaacttagtcttttagtattacctatctacatgtctcttcaactggatgatcagctcctgcagaccagggactttagcagtcttgtatatattctgagttgcacatataagatctggtatttatgaaatataagcaaacccagtgtgttgtctgggttactgaatttaaccaatactgaaattcagtagagccctagtgtagtggaactgaaagtgaacattttaaaaataaaacaactgcggctcagggagatagtgtgattatttccccccccccatccccatccccccccaacccccccccccccgtggtttctagtggattttcctgccttctgtcccaaggccatctgcatccctgtagctgctatcagttaatgctgattaggagtatttaaactaagacagagccagcctgtgaacacttactatctatcatgccatttagttcttaagttacagaatgtgactcaagtattggaatgaagtagataactaggcaagtattctagctaccacctagcccactgctcccttacagtgagtgctctcagtaattatccttaatggggggatggaggaggacgaagtgaacagcaacaaaaacactggtgtttatatttccagtcttccttcaagcatatgaaagtagggaaaagtgagatttaagatgttgtaggggtggcttagggctgactctgtgcttggcatgcatgagctaattttattcattagaccaagaattaaataaaagtcagacttattgtcctttccat

SEQ ID NO: 26322 - DNA, 1147 bp, Mus musculus
acagcatttgttaactcaccccaaaaagagactccacaacccttcccttccccaaccatggccatcgtctgtttatatttttcccgttccaaaagtttcacacaaacagaactacaccatacgtggcccttgtgactgcctccttcctctccatataatattgagtccatgttgcttagtgtggattagcacttgattctctttatggcctcatgtgatcatagcatgctttgtttatcgactcataatttagtttgctcctacttcatatcttcagcagtgagcaatgttaaacttgtatacaagtgtgtatgtagacatgtgttttcacttgtcttggatgtgtccctaaaggtagaatagcggcttcagtatatagggatgcctgtgtgtgtatatgtgtgcatgtgtccctgtgtgtgtgtgtgcatatgtgtatgtgtatacatgtgtgtgtgtctgtgtccttgtgtgtgtatgtgtccatgtgtgtgtgtgtgtgtgtgtgtgcatgtgtccctgtgtgtgtgtgcgtttgtgtatgtgtgtacatgtgtgtgtgtctgtgtgtatgtgtgtgtgtgtgtgtgtgtgtgtgtgtgtgtgtgtgtatgcctgcctgttcactcatatggatgtacacatatgggtgcatgtgcatgtgtgttcacatgtgaaggccagaagttgacttctggtgtcttcggttttttgaggcagggtctctttgaacctggaattcggtgctatggaggttggtttggtgggaagccccagatattctgtgtcttcttctggggtgctgagaatctagatgtgtgctaccacacttagccttttaagtgggttctgagagccttcttagtggtagtataacaacattgtgattttgatttacatttccctatcaatactgatgctaagcatcttttcaacttgtgtactcctgttttgaatactatatatggtgtcttacacacaaatgctcactagtgtagtacctttggagacaaaaccctcttgagttttgagtactatatatagtatctcacacacaaaatctcacctttggagacaggtagtcagaaggatcaagggatatggcatgtctgtcgtaacccctgaatctgggaaaggctttgagtca

SEQ ID NO: 26323 - DNA, 1199 bp, Mus musculus
acttattgcatacttcatatttccagtgacccgttggccaagggaatattcacaactaaaccagaccccctatgcagagtgcatggtggtgaggagaagatgggattactagagctatcttagtaaactatgtttgttgtaagcaatgagctaaggccccaaggaagaagaaagaagccacaactcactcatatcctagtttaaagctttctaatggttccaaaggtttcctgtctttcggttttcattgttgctttttgatgcaaagtcctgctagatagtccctaggtgtggtggtcacaatgtagcccaagctatgatagtcaccttgtagtcccagctaacatctaattctaagcctgccgccaccttctgaggattggaattataggtatgcataacaatattcagtgccttaaataccttctttctgaatattatggccaggaatgggatcataaagagccaatggcatgcagggggcttttctctgctgcccagcgtgcatttgttcactacctacttctctagtgtcaggagctggtgtggacttcatccatccactcaccctccctctcccttccctgtctgtctctctgtctgcctgcctgcctgtctgtctgttgtctgtgtgtttgtgtccatgcatgcatgcaggcgcccattcatgtgtctgtgtggtggccagaggtcaaccttgactctaactccctttctgtctacccgactgtttagaaacagcgtctctcagtgaacctgaacttcatcgattcatttgaaccagcttccagggcttgagggattcccgcgtctgccatcatccagcagtagggttagccaggtcttacaagggttctggggctctgagttcacaaccccaggcttacatggacaaacctttaccactgaaccaacttctcaaccatccattaacttctcaatctcgtcagagaaaaccaacagccatgtaagccacagttatgcaagttgaaggatatcaggacaatgatttggaagtatcttttagggattatcactaataatatttcatagcttcctgtaagtgtcaaagcctgtgtatttgcatagtttctgtaccaatgtgagaataaattcattttactccaccttttgaaataggtggcagcatctagcagagatttttttttcaatagttccttaaagcatggaccagctta

SEQ ID NO: 26324 - DNA, 1222 bp, Mus musculus
gaatccttcccgcgatcccttctttctcagcacccaagggtgagtagagagttcgggtgatcaccaggaaagcccctgaaaggcctagcacttccaattagtaacaggactgtgcttgataccctacagccctggaggaaggctcgaggggagctccctcccccaccccccttcctcacttctttccgggtccccattggctggctcgctcggcggctaggatggcagtgggaggggaccctctttcctaacagtgttataaaagcagcgcccttggcgttgtccagtcctctgccactcttgctccgggaccccagagaccccagcgctcctacgattcacagccaccgcgccctcattcccttgttgcagtttttccagccgcagcaagccagcccaccttcgaagccatgtctaccaggtctgtgtcctcgtcctcctaccgcaggatgttcggtggctccggcacatcgagccggcccagctccaaccggagctatgtgaccacgtccacacgcacctacagtctgggcagcgcactgcgccccagcactagccgcagcctctattcctcatcccccggtggcgcctatgtgacccggtcctcggcagtgcgcctgcggagcagcgtgccgggcgtgcggctgcttcaagactcggtggacttctcgctggccgacgccatcaacactgagttcaagaacacccgcaccaacgagaaggtagaactgcaggagctgaatgaccgctttgccaactacatcgacaaggtgcgcttcctcgagcagcagaacaaaatcctgctggctgagctcgagcagctcaagggccagggcaagtcgcgcctgggcgacctgtacgaggaggagatgcgggagctgcgccggcaggtggatcagctcaccaacgacaaggcccgtgtcgaggtggagcgggacaacctggccgaggacatcatgcggctgcgagagaagtaaggcctgacctacgcgagtggtggggtgtgggagggaggggagtcctgggccttgcactggggctgccacgcccttggggatgtggctggggtggcggttgtctggaggatagcagaggaagcgggccccaccctgaacctaaactttgcagtgaacatttctcttttcgcctcactcaagcacttccattgaactttttagaaagtttcttaggtccttcttctgggcttacagttaccagacag

SEQ ID NO: 26325 - DNA, 1193 bp, Mus musculus
tccttcgaagttcggcactgcgtgaaagttagcagaagagtcattgcacaaccatttttgaaatctaacaagggtgaaaagaagccatctgttcccgtagctcaagggtgttaaaggtttctatgggcttcactatggaatgtagatagggacgttctggcaaatgcggtggctctggacagaaagaataggggcctttgtgttcccagagcagctttgcaacaggctacattcttattgaatatgtaatgatgtaaccacagttccaattggacacaagtatttgctaacatccattatcttgtgtctgggccaggcttgtgaggtatgccgtgtacaaagttcttaaagctaaagtcctccctcacatttggaaaggcccccttttaggggggtttgtagactcattagcaccctccacaaacaaaattaaaccctaaactgaagaatggagtattttatggagggaggatttgtttgtttgtgtttgttccagggttaggcattaccttagcatcccgaagtggacagatggccagttcagtcttgtttggaacacttgttaggatcaacagccaaactctccagatgaatgttctaaggtagcattctgaaggcatttgcatccttaatggcagtagacgaatatgcagcccctttcagtcactgggcattttcagtcatcaccaaaggaatgttttctacaaagcactgagttaatacacaccatctcttatttgtggactaaaaattgtttcattcattcatttaaatgaaatgacacatttagctgaactttttcgagaaggttagtccaatatcatttatatattttttgatggcttagcagaagtcagaaatgaatgatactactatttaagttcttatattcttttttaaattagtattttctttgggactgatagagtaactcaacattatagttataaactatactgcaaatacagttgcttacaagggaagtttccaaacatttccttgaaaggaaacaacatttcacatgcaagattgaacagtctgtcttaaaatagatcactttataaaaactctgcagagaagtttaagtatagtttcattgtaagtgttttgatctgtcatcctaaaacagacaaagtcattgaaataacactgtgacagctgggacaggcagaaataccctataggctgagcca

SEQ ID NO: 26326 - DNA, 1165 bp, Mus musculus
caacactttggaagtgctgagtgaaatttgtctcacagttctcctttggcccagtcgtcttacttcaggatttctgagtgagagaacttccaggagacaaatattaaggcagacgattagacaaggatcttttcaccttgggaagttaatgagttaagtttgccagatacataatgtagaaactaacacagcaattaggagcaacttgctatagagagatagaataataatagtcttaacattttagcataaaggagaaataagctaaaacagtgccattctgtcaccttaaagtatatacattcctccacacatatcacaatcacgcatcaaattcacgaagagtatccacttagaagagggaaatgggatgggcttagtgataaaacatacatcagtagctttactgcagccagggacgcatccattcttatctcccacaaagtattttactaacattgaactagaatctgagacacaaaactgtaatttacgtaaggttgcattataggagcagaggtagcattcaaactctcatgtctgactatcaagccatttccccagtgtgtaaacacaaagagggaagagaacgaaactcagtctcgatgactgacgtacgccaagggcgttccaagtgtacactggcaaagttctgacctgagcatgatcaggaagccatcgccactgccaacacgtgtcaaatttctcccaaaatattccccgtactaatttgtaatcatttaatccttctaactgcttgatgtttttaccctacttcctcagaattcccgatctgctttttctatagactagcttacatttttacaatatagactgtttacatttttttaggattttatataaatgaaatcatgtttatgtatatccatgtgctgtcttgctctttttctcgaaatgaaacattaagatcaatttgtgtttctgtctcaataatcatttttaaattttatctggctataatgtaagtgtaccaaagtctgtttacacactcacctgtttatacacaactttgtcatctatagttgtggatgctactaataaagttatcaccaacagtcatggacacatcgttgtgagtgtgcattgttatttcttgggaacaagatctatggaaatggctagatcatgtggtcaatgcgtatct

SEQ ID NO: 26327 - DNA, 1196 bp, Mus musculus
tggtgcaagttggagattaatgaagacaggagatctggattagattgaggcagttctcagtgaggtcaaagaatcattgcagagagaataaaagaataagagagctggatctaagagacgtgttaccactgacagtaacgagtgtcattctttatatggaacaaatgacaaaatgatctctagacagggctgtttcaaaaatcaaatgagaatacttggtaactatcaaggtgagttaccagtttggtgaaatagatactttggtagatatgacttgatccttttatgttctactatagttaccatacagacaaagtcgtaatatgtaaaccatggcactttagatggatgtatgactagttgaataagtgtgtcaaaaattgttaaagtgtttattctggacaggcaaagcccctcacacctgtgaccctagtacttgaaggttgcgacaggaggcttactgtcacagccagccttggctacctggctacttgctctgcctacactagtctaagaccctgttctgtgccctctccctaccccagtttttaaacaactgttgattctactactattttagctataggccattgtttggtcaactgccctgatcagtgacttttaagtgagacatttcacagtgggacactatataaggaagacattgatgtcctatagatgtcagaagtaattatatggaaggtccatcaaagatctggcatctcaatttcaggaactgtgaggaaagagttacaggaactatgaaaaaaaatgggcagtcagtagttcatgtatcaactatttctctggcagaaggaggacgtgataaaactgataaattctaaattatcttcaattgtatctaataaagatgtttaagaagtagagcaaatatatattattactgggaaagaaacagaattaagaccccaaaaggacagtaagcagatgaagtaggtggaaacattcaatgcagaaagaaaaatccagaactgtaataacaattattatcctgagtattttattacctgaatttaaagaaaaaagtattctgtcttgacagttgtggggggattattttagataaaatgctagcacttgtcagcatttatgtcaaattctctttttatatacatttactttgattacgggtccatttatgtttttacattatttatttaagaaccctatatgtc

SEQ ID NO: 26328 - DNA, 1183 bp, Mus musculus
ttaataaagattggtttttattttgataggcaggcttagtcccttagctaacctctggcttttcacccttgctgttactgcaaggtgtccttaggctgtgaaaaaaacagggatgaggaggaatgacttccagctcctattttagccacaaatcgtggtattactaatgacataattcttgcctaggtcttgctaaatctaaggttgataattctcctttaagagctgcacagcactcagaactgtgcatactggtttgtgatcgtacaaattcagtatgggcatcgcttggtgcagaggcactgcaaggaaaggtccagcttgaccatttctgagtttcctgtgagataaacccagtttaaaagaggttggtatcatattttggctaaaaatcaaaaatatttttcggctctgcctcacctccccaaaagatacccagagccacaggtgtgggtcttatcagtacccacgagagaaatcgggtccatgtccacccaagccaaggttaaaagcccactcatctacggatgagaaaatcatttaatcacctcagttaagcattgccttattttaacttaattaataggagggagagagattggagacgtactattgaaagggcaagcccttcactgcctcccacccaaataaaaaagccaattggccttgtactacaagagccggtcgaactccttctccctgtttcccacctatcatccaaaaatgcggaggaatatcaacttagtgttattcttattatagtgtatttcacatttgttcagtcaaacttagccagagttccaacgccctacttaaaattcaactagaaagttacctaccaagtactaattagcattataaagtcagagccaacagctccaggcttttcagttagttgtttactaagataagaaaggtcactcttagccagatacagtttaccataagaaaagttaaggaatcccatgaaagcaagttttttctttagccctagattccaggcagaactattgagcatagataattttttcccccctcaggccagctttttctttttttttaattttgttaataaaagggaggagatgtagtctcccctcccccagtctgaaacctgcttgctcaggggtggagcttcctgctcattcgttctgccacgcccactgctggaacctgaggagcc

SEQ ID NO: 26329 - DNA, 2008 bp, Mus musculus
ataactcaagtttagagtccttccgacacacggcataaagcaggccaagtggttgggtctctaaagatatttctagtttaggtaagaactaatgtggttcgtatcctaaatagtaaaatttaagataagatttaaagcaatgtctttttattaaagcattaaagcttgctttaataggtattcataggtattaattgacatccaaacttcgtaatatgatagtaatgcttctaataatgattttaaagataataaattgttttaaacttgggttttgctttcccaaggttataggtattatcctaaccttgcacaaaaaacttaaaaattatggttaaaactgctattgttccattgactgcagcttgcagtttgatttcaaatttaagatctttaattcacctgtatactgtaattaagataattacaagagtaatcatcttatgagagcgctcatacagctcacttcatacaaaactgtgacagagttatctagttatgtttgtctttgtaaatagattagacaaacagtttggttatagttgctgcctggcaggaaactgtagtacaggcaattttttcacaacactaaagttgcaaagaacgttttaactgtaagtcatcttaagaaagagtatcaaaatttagaggcgtagacagttatattgtttctctagaatcggtccttattacaggagggccaggatgctcagattaaaaagtattttacgtttgagtcaatacagggctctgggcagccccagagcggcttgtggcctttcttttgttttacaaacagtgcctgagaaagatttttccctgtgttcaagagaaattctttttaacagtgttgcagatctattcagatgtttaaaataatgctttaattcaaagagttttgcttctagtgaactgtaatcactagaaaattctgcctctaggtatggccaatgtaactttacattatgtaagaaaaaattttattgtttctgcttctatacaagaagccaagagttttaatctttcagtgtatattgtttcctaagtaaaaagtattttattaactaatgcttcttgaagtttaccttaaatccttgctctcacccaaaagattcagagacaatatccttttattacttagggttttagtttactacaaaagtttctacaaaaaataaagcttttataattgttattaattggtaattaaaaattggttgtgcccaaaacaattctttggccaaaaagaaaacattgtaaagtcatttttctcatcctcccagccaatcgttggcccacgtgggcccaactagcttctgtggggcaaagtcttaagacacagtttcccctgttccagcacagatgatctagttgtgtgctgtagatggtgttttaaaatgctgaacaatcaaaccttaatttgtatactaatagtcaatgccatatctctaagctcgcaattgcttaaattgttcatccctcagatactattaattctcaaatttacaattgcttatgaatatttctagttaataaataaattatgcacatgtaactcttaataactttgcaagccttctagttacaactgctccttaagaaaattgattgaaagtgcaattagtcactgcccctttacagccaagtatttaaaatgttttgtcaactagttattaattcaaaagtttaggtattgtaaaattttaaaactttaacttcttaaaagacaaaaaagagagaaattgtatccccgtgcatactatttagtgcattcccatgcacactattaaagtcttacctttattttcaaaatctaatattttaatgtcaaagagtttaataaatgctttatagtatcttaaagggatctacttattggcttatagattaatcctaaaacagctaccttattaaaaaaggggaaaacaggttttctccacagaacgctgcagaaacatattagtaaattcgtgtgacgagctggtaggtaagttgactcatgtcctga

SEQ ID NO: 26330 - DNA, 1236 bp, Mus musculus
actgcacgtggtcttattctatctgctaaaaggttttagaagatgtttttaaaattgcaaaactggttaataaatttgtctgtttacaatgccaccttcccatttatctctcagctacgtagtcctcagacttctataaagagaaaagcatgcaggccggcaccatctaaggagtctttccattgctctttttctggactcattttgtgtacctccaaagaatatggaagtccttctcctctatgtctaggtggagggctcactcttcacagagcactggctttgacatcctaccctgaggtgctcaactgtctctcagagctttggcctttattagtcctacactctacctatgtccatgcattggcttcccctgcatcaaagtactcatttaaaaaaattgaaaccgctctttccttttgcggacatcggtggatcgcagccgccaaaatgaagttcaatcccttcgtgacttctgaccgaagcaagaaccgcaaacggcatttcagtgcgccctctcacattcggaggaagatcatgtcttcccctctttccaaagagttgagacagaagtataacgttcggtctatgcccattcggaaggatgacgaagttcaggttgttcgcggacactacaaaggccagcagattggcaaggtggtccaagtatacaggaagaagtatgtcatctacatcgaacgagtccagcgagagaaggctaatggcacaaccgtccacgtgggcatccaccccagcaaggttgttatcaccaggctaaagctggacaaggaccgcaagaagatcctggagaggaaagccaagtcccgacgtaggaaaggagaagggcaaatacaaggaagaaacgatcgagaagatgcaggagtagagacatcccatgcacggctttcattaaagactgcttaagtaaaaaaaaaaaaaaaaaaaaaaaaaatttgaaaccaccctgagacaatgactctagcaatgcacacacaaggatctgagtttaaccccagagcctatttttaaaaaattggcctgatggttatggaaccaggtggctacctgagtgtcactagttagcctagtctatttggcaagcttgagggtaatgaggccatatggaaaaaataattaattaattagggaggtggcaaacacctaaagttgtcagttgtcctctggtcaactcttctgtctgtctctctgtctcaatctctgtctcgggacaactct

SEQ ID NO: 26331 - DNA, 1151 bp, Mus musculus
caaatatctgttttctcagcttttcattatctagctttattctcactgaggtacaaaagaataagatccttaaggaattacactgagaattaaaaatttaatcatgggttctgaaaaatctatagtttgaagaaggcctttcaatatcattacttgaagagccaagcacatgttaagctctaacatgtaggcattgtgctgagtgtgttaagcatgctagcttccactagcaggcattttttttcaggtgtcattatgtgtaatagaattactagactaggtgttttatggcacacaaaaatttaaaaaagcagattcatctgcttgggtcctcatttattataacaaatcacatttaaaaataaatttcaaagtgaatgtcagtctcagacatctgtttctcctccctttgtctcctctggtatattaaacatgcccagcaagagcttatgagagtgtctcaaccatatagagaacatcataattgcttaccaccacatcctccaaattgccaatatcttcctgctcagagcttagaagaatcctattttgtgagtgaaagactgtgagcccacaatgatgcttattccccaggactaagatacaccaaagatccaagacagagcaagaccatggaacatagacttctagcacagagcctggacttaatatttatggatccatattatctgtctcgggaaggcacactctcccctcccttgttccaagattgtcagggaacagtgttagaagtttatacattgcctccagcactgtctaatagtttccttctggagcaatgagccacctttttgctgaggcttgaaagaaaaatcaagatcaatgaatggtattatagagaaactgtagtagtgtggggttggcctagaaatgacatgaaagacacactatctagtgagactgtactgtctgtactgtcacacatacacataaatctctccctccacacaggtatggttcatagcctacagtgtctcttctattaccctgatgccaccaacaccctggagaatgtttcagtgattgaagcatatgccacccttctaccctttcttacccagaattttgtgatgtaaaccttcctctcgtggaggggcttgcttttgggggggatgttgtgggaaatattt

SEQ ID NO: 26332 - DNA, 10718 bp, Mus musculus
tgtgaagtaaaggataagtttaattttttcttgtgtgttgtaaatataactcataatcaaagatgagagagaaaagcagatataaatcagtgtgtatggtgcatggtggttgaggggtggggatgggaactgagaaaataccagttactgaaagcacactttgcctgaattttactttgttatattatttaccataaatattaaataatacttctcataagcctgtcctcagaaaaagaatatttaatgtcccaatatttctgcttatgaaataattttctgccttcttgaatctagtaagattggctggttcaattttcttctatcagataatatggttattttttatattaccacatcagcattatattgaaagtgttttttaatagttgattgtattttgtcaaacagctactagtatagatgcagatttgctatttaattgttgaaagtacagtttattttacttgtaaatcctttttaaaggcacatgattcatttggactagaagcaactgctgttagttatttggaaatggaatcagcattcaagtagatgttgtgctgttgattggatagggctccttgggaagttcctgtgagacctttgcaggggcttttcatcagccttgctgtttgttcagtaggaaactagctatgctttactccaagagaatgtttggaccccaataagcataggatgctagagagtttcacttgaacatttgctataaatcgaatgactgtaaaatattatttcatgaacttgtaaatgtgtgatgggtgcctttgttattttgagatgagttctcagtttttttactctgttctttcaaggtcacgtcaacagggatgagatggaggggagtggctatgtttcacattctcctttgtctctatatgttatttagtaaagtctgtattgtacagagctcctccccccagactggctctacccctccagattatcttgtattgttaatttaaaaatgaagaaattaagttttaccttagaatcttctcaacatgttacagctaaaaatgaaaaacaaaacaaaacaaaaaaaaccctttgcaaatcacgtgtgccatttccttacctgagcatgttgtcacctagaagcacatttgagaatcactgtagatgtagcacttgcttttgtaagggaatgcactaaatatttttattgttaatgtgatataatttcttaaaacctgaaatattaatatatgttacctattgaaaattggggggttgaatctataatggttgcttttaggttcttgtgttagcattcttaaggggatactgcttttattctatatacactagagaaacaacatatacatttcattcttgaaaggactagctttacataactcccataggaatagtgttttgtaacatggggagtgtctggagacagagcttcaggtagccaaggtgagcagcagcaccaggccaggatgctcctgcttccccatcccagtgctgggattgccgtaggcattttgattgaatataatttaactttcattgtagcataaagaggaaacagttggttttccctgtggaaagaatgagggattcagacaatgctgtaaacaatattccctgacgctaccaagcctggccaccaagaactctttgaagaggaggttttaagtctttggttttgtatctcaacagattatgagcagaattgtttccaaggccattgagtcccccgctgtgttaactgtggattagcagcagactgggattgtgcattgtgcctccacactctggtgatttattggcacttatctctagaggccgattttatgtgccaacttacctgtggctttgaaacaaaatcctcacacacctgaactttagttttgaaggtcctttatcttctgtcaggggtcacctcaagatacagcttctagtcttgtctaggcacacattgcaaagcctgtctcaagaggtggattctgatctcaatctgcccatttatcgtgtatctagttgatttaagacactattgttcatggccatctttttgttcttcccaaagtgaggaccttttaaataagccaagcctcaaatatgtgttctgtttaatattctgaagccttacgcactgtcactattttttcaaatctaaactaataagaggaatgcttgtagtggtgcacctgggtggtcttactcactgtgtgatccccacccgagcatcacgtcctctagtgtgtatacaacacagtatggagaaatagctttcctttggcttaagctgaatttctaactaaagacagtgcaaaggacaagttatattcaccaaaaaatggcttagaattgcttctaagcagcacccatgtgttttggaaacccacttctacaaaacttaccttatttttctggcttttctgactggatagaagtggttagtgtgtgtgttcactgcttctaaggcatcctaaacacttggcttggcagtgctgaaagagtatcatcagccaggacatcagtgtgttacagactgaagcccacttggctgtgaaaatggctgctttttaaggtcattggttttcatgtcttctcatctttattcatttaatattagtgtgaagactgaaatccaagagccagggttggggggaaaaagatatattttaagaattataggtgaccaaagctatatagaggtcaatagacctaggtgctctacactgcatttcatatggctggaaagcctgaagactggttagcctgctaggatggaatcgggacctgtactcacacagaggcttcttgattttttttttttaaaggccagtcctctgcattttctccatgctatgtgtagatggagtctagaaatcagaacatctgaatgaatgaaaaggttttcttgcacaacttgtgaatttttaatttaaaaataattattacctcattttttactccacagagtgctttgcttaagtgtcaaagcttccataaaacccccttcacccaaatgtctttgaatatgcagaatgccctgctagaggcagtgtgagtgctgggccggatttttgttttctttgtttcccagcaagaaggtgaccaggtacacttgagcaaagcacccagtatttaattccttacagaaaggagaggaaaggtctgcagttggactgatggtatgctaacaccgcaaatgactgtcatttgatctcagaagttcaggattgattgctatgttttagctctaattgtgagaaacagtagtcattttagtcttaaattttccctcaggaaattcagggagactgagccttccttcccccacctccgtttattctcttggagtaaactttcagtctcatggtgaatgtttttcatccaaatttcatcttgaaagagcttagctgctgttttcactgaaattgtgaaatacagtgacgattatggcattttccaattatgagatcattttctgtttctccatgctgctctctttctcagaacatagtttaagataaggaaagagcaagctcctggcagttccggcttcactgttgcgtttattctaatgggagtataatgatcataattgaacattctcgtcttcacacataacttggtgctttataacagtaaggagaaacaggccctggattcgttatacttttagcttggattgtaaaactctttaaatgtgcatgtatgttcattttataagatttaaatatacattattatctattacatctcaggctctgcaagtggtctgacagtatctttgccaagcagcttggttcaaaagaccatattattaataggatcaaggtgggccctctggtgttcacagaggaggaaacagtgtctttcatatcacatactgcttcggaaccctaaggaagaaactgatgcgtgcgccattgctctgatacttaagtgctaaccaagaaactgtcaaagcaaataccaaaagcatttcgcaccctcacgccccacacatgcttccaaacttgtttgattatgaggttgttgaaagaaaatgttttttgaattttaacattttccactatcatgaaatgcttcttttatatgttaggtcatattcatgattttcttatttcttcaattatgttctaatgaattgtgtgcatgccaacttacccaaggaaaaagatgcagtttgctctggactgttaatctgttagagaggttttggctcctttgcaatcatggtgcaatatagcatgatatccatttgttttcagtccacagttttatttttgtcataataaatactttttcagtatgaagtgtagcctgtgttttcttttggtgatagtttaacactctctttggttataaatgtcaaaaatccaggtaagctaacgggaattttatcataatgctgccatggtagaggccagagaacccaaagtgggaaataaaacttggttccaaagctctcagcaaaggccagaagatggtgaagactcaggcaattaccttccttctgcatgtctttcttaaactttctttgaacttgattcctgttttcctgtccacagggcaagtatgatacccatgtctaatagttcttacatttctttatacagggaaaagttagatcattgttgagttcttaggaacaattccttatttctctaggaaacaagagaattgttcccgaatacagccgtttggcctctttaatccaaacaatagaacgtacatttagatcaggggaacctgggtggtaggaaagcctggaagaagatgctctttatgttgtgcctacattctcagagagcagttggcacgctttaatcaagaataggctgaaaatactatattcattatttagatccctctaaactagtggtttttaataccaccctttttgagaccctttgagactactgttaggaagatccttaaattcatagggaggtagtaactttgtttcaaaggtttctattctagttacctttgtgtagctctgaccaaatacctgaggaaaaaaactaaaaagaagactgcctacttctgccagtttgaggatgtaatctatcatggcagacagggaaagagacaaggcagcccagttctcatggtgagctatgaagcagagaagtgggccacacagacttgtgggttccccatagagtctacttttcttgatatccatgtttctttctggccactgctgtaaacttgtgtggaatttctgtgctttgtaggagtaatttttttttttttttttgaggaagggctggtgtcagtataatttttacaagttaaaataaccctcggccaggcgtggtggcgcacgcctttaatcccagcactcgggaggcagaggcaggcagatttctgagttcgaggccagcctggtctacaaagtgagttccaggacagccagggctacacagataaaccctgtctcgaaaaaccaaaccaaaacaaaccaaaacaaaaaaaaaaaatcctcactgggcttggtaacctaagcatgtaatcctaccatttgagtgctggatagaggtaagaggattaggacttaaaagccagtgtgggctatctgagactgtctcaacaaaaatatttgtgtatgtatatagtgaacacttgtcagatttatttttctagatattgaaccatttttttttttaaatcccaatacaccaggaggctgaggcaagacgatcttgatttggaggtcagcctgggctacatcgtaagactgtcaaaaaataaactcactaataatcaacaggtgatgaagtgaatgcaaagctgtgtctaactttatagactctggggcctaactgatagtaattaattaaaagaaaattatcaggtctgtctgggcctgtgccctgagtagaccttgggagcaaactctgcagccagccccacaacacccagaggcagctccactcccaggcactctaacacacccaggtcacgggatcccaggagctctgacacacacaggattgcaggattacaggatcacagagacaacgtgactgaggagttctgacaaaaccaggattatgagaaggacatgctccagtcagacatagctagggcccgtagcactagagataaccagaaggcaggaagcaagcataggaacataagcaacagaaaccaaggttacttggcatcataagaacccaatttcccatcatagcaagtcctggataccccaacacaccagaaaagcaagattcagatctaaaatcacttctcatgatgatgatagaggacaataagaaggacataaataactccctttaagaaatacaggagaacacaggtaaacagaagcccttaaagaggaaacaaaaatcccttaatgagttacaggaaaacacaatcaaacagaaggaaaggaacaaaactatctaggatctaaaaaatggaactagaaacaataaaacaacaaagggagacaaccctggagttagaaaacctaggaaagatttcaggagtcatagatgcatcaccaagagaatacgagatagaagagagaacctcgggggcagaggataccatagaaaacgttgacacaacagtcaacgaaaacgcagaaagctcctagcccagaacatccaggaaatctaagacacaatgtgaagaacaaacctaaggataataggtatagaagagagtgaagattctcaagttgaagggccagtaaatgtcttcaacaaaattatagaagaaaacttccctaacctaaagaaagagatgcccatgaacatacaagaagcctacagaactccaaatagactggactagaaaagaaattcctcccatcacataataaaataccaaatgtactaaacaatgaagtttaaaagtagtaagggaaaaaggtcaagtaacatataaaggcagacctatcagaattacaccagacttttcaccagagactatgaaagctggaagatcctgagcagatgtcatacagaccctaagagaacacaaatgccagcccaggctactatacccagcaaaactctcaatcaccatagacagaaaaaaagaagatatttcatgacaaaaccaaatttacacaatatctttccacaaatccagcactacaaaggataatagatgggaaacacacaggagggaacctatacccaagaagaagtaagaaagtaatctttcaacaaacccacacaaacatacttccacctctaacaagaaagttaacaggaagtaacaatcacttttccttaatatctcttaatgtgaaaattaatattaccaacatatcttaatctattgaaattcaaaattttgaggaattagacatttgtcagctgtcatcctgtggtttctctaatttggtaatgggagaaataggtccaatattgtacaatccatatacactttctgcctgcttgtacatgacagggtcttgctgtgtgccacataatggtcttgaaatcatgtttctcctatctcagcctctattagtaggattgtttatttgatgttttaacacaatactatagtttggagaacagcttacatatttcaaaattatgtatacagctaaaagaaatgtagacaatttgggaggttgcttttaagagaatagcatagagtgagactgaaggcttttcttgagatgtacaattagtgtatcaattttgaagaagaaatccttataagttactcttattctgagatgaatgcttttcaaaatcatcacagccaatgaaccagtatcttaccctcacctaacgtctgtgccaccctccaaacagaaccattgttcattgaaacagttgatgaatgacttcatggatagaccatcttaatacacacaccatttcttaaatgaatgtaacctgttccctgcaggctgagaatgacaacagtcactcaagttaaatagctttgaccatagcaggaaatctgtactcaaaaattgtgcctacaattcattccttggcactgcagaactgtcaactcttagcttatggaggtaaaatcctttggtgatgtgagggacattcaagtacagccttattacaatgaactccaatgtccaaaaactgttcttattttgtgtttgtaccacagtaagagccaagattttaaactctactaaaaacaaaacaaacaaaaagactttatttatgttcatttaaaaatctaatatatttttaaaaatctaatatgttattttaaaatatgcagttaatatatttggaattacttaaaatttatatttagaaaatgtatgtattttcagcattgctgtagacaaacatctatataagactgttcaattgattgttgtcttatatcaaacaacttttgtaatactcatttttattgttaaaatattttataaattttaaagaatatgataaaaaacaaaaggtattgtaagttatggtggcggggggggggtggaactgtctggggggagttggagtacaaaagggaaagaagaatgtgttgtaagtctatttactcaaaatatgtttttaaatgtaacaaatacagataaattgaaattatgtatcttttctcttcataatgcaataaaagttaaagaaaaaaagaaaattatgtgtattttgaaagacaatcttaaaatggagttaatagtgtcttatgtgaccttgaaagaatatccctgtcctttagtcatattctcaagttttaaataatctagaaaaattttactttgctaaaatactagttcatcaaaatacaaaatacagaatgggctgcaggtacagaatacatttaattatgtatttagactatctttctgtgtagctctggctggccttaacctagtgatcttgcttcattccctctagtggtatgattacagggtacatcacacattctaccccagtgtactgtggcttcccatataagtactatctctgtgaacaggctagcccagtgtttccattttagctaataatggagagacttcctatagctgtaacccaatgagcagataggctggagatctccaagtggctgttgaagggcctccctttgccgcacaaagctgccactgactccagggactactttgcttcagtcagcatgcctgttttacccatgacatgctcccttactccacagaacatgtggatccactcctgtgtgtgatgaaaggacctcaagagatttgatgctgattctttccaatattaagatgtccccattagtaatttcactacataatccacatgaactagtttcacaggtcaacagaggaaattgtgtacctgcctttctggtcctccttagaaatagataactatacttgtgcttcacttaagagctcttaagaatgcattccaccttcaagagcttctagggtggggtcaggtggttactgattcacttcaagccacagaacgccccaagacatatattgtagtgacaaatttgatggggtgtggcttaggtttcccatccatctcttattttctggagtttatgatattacaagtaagaaaggttttccatttgctttgtgtttggggggtgaggggcacttgttgaacctatgtgctctacatgttggctatatccacagtccttttaatttttaacttaatttggttcttgctatagtaacctgggattgccttgattttagtctgtgtagaaggcaggacttgaactcacacttctttctacatctgtctaggataaactaaagtatatatccacagtattttagctccatttttgcccaagccctggacatacaatagtaaaagtcacacagctgggtagtagttttggggaggggcattgaacatctgcagagctgattcattgattagagtttaagtgattattgagcatgttccaggactagggccaaattatctcgggctatcttcagccttccaatagccattcattcctcaccactgtgtttgatctaatatccttaagactctcatgtaagatccttttttcaatgtacagacttttaatttctcccacttcaaaagctaagaaagtcctttgatagcattagagatgcctccacttggttgtgcctgccaacaagatgtttccatcagggcactttaaaagtaactgactactttctttgttttgtcaccatattggaacgtgatgtttgggtaggtatcctgcttctgtggttcttacccaggatcactcatatttagctccaaaaaagactctccttttgagatgagagctgtgtatctgcatcaacagagcatacaacccagttgtggagataaacatggctaaatgtaagtcacagttaaaggttacagatatctactctgctgtactaagtgcaagtcacagtgacagaggttgaggacttctttttttcagaagttaggataccagtcatctgcaacaactgttttttaaattttgctacatgaagtgtttataagcatatttttatttatttactttacatccctgtatcagcttctctttcttcccagtacctcttcacacagaccctcccccattaatcccctctcctttgagaaagaagactcctatgcacccactcctgcatatcaggtcgcttcaagactaggcatatccataccctctcccactaaagccagacaaggtagtccacttaggaggataggatccacaggcagacaggcaacagattctgggagagtccccattcctgttgttggggaataagctgctct

SEQ ID NO: 26333 - DNA, 1161 bp, Mus musculus
ccagataatacatagtgtgggaaggcatctcatacaacctgttccttttactgacgtgaaaacaaaggcttatataggtacaataattatcgttggtgtcaaaagtgggtttggaagttaaacctctcaattgtttttttttttttttctccttttgattgctgtggcttacattcctctgtaagtaattaagacaactaagcatctggaagtcataatccatgaaaaattaatttcacctgctataaggatgctgtctacacactgtgtcctatagtatgaagcattgaagcaatagtcttctatgctattactgtcctaagaatcctgttgttctatttccagttccatccctgatagggtccttatgtgtcccctctctcacctcctcagctgtggtcatcagttagcagtgctatttatgtttgtcatttgaatgttttttctgcctttgtttcatttctactcaatggtatttgaaaactaatactgtttattgaagaatttctgctacctagataatcaccgtttttacttgttcgtggaaactattcgggaacttgttttccaagaaggtcttatgggaaaagattgtgagatcagggctgttacctatgatatactcatactgttgtgtttttataaagcactttacattttacatagtacattgattcgtgcttttacttgttctttcattgaaccacagaattaattttcctatgtgttaagcacctactgtgtggaagttattctgcagatcttctgatacaagaaaacaaattatatggtgttttgtttcgcacacacacacaaacgtgtgtgtgtgtgtgtgtgtgtgtgtgtgtgtgtgtgtgtaaactgttcagagggctgaagagatggctcagtggctaagaaaacttgctaattttttttttcagaagaccagagtttggtcaacggtgttcaaaccatctgtaacccaagctctaggggaactcacgtcattttctgttctccatgagtgcctgtactcatacaaacatacaaacacacacatatatataatttaaatatgaacaagtctaaataagtagtttagggaataaatataacattataatacaataagattttcaaacacaactttgcaaataagaaataattcaatgaactatt

SEQ ID NO: 26334 - DNA, 1168 bp, Mus musculus
tttttttaaagatttatttatttatttattatatgtaagtacactgtagctgtcttcagacactccagaagagggaatcagatctcgttagggatggttgtgagccaccatgtggttgctgggatttgaactccagaccttcggaagagcattcgggtgctcttacccactgagccatctcaccagccgcttaaagaagagtttatcatttgttaagttaacctatgtcctactatatcatgttattgggccttaattgttaatgtggagagttgaggtaactttaagttcactcacatgttttttccataggatatggaatatatcctatctcggtgccagtgaagagggccctggcagggttcatgagttcagtgaaaggctaatgaaaacagtgcctttgtgaacccaccctcttaagtaaagaagattggataacaagtttggtgtcagtttctgtagatcactgtaaaatgcagattcataattaagtatgtctgtgatttttgtgtcatttttgttcttgtttctttctcccaagacttgctatatatgtgatgaacaaggacgagaaagcaaagcagccactggtgcttgcatgacatgtaataaacatggatgtcgacaggctttccatgtaacatggtatgtttccctcattgtaaagaaataaaatcggcaaacacattacataacatgaaattaaatatctatctacagtttttctgttcagtgctgaggatcaactcagtacctgtggatgttgtaaaagtgttgacccagctacatcccagtgctcttttattgtttttgaccaaaaaagcatatgttgatcttgtttattgtgctgtgattttgaagcatgtaagaattgccaagaatttttccttttaagttgatgaagttttacccagccctggtggtaaaatcatgtaatacctgctactcaggagttataggcagggaaattgccacttcaaggcctgtatgggctacagagtgagttcaaagccactttggacaagctcatgagaggagatgtgtgtttttaaaatgctacagtaagagctggtgagatggcctcagcaaggaaaggtacttgcttgccaagctcagtgaccagagtttaatccttggaccccacatcacatggtggacagaagagcca

SEQ ID NO: 26335 - DNA, 1161 bp, Mus musculus
gatatttactggcccttaaatttggagtcttcattctcttctataactattatccttaggtttggtcttctcattgtgtcttggagttcctgcatgttttgggttaggagctttttgcattttgcattttctttgactgttgtgtcaatgttttctatgatatcttctgcatctgagattcaatctcttgtattctattggtgatgtgtgtgtctgtgacttctgatctctttcctaggttttctatttttcagggttgtgtccttttgtgatttctttactgcttctatttccagttttagatcctgcatggttttgttcaattccttcacctgcttggttgtgtttttatgtaatatattaaggggttctttgttttctatgtaagggcttctagctgtttacctgtgttctcttgtatttctttaagggagctatgtatgtcctttgtaaagtcccctatcatcatcatatcagacacatacacatactttttaattattggtctgttaatttttatattcttgctgtgtctctttgattctcttttaatttcttcaaagttttttttttctaccttttagtatattttacttttgctgcagtagatactgtggccccgtaacaggaaccaaggtaaataaatagatagaccttaagtaatatagtggcgtaaggaatgggcagagaaagctttctatatctgtataattgtcttagtccgtaagtctttctgtgacctgaattctaaatttcacaatccctttctcagctttaaccatcccttttcctctctagagaggagacaatggctgtactgatctgagttgctctccactcgtgctcctgcctggccctcgggctgcaaagtctccatgccaacttgggggctctgcctccccccccccttccccttctgaaagttcagcatatctgggtatagcagggtatagctagctggctatcttctaagatagaacttgttaagaacagaatgctttggactgggtctgacaacatgagttgatttccatggtggatggaaagaaccacagctttgagaacaatttcttgtgacctctacacatgtatatccaacttagcaaaccccaccccaccataaatcaagaacattaaacaaacaaaaaactagaagagaat

SEQ ID NO: 26336 - DNA, 1114 bp, Mus musculus
gtttttcaggaactccaggcagtgtaaagtcatcttctggaagttcagtgcagtctccccaggacttcttaagctttacagactcagatctgcgaagtgacagttacactcacacccagcagccatcatcaaccaaagatgtacataaaggagagtctggaagccaggaagcggcagtaaacagttttagctctttagttggtcaccctgtgacctcgactgttatttcacagcctaaaagctttgacaattcacctggagagttgggtagttcgagcctccctacagcaggatataagcgggctcagacttctggtatagaagaagaagctgtaaaggaaaagaaacgaaaaggaaataagcaaagcaaacatggccccggccgacccaaaggaaacaaaaatcaagaaaatgtttctcacctctcagtttcttctgcttcaccaacatcgtccgtagcatcagctgcaggaagtgtaacaagctctagtcttcagaaatctcctacgctgctcaggaatggaagtttgcagagtcttagtgttggctcgtctccagttggctcaggtaagggtctgtgccatgtttgcccctcaatcactccgcagccctttctttcacgactccaaagagttgtgaacagttgttctgagtgagctctgaagtgccgctacatttaattaagattgacatttgttcatttttatttttttaagtttattttattattatttgtttttaaaggcaagggcttattaagtagcccaagctggccaggatcattctgtaaccaaggctggcctcagagtcttgatccttctggatcagcctcccaagtgctgggattgcagttgtctgttaccatgctggccatttttagggaggagatcgcatatactgtagcacatgtatatactatgtaggccttggattatcaggtggcaacagccttcaccctcttagcgttctcatagaccctagattttccatttcctagtgagaaagaaagtaccctacaatcctagaaaactatttggtggtgtaatttttagcatcaatctcattttacttagttaactttatataaacagctttattagtcatccattactta

SEQ ID NO: 26337 - DNA, 1207 bp, Mus musculus
tctatacaaccctttttggattctccttccccctcctcctctttccctttcctctgctcattgttgacagggtctcatgtagtctgtgtagttaagggtgccataatcattagccctgcttctactctccaaatactggagttacagttgggggctatgtgtctggctgtgttttcattatcactgtttccttctttatgatgccttctacaagaaggaagggtcagatgtcgtaaggtatacaatacccttaaatcatttattcttagcttacgttcttctagattagtagggtgtgaagatatgttgtgatttagagagtggtcccagtacttaaaatccttagttttcacatagacaccacttaccagtacaagaatctgtaaaatacagaaccttcttcctccagactctcctctgtttgatgcatgcatgctcaatgtaggagattatcatcaggtttgtttttttgaaaatgcgtactataaatgtatcccgctttggtggaatgcaatctaaacatgagataaatatgtttattaatgcaattttgaagaaatagcattaagattttgtgatctgcaatgggaaagagttcggagtaaaggaaaattacctttgatggatgagctgtgctgagcatagcatttgacctgtctacttatagcagttagcgatttggtagagctaatcagtccgtcatttccagtctcagatacacatttagcacaagtagtcagctacgcaggctgtgttagtatgttgtcatccccactaaggtgtggctatgcagactgcatttgttacttgtttgctgctttgataaaacaccatagcaaagagcatcttggggaggaaatggtttatttcagcttatatctctcagatgccaaggtattatccaggaaaatcagtgcagtcattcaaggacctaatgcaaaaacaaactcagagcccttcttcctggcttgcttttcctggcttgctcagccggtctttcatagcacctaggagtactcccccagggttgtcccaccctgctgtaagctggtccttcccacattaatcctcaatcaagagcatgctccataggcttgcccaaggtccattgtggtgggggcatcttctcaattgaggctttttccctttccagatgactatctttagtcaagctcacataaaactagccaggagtcagactgcaagg

SEQ ID NO: 26338 - DNA, 1191 bp, Mus musculus
tcttcctggcaactagaaggactccccacccccaccccaatatgtcctctaacaactggatggacccccaccccaatatgtcctcctaatagtgccatttcttgggccaagcatattcaaatcaccacagcagaataactaatttttcactcttgttaaagtgccttttccttgtttatcctagttattatggaatgcatttttatgtgtttgtgaacttgtctttgtaattgaactatatattcctggtgaacacagttttatcttgtttttcttgtttccagttttatttctgctctaactcatcgagtttttcttagtcattactaagtgttaactagatgaagggacagggaaatgaatgggtggataaaagattgtgagtcagtatgccactgccacccacgtatctttctgcgttatcatttctgttctcttcctgatcttgagagtcctttcctagagcttgtgtgttataggattcagtttcattgaactcaatgaatgttagattgatttagatcaaaagttgtaaaacttgtacaagatggaaagagaccgatgttgagtagagagtagtggtggggcatagcggggaggacggcctccatcaagagcacttgctgctgagttcttgttttatgtgctcctcttccatggacagatgtgcaacatgtggatttctgctgcctggagaagttaaaagaggacatcagagtatctgggactggagttctaggtagttgtgagccattaagtttgcattgggacttgaacccaggtcagctacaggaatagcaagtactcttctacgtcatctctccagtcccacccccccccccttttttttttctttttaaataaaaagagtagatacagaagattgagaagatcttacccaagtgtttgtcaggttggtgagtgaaaattagacatctccctttaatttttattactgtgaaaggaatattttgcagtcagtattttataacaaaaacccgagtttcataaatgtctcccaagcaggattattagattgcgcttggtctgggcagtctatgtagacatcctaatgcactgtccaaacagccaaccttctaagtctggcggttggtgatcagtgctgcggagtgctggatggtagttttggctttcatactgtgccgataatactacttacttaacctagaa

SEQ ID NO: 26339 - DNA, 1144 bp, Mus musculus
tgttagagagacagacagacagagacacagacagacagacatgcgtgggccagagctgatagtatgttcctctgtcactttgcactcactatctttttccatgttaatttttgctgaaccttcagctcccagttgtgctattcccagtgcctggggattttgaggatcaagttagggtagtgattttagcaggcatttcactgaccgagccacctcagccagctctgtgatactttaaactacagccttccttcctacggcctaattaacactagttaatattagttacttttaatatttattaatattctctctttgtcctatttaaatcaggttttcgtgatttcctctctccttttcctccactttctcctctcttcctttcgtggttcctatttaggtttggatgcttactgacacactggagaaggaaatttgtccaggagactgtcacatggatcagaagagttttgcaacaactttggcctcttattatgtgtcaggagcattacccactttttacaaactgggacattgacaaaagtgacttctgcattggcatgtgtttctgtggggtagaatccttcctggctagggtcagcctctttttctctgtgcacgtgagtgtgtgtgtgtgtgcgcgcgtacgcatacacacacacacacacacatgtgacagctagtatgcagggggtgctcttggtatatgccatatgcatctggggtcccctgtgcacacagaggctggaggagaccatcaggtgccctgctctctcactcttagcactcctctcctgaccctagagagttttgtttcccgtgagccttcagttcccctccccagctctcacccctgagagagagtgctggagttacagatacatggcttagattgttctttctaaatgaggtactagtgatttgcactcagcttctcattgttacaccatacggctttgacacatctgtcgatcctttccccagaatacagcggtgccccgtagctgctagtgtatgctgaggttgtcttttctcctgcttcactttctagctcttctcgatggaatatcatctacatcctcatttcctttttcctcgtggttttacctgacagaacaatgaaaaaaaaagtctttatcaagtt

SEQ ID NO: 26340 - DNA, 1149 bp, Mus musculus
tgctgtagcaaccatcagtttccaggcaactaaggtacattgacctctcagttgagctgaggcagatctacttcaatttagatgcccgagacaatattaatggtgttgaatgtgaaatgttataagcagtctgtaagggaaaaagatacaaaaatattttgatggaattgtaagaactcagaaaaatggtcattctgtccccttctgtctacttggtggcagcactatttcagcttaacctttatgtaattcttatctacttcatgcacagtccgttgggggtaggtagttaattacacatgatttaaaacaaaacactgttaaaaggtagatttaaaatatgattctagatgtcatgtcacaattattaagaactgtgcaagagggctggagagatggctcagtggctaagagcactgactactcttccaaaggcccctgagctcaattcccagcaaccacatggtggctcacaaccatctgtagtgggatcagttgaccttttctggtgtgtctgaaaacagctaagctacagtatactcatatatataaaatgaatctttaaagaaaaaacagattgtgcaagaacatgaagaaccttagcatgtgcaagggacacatggttcacttactagcagtaccggaaagaaaatgagataaagcaccaccacccccttacccaggccccaggcgttctctctctctctctctctctctctctccctctccctccccctcttcccttctcccctctccagatagatactttaaaatgtgcttatataattaaatgaaaccagaattttagtggctaggttggagctacaacagaaatttagggttctttcttactctttctgatcctcagtgtaagtgaagtcaatagactttattttgatgccttagaaattatcacccagggaagtgatgaagaaggtaaaagtctggttactagacattaaaggtgcaatgataggtggtttgggcttgtgatggtttgtatattcttgggccagggagtggcaccatttggaggtgtggccttgttggaataggtgtgtcactgtgggtatgggcttaagactctcaccccagttgcctggaagtcagtcttccactagcagcctttggatgaagatgtagaactct

SEQ ID NO: 26341 - DNA, 1156 bp, Mus musculus
gacggatgtgttgtgatccagtgcccatgggtcatgctgctttcttttgctgttgacaataaggataattttggataataacaggctggccttggacgctccgctccgctgctcctgattccggttctttaccttaaaatgacacatcttagctgacttcgacatgggacactttgcacatgggacatcaatgcacatagcaaaagtgccttcctatccagcaaacttagtaattacactttctcttttgaaaatttattttcctgtgtgaggtgagatcttcctgtgtagcctcaaacttgtaattctcctgcctcagtttcctaaatacataaaattttttaaaaatcagactttcctactttagaatatgccattaggcatgtcagtcattgtactgcactgccttttgttttgatgtttatatagtgggcttactagctgaaggtgaaagaaaatgccaccgtctaaatttgaagctatcaagaagaaatatgaaacctttggcacagcagcaggggcccctcctttcaaaaattttttctaataagagttggatcttcctgggcagtggctggacacatctgtaatccttgcacttaggaggcagaagcagccttactggtctacagagtgagtttcaggacagccaaagagaaaccctatcttaaataacaaaaacaataaaagagttggatttcttaagaaacttggaagtgaaaaggtattccggcttgtaaattatagaacaggaatgtaactcaggccgtcaggcttggtggcctcacccttacccactgagctctctcacagtctgagtgtcatatgttttagtttattgtgttttcagtgtccatgttattaaattcatagtttagtatccagtgttgatctttaggttgaatttcacttatctttcaccgtggactaagtgatgagtgtgtgtgtgtgtgtgtgtgtgtgttgcacatgtcggtatcaaaaggatcacctgtaaaagtcagttttctctactgagtggatcccaggattagaactcaagtcatgaagtttggttgcaagggtcattatccatccaggtattttgtctgctcaattattaaacaagacttcatagcataaacttactgactctaccgtatatccttaagaagag

SEQ ID NO: 26342 - DNA, 1172 bp, Mus musculus
taattcccttgaatttgttttcacttcagaggatagtttagtggtaaaatttatttaaatgtaagatttcatttttgaaataaagctacaacattcaacacaaagacaccttctccctcttcccccaccccccagttaaataagtgttagggataacaggattgtgggcttcagcatctacttttaattagcctttaatacacatactataattaatagggcctgtgtttgttctcttcccctgtttctagctcctcctcctgattccctgaacagcagtaagagcccacatataggaaacagctttttacctgacaattctcttcctgtattaaatcaggtaaacttttttgagagtggttaaatgttcatttgtgtgttttacttgcaaacattgcaccttacattgaatgatttaaaataatgctaaacagtcttgctgtgctctttgcaacttcagtttcattcttattacactaggacttgacctccagtggacaaagcaccagcagttcttctgctctttctactccccctcctgctggccagagtcctgctcagcagagctctggagtcagtggggttcagcaggtgaatggcgtgacagtgggggcactagctagtgggatgcagaccgtcacatccaccatcccagctgtgtccgcagtgggtggaataattggagctctgccaggtaaccaactggcaattaacggcattgtgggagctttaaatggtgtgattcagactccagtcacaatctcccagaaccctgcccctctcacccacaccagtgtaccacctaatgcagcgcatccaatgccggccgccgcactgaccaacaggtaagaggcttgcttcagtacgttgttgtggttgccgttgttattattatttggttttcttcatgcaacatgttattagtgttgtctttgttttgggttaggattttttaatgtattttgtagatgttctctaaaaaaattaagtgctagctactcatggattgcttgttttttaaattgatgtaattcaattaaaaatagatttcagtatcatattaaatatattttgttgaaaatgtcggtcctgatctgggatatcaaacttaaaatgttacttttccttattacatacatgtatactaaattttgaaaaggcatttttgtggc

SEQ ID NO: 26343 - DNA, 2646 bp, Mus musculus
atccaagggccagagggacgcctgcaaatctgagtactggtattaccatattcattgctttgagatttttctctcgttttaaccttcagaaacattagttttcatttagtaatgaacactggttccgaatgtgggctaactgccgagtgctttctgtttgtcctctcctgtgtgcctgcttcctaagtgtgggagctgttaccgtgcatcttgcccgctttccctacgaaggagtctatgcttatatagacatttgacacactttattgtgctttctgctcatggatattttccacattaaaaatagattaatttttagtggaagatccacaataaagaatgagagtaaccagcttcttgggggggggggggcaacagcacataagctcagctgctcggtggctaaagctggagggtcatgagtttgtggacagatatatatatatgccccatatctatccgcccctcccttccccgcctcccccctctccttctcaggcccccctccccaagacaaggactctgtatagtcctggctgtacaggaactcagtatgtagacaaggctggccttgagctcataggacctgtttatctctgatccgttcttttgggattaaaaacaggcacttaccacaccttgctgagacctaatctcaagacaaacatcaaaaccaactgtaagctggttgggagggaagttaaggagtccctgccaggtacaatgtcatatgtgatttcagttcttgtaggtgggaacccacttacaataggcaagagctaagagaggtcaagaacatatacgactatggggtcaactatggctttttcctagttcattaaaactcagtatttgccctcctttgctcctcctatggaaaggtggatcaggaaaggtgatgctacatccttagaattgtgtccaaggatgggctcgccaccttggtgcctttccatgtgcgcagtgtggtgatataaataaatccatggtcactctggggaagactagctgacttgaggagaaatcacttgtaccacattgaaccagcgacagtctcagagggtactgtctcatcttggccaacattggttgaactaattaatgcttcttatttctgttttgaactgcagagacttagtgataaaactgggcctgtagctcaagagaaaagttgacacttgaaaatggccagaactcgcctttcctgctgttctgtgcttcactggctgctgcagtgtctgccacagctatgaagaatggaggcgggaacacacaggggaggatgccacacactcccttgtaaggctctgattttcttgttgctttgttgcactgaaatggaattcctatatacccatcccctaccaaagtgtttgaacttcggaagaaaaattaataactttttgtcaatgaaataattcatatgcaatgagtttatcaatccaagaaaaatgtaatgtgcttgctgcacagctagttttgttataaattggaaacataaaactaaagactattctatttggaaaccacttggttatatcataaaagttggaatataactatcttattgggatagagtgtgcttgttccacggggcagatcttaagttttgagaactgtctaatatcttctcttggagttgtattcattaaatattgttattatacagatcctcaactggggctttgcaaatgttttaaagaattcctttctaatgagatttgtccatttggagatcaaattaggatggagacaactgcttctgctaacagtagttttcttttgcaaaagaaaaaaattttgtgtgtgtgttaaaacctactcttgagttaagggagctgtaaggctgctgggagaactagatcaattggatgagaacagtttctttcagaaagatacaccaatgtggaaactgctgcaaggttctagcatcaaattgcctgttgggacctccctggatagaaagggctctgtactgccgggcaggccacttgtgccagcagcttccccgtgcttctgtctctgttgaacctttctgtgccaccagagagagctcaggcaaactgactgtccacaaggaaacaagtagacctgggaagagtctacatgcttgcttatctcatcagcctcaaaccacccactggaacaggcacaccaccacagttcctaaaacctgtcccacagccttccgacttagccatgccccgagtagccatgctcttgattgtgacaatatggcagcctagtaggttagacagttggggatataatcattggtctgtttctgaaacacatgaattactggtgggaaaggcccaactgcagttcgacctccactgtgtgcttagctggaagaccatgtgcacggcttagcagtctgtcttctgtgacactgcacacctcttacctcacttctgtaaataaggttgtgaatctgttttgtaatgtgaaaaattcataagataacattgatattttgatttgtaatatttctaattggtagatttaattgaaaagtaaaattaatttatttttatatgttcaggggaattttaaagaaagtcaaaccttttgtagataatttaaaagaatcagtgtggtttattttatatatgtaacccactggttgttattctgtaacaattt

SEQ ID NO: 26344 - DNA, 1174 bp, Mus musculus
cccatgcatcctatcagatcaccatggactaaggctgatcttcaataacagcataaataatagaaagccaacattcatgtggaaactgaacaacactcttatcaatgataccttggtcaaggaaggaataaagaaagaaattaaagactttttagagtttaatgaaaatgaagacacaacatacccaaacttatgggacacaatgaaagcatttcgaaaagggaaactcatagctctgagtgcctccaaaaagaaactagagagagcacacactagcagcttgacaatacacctaaaagctctagaacaaaaggaagcaaattcacccaagaggagtagacagcaggaaataatcaaactcaggggaaaaatcaaccaagtggaaacaagaagaactattcaaagaatcaactaaacgaggagctagtttgagaaatcaacaagataaacccttagccagactcactagagggcacagggacagaaccctaataacaaaatcagaaatgaaaagagagacataataacagatcctgaagaaatccaaaacaccatcagatccttctacaaaaggctatatactcgacaaaactgaaaaacctggatgaaatggacaaatttttagacagataccaggtaccaaagttaaatcaggatcagattaatgatctaaacagtcccatatcccctaaagagatagaagcagtcatttatagtctccaaaccaaaacaaagcccaggaccagatgggattagtgcagagttctatcagatcttcaaagaagatctaattccagttctgcacaaactattccacaaaatagaagcagaaggtattctacccaattctttctatgaagccacaattactctaatacctaagccacagaaagatccaacagagaacttcagaccaatttcccttataaatattgatgcaaaaatactcaataaaattctcgctaaccgaatccaagaacacattaaaacaatcatccatcctgaccaagtaggttttattccagggatgcaggcgtggtttaatatacggaaatccatcaacgtaatccatcatataaacaaactcaaagacaaaaacctcatgatcatctccttggatgctgagaaagcatttgacaaaatccaacacccattcatgataaaagtcttggaa

SEQ ID NO: 26345 - DNA, 1213 bp, Mus musculus
gagaatcaaggacccattcagcaattggccgcaagcctcgcaggacacgtcgtaacgaaatgttactgggacaatcgcactgagtaaagtcgcaacgcaaacagggtttgaatacgtgttttagtaaaacctgaatctaaaaagcaaaaggcacgcatacagtcagacggcctcgaagaggcttagtaagtaacgtaaggtcagcgggaaaaccgcaaaaacagaaacaaaggaaaactcagcctgcaagctgaccattacaagtccttacaaaaggtaattaattagaagctgtcatcttactgcaacagaaccttccaagctggggttgggaggaggggagagccacagtgttttaatccacgcagtgacctgtaattctcctccatcttgaggcataattttccaatatgcttcagaagtagagggggaactcgaaaggattaagaacctttagtaacatttctgcttcaaataggagtcaggcagtaggaaaaaaatgtgtcacagaacctttattattcttcataagagccttgcctggagcagctaggagcgccaaagtctctgtggcgcaatcggttagcgcgttcggctgttaaccgaaaggttggtggttcgagcccacccagggacgcctttcctttttctcttttaaacaaagcttgtctgcggctttttctaccctgtatacttccactgtcaaattcaaacaaactgaagtctaacgttccgcatctattctaagctatctttcagaaatcaaatttgttacaatgaagcccagcttcagcccttttggtttttccgctctaaagtcttagatatttatagaaaatggaataaacctgaaaagaaaacctattatacggtctcataactaaatttctaaaaaaaacgaaagaacttaaagcaagaaaaattaaagggaaagttactttcatattttgctcacacattacgagtgcacaaagtgcccccccccaatagatactttaggaaaataaccatagttacatcataataattcagtcttgagtacagattataggaatctaaagccagttttaagaaaaaagtaaagattggtgtatcagctatcagtaggtacttgtctacagcacaggtttcttgagaagctgaagcaatggaataaccctaacccaagagtttgaggtcacctgtctatttaaaacaaggaagaaaaaggaac

SEQ ID NO: 26346 - DNA, 1205 bp, Mus musculus
gtggccgaaggcaaacccagttatggtttatgtttagccattgtttaggaatggaattttgttatgaattatccctttaactgaaaccctcagttttactgtttacatggttagagaaacagggatatttttgaatctaaaaatttaatatacagcatgtgatttttgaagtttacatgtaaagccattttgcagtgtagggaacataatgtttgttgtgttttgagatatgtcttgcagttgtgtttctgagtgagtgttttgttgagagtacttagtagacagtctatcacataaaagcaaaaggattttgttcctcaagatgtgtatttatcaatctagtggggttttttttctataaaaaaattaaactcaaaatctggttatgtaagttcattgccctaaactgtgctgatcgtgtgtaactgagattaaaaaacaaaacaaaacaaaaaccttccagcatcaattatgtatcttccaacttccctgcattcctaaaaggcctcaagttacagagtcctagatttgcttagagtccattaccaacttacacgctgtttggcagctgtgcctttaaaagcccctgtctcaaatgtgagatggtttctgtaggcagttttagaaaggaaaaaatccacccttcaataattacaagtcaacaagtcccctgccaggctgccttcccagtcactttccttttggcctctccaggtccagctgtgcccaacatgtgtgggctgccttctcagcatctggaagccagcatcagcaccatctgactcctgtgtactgacctgccacagatgcattagcggatgatgctaactcactgtaacatagttgtacacatctgtacctgatgcatttaaaataaccagttgactccgtttccgggcactgttaactgtggtgtccgatccgtttgagtgttctgaagctctgctcttaacctttgatccccaaacttacaaacccgagaccctaaagttaaaaaaatgaaggtacatatacatgatctgagtaaccatttcctctgtggccaatctgtatgcttttagaagtttacaaaactgctttggtttttgtctgtaaccatctctgtcatcccaataagctgtttggacaagagcgagaacagtgctaacagtgtgcgctcgagtcatgatccgggctttacgaataaagcactttgatgactctct

SEQ ID NO: 26347 - DNA, 1167 bp, Mus musculus
tataccacacatcagtgtttccatatatgatgggcctcatggatgacaacactctaaaggagactaatggaaccgaaaagtcaccactgccagagatgtagcagacagcctaatataacagtgtttcacacacatgtctgatacttgtgtaagcaaacatgccatgctaccaatggtgtgtcaaaattcagtagatacaataagtattaccctcttgttgaaatattcactgtagataaaacacaatgtatgtcagcagcaagctcatacatggtgtgtttaaagtctcttgatacaatcaagaagccatctggtagcttgacctagatatcaggttttacaagtttattctagaatctttgccctgtgacaaatacctttcatgacccatctcccaggatgtaccttggctagtaagcagtgcttgcctgtctcattctgttctcaactacagtccttgggggttaaggggaaatactctgaagatatttatctagaggcttaagagctgagctctaggtccagtctgtgtcccaaaaaactcttgaaccaagatcatatgacctaaggggagggtgtgagtctagataaatgctcagataggagcttagaaaatctgcattgtattggatgaaaggtaggctacaaggaagtttattttggcacacacattgaaaattagatttaattaaaaaaattccttgcacctaaatgttgatttccatgtacaaacgaaaatgtccattgactattgtagttgactaaagcccattttttcatagattaaaattctccggacccctacatatgcttatccttcccaatttattagtatccctgatgaaagtggtactttaaaatcaatagcctgtgttgcacattcgtgtagcctggagttcatagttcatcataggctttgctctcagtattatgcttcctgtgaattttacaaatgtgcaactacatctatccaccattgtcattttgtacagagtaatttcaatgtcatgtaagtcttaaatatcagctcttcctatccccttcttaatagctgctggcaaccactgacttccattcttctgtattttacagaatgcatgcagttatctatcattttactacgtaacatgagtctttccctgtcttttcatgactagatagcacatt

SEQ ID NO: 26348 - DNA, 1106 bp, Mus musculus
aacagccgaggcatggaggggggtttacctgacagctcggaggacggatgagtccgaagaccattagatttgtaaagtttcagaagatgaactaggatttcttctttcgcctctgcctcacctgtggagtgcttggtacaggtaaatgcatgtgctttttttttcctgtttttttttttttttttttaatttccagttattgccaaaaggttatttggaaaccctgtggtctgttgtgagcattgttcacttggcaggaagaatggagtctataagcatagctttttcacacggagtgttccagctttggggctatcttaagggcttttttttttttttttttggttgttgttgttgaatgaactgagatttttgaatagagctgaaaaacaagtaatgtattacgtattatgctgattgtgcccatggagaatgctgcagggacagacgacacagagagggactcacaggatgactgagcatcaagatactgtatacatttgttgactgttcccagatgctgcgcgcatgtgtgtgtgtgtgtgtgtgtgtgtgtgtgcacgcgtgtgtgtgtgtgcatgcacacgcatctgaaggtaagactctggtaattctggattttcattttgtaaaatatgaaaactaaaatctttggaatatctaggaaataacctgggactcagatttataaacagggcccttctgttttcaaatgtgcttgcatgttttgtttttttgttttccttcataaaaatgttcgctaagggggagggtataggggactttcgggatagcatttgaaatgtaaatgaagaaaatacctaataaaaaattggggaaaaatgttctctaagactggaaaaaaattaactgtgctggagttattagtttgggaacttttaagaaactagctgtaaatagcaggatggatgaaagaaagaggagggaaaagttaatagttagaaagctcgcttccagacagaagcctggtcacctggtagtggaggcaggtggatggccctgtagccttgatgggtacagacccctcaattggcagcagaggagacatctcctgctgttaactgttctatgagcagttaagctcc

SEQ ID NO: 26349 - DNA, 1164 bp, Mus musculus
agaatgtaagccttttagaggagtccaaagttggtacatatttttttatcatacatagtaatacataaggcctgtggtttgggggtcatttcatattttaatgtgaatttcctcatagatctttacaaaatccgttgccttttcataaagctcctgaccttcacactttacctgtaactttatatgagaggaaatatggatgggtggattttcatttttctccttgatagaggtgtaagatttaaggaaacaggtctttctttttctcctcttctgtgatgttgtatcctgcctcctcttacttttattcctcctcctctttttctcttcctcttttcctcctcctcttctttctcctagttttcctcctcctatttctttttgatttttttttttttttttttggcattgtgaatgggacctagagtctgaaacatcctaggcaagtttacatcattgagcccatcttcagtcccaaggcagtgctttgagatatctaatcactcccctcttacttactgcttataaccaatgaaatacatccttcttgctttatgacaacagtgtggcctcacaaaactggagaccttcagagctttggattctggtgggaagaaataaatccaggacacccttagtagagacaaaacaggcatcctggatcagctttttcctggggacaggaatctctgttgtgtctattttggaaaagagagtgcacaggcgaaagggtgttgagatccctgactgtgtgacttgtaagcacaaatgtaaaatgttaccatgaaaagaaatacttgccctgagttctcccagaaagaaatgagcagatcactttataggacctgtcagttctattagcccagagtccattggatattagcatctaggttcttgttctatgtgcatcatggtgggacattgcatgactttgacagtgcatagttactatacctcccattccaggttggttctaatttaagtaacagatgtgataccatgcttcccaccctgagttccattagggttagcaaatgcagacagtcacattggccccataaaactgatggcagggttcctatgactgtgagcccctacatcacactggatggagaaagcaaagatcctatcaggggagtgtctgcactgaccagtcattaacac

SEQ ID NO: 26350 - DNA, 1097 bp, Mus musculus
gctgggctctcagcatcgtcaagtcccgctgacaccttcagtgctgggctttggtcactttggacttgtgaaaaattcctggcaagctcatgaagtagctgtcaactcccacacttcacaggcaaggaagtgggctttgaactgctatggcctggattcctcttgccctgaggatccagagtgaatctgaaagtgggtttctacagcttcagagagcagggcagtaagtagccaggtgagatgggtggtgtaagcgatcccatcgaaagcccagtgttgtggtaaggatggccctgggtagttttcaaacatttggctgtcagtttgtttaactccttataggagccctttatacagttattgctgaagctcccagttgatgaggcagggctgaaacagttggcaattcaggttttgtcagttgatggtgatttacacaaagttctgcctccaatcccagtgttcatgaactgtcccagcatgcacaccagaaacaggagctagaaacggccccttcccaagcagcttgctccaattttctttaaaattggtatgtgggtggagcttatttggccaagtgaaatgtatgttaaagagagacattcttgctaggatttttgctgtccacatccgtgtatggtaaaactccacccatggtacatttgcatagcagtgaaaaaactggtatttcctatctgtgagtgagtcacactccctttcctgagcctgtctgtctgtctgtctgtctgtctgtgtgtgtgtgggttgtatctggccagctagttagacaaatggactaggctgcaattcaactgcacttggagggggcagcacctgccactcatgggctgggcccttttctgctcagagaacgctaaggtctggctgatggccacagctggacctggacatggagccttcagtctgctctccacaggaaaggccaaagaggaaaacaagccttgggtatttctgctgtggagggccccatggcgcagcaagcaggagacaggtacagaagtcacatgattctaggggttgtctcccttcccaggtgtctctgattcctggctgctttgtcctgaatgtgagtcagg

SEQ ID NO: 26351 - DNA, 1355 bp, Mus musculus
ggtcctcaggagcaattctagtttgggcctccagactccagtggaaggcagtatctctgtgtgttcctcaccacaccctaggccttcctgttctgttgaagggagatgggttcaattgccagatttctgtgagaattacagggctttcagatcatcatggagaaaattacttagattcaatgtcaccggggaaaaagcatattcttaatttgcctgtaatttttcctttaatggatactttggctccattttcaaagcacattcaaagctttctttcccaatttggcatcaaaattatttctttaaatgcctttaattttaggattattttctcctttgattgacataaagtgtatcattctcgaagggaaaatatcaacacatatttgaataagggacttaataatgctgagtttgaaatcacttacctaggagtgaaggttagcagctgtaaataccagggaaacaactccatataaccaacacactatgtgaaatttgagattttggatcatgagtgctaatttctgttctcagtataactatttattatttctcactaagagaataagactaggaatgattatactgtgctcatgggtcttttaatgtcttcccctgtgcagtttgttctagcttaatgtgttgctttgggcttcaatacgttcaaatgaagaatatgtcattctagtctgatccagccttctataagataaaataggccctattgagaggttcatgtatttacccccattttaagctggtcatagggaacacagaaagactaagccccatgacgatgctcactagacctggacctctggcaggaggggcttaagacaaagtaactgtcccataaatacaaatgctaccagggtaaagggtacttcctgcctcctcgcttctctccacatgatcaacaccctttctctacagatggcaatctgcttagagaatataatcagatgaggacagttaccaggaaaatcacttagtaatgttagtacccagactaagaaccaggagggctcagaactaaactaggctggtcctgatctgactcactgtgtggtcttagccacttagatggtttttggacttggttgtcatacctactagagaaatattcatattgcatgtataactgagtaatgtctgaattttctttcaactctaaattgtctctgctaagcaatcaattgtaaaaataatgtgttctaggctagagaggtggctcaacaactaagagcaagggcaaatcttcccgaggacccaggtttaattcccaccacctacgtgcctcatagccatctttaacttcagttccaggggatctgatctttcttctagtctct

SEQ ID NO: 26352 - DNA, 1201 bp, Mus musculus
tatatttttcggacttcatctctaggttgaattttttttttttttaaagatttatttatttacttattatatgtaagtacactgaagctgtcttcagaaaccccagaagagggcatcagatttcattacggatggttgtgagccaccatgtggttgctgggatttgaactcgggaccttcggaagagcagtcggagctcttaaccactgagccatctcgccagccctaggttgaatttttaaacaggaaagcctcactgtgttgcttaggctgaccttgaacccaaatatgccctaacatgtgacctctgatccctcacctatgatgacaagtatgtgcttgcatgggagctcatgtaggtagaaaaggattgatttcttcccaactagtcttaattgtaatatgatgggaagatggcagcttttcaacaatggagccatgtcagtttttaggctagatgtgtagtccagataatggcattttctggactgctgatcagttccctctgatgtctctgaggtggaccctaccacagctctaggaatcagtggcttggtggcagtcaccctgtaagtgggatatagttcaggatgtgctaccctgaggagcttatggaaaggctacaggcagctaccaaccagatctttctatgccttctctctgacttgcctgagcaaacggcatatctacaggacaccagtaggactggtggttgtttagggacccactggctgcttctcatccctatgaatataccttttgttctgtgagcctggtgatgagtggtcgctgctctgagaggctgtcttgggtaaaatgctctaggttgtattgatgctgcctcttcacctctgagtaaagctggtgaggagaagcagggtttccataaggcctttgagatgggctataatggaaaagaccattcttaggacagcactgtgtcaaaggagaggctaactactggcttccagaaaaatcttcatgttattaaatgaatgcaggtgggtaggattaccctcacaagttgaacacatggcactcttgtggtttgtgcttgcttacagggagagggagggactgtagttcgataagcaggaattttgaagttgcacagatctggtcttgaattcactatgagcttgatgacttaagagaaagctatttaatcccactgacctttgtcttcgaaaggtccaaaaat

SEQ ID NO: 26353 - DNA, 1115 bp, Mus musculus
tctgtaacattttgagggtctcttggataaccctgaccgacaactcagaagagggcttctcatgcttggtgttggtgtttttcttagttggtctttagctctaggaaggtacattgtcagacaagatgagaaatttttattttattttaattatatgtatatttctacatacttgcttgcatgcattacaggtatttttaggtagatcgttaatagcatgatgccttgtaactttttcagatattttcttgttattttatcctcctctaatggtctttattttttattttttatctatctatctatctatctatctatctatctatctatctatttatttatttttactttcttgccttccgcagttactccaggatatatattcatatctaaatatttggggctcaaagcctcaaatgggagagtatacacaaactttgtctttctggtctgggtcatgtcactcaacatgatcttttctagttccattcatttccctggttacaccctagagaaagatgtgtggatctggctgggtttagtggttggagatggagtttcatctcttcatgcctagtaagcctgaaccttagaagctctcttcagcagtaaatgccaaattaccttgtcataacacctttgggaatcattctgatgctaccctctcacacctgggtagtcagctacagtgtgttatagtcagctagacactattatttatttcattcaggtatacaatgtccaaagtagctagattgtatgccataattatgtccacttatttcagaaagtattaattaagctctccatttctagagcaccctccagccaatagaaatcctgtgttaaaaaatctctacctattaagtgtttactactgcagctgactgattcccctggattcattccctcagatccatgcctgtgccataacaggagccaaggtggctcttagcttatcacatgtggatggtggctggctaacatgaagtatgatgctaacccaagctaggagtcttgtgacagaaaatcaagatagagacaagcaggaagctttttgaacgaactcattcaaacatatgagtggcccttgaaggtgatctggctgttacccc

SEQ ID NO: 26354 - DNA, 1192 bp, Mus musculus
tcactcactcactcactcactcaataaataactaaagttgagttcatatagctataacagggtagggagaagagtagggatgaagtgggcatgctgacacccacctacagttaaatgtcccctcataccgttttaaaagcctgttgcaagagtgggaggtagacctgggaggccttagcatgaagagtaggaggttaatatgaccaaaatatattgtatgaattatgaaattctcaaagaattaataaaaatgaaatcagggttcaaccttcattattttcctccctaaagtttttggttatttaatacattgtctgctgagcgcgtgtcccggaacttcatgagcaggagggaggtccccttcctcttttgaaggatgcctgtttggtttgctgacataaatggcaacaggtgtgttaacaggcaaaacacaaggtaatgggtccatgagcatgaaagtctttcaaaaacacataactcaaatatccccttggtagggaagtgagaaatggagatgtgttgtgggtgatttcaaaagttaataaaggatatttttagaaaattgaatgagcctccaaagaatagatagacaatagtgtgtgaattaagttggccagaaaaccaattaaaagtctgtctgagtgtggtggggccccttcgtctttgtttctatgctgtgaagttaattgtgactgatttaagaaaatttctggaagggagtaaaggccattgtgttcattttggaggagcctcaaatatgggaacttcagagagagagagagagagagagagagagagagagagagagagagagatccctgctggggttggaaacagaaggtcagaaaaatctctggtcctgaggatgtctggaaggctgccttttgttcaaagaactcagcatgctaaagtgtgggggctccgagctccagccttagaaatacatgctcctaacctccatactagattagctgaatgggaattcaacctcaacaaagctcttaggtgattatggttcacaggaatcaaacatttatgtgtacatagcacagggcctcctcctgtgcagcaagaactctgaatgtctgctggatgactaatgaatgaattgcatagagggtgtggcccagaggagatcgtttcctatacaatccttttcagttttagaaaactgtagccccttctttgcctt

SEQ ID NO: 26355 - DNA, 1198 bp, Mus musculus
ttccatgaaaaatcaccccactgatattaggtctgccgtttaatgacggagtggtgtccatttaatcatggtgcctgtctggaatgcagcatcgagaaagtagggttggtgtctggctgctccttagttggcctttggggaaggagtagccacaagatgtccccacccctccgtgtgccctcaggaatttgcaaatgaggctctgtgaaaataagaactgcatcagcagcttcctctgggtaccgccagattttggaaggtggaccagactccagaagaactgctttagagagcagccctgagtaagcccggcagaggtcctgcatatctgtaaatatagactgaaaaaccaaaaaccatttaaaacagtagagaagggtttagtccagatgacgaccaaattcatcaggtgggggtggattgctgagtttatggcggttctactgcaaggcattggctttgatggtgattgctccctgtggtgacttaaagaacagaggtccagggaatcagagtctgcatcttggtgcaagaccggggaggggagaggggggagaaatcagccatctccaaaggtggaagccaccagtgtggggtggtgactgaaaggactcaggcccgtgcaagtgcacgcgtgtgtgtttgtgagtgtgtgtggtgtgttcactactgtgtgtaccataccacctggagccttcaggcttcagggaattctcctctgcctcccatctccttgtgatagcagaggaattatagatacatactacttctcgcaacctttacgtgggtctggggaatttgaattcagactcctgtacttgtttggcaagtgatttgcccattgagccatcacctggagcctaatatctaaagcatttcgacatttgttttcccaagtactgtcagtgattgcaacgcagtgctgtattgggctggagcgatggctcagcgattgggagcatatactgtctgcactgctcggaattcccagaatggatgggcacctgtgttcttgtttgcacaccttcacacagaaacatgtgaatccacttaattaaaaacaataagccaggcagtggcaggcagactttctgagttcaaggccagcctggtctacagagtgagttccaggacagccagggctatacagagaaaccctgtctcgaaaaacaagcaaacaaaaaaagagtgctttgta

SEQ ID NO: 26356 - DNA, 1100 bp, Mus musculus
cccctggaactagagttacagatggtgtgagctgccacgtgggtgtttggaaacaaacctggttcctctacaagagcagctggttctcataacagttgagttatgagtcaagttccatcttgatcatctctttaaaaggctctcttctaagtgtcttaaattagaaaactacagaaaacaacactatagtagccattgcaaaaactaagcaaatctgtttaatcattggagagatgacacagtatgatagataaggtcattaattgagtaagtcactcaagaacttctctatgaaatgagaacactataacgatgtaatgagttaatatttggaaagggtttaagatcaatgcccagcacctaacaagtgctatatgaggttgtttcaagttttacgaagaaatagttgcttctgtaattaatgccacttaattaacaaacatttttaaagaggaaacatagtgtataaccacacatcatttcccagagctaaccagtcactagaggctggagttgccatgctgatttcagtgtgtctgctgagtttgtggatgctcacaagcaagagtataagtgtgtgttcaatgtaacattctactaagcgggactgcactgcacacgtcctcccctggtctcatggctatccagctttatgttattgagatagacctctggggagagacatgattttccttcattgtaaacagctgtttcatattgcattctatgaatatgccaccaagaatagacacatgccaatggagctccaatggcttgcctggagcagagcctgttcatgaagtttcatcttgatggacagcaaagagagccaagtacaggacttgcatcttcaccctctccaaaggagtgggtggatttcctcatccagtgggcatttttctcagacctcaccatgacttgaagccattagattctctggctttccctgtctgatggagacatattaataatgtaagtgttttcatttcaaattgcatagtcaattatagagaccattctagcatttattggcctgtggagtttcttcttcactgacttgtgtggttattgtcatttggaatttatcactacccattttc

SEQ ID NO: 26357 - DNA, 1107 bp, Mus musculus
gactagtaggaagaagttaagccgtcctctgaagagggttactcactcagtgggcctatgtgcagcaaacactttgttccagaaatggatggttcattagccacttctttagagccttggatagcaaatccctctcccctctccaatcaacttcctgcttactagagggcattcaactcatcctggttcaccacaggattgggctgcctgtcaaactcctgacactgaattaccgccccagtaatgaagaagtctcggatgtgctgtgcagaagagagggctctggagcactttgaaagtgaaaggagctgtttatgaagtgacagggggaggagaccagagagggaggccagactgcctatcactgactcacatggttagcagggtcaccagaagccaccacctctaaggtggctgtcatgaaataatatgttaattatgtcatgcttcactcaaccaaagagcacttctcttttgggagtgagaatagccatggcccctgttactccgaggacagccccttggaacaaggaagacattgtagaagtcactcaaagagcagtgctgtgccctatgccattaaacaatagcattagaggtatagtagagctggatgtggctctcacagacaacgaaggccagcctctaaattccccttcctggaaagccctcctgtgacccaacaaaacctaccaaatgtatgccagatgcctgggagccaagcatttgcttccttagcctgctgaaagataacaaatctgtgctgattagattaaaaaatcaaaacaagggttttcaaatccctcctcctctttccaagcctcttagatggcatctgttacagccacatcatcaaaatctagtttctaatgggacgtcttgggaaggcagtggtgttggggagaccactttccccctcccttaataaccacaagcaatcggtgatggtaaacagttttttgggtgagcctgcaatgcaaactgcctttggacttcacagacgtcacaaaattcttttggtcggcaagtagaacctctgagagcctgaaaatgttttgtttcgttgtagtgtgtttttctttaagtgtccgggcagccatgagtgtg

SEQ ID NO: 26358 - DNA, 1772 bp, Mus musculus
tgctggttagtgctgtactccttccacagagtgtacatacatacatacatacatatacacatataaggtatgtaaacacatacatgcactcctatatatactacaggcatatacacatatacaacaaagatgtataaacacaggcacctgttcacctataccacatagacttagacacataaaaacaccacagacatacatgctgaaaacacacattcttgtgtctgtactgccctagttagatttctatttctatgataaacaccaggaccaaagcaacttgggaaagaaagtgtttatttcatcttacactcccagacaacagtccatcactgagggaaatcagaacagaaactcaaggcaggagctaaatcagaggccatagagaaatgctgcttactgcctgctcatctgctttcttatgcaacctaggacagatgtccagggggcttactgaccccatccacattcatgcaaacacacaccaccatacagatgtacatgtatatatgcatagaccacaagccctcacgggcacatacaccatctacattttgagcctctgctcaatgaaaggcctctttcctgtcctgactgattcatcctggacatgaacatttgcaagtagtgatgcttctattgacaggcagcacgaacacagctgtcatgtacaggggcttctttggaacaagcactgtattacgtatcatccacatattgtgtaatagagctaccagaccaaccactagatataagcttgttttactccatttcgtagatgcagaaactgaggagcagggggattactctgattccgtaataccaccagtgctatggctcggtctagtgaaggctcagtatcttttgttaggcatgctggcacacacctgtaatcccaagctcaagatcctgtcttttataaagagaaaataactcagtagtagagcccttgcttagcatgtgcaaagcttgggagtccatcccatctcacaaggaaggaagaggagagaggaagtactgtatttactgggtgcatgtaggtgactatagtaaccatggctgattgacagcagtgcacccactttcccgtagcagcaaagcagagagaagtgaattctgaacactgcagccagaattcttcagaaatcattttaggactggatgctaagtaactgctcccaaaggacattcacaatcataaacatggcaggatttgcataattatactgctaaatatacacatgccatttaaagtataactgccctagctggtatattagcacaattacacagaaatagggaaaggagaaaacatttctggtagaatttattaaaaaaaaaaaagtgcatctgaatcctatgtcaaaggaaaaaaatgtaaaagacaaataccgggaacaattacaaaagtgcaaaattatatgctatagtcttacttagcgcatgacgttattttagaaatatttaatctgggtagtatttttaaaaagtctaacttcatgagtatgggatataaaatgccaaaccaatttctgttgcagtttcataatattaaaagcaaataaatgagagtgctttttctgtgcgagcctctaagtgagattttacatttaaaaggtgtgctgacagaacacagggacaggaactgcaaggagctgtgcttccttctgtgagccagcaggactcccttaaggtttctaagagcacttcactataatagcccaaatagctgcaggacattagaaatcagagaggaggatcctttcttttac

SEQ ID NO: 26359 - DNA, 1195 bp, Mus musculus
gaataccagcgtccagaaatactgttaattctttgttctgtatacttttcaactttttaatcccctgtgtgtttaaagagagagagaggggaaggtggaggagtctgcactgggggattggagagggatgaggagggggatgaaaggggaagtggatggctagaggagctggcagcagcacagacgtttagcttcttgacatggcatcatgctgtgaataccatacactctgctacctcatggcagtgaaacttctagaacatgagggttacaggctgcgttccttggcacgctgtggactactgtttccatgacatttttcttagtttccagtcttctgtggagaggtaggcctcatgctcaggtgctgtctgcattgtaaggcttctgctgttctttgtgtggttttgttggttagtttgtttgtttttccctcataggaacggcccatgtttctgcagggaaggttctgggctctgtggagttctccctgccgcccagccaacccctgcctgccggaacctcgcccatccacactagcctgcttgacatgaggaggaacgtggctgaactcaggctccaactccagcagatgaggcagctccaggtactcctcacaaacatgtcccctgtcatagtggctctaggcctgatttctctgcatgcccatctcccatctccacccatgtgtcagcttccctgggcgcctttactgtcctttctgtagcagctagttgaaggaaggaacgacacatatgaccagaatggcacaggttccttgtttatctacaagcctggtctagaaccttcccctataactaaagccagtgtatcacaacttcctttaacagtcagtgtgagcatcctaccaggcaaggctgccagctctcagtgtgatagaggtccatccctcctccgcaagcaactgtggtgtctttagaacttgagtttagcatagaagatggagtcatgtgggtgaaaaaagctactcgggatgatttgctgaggaaaaaaatctgcattttacttgggtagtatgttccagatttcccttatccttttcattactgaggaatatatgagcttagggaatcaaagggaaggcaaaactaacccttcctgtccctgatctcagtagggcagaatagaatatcccatctctagcctgagtcctaaggagttgggaggcccagca

SEQ ID NO: 26360 - DNA, 1172 bp, Mus musculus
attgctgctgaagctgatcaagggtgttcactttgtggacatatgaaaacctagcaactattggcaagcatcttctgaagggtagctcaaacttgcatgctctttgttccatgtgatgaaggaccagtgaatcccggaaaccgtatggaaattatggacttagatataaatgcagcctttgtcaaatccagtgaaattagtcaattcccaagagcctttgtctcatctggactcattattgccccatcaatgtgtagtgccacatggtaaggagctgtgattctacactgttgagacatgaagccaaacaaatcagagagctcagattcgctttttgaagacattctgaaaaattcctgtcaacccaatggttgttgaggatctacaagaacctcagagtagctctgccaaggagagcagattctacatcaggagagaaacgcgaaacggagagcaagaaagcctatccaagtgtctggggggagacaaggactgaaggcctggttgatcactgggctttcaatgctagtactcttgactcctctctataaaatcgtctgtgagagtttgtggtgtgtttgtgtgtgtgtgtgtgtgtgtgtgtgtgtgtgtgtaacagcagccaaagactagaaaaaactctaccttttttataggcacagaagttcagctgtcagttgcctgataaaacttagccgttctctgaggaagcaatcctgtatacagtcctgtatacagtccttgctctcttctctttcttactgaaataaagattcagctgtgggttttctctgtgcccacttctgaagactgcagggcattcaggcttcatgatagcagacagatgaagccaatggaggctgatttcttttgttcaacagctgcagaaccaggagattctgagggcgatgatgaagaaggctgagctggaaatcagtaacaaagtgaaggagaccatgaagagactagaggatccggtacagcgtcagcgcaccctggtggagcaagagagacagaagtacctccacgaagaagagcggattgtcaaaaagttatggtgagtcaccctgaagagaaaaactgtctttgttcacagggtgaccttcttagctggtatttctctccctctctttaatgagcacctattgtgtaagctagagatctgctgagcc

SEQ ID NO: 26361 - DNA, 2050 bp, Mus musculus
tgcttctacccctctcagcccccaagcaggacggtccgctcactccgcttccctcatcccttctgtctctaatggctccttaaagtttcagagcccacctcacgcaggtaaaggccatcatcacctttcgttcgcactgcagactcaaaatggccgagctgcccctactacctcttcctcctcatcccctccttcccctgcctcccccacctccctgaatcaaggtgccaggggcatcaggaccatccatactcctagcctcgccagctacaaagcacagaatggaagttcaagcaaagccaccccatccacagcaaaagaaacgtcttaaaggccagatcctattaggcacaaggtggaattgcatccttgtttttaattttcagcaatctggaacaagtgttttcataagagaatgtatcatattgctgtatcgttcaaggcttcatgcagagtatgtgctaagtactgagttggtagctgcagtaaagcttgttttttttccactctgttgctgttgtaattgcatagtgtttactgtctagattcgatacctattacatgaagaaagcatgtgctataaaaagagagagtatgatgagagtgaagacatgtgtgagacaagctgactgtactatgcatgtaaaacatgtatgattccagaattttagtatgttttgtataaaaatatttttcattacagagactagaggcaaacagagaaataaatacgcaagcgtgactatataaattgtaaagcatatattatgatattttcttttattttagtgttatttagctttattacagatttctatttttgtcaaaacttcatggttcctttcaaaatcttttttgccaaaacattttgatactacagcattgtacatttgaaagtagcgtgctagcctttaagccaatgagcttctacagtcgtagaaagaaattcagcaaaactcctgcactgccagcaaaagtttgtatgataattcgctagcgcaagccagctcatttttttctttgttttcttttcattttcttcttccttttttttttttaaagacaaaacatctgagtattctgtagctgttttctttgcactgtctgacccccttttatgttttcttagacctggtaattcataccattgcattgtggattttaaaatgtacacttctgtatggttctgtacactgaggaacttttgtaaatatacaaatataaataaacatcaaaatactatctgtgacagcacatagagtagttttcccacaccaaagttaatttgtatgcatgcttaagagtctatattgggatgggcagaaatgggactatccatacatttttaaaaagcaacaagtttgcacagttagggtggttttgtagataactgtatttgtataacacagccatgtaacatatggagctataagcagagacttggcaaaactaaataaagggctgcatgcttattattttttttttgtaccttgtcactataacgtctttcagtcaacgaatatgtaactattgccacagggtttcagctctgagggcattctaagcaacgtgtaatcacatccactcatacagtgttgcttcctcgaaagggaaggatgaattcctaataaactcatcaaccatgtggccgtctggacttcctttcctgcctgactcttctctagggcatgggggagggggcgtggctaacagagaaccctgcacacaggtttgcacactcatccattgcagcagctttgctgcttgcttggttttgtttttgtttttagtttctattaaaagtaaaaaataaaataaaaaagtgtatttatcagtgggttaaggtttttttttcagttcccaatttttaattttttaaattactattttatgtatttgacttggatgtctgtcacaggcagacattatcagcaacactcagccacaaatgaaaatacattcagaccagggctcagactccaagattgtgaatgtcatgtgttaggactttttgcaaagggtggaccactgtttaaaacagagcttctca

SEQ ID NO: 26362 - DNA, 1310 bp, Mus musculus
ttctacagctaacatccacccccacaaacagtctgaaagtccagacactaaagcagagactcctccctgactttaagctgggtctagccactctagcaaggaaaaactactgttacacagtctagtaactgtaaatatttttcttgtaccagaattgttattatgcagccttgctttgggctggattcaccattttgcactgtgaaatagctttacagtgcattactacagccagaagaacacacgtatatatttaagagtatattggatagttgtatacaaataagcaaggtgtttgttgcaactcactacataatatattccccaaattactgaagaaagtcgctgcctcctgcagccaaattgttcttttggttcctcactaacaaaagtgcctcatgataaaagtacatttgatttttagggtgccatattgttaaaattagaaaattgaataaatgaatgcattttatcagtaacaagtttccttccatttaccagttaacacaggtggatacaggacttcaagtctttagtcattccagacggatctgagttttatattcaaacttttaatacagtttttgagttttgtgtgacttgaatttttaatctttctgtaaaatacgtaataacttaaatgaacatattctatgtgtatcttttcttcagataccagatttgatataaatgttgtaacataggtatgtagatagtgtatcctggatggaactggcttcttactgagaaaaatataattctgcatgaggactttatccaaacctgtgtcatgcctgtgtgcatacccaactaaacactggaaataaaattgtcttggtgaagtttgcactgttgggagcttacttggttttacaaagctgtctatttatatattatctaatccttttttaaaaatatttatttatttattatatgtaagtacactgtagctgtcttcagacactccagaagagggcatcagattccattacagatggctgtgagcccccatgtggttgctgggaattgaactcaggagctctggaagagcatctgctcttaactgctgagccatctctccagcccatattatctgatattaacttgtaaagaccgcctctgttcacaccgtccttccacctttcctttccttgtgactgagaacggtctctcagggtgcttgcggaacttactcctgtgcataggaagtacttagtaactctagctacagcactatgttgcttacttagcaaccaactacagcagtggatgttgctcaccttgtcttgaggcgcattaagcaagggaag

SEQ ID NO: 26363 - DNA, 1129 bp, Mus musculus
agatgtgctagataataaagaatctgtcattctaagagagaaacctcagtctggccgccagacgccacagcctttaagacatcagtcttacatcctggcagtgaatgaccaggagaccgggtcagacaccacctgctggctgccaaacgatgcacgcagagaggtccatataaaaagaatggaggagaggaaagcttcaagcaccagccctcctggtgattccctggcatccatcccttttataggtgagcgcattcagaggccctgcacagcagcagctgggtgaaaagtgttcgaagaaatagagtatttgtattccataggcacagaaatcttaaactgcgcgtgcatttaaagcattttaagtgctgtatacgtgtttattttcagtgccggggattgaccccagggcctcatgcatgctagacaatcgctttcctactaagccacagcaacccactctccatgtgtaagttgtgtttcactcagagcaggttgcttttctcctccttaaatatatttctactagccattttcctttaaaagtaagttggcatctagtgtgtatttgacacagggtgttgtagcccaggctggatttgaatatatggctctgtcctctctgcttgctcagtgggctcatgggtttatgcgctaccctgtctgtcctcttttgttagtcttggttaaatcagttcctgccatctgtgtcaagagagtcagccgaactattgtacctagttgttggtctacctgaatcaacagcagccaggcccttcccttgctttgtctgtagtaaacggttgctggttgggcagagtctcctgagttgtcaccacacaaaggtgggctttttggaaatgcagctacctttgagtcactcctgctcctgtaggtagcccacacccacataagtgacccctggagattctagtggttcactgaagtttaaaacaaatctcattttgtacaaatgaaagcatgaggcagaagaactgccttagtttgggttttactgctgtgacaccatgaccaaagcaactcttataaggacaacatttaattggggctggcttttggattcagaggttcagttcattatcaaggtgggagcatggcagtgttcagg

SEQ ID NO: 26364 - DNA, 1150 bp, Mus musculus
acacttctgagtggaacaaaatatctggtatttagcatagcatttacaaatatttaaatgcagttaggtgctgcatatctagtcatttagtgtttattgaacaatttgtgcttgagatagttagctaacatagaggaagtagtaagctcactaggattagaatcatcgtttttaacccctttcaaattccattttggacaatacttgatgacatgtacactgtccagctagagatttcgtggcccattcactgctctttgaatgtctgtagttagtgctggtgaagtttgaaaatcaggccgatgtaggatgtagcagttgacagaactgtgaagtagtgaacacggaaacaaagtcacctacttcaagagaaaggtgatccaagattagtaatgtttaagatgctttattaaagttcagttatagacagcagctcttctgtattatttttagtctggtcctatttgtttcacttaaaaaaacattttggggtacctaaatccacacaaaatggtaactgtgtttcatttccattgctgtgtagtgacagtgatcttaattgtggtttgtatatttcctgagtatttactttctggattgaagggtgtgactgaatgaagacatgcaatgggctgctccccaccacaagatggcattcctcacagcatttgctattgcccatgacagtctgcttctggttacctttcagagaaatgttcaacattgaaatgatgaaaaaggttaatagttttaatgggcaataagcaatttgttatacaagttttaaattaaaccatttacatgttaatatcagctctctggttttgcttctaaaatgtagttctagggcttataatggaggccagggatgtccctgtacagtgcacaaaaccctgggttccatccttagcacctaggaaggtagacgcagtaggaaaaggtcatgtttagtcacacagtttgaggccagcctgggatacatgaggtcctgtttaaaacaaacaaacaaacaaacaaacaaacaaacaatacttgaaacactttttgttaatagagactcaaagctctgtatttgtgtacacattctatcatttcagaatatttgtttcagtagacttagaaaattatccataaaagaaaaaaattatcc

SEQ ID NO: 26365 - DNA, 1695 bp, Mus musculus
acttcatcccacatctattgaatgcaaatcaattgctttaattaagctaagacctcaactagattggcaggaattaaacctacgaaaatttagttaacagctaaataccctattactggcttcaatctacttctaccgccgaaaaaaaaaatggcggtagaagtcttagtagaggatttctctacaccttcgaatttgcaattcgacatgaatatcaccttaagacctctggtaaaaagaggatttaaacctctgtgtttagatttacagtctaatgcttactcagccattttacctatgttcattaatcgttgattattctcaaccaatcacaaagatatcggaaccctatatctgctattcggagcctgagcgggaatagtaggtactgcactaagtattttaattcgagcagaattaggtcaaccaggtgcacttttaggagatgaccaaatttacaatgttatcgtaactgcccatgtttttgttataattttcttcatagtaataccaataataatcggaggctttggaaactgacttgtcccactaataatcggagccccagatatagcattcccacgaataaataatataagtttttgactcttaccaccatcatttctccttctcctagcatcatcaatagtagaagcaggagcaggaacaggatgaacagtctacccacctctagccggaaatctagcccatgcaggagcatcagtagacctaacaattttctcccttcatttagctggggtgtcgtctattttaggtgcaattaattttattaccaccattatcaacatgaaacctccagccataacacaatatcaaactccactatttgtctgatccgtacttattacagccgtacttctcctattatcactaccagtactagccgcaggcattactatactactaacagaccgcaacctaaacacaactttctttgatcccgctggaggaggggacccaattctctaccaacacctgttctgattctttggacatccagaagtttatattcttatcctcccaggatttggaattatttcacatgtagttacttactactccggaaaaaaagaacctttcggctatataggaatagtatgagcaataatgtccattggcttcctaggctttattgtatgagcccaccacatattcacagtaggattggatgtagacacatgagcttactttacatcagccactataattatcgcaattcctaccggtgtcaaagtatttagctgacttgcaaccctacacggaggaaatattaaatgatctccagctatactatgagctttaggctttattttcttatttacagttggtggcctaaccggaattgttctatccaactcatcccttgacatcgtgcttcacgatacatactatgtagtagcccatttccattatgttctatcaatgggagcagtgtttgctatcatagcaggattcattcactgattcccattattttcaggctttaccctagatgacacatgagcaaaagcccacttcgccatcatgttcgtaggggtaaacataacattcttccctcaacatttcctaggcctttcaggaataccacgacgctactcagactacccagctgcttacactacatgaaacactgtctcttctataggatcatttatttcactaacagctgttctc

SEQ ID NO: 26366 - DNA, 1214 bp, Mus musculus
aggctgaggcaggatggtcaatttgaacccaatctggtctatacaaagccaatctggtctacacggcgagataagataacgaaaaaaaattaattttgcgtagttcattacatccaagggttggtctcccatatccagacatgaacaaaaccgctaaactatgcatgtatacatctctaaggctttcaggatagagtccaaaagctaagagataaggtcaacttagcttctgttacacaataacccacagcgtagactaattagaggaagttggcacgtccactcggagcttggcattgcgaaaacaatggcctcagggttagcaggtaccggaaccagatttctgcacgctttgtcccgcgtaggacaacagttcggacgcacatttctggataaaagcggacgcggctcccgactagagccagtggctccgaggagggttgaagaggacaggcgaccgggtggggaacagggtgcggcttcgcgcttccggtgcccagcttccggctccgggtttgggcttggggcagaggcggagctacggcccgccgcgactttcagacttgaaccatggctatgcgctggtcgtgctggcggcgtggctgctcctggaggccgaccgcggtcgggagcccgcggcgggaacgacctggctgtgtggagcctctcggaacacgtgccgcctcggacacccgcgcgcaggtgaggccgggacgcgcgcgctgtccgcggcgtagaggtcaccatgccaatgacagccggcgatccaatgaatgggaggatgcgcacgtgcgccggggcctgcagtccccactgggtgggacacccgggaagtgggactagtcgcggggccagaagtgcggagctgctgatcgggcatccagaagacattggggttgaggtagagggagcggcggagcgcagccctgttaagccggggctacccgggtgtgtcgagaggacaaccagagccaaagggacctctgctttcactttcctagcaatttcgggtttcggatccagttagcctcaaaattcggaaagggtgttgtagcgacgcaaagtgatgctagccagggtggacttcagtgctgcaggtgcttacaagagaacgcacgcctgaaaggcgctggaaggacactagaaggagaagagccgaagggtgtcatgagagacctatgacttctttgaagtaaaatcattatctaattagt

SEQ ID NO: 26367 - DNA, 1069 bp, Mus musculus
agaaagatttattgcagaattatggttctattttctcaatgcatcagttttgaaaatatttttagcttaatcttaatgtgtccaaacagtcaatgtgacagaattttgcagattttggagctagactgtgtcagagtaagcacatgatattctgggggcaacatctgaaggaggagtgccacaccggtcctttggattttaatgaaactgaatttacattgactcagtgaaaggaaaatcctttacatattgtaaagatggatgcagttcatttgtggataggcatatttaatccattccctggcactagaaacataaaattttacaataattttgaaagaaactaggccatgtattaatctgtaaacaggtaataagcaggtttgtattgtaactttgatgcaacacatgcactttgtgtgtctccttgattcaagggagggtgtgagggatacttctcttgtatataagactgtactgcttaggatattaaagtagatcacacaagtgtgggtttctatgtactgagggttgcagatttatgacagcatagtgatgagagcagtgcaaaatatttctgaaaattaaagaccattgttcctaccaaatcaatgattccatatatattttaacctttgttatttttgaagtactatgtcattagcaatcagatagctttttattatgcatttcctttttgaagcaaaatgttttcttcatttgtaaataacctgttgtctaaattttatctagtcttttataataaactatgctcctatatgaaaaatttggatattgttaaagtataactaatgtggatttaaatagtacagacttcaaaattctctgacctttaatcctatggtgaaacaaagacaaaccacttgaattttaacgttgattatttatttgtgtaatggctttacatgtgggcattaacagtgtaaacaataccacatataaccatcaggatacctcgattagaatttataggactataatgacactggtttaattacatttaaaaagttttccgaaaaactttgccaataaaaattgcccatcaata

SEQ ID NO: 26368 - DNA, 1191 bp, Mus musculus
tggtcaatatgtcgggtaagtgatttagggacttgattgaccatttacttataccgatagaaaaattaagtccatctgggcggaggcagcagctgtacctttaatcctagcacttgggaggcagaggcaggtggatctctgtgagtttgaggccagcctggtctccaggacagccaaggctttttacacagagaaactctgcctagaaagaccaaaaataaataagtgaataaataaatagaccaaaaataaagaagtgaataaataaataaattcccactaaaaatacttagtttttctaaactaattaattggcattacattttaaaagtaaatgttcaagatagtattctcatgttatactttgtttcctccacagttgttgcaatatatgattatacaaaagacaaggatgatgagctgtcctttaaagagggtgcaatcatctatgttataaagaagaatgatgatggctggtttgaaggagtttgcaatcgagtgactggactcttccctgggaactatgttgaatcaatcatgcactatactgattagtttttcttttttcttttcatgtaggttattactccgtcatactgtgggattatatggttaacagaattgttttaatgtttaaaatgtgcccatattttcaaggacatgttttattggtatatttggatgtctacctgtaagcataaattttggaggcagttcaaacattgctgagcagcagtttatatgcctataattgattatgcatatgtactcacaccttgctaagtttatgaccagcctaaaacttctggggattgggtattatgtttaacaaatcatggttcagaatgcaccattacatgtttcagtgcagcatggtcactaacattgtgtcagactaataggaaaaaacagaaaacgtcaatgctggtgctggtcatacttttggtttcaattctcatttttaaaaaaatactgtgtttaaagcatgcataaatttttatgtattgaaatatacttaacaattcaagatgcttccaatttgtgtaacgattatctggagtactcatacttgagtctcctaagctctccatgtgaaatgaaagactatctgtaatgttgtaatttgtatctaagttttttaatgagtgaaatttgcattataaatttttccattcataaatacataagtga

SEQ ID NO: 26369 - DNA, 1167 bp, Mus musculus
tttcacaaaattgttagggttttacaagctgtatgtgtggtacagagaagtcactttgttaagtcagttttggccattttgttttagtaaatgttgcctttctaatagtttgtgatgtttattatttcaaaagcaaaccattttgcataatatttcattcagaaggtcagtattgctaaaccaatgtatttgtgccttcctatttatgtatgagattcagcacctgttttagtgaaatctggtgaatataagatgatatttaaaaatatgaaaatttattttacctttttagaaagtatgtaaatttaaggtattctgggagaacattcagttaaccctttgaaattgagtcagtgaaatgtagacttttttgaggtaggttatttctgtgtagcccaagctatccagaaacaaaatgtgtatattaaaaaaaatgtttgaaaggtaatcataataaaaaaatgagaggaaactatcttaccttttcaaagtattgttcaagaaaaatgatcctgttataaacacaggctcattttgtgggtactgcatttataaactcatttgaacttgttttatatacggatgtttgtttttttttctttgtcttcaatatgcggtattttcctgccattttggaatttttggttctgttttcttacactccgatctgagtgataaactattttgctagaaaacattgtgtctggcttcctggagtcatacttctcccagtgagtgttgctgatgagactgtgtaggcgttggggaaccattagataaattttacatatctgcacttaactcttgtagctgatagattacaagttgctgcagttactggattatagatggtaccactaaaagttaaagaattaaatctaattatttctaatttcttctggtgaaggacctttgaacttaacactataagaacacggagaagactctttattaaatacaatgtggtcctatgtatgatttacaacaaacttaatgggatttttatttgtgatttatttagattgacaaaaactggcagttattacatccagtcaaaggactgggctgaaggtggagataggaagtggaacatggaaaggaaatagagtgtgactgggctgctgtggtgctatcttttggattattctttgaaaatttttgcagcag

SEQ ID NO: 26370 - DNA, 1175 bp, Mus musculus
tttttcccataagaattataagctgcatttctaaggcatagctccaattatgagataaaatttatactttttacttttctaaattaaacacaagaaagaatgcaaaaacaaaagtgattttttaaaaatgaggttaaatcgattttgcatcagtcactgaactgtcagctacgtggcaggaaccggacggaagaatcctctccaggagactgggctttagttagtggcttgattccccggcttgctcaagggaactcagaaaatcatcgtccttgtactgcgcttctgtttacaaacgattcactgaacagacttaacttgatgatggaaatgatgaaaaacaggcctaatgtaggtgtaaaagtgtattcaaactctagacacggctaatcagattttaattcaatcatacacacataatcctttgtaatcatttttcttttaagtgaggatatctactgtctgcttcatagggtgctttgcaataaaatgaaaacgtatttatactgtttttactaaggtaacaaaagcatgataatccttttttttgcaagtgtaaacgacagtctggactcttaacttcttagtgcctcagttttcctttggggtatacttcacaaggtatcagaagtactttcagtctacaggtctctatgtccacataactaaggaatgcctaactaatggaaacttaagttccttctagccattaaaacagagagaagatcaatttagatcccggaacactgtatttgaaaaataatcttcctgtgtactttctcaaacctgcgctcagtaatatactttattctttgaagatttaatttaaaaacttcatagaaaatccttttttgcttttccttttgagacagagttttggtagctcctaccagcctccaattctctatgtagctgaagatgaccttgactacctgagtttcctgtctctacttcttttcagcttctgggaccacaggcctgtaccaccatggccagctttagagagtaaaacattttaatttgttcttgatttgtatgatgttgggggcgttagcattacgtgttgaatattttgagtaagaagaaaagaatccatcttcagaatatagggttgttctttgggaaaaagagtataagaacataatttctttgtcctagactttacaaatttttca

SEQ ID NO: 26371 - DNA, 1181 bp, Mus musculus
atcagactatgcctttcgtaccccaaccagacgacgaaacagatacatcctattttgaagccagaaataatgctcaacatctgaccatatctgggtttagtctgtagcacatgcgtgtcatttttatctaacttgtgatatagaattaagttttacagtaatatgctacttaatactagattggtctaaatgggataaaagtcattattttacccagactgaacagcttttaattactaagtacaacagtttttacagaattaaaatactataagcaatataatcagtaattaatctttaccttagaactgtatataagccataatagcttttttcatcttatttattcactgcactttatgaagagcaaagtatcaataaactaaaacactaccactctaaatagagggagtgagccgtaagcttatctttatctgctgattttaattctattcactttggggttaatatcaaaccaaaaaaaaggactatttcatttaaatttaatttatttgcacatggttacatgcaaagctgttcttcaggctgtcatatgagacaaacatgactgaaaatcatgtgaaccagacatgatggtggaggtccccatgatcaggagcagatgcaacacaggagtatgtctgcaacttgaagactaaggccagccaggactatattactaagcactgtctctgcagggtgtggactagtcaaaagaactaaggttccagctcaccttactagtgatggagtctcactgccttgaatgctcttgttcccctctacaattcctgcttctttaaatgggtagtggaaagattgggtggttttaatagcttgttcacttttaatagaaaaatttatactttatgtcatatcatttcaaacatcataagagacaaatagtaataatttcttttgcttacaaaatgtaactgtaattagtgggttcagtatcattcttttaaagaatatgtattaaaactcagctcacaagtcttatcttaaactagttgagactttcaatatttctctagaagaggaaaattaagatttacatgtctcatgggtaagattttactaatgcccttgtgatactggccatagtgctttcattaacacctagtcacaggctatacagaatgtcgtttacaaagatgcataatcagtgctgagtattg

SEQ ID NO: 26372 - DNA, 1104 bp, Mus musculus
tttttagtgtgaattttatgttgttataaattaatctgtattcctttgtcttagtactcttttcttgtcttgcttcttgatatgtggattttacacacacacacacacacacacacacacacagtttgatatagactctcattctgttccccctggctggcctgaaactactgtaaaaacaaggctggttctgaattcacagagaatttttgcttttgcttctgcctcccaggtgctaagattaaaggtgtggacaacctctccttgctacaagtaatatgtaaatggtacagagaaaaatttaaaatggaacataaacagaaacttgttggttgttttttctctttgttgttgtttgtttgtttgtttctgccatgtttagcaatattgaacattactgttacagcagtgagtatttgtgatagagcttcttattgagggatttaaaaattaatgacttgttcttgtctctttttcttctaggaattcttttagttgggccaccaggaacagggaagacgcttcttgcccgagctgtggcaggagaagctgacgtccctttttattatgcttctggatcagagtttgatgagatgtttgtgggcgtaggagccagcaggatcagaaatctttttagtatgtttggtgtatatttcaaactggtagagaaacagtaatgttttctttatcctttccttgataattggctttagtttcaggtaacttaatgaagctatgtgctttatttaaacaattttactttgtacatatgtgtgaaatatatacaaagtaaatattctcctctacctttttggggggttcaggaattgaactcaagcccgtttgctactgagctctcttactggccctgcattcttttctaatataggctaaacaatcataaggcctggtagatgtgctagatgaagttagggactgttgatgttgaaaaattcttgagtttttttgtttttttattttatttatcaattctgtagcatgtaattaatatttattagctttaattctaattatattaatttgtacaaataggaagagtggaaaccagttcttaaacatgactctttgatagtcttacagttt

SEQ ID NO: 26373 - DNA, 1221 bp, Mus musculus
gggcttgcattttcatttgtggccaatcatgtagagtgtatctaatgtagagtgtatctaagatatgattatttttatcttttatgtgtataactgttctgtctgcatgtatttattttttactatatatgtgcagtaccaatagaggccagaagtggagctgccctgtgggtgctgagaactgaacctgggtcctctgctagagcaattggtactctaaactgctggcacatctctccaggcccagcattggttatatttcgagtttctaattccacttagtaactgctttttgttgttttcagaaagctagtaaaacttagacctcttctggaagttttattattgaaatgataatttattattaataatattaattaatagtaattaataacattaacttaaaatggtatattttgttgtttaagttttaagttcagttttagttttaagatacgtgttttaggttgtaatttggagtagttgtgttctttctaccttcaaaatgtaagttgaatgggaagagcttgaactgataagagatgtattatgttctctttctctatagctgttgatccagaaatcatagctcgagggactgttgggttctctggagcagagttggagaatcttgtgaaccaagctgcactaaaggcagcagttgatggaaaagaaatggttaccatgaaggaactagagttttccaaggataaaattctaatgggtatgtcttccttcctcacgacttctcttgcagttcatctttttctttgtttttactctgtcttagttttttatttttgagactgactttcattctatattccaagctgatcaactggccctcacctttcaggctggctgggaactttagctagtcatcctgcctcagctttctaaccaccatgcctccatcctccataaggagtgcgtgcgtgttctcgctctgtctctctctgttttctctctctctctctctctctctctctctctctctctctctctctctctctctctctctctctctctgtgtgtatgtgtgtgtgtgtgtgtcttcccttccacccccgtgagttgtgtgtggtttatctgttgactttcttcttaccacagagactcatggtctaacctgaaacttactattctcttgccgctggagtgataggattataggctaccatatgcagcctatactgggtatggtatagtatataatatagt

SEQ ID NO: 26374 - DNA, 1112 bp, Mus musculus
caagtggattcttaatacttctgcctgtgctgaagagagaagcttcctaaggaacaagcaagttgaatagagaaagtagtgatcaataaaaggcattttagtggtcgttttaatgttttaatgttttctgctgcgaaacatttcaagatttattgatttcctcctccccccatttttttcccaccacactcacacacgcacgctcacactttttatttgccataatgaaccgtccagcccctgtggagatctcttatgagaacatgagttttctgataactcacaaccccaccaatgcgactctcaacaagttcacataggaacttaagaagtacggagtaacaactttggttcgagtttgtgatgctacatatgataaagctccagttgaaaaagaaggaatccacgttctagattggccgtttgatgatggagctccaccctctaatcagatagtagatgattggctaaacctgttaaaaatcaaatttcgtgaagagctaggctcttgtgttgcagtgcattgtgtttcaggattgggaagggctcctgtgctagtcgcacttgcattgattgaatgcggaatgaagtacgaagatgctgttcaattcataagacaaaaaagaagaggagcattcaattccaaacagctgctttacttggagaagtaccgacctaagaagcgattacgcttcagagataccaatgggcactgctgtgttcagtagaggtacaggaaggctggctggatcgtggcattagagggaactcttggtacttggaaatgtgaagctggattcttacctgtgtcatcagagtagtaatggattcagtactcctcaactcctaatgattgagaagaaggcaaacgataaagaaatccctctattacacgaataaaatgtttaagaaaagaaaaaagaaaggaaaggggattaatttagtgaatgatgattttgcttctagttttaatttctgccaggattgaattatttcaaaatctcctgtgttttttttaaagcttttccaaaatagatgtctgaggaaaaccagcagaatattagccagtgtggagccagttgttgggagcacacacttccattatgcttggc

SEQ ID NO: 26375 - DNA, 1174 bp, Mus musculus
atagctattctagaaatcagtgttgagtatccccaaaaatcgaaaaataaataaattccattctttgatatatttacatcttactctgcagacactttctcagccatgttaattaccaccattttcataacaggctgattttttttttcagataaattgctatgcttctttctgtgtggagttacagaatatgtgttgggaacaaaaaaggagggcccggggggagtgggggaaagacccacaccccgccagagatttccctattctctggtctgtcaggcgtgggagagctgccatacactttccactcagtcctgggtgggcattcaagcctctgacccactcttcagggggtggccctacctggggaccctggagctactttgctaaagccaccaggattataggagagagggttgagggaagaggttcccaaaacctgtgagagtgcatcaagcagtggatctagatgagcagagactctctatggttttagaactttattatagaaatgcaggggaaaagagggagagagagagagagagagagagagagagagagagagagagagagagagagagagagagaagaaaaactagagagaaagagagtaagagaggagagaggagagaagacagagaggagagaggagtgagagaagtgagaaataagagaacaaaggagtgagagagacaagtaagaaagcaagcaggagctggacagccctttttatggtcttactgttgctagataactggggaggagtttagctgaaggtcagaagcttgggccattgcctatgtgacaactgaccatgcttctcttgtgggggctgtgggggccggtaacttaggcaggggccagagttccaggagcataagggaacacctacagtgtcatgaaggtgaattatcactatcctcgggtttcagacctcagctcaactggagaccagcctgtctgtgcagagcccaatgccccacaaatatgtactaaatactttagtacattaagaacatgcttttgtgtacattgtttctggagatcatacgttgtctcctgataggttctctgattcgggggtcatacaagttataaatgaaatgtgatgagcaggcaggtgtccatttttccttctttttaaatggttaccataatagtttacatttaattt

SEQ ID NO: 26376 - DNA, 1172 bp, Mus musculus
catttgacaaactccaacaccccttcataataaaagtcttggaaagatcaggaatccaaggtccatacctaaacatgataaaagcaatatacagcaaaccagtagccaacatcaaactaaatggagagaaacttgaagcaatcccattaaaatctgggactagacaaggctgcccactttcttctacctattcaatatagtactcgaagtcctagctagagctattagacaacaaaaggagatcaaggggatacaaattggaaaggaagaagtaaaaatatcactatttacagatgacatgatagtatatataagtgaccctaaaaattttaccagtgaagtcctaaacctaataaacaacttcagtgcagtaggtggatataaaattaactcaaacaaatcagtggcctttctctacacaaaggataaacaagatgagaatgaaattagggaaacaatacccttcacaatagtcacaaataatataaaataccttggtgtgactctaactaaggaagtgaaagatctgtatgataagagtttcaagtctctgaagaaagaaattgaagaagagctcagaagatggaaagatctcccatgctcatgaattggcaggattaatatagtcaaaatggctatcttgccaaaagcaacctatggattcaatgcaatccccatcaaaattcccactcaattcttcaatgtgttagaaagggcaatttgcaaattcatctggaataataaaaaacctagaagagcaaaaactattctcaacaataaaagaacctctggtggaatcaccatgcctgacctcaagctgtactatagagcaattgtaataaaaaactgcatggtacaggtacagagacaggtaggtagatcaatggaatagaattgaagacccagaaatgaatccacacatctatggtcacttgatctttgacaagggagctaaaaccatccaggggaaagaagacagcattttccacaaatggtgctggcacaactggcggttattatgtagaagaatgggaattgatccattcttatctccttgaacaaagttcaaatctacgtggatcaaagaactccacataaaaccagagacactgaaacttatagaggagaaagtgggggaaagcctcgaagatatgggcacaggggaaaaattc

SEQ ID NO: 26377 - DNA, 1220 bp, Mus musculus
actgcaaagcatttgtaaagtgtcttttcagtaaacttcatttaatcttgtttttcagccaagcaactgacataatggaaacatcggggtggaagtccatgattcagtctcatccccatttagtggcagaagcgttccgagcactagcatcttcacagtgtccacagtttggtattccacgcaaaaggttaaagcagtcttgagtcttgtgtggacagtaggaaatgcatttgcctttcctccccaggtcccgaaggattccaatacaaaccataagtaacagccgcttctgtctctcgtccacggacagaagctggaaaggcattgcttgctttcacatggataattcatggtttatacttcagctttaaatctgactgattgattcacttcaaggccttaaattgtcttcagtgacttctcttgttcatagaatagtttaattttttttattgtgccttgtcagtttgccaaggctctgcaggattgcactagctccacaatgcagtaatattgataactgataatactgagtttcaaaggatcttccattattttagaaacaaaagtattttataggttttgttctgtatgatctccaagtataaaactaggttctattggattttgagattgccacaggcatgtccaatctcagttgtgtagacactaaagagcccgttgccatccaggtaagtgatggccatacactgctctggtttaagttatttttcatttcaaggagcagataagcaatgagttgacctaaaatcttagtaatatttgtttagtaatatgtgtttgtctgtatattaactgctcaagaactggttttatgcacatttgtaaagattgaaaaataatatgaagttaagatttcaataaaaagaaagcatggtttttgttaatgttttaaatttataatgacttacatttgaaagaaaaattcaatagatgttaaagtcaggatgaccaagtacatgtaatgaatgagtgggccgattaagcaagatatatgtgcacttttaatgtggaaattttctatgataaatggtacatatatattttcctttttcgtggattaataagatttaaattatgttttaacatttaaaagaagtttttatgacacatggagccaatttggatattcatgataatagataaaattacacttgattttagattcattgacttggatttcaaatatttatcattga

SEQ ID NO: 26378 - DNA, 1093 bp, Mus musculus
atactactacatggatatttttgatttgtggtattttgaaaaatagtcttatgtaaatattaagctggtttccattttatgaaatatttctaaaattatttaaatacttcatatactttttcaaaatcttattttaatactaattcccccaactttaaatataatctcttcctggttttctcaaagattgatcaataaataaatttttttgtttgtagctaaattattcaagtttgtgggatactatatgaatcttaagactgtaataaggtggcaatgtctcgggaacctactccacctctgcctggagatatgtctactagtcctgttgcagaaagctggtgttacacacaggtacataccatttaaaatgcatttgctgcttgtcacatgcattttctaacgatgacaagtatactgtaaaattgtaaagcagtatggctttatcactctcgttagaatgaatatttgatttgtgacaagtttaagtcatgagtataaaaatggttttctcatctcgtaggttaaagtagtgaaattttcctacatgtggactattaataacttcagtttttgtagagaagaaatgggtgaagtgttaaagagttcaacgttttcttcaggcccaaatgataaaatgaaatggtaaacatattatatttttttgttaactttgtgttattgttattgttggccctaatggttattagtataattttatattaaattagtaattaattcctagaacagtggagaaatataaaaaactatggggttatttcagaagtgctgttgtgatattaatttgtaggtaatttcagttttgtctgccttttttgtttgtttgtttgtttatgccaaatactaaattactataagtgacctattgttttattttaggtgcctgagggtaaacccaaagggattagatgacgaaagtaaagactatttgtccttatatttgctcctagtcagctgcccaaaaagtgaggttcgagctaaattcaaattctctcttctcaatgataaaagggaagaaacaaaagcaatgggtaagtggttggcaaactggatgaaaacttgtcttcatact

SEQ ID NO: 26379 - DNA, 1174 bp, Mus musculus
acatgggattccctttgactcgccccagttggaactgcaacatggctaaatgtagggagagcttgaaaatctatcaccaggctccggtctccaaggtgcctcaagatgggcccactaatttggctaaggtaagaggtaatgcaggggcccgatcgaacctccctcggtgttccttgaaaggcttatggaagccttcaggcggttcactccctttgatcttcccttggaagcccagaaggcctcagtggccatggcctttcataaggcagtcagctcccgatatcagaaagaaacttcagagattaaaaggtgtattatgagagggagacagtcatttaatctagtaaaagaggcagagaaagtgtgtgtgtgtgtgagagagagaggtgggaggcagaagaaagagaaaacaggagggatcttagacaagagagaaagttgactaaaatcttgaccacagtgataggaaaaaaaaaaaaaaaagacaggatctagacaggaaacctggacaactgaagaccgagcctcagctaaagaggctcagctgtgtcagactgaagtgacttatttgggatacaccctttgaggtggaaagcagtggctaaaagaagccagaaaaagactgtaactcagatccccaccccaactacaccaaggcaagtaagagaattcttgggtactgctggcttctacagactctagatacctgggttggcgaccttagctaccctgttgtaccccctaaccaaggaaggggaggtgtttgtgtggaccccagatcaccagaaagtctctatgtaaatgagagagcaggtgtcaccagaagagtcctttctcagactttgggactttgaaaaaggccagtggcttacctatccaagaagttacatcctgttgccagtgggtggttttcttgcctaaaagctattgctgccataaaactgcttgtcaaggatgctgataagctcactctgggacagcaaataactgtaatggcatcccacactattgaaagacctatccaaaagcccctgactgatggatgatgaccaacgctcctgtgacacatcagagctttttgttgtctaaatgagtgagtgaccttcgcttcattccacccacctgctgtcccactgcgtgagactgcacctactcatcactgcgctgacattct

SEQ ID NO: 26380 - DNA, 1378 bp, Mus musculus
ggtggccttgcaagaaaatggtttttcttgctttcccatgaagttttgaatccagtatattgcttatttgagtatgcaagcaagaataactattgtttacagataaatccagcatcaactataaatcctgaccatctttcatacttctgttttattgatcgctttattgcaatggcactgttccatggaaagtttattgatactggtttctctttaccattctacaaacgtatgctaagcaaaaaacgtactattaaggatttggaatctattgatactgaattttacaactctctaatctggataagagataacaatattgaagaatgtggcttagaaatgtacttttctgtagacatggagattctgggaagttacttcacatgatttaaagttgggaggttccaatatcctggtgacagaagaaaacaaagatgaatgtattggtttaatgacagaatggcgcttttctcgaggagtacaagaacagaccaaagctttccttgatgggtgtaatgaagttgttccccttcagtggctacagtactttgatgaaaaagaattggaggttatgctgtgtggcatgcaagaggttgacttggcagactggcagagaaatactgtttatcgacattatacaagaaacagcaagcaaattatttggttttggcagtttgtgaaagagactgatagtgaagtgcgaatgccactcttgcagcttgtcactggaacctgtcgcttgcctctgggaggatttgctgagctcatgggaagtaatgggcctcaaaagttctgtattgaaaaagttggcaaagacacctggttaccaagaagccagacatgttttaatcgcttggatctcccaccatataagagttatgaacaactaaaggaaaaacttgtttttgcaacagaagagacagagggatttggacaagaatgactgacttgtcttggagaagctcttgcatttaaatacctgagccaagaacaagtgcacagatagtgtgtataagctgctcattctgtacagtgaattttatgaacctttcaaagaataaatgttttccgttcttccacagaaatatgcaaaccatttcatcattttctactttatttattgttccctttaaatgactggccaggaagaaaatcatccttaaattttgacgcaagcaagagaatttatttaaaagtatatatctatataaccatatatgacagtggctctagagcgccaggtgtattaaacatgacagctgttcattcacacacacacacacacacacacacacacacacacacacacacacaaaaggatcaaaagtaccattaggaggccatttagagtcattatgaagtggctttagaggccaag

SEQ ID NO: 26381 - DNA, 1171 bp, Mus musculus
tgctagctgcaccacgaccacccatgtaccagctccatgggtgagggttccagttgatgagttttatcatccgctctgggctgtggggtcacagccctgggaggagggccctcacatctcggcctctgtggtggaggctcctgcttccctccctccctcccttttacactggatagactaataaagccctttcttagagggacatggttctctctatcctcctgtgtactgccttcctgggttccatgccagatgttggatcctaagcaggaggtagctgagttgagatggacccagcaaatccaaatcctatgtcatggcctccagcatccagggtgggtccttgggacttttcttaggagggactttctgagcctcgtggagagtgtggtttgtccaaatgtgtggcatgggagatagggtacccctgaaagcaaggaaaggagcccagctgtggcctggtagcacctgccggcaccagtgatctcacgtctcttgtggtcttggagtcaaatagcacatgtatgtagagatgcgctcaagggcctgcctttcacctacactgtcaccataacagggaccaaatctggaggatgtccttgctgttgattctggttttcagtcacaacactttcactgtttgtcatttctatgtagttgatctagaaaaagcagaaatcaaaacaggaaaggaaatgtttgtgtaactttaaaaaaaaagtcaacatgtaggaaggtctccattttgcattgtttctgtgtcttgtatgcaatgttcctgtatgtttctaccctgcctgggatgtccccaatgaccctggctcctctgctcaaccaagtgcctgatctctggctctgagcatcgtggatgaggtacggcctcaggaagcatcgggtggattgggtgggagctgctcagagcagcacgggggcttgtgtcttagggacattgacagtgtccatcagcatgtcagagaagcagctgtagtgcccgtgtttctccctgagtcatgggttctgaagaagccagagcggcacaatgcgtgcttgcatgaggcactttcagcctttttaaatctgactctcagggatgggatgcctgccaagtagggtgtaatctctgttgtgtttttaaaacaacaacaacaaaataaaacaaaaaaaaaaaacc

SEQ ID NO: 26382 - DNA, 1127 bp, Mus musculus
agaggaaaggattcacttctggacacgaagaggatgaggaatctcccagtgcagtagatcatgcccgggactttcttagttagcgtcagcctagaaatcccctgtaatccagaagaggaggcttcctctccacagctctttcaagggctctgctggccacgctctgggttcattgaacagctccctctgggcttgcctttgtgtgcttacagctctgtccttttcaggagtgccactggggaggcctggcatgagatcatgctgtcttgtctgggcaaccgggcctgtgacccacatgccaacgccagtgagtgcgggagcgactttgcctatttttattttgtctccttcatcttcctctgttcctttctggtaagtccctttttgcccatatctgcctatcacaggtcatcttctgttggctcctgattttgacccagtccacatttatgtcagtcccatgcttaaagcctttgtccattgtctaaggcagttcagtgaaaccatgtgtctgggataatgagtaggtaacattaggatgtggtgggttcttaggcatttggaatcttgggaaccttggagcaggagcaggagcaggagcaggagcaggagcaggagcaggagcaggagcaggaggagcaggaggagcaggagcaggaggaggagcaggagcaggacaggagcaggaggaggagcaggagcaggagcaggaggaggagcaggaggagcaggagcaggaggaggagcaggagcaggaggaggagcaggaggagcaggaggaggagcaggagcaggaggaggaggaggagcaggaggagcaggagcaggaggaggagcaggagcaggagcaggaggagcagaaggaggagcaggaggaggagcaggaggagcaggaggaggagcaggaggagcaggagcaggaggaggagcaggaggagcaggaggagcaggaggagcaggagcaggaggagcaggagcaggagcaggaggagcaggagcaggagcaggacaggagcaggagcaggagcaggaggagcaggagcaggagcaggaggagcaggagcaggagcaggaggagcaggagcaggaggagcaggagcaggaggagcaggaacaggagcaggagg

SEQ ID NO: 26383 - DNA, 1184 bp, Mus musculus
cggaccatcaggtacatgtccacctaccctctacttgttttccagggcaaggctgcagctttatcggacacaggacatgggctggggtgtgcggtccctccaggatatcccactgggcacctttgtctgcgagtaagtgggtccctggagtcccacagctctgtttattgtgtttttgtttgttagtttgttttgtttttcatttctggaacttctcatacacgttcatgctctaaggcccttgggagcatgcttcactgtcatgcagacgtgaggataagcagtggggacgctgattacaccagccaggctcccgttactagccctagggttgtgctcagagtttctacctcagtcatttactaaaggtgctagctttagagttctactactagcatcttggtaagccatccctggtcctcaccttgcactgcaaatacacggggccagatccagatcccagcccatagaacttttccagagtgttctgtgtctgtaaccttccatggcattgtttcttgtctgagggcacagaggtgagatgggtcttcccttttcttactacagatacgtaggggagctgatttcggactctgaagctgatgttcgggaagaggactcttacctctttgatcttgacaataaggtaatgtgttgtgaagggccaacacatatgaacaagtgattgcaaaatgtaaaacttgggcagtttgttttagagtattctggaaagtaactggcacaggcagtctagctctggagtcactggtgcatatgggtgtatgctccttacacatttgtcaggttttatcatacagttctaggctcattttggtgttcaaggcacaggcccctaacttgagatatttctgttgttgtagcaagccacgtacctcaagggaatacctgggatacctcattatgccccccagttcccaggctggtcccctaagaccaagcaatagggagcagctcatggagtcacataggaagcagcataggatccagaaatgtgggcgatgagggaggcttttctgtttccattgacatcaggatactaatgtcctatgtagggagagaatagaggaccaaactcggtctgctccaggatttagggtttcctatggcttctgtgccaggcaaaaggtggctaagaccaccctagtctgtcactgtttctgaat

SEQ ID NO: 26384 - DNA, 1166 bp, Mus musculus
tttattgaaaaagttacaaattattctaaaagttgtatcacttgaagctttttttgtttgtttgttttattctggaaaataatattttgcaaaaccggctaaattgatgcactgtcctctgccctcccaaatacttttccctcccgtgagttgaggctctctactccctttcttagacatatctctatcctgctgtgcctatgtgtcagttaatttagaaaggatatctagcaaagatactctgcttgagctagaccttgatagaataattgtgcctgtcggtgtgtgggactgtgtgtgggctgttaaatatcttgcacgtgttgggctagactttgaatccagggccttgttggtgcagtgcctaccactgaatagctccagctttagttactatgtcttgaatgcagttttgaagaatcagacagctggtcagtaaaacagttttagtgctgtttgttaaatctcttcatgacaaatgcagagcctcacaactctttcacttcctgggaaactgactcagcccatctaagtcatctctgttttgctaggcgggtgccaatattgacacttgctcagaggaccagcggaccccactgatggaggctgcagagaacaaccacttggatgcagtgaagtacctcatcaaggctggagcacaggtggatccgaaggtacccacccagtcaggttcatattcctatttcatgtgtagatgtttcttagatgaagagggagcagtttctccttggaacactgcaggaacttgttgccagcaagacatttgccctgttgtttagcagagcctttgtacttgatatagtagttccttttctgtcagtaaagatctagtttggctcatgatttcacagaggttctgctccatcaaagtgtaaaaggcctggcagaattgcagcaggaacttgctgactagagcaggagaggatgtgagctgggctcaggagcaggtataactgcccaggcttctctctgatgacctgctctgctagccaggctttacctatgaaaatttcacaaattttaagctgagaataagactctggggacatttcaaatgcaaactataaatatgtggcgacttggcttgctagtaaagatctcctggtaaccactggatctacatctgtccagtaatagacaaatcg

SEQ ID NO: 26385 - DNA, 1201 bp, Mus musculus
ttgtccccctttgactttttttttttagcttgcttgccttttgttttagcagctgcagtatctcggaagaaaaaacgaagaatgggaacctatagtttagttcccaagaaaaagaccaaagtattaaaacagaggacggtgattgagatgtttaaaagcataacccattccactgtgggcgccaaggtaagagggatgcagggattgtttgccatatattgttggaaatgtattcctggttccaaagttcctggccaagagaacattctgttgaggtcattactaatttaatgaccttaatcactataaaaggaactggagttcttgagctcttgtgctctagcatagcctcgtgtgggtgcattgctgaccccgaacacatactccagggatccttcctgccggcttcttcggctggtagttgccaatgcaccccagtactggcagacctttccatctcctgtcacacgagttcgtagtgagtcagtcaaggttttatgtgctggacagcagtactcctgagaagtgtgaactgctgtgttccagggcgagaaagccttagatgatagtgccctgcatgtaaatggcgagagcttggagatggactcagaagatgaagactccgatgagctggaggatgacgaggaccatggagctgagcaagcggctgcatttcccaccgaggatagtaggacttctaaagagagcatgtctgagactgaccgggctgcaaaggtagaaatccactcccccaggtggtggcactagtgagcaaaaccacgaagtccactgtagcttctaagattctgggcactcttatgtgctgctgatttttttttttctttttatttaacatttataaaaaaattaagtagctgggcatggtggcttaggaggtagaggcaggcagagccctgagttcaaggctagcctggtctatatagtgagtttcatgcctgccagaactacatagtaataccccatctccaaaacatgaaaatgaagaaaacaattaaatatctgtcagccggcagaagaaccaagaaacaaaaggtagatcaaaagcaaatgtaattagtggaaaacagaataaaatggctagagttaaatctcattgagtcagtagtggttttgttatgtaaactatttttgaagactacagatagaaaaagcactgttgtgcattctgagacaacattcc

SEQ ID NO: 26386 - DNA, 1296 bp, Mus musculus
ctcagaaagatttgcttgcccctgcctccctagtgcaggagttaaaggtgtgtgccgtcactgcctggtgaattttagtgggcttcttatctaagtgtctccaagtcactattcagtagtgaagactatgtattattttatcacctaccccttagaaaaacttacaaaaataaggaattagctttgagagtcgctaccttccttcttgtctcctcagttggtatctaggatggaatggtactcttgtggcaaagaggaattattaaatgacctgtttattagagatgcatttaaactgtgaaatcagctgtctcatacctgatccagcagaggatggtaggactgagtgttctattcctatggttcacgagttaggttctttgtaaatggctgtacttctcagatttgtggactttctgccttcctcaataatggcctttcagtaaatgggaagtttttaaacagggattgatttttggatgcgctttattccattcaccatctacttctgcagtcatcataattacttgtctttgtttgaagcatgcagccagcaaagaccatagagaagttcaagaccataaggaaccaaaagaggatatcaacagaaacatttctgaatgtggacgacagcagcttttaccaaccttcccagccctccaccagtcgctacctcagaatcagtgctacatggccaccacaaagtcccagacaggtaaatctggtcaaccatcgccacccactcctgctgcccatgtgtgtgtcttgttgctctccaggtagtcagtgctggctatttttggagataaggtgatagccttgcatggctaagaggccctctgcccttaagactttatggcactgattttgttctcctgacttgctttcaatctcaagatgtatattatgtttcttactgaaatcttacgagatacgagtggaagacagtgaatctcagtgaggtgctggtggaggtactaaggtgctagaacaaggtgcagatagctgtccttgggctctagagttcattactaactatttaactgaacttcgttcattctgggcttactacaggttttttttcaatgggagtagtggactagtgcttgattattattgggacggtcaggctttcgttatatttacttttattttatttcatttctgatttattattggtattgttttattttatcttatattttccagacagagtttttctttgtagccctaagtgtcctggcattagctctgtagaccaggtagacttccaattcagagatctgccttcctctg

SEQ ID NO: 26387 - DNA, 1185 bp, Mus musculus
aaaagagggcgggcacttggtaattctagtactcaggagatagaggtgggtggatgtgaattctaggacagctggggatacatagttttttgccacaaaaaaacccacccaaacaaaacaaaaacaaacgagaaagaggataatgaagggtgaatatattcagaatacattgtatacaagtataaaagtatcataatgcatcctgttattatatataattaaaatacaataatagtaaaagaaaaaattccaagactattaaaaagttgtacattaagatatgatagtaggaaaaacccaagaaagggttttgaaataggaaactttgaaaataatattaacgtatatatgtgcattttccagtcttctcatttaaaaagtttcaaaattatattttatttgtttattcattttttgtacatgaatgtgtatgcgagtacacagtgcatgtttaccatagtcacatgggcagcttgcaagacttggctctatcctttcacagtgtgggtcttggggattgaatttaggtcatcagtgttgatagcaagctttattgttggagctacctgggttctggtgtccttgccagcatttgtgctgctgctgctggtggtgtctgtgtcagtgccttgccaggattgtaacttgaacttccttgaactttcaaatgtgctgctcttctcggtgctcatttgccaactttgttgttgttcatggataaataaccttttacatttttattataaagtattttattagcttttaagattaatcttgcttcccttccctcccttttacacatgcacttctggttttcaactcacagaggtaaataaattctcagctccatgattcctgggtaagggttctctgccaatgaggcgtcttgtcagttatgaggcactggtcccatgtctgtctgttcatgtcccctgtcctgctctcctccattccttcttaggtgtccaggtcttgtcttgaatttgctaggcagaccttggctggcttgcttcaaacagcgatcttttgccttctgtcttctgagttagtgtgtccagtcttgggcagttagagttgtgaccacttatgtttgtctgtagataatttttcctatttctgtgttaggtatccacgagtataattgccatggtgtgcagcagctcttttctctatctcctcctgctt

SEQ ID NO: 26388 - DNA, 1152 bp, Mus musculus
cttccccttacagctatccgggtgacctgcatgggttcctgtggggtctccaccaaggccaacgatggggcatgggtggtggaggagagctacttcaacagctccctgtcactggctgacaagggtgagtgtgagagccagcagtgatcacaggggcagcccttgactggagggggtcagcctgtcctttcccctccctgcaaccgtctcttggattcccactttctgggtctgggtggactctgatgcttagttatgactgtcatccctgttttttattttattttaaaatttgtatttattcacttttgagacaaggtttcatgcagccaggctggccttgaacttgctatttaacagaggatgcccttaaagttctgatttcctccttccacctcccaggggtgtgctaccatatgtggtttgcatagtccttggaattgaactaaatctttgtgtgtgctaagcaaacactctactaactacatttccagccccacactttcgtttaaaacaagcccttgtacgtagcctgtagctcctgctatggtcatgctgctatagtgctggagacaggtagtgtggactggtgggctgcactgtttacttctggtctggcactgtggccgctatggatttcctctggtttgctcccacctcctttttgtctctgtaggaagtctgccggctggagagcacaacttcccttttcagttcctgcttcctggtgagtggaaagcttgtggggacagcagccttgaaatggtgagacccacggtgggaggtgctgggtgacagccaagccctattatctctgtagccacagcacccacatcttttgagggaccctttgggaagattgtacaccaggtgagggcgtccatcgacactccacgtttttccaaggatcacaaatgtagcctcgtgttctacatcctgagccccttgaacctgaacagcatcccagatattgaggtaaggatggaacagagaggcttcctcggttgccttcaaccttcttggaccaggcaaccaagccctgtcttaagctgcttgctgctgtctagagcagcctgagtcttgtctgtgctcgtttgataaactctttccccttttctcttcaagcaacccaatgtggcctccactaccaag

SEQ ID NO: 26389 - DNA, 2146 bp, Mus musculus
gtgcaaaggaggctctgttctctctggtaataggtgttctggagtgttccagtaggttggctacttgtcttagtttctattgctgtgataaagcatgagcaaaagcaacttgggaaggagggattatttcagcttactgtttcacatcgcagtcctctgaaggaagtcaggactagagctgatgcagaggccatggaggactgcttactgtttgctcttcatatcttgctcagcctaacttcttgtagtgcccaggattgccagcccaggggtagcattgcccaaagtgagctaggctctcccaaatcaatacttatgaaaaatcaggacagagtagtagggccattttcataattgtcctctcaaaatgacttgtttgtattaagttcacataaaactagccagcaaagtactatatatccctatgttggtaaatttcaagcacacgttcaagcacagagacccttggagccagtagtaagctgctgcccctgtcccaattgtgggttggaatagatagtgtgatagacagccaaaatgaggcttcattcactgctgagctgtggttctcaggataactgttctttgggggattcacatgtctgagggctgtttttcatttggcatcttgatcactgcagaagtgaattcaccatggctggaatcttacctatctcagggtatggcctctcttgttcaagctttctacctgactgctgacctcggcagctctctggcctggttggtctgcaggtgcctgttaaacctttccctattgcagcatatctatcacagtcttgattttctgtgagttaaacgctgtctggctcagcacagccctttggtagccttagacttgtaagttcagcttctatggctgtttttgcatttatgctacacagtggcttagaagggaagacagctgaaactcaagatggcaccattccttgagtgtttaagcttggagtgttgctatgatagacctgcatcaagaaacttcctcctttcagttctgaaggttatggctttttagttgggatccctactcagaccccatgttgaacatcaatctgatcattgggaaggggagagatatgtatatattgtaaagtattgctacaggcagcagctgactcatgccttcaatgtctccacttggataaactacttttaagaggccagaacggttgttgtaaagggtcaagtttcttgggatgaaccatttagactacaaacttgtagtgatacttgcttgtatctgaatgaccagtgtagcacttgatcctgtcgtcccctcaccagcagagggtgctttactgccagctctgcatcagaaaattccacctagagactgaccgcacagggatggacagctgacctccaggcattgctggtaaaggttctggtataccctgggcttgcctgtgggttttccccatcaaatctgcacatgctagcacagctgctgctgtgcagtgagatgggctccatcaggccaatctgttgatgcttactccccatatctgttaccatcccattctcccttctgattatccctgcctcttgttctttgtagctgttctatgaatgttctggtggttcaacgatgggacccttagtcttaaaatagtatgttgggctacttggccttggaacaagctactgctggagggattggggttttttcagaattccttaggtgccaccgctgcttcagctgccaactggcctgcaagctaggctatatagccatattcctgcttcagttccagggctggatacccaggtgtcctatgaatttgcttcctggagctgctgtaacgaagtgccaaaaactggatggactaaaacgaaattgttgtctgttgggtctgtctcatggtttaatcaagacatttgctaccgcggccactgcaagtgctgggcaaaagggtgctgcaggtctgtcttgtagcattctggactcacttatgcattcagtgtcttagacttcaaaggtacacattaagtcctctgcatgtttccaaaatttcctttacatgaaggctatattggatcagagcttacctggagcagtattttgcctcagcaaagaccacacatctagggctggagagatggctcagcagttatgagcactgactgc

SEQ ID NO: 26390 - DNA, 1140 bp, Mus musculus
ctacccacttagttgtggccttttatctttgtttttgccagaggacctgacccagagttgcagctgatagcaccatcactaagtggttttgggtgggggtgggggttctagtcctcatgtgtatcctgaactccactgtcaggctgcttctgtgtgacaggtgactgttaccagggtctgctcttctttacctgataggcatctagattttcctccctaggacatgcctttgaagcagagtccctcaccagaatagtcctcccccggccgcaactgcgatggcaaaagtgcacagggcacaggcaagcttctgtaggaccaaaccccaaccttgcctggctaaaactcagcacctagtagtatgggccagtgcctcagcctcggtgcccttgagtccagtggacatcccgatgggaggaaactacctccaggggatctggggggctaaaggaagacagagatccacactcacggtgtcctctttctcttgctgcctcttgacactgtggcttcagcatctcgtaagtatgccatgccgtgtgcacttaggggcacaaccattgtcctgggggccctcccacccttggacagaattctgcaggtcagggatcctgggcctgggcagtgagtagtgctaagctcccattagtccagactcctgtggacaactaggctgcagcaggacctgctgggagctgggcctgggatgcccctctgggcccccgtgcttgtgcctctgtctccacgtctgtgtccctcctgccttcagccaagggcagtgctgacttgcggcggtttctcagggtattcaggggctacgcggagaggaagcgtcggaaacgggagaatgattccgcgtctgtaatccagaggtagggcctgccagccactcgccaccagggtctatctctagtctgcactggcctggccagggccctcctggccctggaagacctgatgggggaagggtggtggcgaccactggtctggccctgctctggggacgtggcagacaggaggccatgtggccaggctgcatttcagcccctggacctatactttgagggtacattgataatcatactgaagctagctggcccatccaagtctgtgtagccctgaagcccagagctgttcatc

SEQ ID NO: 26391 - DNA, 1500 bp, Mus musculus
aggaaggagaatgtgcaccgtcatgtgctgaggcttctcctccacttgcatgcaagagtggccccttccaagctggaggcattgcagaaggctctggagcccacaggccaggtgggtatcatcagttcctacttagagggcattgttctgtgaatgtgcttggccagtccagctgtggcatgatgcccttggcgcttgctttgatggtgtttttcatgattggtcttgcctctgggttcactcctccatgtaggctcagacagaccccctgtctatggcatgccatgtctggttttcctacagagcggggaggccgtgaaggagctctactcccagcttggtgagaagttggagcagttagaccatcgaaagcccagtcctacccaagctgcagagacaccagcactggatctgcctcttcccagcgtgcctgctccagccacactgtgaggctgtggagaactgaaactgtttgacagtggtgccctatggaagggcacctagttggctaggggtgtaggctgagctgagaggggtgttctttggcaaggttctccctcctctagtttctcccaggagctggtcccaaaaggtcctccctcagtggtctacttgcatatcatagggggcccttgatgtcatggtgggacttggcccctgcttgaccctggcagaggtggatggtgattgggatataggaaaagcagtgggcagaggcctgactgacctgatattcaatctgcacaaagtccaaggtatgctaggttcaccaaagtagatttgctggacctgatccccaagcacaggagtggtaccctccacagaagctgggggagagtctgcagcaggcctgagcctgctgatgtcagtgctgactgagtccatgctaactgagatctgtaggcagagctctgccctgtagctccctgcctcagtttatctttgcaatacaaagcaaatccttccccagctatgtgttttagcctttgagtaggggagtttcggtgtacacattgaattttccacttatgtaaataaaacggattttgataaatccatggtgaggaatctgtttgtcctgggactgggttcagtggtggatgccatgaccaccttcaccacctcttccttctcttcctcctcttcctcctcctcttcgtttctttcttccttttttttttttttttttttttttttaatgttaggtctcactacctgtctccgactgtcctggaactcattgtataggctaggctatcctcgaacttggagagatcctgcctttgcctcccacatgctgggactagtgtgtgccaccacgcctggagggtgtaacattctggagagtcagtgctttggcctctgtgctgagtaacctggtgtagggcctagctggaagatctcagggcctctcagagtgctttgatctctgtgtacagtctttcaaaatgagggatagggattgctatgaggaccaaggataagccctaagtcagagtg

SEQ ID NO: 26392 - DNA, 2031 bp, Mus musculus
agagtatgagaagacctgacctagtggcaggggccctgtactctccttgaacattggcaggggtgcctttggaagtatttactgtcttagctctagtgtgttctgtacatctccgtctggtctcccccaccccccatccccaatctatgtatccctgcctggcctctttaactgtagaccaggctgaccttaaactcagaactacctgcctaccaagtgctgggattaaaagcttgtgccattatgcacagcaccccctctccccttttttttaacatggcagattgttttgggtctgtacactttattcagtgtcacctcatgtcatttggccccttgggcacatacttagtgtgacctactgttttctcttacaggtcagagtggggctgggaacaactgggccaaggggcactacacagaaggtgcagagctggttgactcggtgttggacgttgtgagaaaggaagctgagagctgtgactgcctgcagggcttccagctgacccactccctgggtggggggactgggtctgggatgggtaccctccttatcagcaagatccgggaggagtacccagacagaatcatgaacaccttcagtgtggtaccttcccccaaggtgtcggacacagtggttgagccctacaatgccaccctttcagtccaccagctggttgaaaacacagatgagacctattgtattgataatgaagcactttatgacatctgcttcagaaccctaaagctgaccacacccacttacggtgacctgaaccatctagtgtccgccaccatgagtggggtaaccacttgcctgcgattccctggccagctaaatgctgacctgcggaaactggctgtaaatatggtgcccttccctcgcctgcacttcttcatgcctggctttgcccccttgaccagccggggcagccagcagtaccgtgccctgacagttcctgagctcacccagcagatgtttgatgccaagaacatgatggctgcctgtgatccaagacatgggcgctacttgactgtggctgccgtgttcaggggccgcatgtctatgaaggaggtggacgaacagatgcttaatgtccaaaacaagaacagcagctactttgttgagtggatccccaacaatgtgaagacagctgtctgtgacattccacctcggggcctgaaaatgtcggccaccttcattggcaacagcaccgctattcaggagctgttcaaacgcatctcagagcagttcacagccatgttccgacgcaaggccttcctacactggtacacgggtgaaggcatggatgagatggagttcactgaggctgagagcaacatgaacgacctggtgtccgagtaccagcagtaccaggacgctacagctgaggaagagggagagtttgaggaggaggctgaggaggaggtggcttagagctgtcttagtcactaaagcatgggagcagtgtgaactctttattcattcacagcctgtctgctagccatgtccactgtgcatttgctgtcctgtgtcctgacatcacttgtacagataccaccattaaagcaattcatagtgtgtggcttcgcctgtccaattccttctgataggctcttcgggtgctgttaccgaatgtcagtgcatagttgtcctgcatggctgcaaggaagaaaggcttaagctgagtacctgcggtgagcacactagagaggtcagagcagcttctctacaatctagcatggaggtagctttgatggcctaacaggaatgactagtgaaccccataatgactgggtgattaatccaggttcaaactgggactggccagtgggctgacaactggttataggcaagtgtggaggataaagcagggtcatttgacccagtcacaggtttggtgtgtcatataaacttgtcctttggaaggaagtgtgggcttctggtagggagcaatactcacatgggataaagcccatgtagaaaggaatcaggccttggcttctatagatggtggtgtttggccagtg

SEQ ID NO: 26393 - DNA, 1205 bp, Mus musculus
ccgcccctctgctcacggttttccgtgctccaggcgtcttcccggaccagcggtgcagtcccaccaaaggaggaagagcttcgtgcagcggtggaggttctgaggggacacggtctgcactctgtcctggaggagtggttcgtggaagtgctgcagaacgaccttcaaggcaatattgccacggagttctggaatgccatcgctctgcgagaaaactctgtcgatgagccccagtgccttgggctgctcctggatgcgttcggtctgctggaaagccgcttggatccctatctgcatagcctagaactcctagagaaatggactcgtctgggcttgctgatgggcgctggagctcaggggcttcgggagaaagttcacactatgttgcggggagtcctgtttttttccacccctaggacattccaggagatggtccagcgcctctatggtcgtttcttgagagtctatatgcagagcaagagaaaaggagaagggggcacagacccggaactagagggtgagctagatagccggtatgcccgccgcaggtactaccgacttttgcagagtcctctgtgcgcaggatgtggcagtgacaagcagcagtgctggtgccggcaggcactggagcagttcaaccagctgagccaggtcctgtgagtactgcttcctaaccatgctgcggtttctctgcaagcttcattagtcctgaattcaaaagacctctcaatagagcttatagactaactggcgatgtcttttttgcccatacttgtaaccagggattattgttcatcacgtttatactgtcctggacataggcatagggtgtgtgtgcagtatctttatggggagagccctcctaggtaagggacagatgtgtgttgtgggttctccatgagcggggatcttttctaggcataggctcagtctgctggagcgggtttgtgctgaggccgtgacaaccaccctgcatcaggtgacccgggaaaggatggaagaccgctgccgaggagagtatgagcgctcttttttgcgtgagtttcacaaggtgagaatcacctctctggtctgtttcttgttaaaggcaaaagtggagttgtggtagacctgataccaaacagtaggcaagttgaccaggagtggtgatggttgaggttatcctggtgctgtctatagaagccagtcctggatcctgatgacaa

SEQ ID NO: 26394 - DNA, 1920 bp, Mus musculus
cccaagtgctgggatcaaaggcgtgagccaccactgcctgacttgccctgttgtttttctgtcattctaaataccctgctcctaccagatgatttcctctccaggcaggccttgtcctaggcatagtgtgggtttggagggttgatctagctgactgctttctcctctccccctcaagctggcggggagccgtgattgagcctgaacaggccactgaacttccttacaaaagagctgaagcctccatcaaacctctggttttggcatccaagatatggaaagagccaggtgagttttcctgcccccttacctcaccagaacctgtgcctaagagcctgggggttggcactctgcatccaggtcatgacctcctgcccgatccctctgcagctcacccttcagcatctatattctgtccacatacctcttacagcatcatgaatatcagagcactgagcagcagagaggatgctctgttagagaatggcttttgccattctgctcctggtccaggttgtgcctaagcatgagaatatgcacaaaattaaaggtatacacttcaataataaagattcaatccggggctggtgagatggctcagtgggtaagagcacccgactgctcttccgaaggtcaggagttcaaatcccagcaaccacatggtggctcacaaccatccgtaacaagatctgactccctcttctggagtgtctgaagacagctacagtgtacttacatataataaataattaaatcttaaaaaaaaaaacaaaaaaaaaaaaaaagaaaagattcaatccaagtattttttttaatcattctttttgggtctttcctttcctttcctttcctttcctttcctttcctttcctttcctttcctttcctttccttttctttctgacagggtccttttttttttctttgtagccctggctgtcttacaacttgatctgttgtagaccaggctggcctctgtagaggcagatctgcgtgcctctgcctttcaagtgctgggattaaaggtgtgcaccaccactgccagcatcaattttaaaaagtcttgttaatggacagaagagacacaatgtcccttgatgtgtcagcttatttctagacctcacaggtctctgggccatgtagcactgtttactgagatgtgcttgatcctggccttgcattctgtgtgcccattcccattctctgtgtgcttggcctgcttcttttattatataatctttgaggtaagagatgtctgcacattgaaccttagaacctactgggaagaggtgtatgctgtgacaccccacagattgctatgtgctgcctagtttaggagaagaaagcacttatgaggcactctcaaggaggccacataagtgcagatgttgttcccgtgggactctggaagctcatttggttggagaacatgtacacttagggtgtatctaccacagtctgcccagtcactggtccctgcttatccctaagtttacattagacattggtggccaggtcccacattgtctgcagtgtagtggcgggccataggaatgctgccctcttccccttgaggtcctagtactgttgagtgtggcctcctggtgacatgcctccttgtcactgtatcactgagggtctaacctgtgctttggcctcctgccttccccgcttcactataactcctgcttctggccagagtcagtcttgctacattaactgaagcctggcctttgagagccttgcctgccccaacagtgggactgttcttgccactcatattttctcttctctagcccccccgaatgagcgccagaagggagtgattgaggcctttctccatgcttggaagggttaccaaaagtttgcttggggccatgatgaactaaaacctgtgtccaaaaccttcagtgagtggttt

SEQ ID NO: 26395 - DNA, 1982 bp, Mus musculus
cgtaggaggagagcacctggtctgggcactgatggagactgaggtgggcctgttgggtccctgaccttcacaaggcccacatagttttgggcagctgtcaagtgtgatgtacctgcccagttgtaggtccctccagtttcaacttttcatgaaggtggtgggaggggcaggagtcagactagcaggtatgggttctggggtttaggctggaaagtctaccaagcctttgacttcctcgaaacctcatatcatggctcctgattcccatacctgaatgaccctgttggctggctaccggcagccccatggtagtcccaagacttcttatcacctcctgggaccacccaggaccccagtgcctgtattgagttcagagtgatagcccaaaccagtgaggtgctgggcatggcccaatggcctgtgatagccctgactcctgattgacccatgggtccactgggccagtgtgaccttgagggtctttgtggctctagtgtttacgggttggactcagggatcctcctggctaccctactgggctggcgggggttagaacagtaaatttgtcttattcccaggataccctggtataatgtgatctctcagctgagaagaaagtggacttggtcccactgtaatggttcttgtggagaggagggaaggggtggtgtctatctagactgaccttaaggggacagcaggttctctggataacatctcagcaactaccctctaaagtcagagctcctgtccacttcaggtaggaaggctttggggccattatacaaacaggctaggatgcttggttgtgccgtctcacaagggcctgtgaagatcacatgctgctgccggctgataggtttgtggtagttgtgccttggtgtctgagcccatggagtaggccctgtctttgatgagttgttactagactatccctgggccttggctaggattctcctatccaattccatgcagtacagcatagggcaaactggacagaatagaaaggacctcaaggctctgggcctgtgttccctgtatatcccaagatctggagatttgacatgctaactaactcatctgcagctcagtggcagccaccttgtgcctctgaggtatagtagctacgctggggacttcctgttaaacacgtggaccccaagccagttctaacaccaaaggtgtttacaaagaaggacttggctggtcacatatccttaggccttgagtttatgggtagaagctgccgccctccacccccccccccccccatcagttataaccctttggttgatgttagcttctccctatgctgtcctcctctaccggagccccataggcttgtgaatggacaggttcaggcggcgcccagggcctaagcattgagaagtgtattctccatctcctgccaaactatggctggtgtcaagggatgacagtaactgccctgtggccctctgaagaggtactgtggatcagagaaactgggtagatgtccacaaagctgggagcctcattaaagcatacaagatgggaatgggcctggaaggggaggctggtgcccagtagaggcaggtttccctcctcctccaaagcaggaaacctgagagctagagtccctgcttaattaaatgtctaaatggtctcagcaagctgtgtgcagtgttactttgtgtagagcatatctccaattatctcatccttccatgcatggatcctactagacaaggacacattaacatgtgtttattcagtttcttccatctaccataaatctggacagtccatcagatacaaggcaagttgtcacaccactgtagatcacataaaacaagggatgtctggggtttgctgcatcttatctggaagggtgctgcttcttaggcccaggccaccgtggcattgctggttgctttagtctggctgctgctacccactcacgaatgagggtagattccagcttacgcacctccacgacagat

SEQ ID NO: 26396 - DNA, 1188 bp, Mus musculus
agccgcactgctagcggagctcgcctcattggaggccgacgcgctgcgtgagcactgccagcgcgccgcagctgcgggcgcgctagctccgggtcctctgccggacctggctgcgcgcctgcagcccctgcccccagaacgcgtgggcagcgcgatccgctgtgaccaagagacacgcctgcggtgggaagaggaaggtaggcagcgccgtgccaggctggggttgggcaggtccggcccgttgaggccggaagagttagagcctatgggcggtgggggtagtgggggcggagtggaggacacggactcgggaagtgcagcggagagttatttgccttgcaacttcttcctcctgtgcctagtaacccccgaagtcgtgctcacttgtggttctccaaagtgaaagaggccttatctcacgatgcacctctcctccaggtttccgacagatttctctgaacaaggtagctgtcctgctgctggcgggtgggcagggcactcgcctgggcgtcacatacccaaagggcatgtatcaagttgggctgcccagccagaagaccctgtatcaactgcaagcagagcggatccggcgtgtccaacagttggctgaccagcgacaggggacccactgcactgtgccctggtgtgtcctccatgccagcctcccaaaaagaccacccctaaattgacccaggcctaccccacaccaagaccttagacccaatcttagcacggccctagacagagcccagtacttgccattactgaaccccttctagacttgccagattgagctggactcccctggaagcagctcactgctaggacatttacaggtacatcatgaccagtgagtttaccctgggacccacaatcaagttcttcaaggagcatgacttcttccacctggaccccactaacgtagtgctgttcgagcagcgcatgctacctgctgtgacctttgagggcaaggccatcctggaacggaaagacaaagttgccatggccccaggtatggcccacaccttggataggaacaggttgccccacctgggccacagagtacagctgtggatcaggaggcctgactcccaggtaagatgtactcaggcaggctatgtggccctgggcatgtggctctggccagtctggagtcacaggctcttggtttgtgcacctgcagcactt

SEQ ID NO: 26397 - DNA, 2102 bp, Mus musculus
ttaagggaagacagacaaagtcaggcacagggagaagaggctccttagagatgcctggagacagagtgtgggaccctgctctgcctaccaggtaggctcacctctgcaggccagcttagtgcacaaagagtataattactttaagctagagtgctgagtctgttcagtcactccgctgccctgggaagcctcagtagaggggctgagaggccagtctccagtatcaccatcatccaaagaggagaaactaggctatgttctccaaggcatacgttggaaccttccctggataagctggtgctttccgtcgtgggtgcattggcagactacacaggtgctgatgtcattcattgtgtctgtgtgctagactgcctgtggacaggtctcagctcccacacctgcagctcctggagcacaaaggtatgtgcaggtgtgcatagagccagtctgcttgctgtcatgagtacatttccatgctcacgtgtgtgttatagttgaagcagatgaaggagttagaccaggaacaggaggtgcttctgcagggcctggagatgatggcacggggccgagactggtaccagcagcagctgcagcgtgtgcaggaacgtcagcgccgcctgagccagagcagagctgctgcagtaagtgccaggccagccctgacaacaggacccaagttgccctggggtggggctcccttgaggctctgagctgagacttgagatgaacaggtgtgccaggttccgggacttcctcatggtcccgcttcttttccaggactttggggctgaaggaagcccccgccctctggggaggttgctgcccaaagtacaggaggtggcccggtgcctgggggagctgttgactgcagcctgctctggcagagtgagtgctctggaggctgcctggcatcccttgtccttgttctggatgctatgccaggaaaggtctggctcactgtgtacttccacaggctctgccttcgtcctctttagggcccctgggccctccctcaccctcaactccagtctggcagcaacagaccatcctcatgctgaaagaacagaaccggcttctcactcaggtgaggtgtgggaagatggggctggggctggaggcccagcaaaccctgaccgcctgcctgcctgctcgcctgcccaggaggtgactgataagagtgagcgcatcacgcagctggagcaggagaagtctgcactcatcaagcagctgtttgaggcccgagcgctcagccagcaggattcgggacctctggactccactttcatctagttggttgtacctctctaggacaagtgcacacagacttagcttcagctccatgacactgccgggagcctgtcttctgactgaagaccaccagggcttagacctcagagccctcaaggaggcagctgcctccagacttgggtgctgctagaaatgtactctgccggaagctgccacttgccactgtcagtgggtggcggaggatcatcctcacgtttacctgatttcaggcagcccctacagagaagggggcatgtttacgtctgtcctgatccacctggcagggtttcctgggatcactggcttagtaaaaagtactggtcacactgggctgtatttctcataatgcccagcaggggctgctagttgagcttagttcctctgccctgtcttaccttggtattactgagtgagtgagcagatagatttttgagctgagggtgggctaggaggcccaggaactaggaggttagaggttccttctgtccaccagaggcactatggaaaggtggttgtggctcagataggagcagaagggagacatggaatgggaggaggatggggctatctaatagagggctctgtgcctgttggaagagccacaaagtcaggggttgtgtgtaacaggctgagaaggaaaatctggctgcagctggaccaggctagtgtggttcctagaaggaagccaataacttggcttacccaccttaccaaaactaactgtctttaaactgttaactaactggggaaagatggcatcaagttagctcaggttgtggccatccccctaaggaggtcctatccccccaaataga

SEQ ID NO: 26398 - DNA, 1181 bp, Mus musculus
cttctggtttgaggtccctagctcagcctacgtgttcctcatcgtcatcaacctcttcatcggcatcacagccacggtggccactttccttctgcagctttttgagcatgacaaggtaaaggtgggggtgaatgggcagcaaggcgtggcttggggcagcaatgctgagctatggctgccccccaggatctgaaggtgggggtgagtgggcagcagggcgtggcttggggcagcaatgctgagctatggctgtccccaggatctgaaggttgtcaacagttacctgaaaagctgcttcctcatcttccccaactacaacctgggccacgggctcatggagatggcctacaatgagtacatcaacgaatactacgccaagattggtgagtctggctctgggtggacagtacgggccttcagggggccacagagtggcgtgcctagtccttgactcttaagttccaagaacaacggggacccttaaggctctcagaaccctgaaccagcggttccacaggccagtttgacaagatgaagtccccgttcgagtgggacattgtcacacgtggactggtggccatgacagtcgagggcttcgtgggattcttcctcaccatcatgtgccagtataacttcctacggcagccacagtgagtggagtgtgttgggtgatgctgcggacccttggtggggtgtgtgtgtgtgtgtgtgtgtgtgtggcttggccaagccctgacaactttgctgccctagacgcctgcctgtgtctactaaacctgtggaagacgatgtggatgtggctagtgagcgacagagagtgctccgtggcgatgctgacaatgacatggtcaagattgagaacctgaccaaggtgggctctgagctgtgggaaagtaggtggggagtggggcggggagtgggtcccagcagtgggatgaagtcaagccagacaggaacccccccccctttgctgagagggaaggctctttggtcaggtgtacaagtctcggaagattggccggatcctggcagtggaccgcctttgcctgggtgtgcgccctggagagtgctttgggctccttggtgtcaatggtgcagggaagaccagcaccttcaagatgctgactggagatgagagcacaactgggggagaggcctttgtcaatggacacaggtggggt

SEQ ID NO: 26399 - DNA, 1263 bp, Mus musculus
tgcaagctttgaagaccccagatcagtggtggggattacaagaaaccaaagactagggggagtgactaccaagctggccaagaggaacagacaccaacgagtacttagtggggggaggatgctcaggggagtgccagtgcccagcgagaagtcaggtagagcgtgaatatcctcagctcccacttgggcgctgaagatgccttcccaagcccattttgtctgctcttcaccaggcccagctctccttcaacactgatacgctctgctgaccatcaagagccacatcagggatgcagctgtgtggggcagatgtcaggcggtggccgtggcccctagtcacacatgccaggccctggaaaggcaggttcaggaccaaagggctcctgccctcctcccaactaccatcctccccgaattgtgccaaaggctggcctggccctgggctgcacataccctcaccctgctttgccttaaagccttgggtcctggcccagccccttaccctgcccagcaccatccaccttcccagggtgacatgggctgccccaagtatcctgtgactcttctctgcagcggccgcaagtctacccaggccagcatcttgcacagatgtcttttcatggacacccttgactgcagttggggatggggcagcttgcctatttattttgctttaagagcctccctcacttggctgtggtacagaagttaggctaccatgggaagccgtgaatgtggctgcctcagccctggtggaatgacaggaacggagaagctgggcttgctggctaggggaggggccactgttccctccctaccccctcaatctgcctttgctctcccgtccagcttggcccttcctgccacccacatgggagcaggactttgtatatagcacacagatgtttgttttcaataaataagcaaaaagcacctacctgtgggagcctgtgcctgtggtggagggagttgtgaaggcaggcccactgggctagggtacagccgcccggtctgactgaaccagatatgaagggcgggggtgctccacacggggagatccattgtgcttccccttacctgcccacacagcccagaccctggttctgtgggtaggtcctgagtgggcttatagaagggtagggtagtgcagttcacactgctgttatctctcaggcgctgcgtgtctcatcccagcctcccccactaggcctagtacccacagtgagtccgtttgtgctaggctgtctctacttcctgaaaggt

SEQ ID NO: 26400 - DNA, 1210 bp, Mus musculus
ccacatgtactgtacttactcttgtattttggtttgttacaactcagctttagaaagagatgtgtttatatctaaagtgacaggaagggacaagtgaccaacagtttggaggccctgcagtacaagcccttgggggatagataggaaagaagaccggcattgaagagcggcagatatgttgctaagaaggacccagaaaagcggaagagcacaaggagtgagaccatagtagatctctgtttggatgcaagggccaaagaacagagcccagaatagcactgagtagctaatgcgctaagccccgccctccgagtgcttcccgccccgccccacgtgctaaaccccgccctttagtcagcctcttacttaatgcctggtacccggaaacaatgtcaaccttgagtaccgcccatcgcctcgtccttccgtccctccagaaaccagaagttccgccgccgagcgaacaccttagattgtgagtcaccgagtttgtacttctgcgcaggcgccctcagcccacatctaacttggctcctgcggcgagaccgccctgctgtcatggctcctccgttgttgtcgctgccgctttgtattctgccgccgggttcgggctccccccgcctggtgtgctactgcgagcgggatagtggtggagacggggaccgcgacgacttcaacctctagtgagtggagtctagggatgtggggtgcgggagcatagcgggcacggtgcctgacagcccctcccacccagtgtgacggacgccgccgagctctggagcacctgcttctcgcctgacagcctggcgaggctcgtgagtaacagtgctggggataggagacagctggtagcttgccaccctccccctccccgtggcagtggttctaatagcatttccagggtagggcagtttggaatgtccagtgggtccagggtcctgggcggggttagtgacaattccttgttcccagcagaaagcccgatttggcctaagtggggctgaagatatccattcccggttcaggtgagttccagttagggaggccatgtgaatgagaagcttggggtagtgctaacacatcctggccataacacacatctccctccttagggcagcctgccaacagcaggcagtaactgtaagcctgcaagaagacagagcattgataaccctttcaggggatacccctgccctggcctttgacctct

SEQ ID NO: 26401 - DNA, 1244 bp, Mus musculus
gcggcatgaggatgtggtcaactccgtggcttttagcccccaggagcaggaactcttgctgacagccagcgacgatgccactatcaaagcctggcgttcaccacgcattgttcgtgttctgcaggctccacgccctcgcccccgccctcgcccccgccccttcttctcctggtttgccagccataggcgctgaaggcttcagtgatttgagccattggaacctactggggaaaatggtaccccgtggttctttattgcactggggcagagtagctcatagcagcaatgccttaggaggggcagcctgaccccaacacacacacacacacacacacacacaaaacctgctcacttagccataaggcttagcactagggtagcccttgttggcagcaccagatcccatgctagcctcttggctagcttggggtacacaggtcattgggaaccctgttcttcacctaccctcttcccttgggttggcagctcacacaggtccaagctggcttctgcctgggtacctttcatattcagccaaacccacacccttggatgtcttgagtgtaccctgggcagcaggccacaggcactggtctctgataattcagtttttgctactgagtggcctgcagtggactgtgggtgctgcatgctgcactcctgaactgtttgggcctgaataaacagttggcaacagcacatgccatctagtctgtttgtagcgaggggccccaggccttgctggccaatgtcgtcatggtgatgtctgcctctggtcctccaagagactgaagagtgagctggttcgggtgcgtagtcctttgacttcagggatgcctgtgcatggctgtgagtgctaatgggtgcaggaagattgaccagcccagcctggacaagcacccaaaagagggttggctccatcctccctcaggagagttccctgggcagagtatagtgatacagatctgtaatacttgctcctcggggggctgaggcaggatgatggggagttaaaagcctgcttggatacaaaacaaatccaaggttgatctaggctacttggttagaccctggcttgagaaagtaagaggtttgggaattgtggtttgtgttaatagtgtttgcctgtcatgccttgagttcaattcttggtgccaccataagctctgaaaatgtgtgaggtcccagggtgcaggagggtagctctaggccatcctaggagcttacgtcatgcacctacactt

SEQ ID NO: 26402 - DNA, 1231 bp, Mus musculus
ttattgttgttgttgttatatacttaattactttttggctgtcctggaactcaactatgtagacggactggtctcgagctcatggagatctgcctgcctctgtctcctatgtgctgggattaaaggcgtgcgccaccacgtctggcttagattttattttttatatagagactcactgtagctcaggctggctgcagactcacatcagcctgcctacctcagtctcctgagctctgggattgctgctgtgagccaccatgctcagcctggccctcagccctttctgagatgcttgacccacactctgaggtcagatgtgaaagcagccttgtgtgtgtgtgtggaggccctgtgaggagtggacagtggtgatggaaggctcaagccgagcagggaggttgggtgggtgcaggaagtggcagagtggtcagcatctcgctggctcgtttcaggcctcaagctccgggggaaggacatcgggaagcctatcgagaaggggccgaaggcgaaatgaacacaaagcctcgaagccagtggttccggctgagctctcctggctggtcccccaggaccaccagcactgccgtgggtctcctcacatggtcaaacggaacacggggggttaggcctgtgtgccccctcaacccataactgctgtcaaacaaagcaaaccttgtaaagtgatagcctcctggatttttcctccctgccttctgacgctcagcaggggtgtgaacctgcaccttctgtccgatggacagatggctgcagagggaagttcaggcctgggaggagtggatgtcctcggcctttgcctcctgtccatctaagggcctgtgctctgctggagagaagcagtacgtagcattctgaagtcttctctcctcaccgttgaccacagttgtggagggtggagatgagtgtctcccttcatgatacgtaccccagagggacctcgggagtttgaaagttctttccctgtccgctcagagaagtgggcatcagtcaacctttgcctgaagatgcagggtggcgcctggccacgccccaccgcctcctcccatgcagctgagttttggataggcaggagcctagcttgaaacacatagtatctttggtgaggacaggtttcctttgtgtaggaagggatcgtctggatgtccactctccctgaggacagccctcgggggcccccagtcctcagtgaagccacatctgaggcatcatgtgg

SEQ ID NO: 26403 - DNA, 1556 bp, Mus musculus
gtgggatttagccttgtgggttgcccattgactctagttctgctcttcatgaccttcaggaggaagaaaagactacaaaaaagaaaagcaaacacaagaagagcaaggacaaggaggagggcaaggaggatcggaagaagaagaggaagccccctcggagcaaagagcagaaggctgcagatgagctggaagccttcctggggggtggggcccctggcagccgccaccctggaggtggggactatgaggagctctaaacatgcctagggcaattgattgtctgggaagaggtgggctgccagtggctgggaggctgctgtctatgcacccacattcccaggaccaccctgccacctatgtcccccagccattatgtctgcccccatgtggtctggcccactctacattgttttttgtgcagaagaccttggtggtgttcaggcccttgggtcaggcgctgcaggtgctgggcctcaacccagcagaagcctgctctgcagggagggaggggacagaataaagttgcagctggcttggtggatcacctggcctcccagaaagagctgcaaccagtccccggtgtttctcagggatgtgcctggggccgagaagggacccaccagggtctgtttacagaggcagggcgtggggctgcttggcttctctaatgcccaccacccagccccactcctgcttgccttccggggctctcccagagccacagcatggcttgggttgtggaccttcttccccatggatccagagtggcacagggtcctgccctgagcacagatgtgtcatgtgtcactcaggagggcatggcagcatctgctactgcaaagtggcccaggccccgcactgggtaagcctggcaagagaacacaatgtaccacttctcctgtgggagaggcactaacgggctgccactgtgtgccagctgcgcctctgcccgctgagcgcctgcgcaggtgagcccagagggcaccttcttagacactccagacccataccataaagctctctgattttactgtggtgtgtgactctttttctggtcccctaaacagcttgagatgaggccaaacaatggactaggtgctgttaagccaaaattcggcccaaagggtggtctgaggacttagtacctagccataccatgtaatccagaggaccaaggtggccatggttcagggcttaccaccacaggctgatacaaggttactgcagggagaatacctgagagtctcaggccctggggccctggtaaggtagttgtgtcctgctctgcactgcctccctgcctgctgggagtctgggggcgcctgcaattgagaatttcgcccccgctggcagctctccaccctcgcccactgtggacacgttgccatgagaaccctccagaggcaggcatttatcactgctagtgacgttgggggtggagcatagtgctgcgcctactgtgggccaaggctgagagtacttccctagaacttgtgggggtgctatgaggggggcttcccttttctgctagggagctgtgtacacaggacaattga

SEQ ID NO: 26404 - DNA, 1166 bp, Mus musculus
cccaggaagggaaggacaaacaggtgtcatcagagagtgatcctgaggggcccattgctgcccagatgctgtccttcgtcatggatgacccagactttgaaagtgatgaatcagatacacagaggagaatggtaaggacaggtgctgactgggcagctcaggcaccatccttccagagctagaggacaatcaagaaggtctgtttcccagagcctgacgagaggcaggagaatgttcctggctccagtgccccagaggcacaatcctttcttatttactgtgtggctgaagcctgctggagaaagtgaatgagagtccatgggagagggcccattgtccacatgaaggccctgctgatctttctgaatctgggtcaggttacccctcccatccagccctagcccctggagtcgtaagtgaacttgccaaccttgtttcccagatccctcggagtggtcagggcacaatcggcctaccagctgctctctttccagggcaggtttccagtaagagaagacctctctgatgtaactgatgaggacactggccctgctcagccacctccaccttccaagctcccaggtgctttcagactgaagaatgactccgatctctttgggctgggcctagaggagatgggacctaaggaaagcagtgacgaaggtaggagggcctggaacctgctggatcctagaggtccttgtctgtgatactcctgtgtttacatttacattgcctatggtttctcttttcaccacagtaattagctgtgagattggtgaaactgtcacaccagctggcaaatgtgcacccaagtgtggtccagaatagtcatctaaacactgtcactgtcactctatccatggttccctatgggtcctcacctctaccaaatgttctacattccatgctttcaggtgtcccaagcctttgggacagaattcttttgggagggggaaaaaaaaccacacaggctaataaaaggttactgcagggagaatacctgggaatctcgggccggcccaggctgcctggagaagtccttggacttgggccatgtcagcccagcaaacagcttaggactgtactgtcaggttctcagccccatagggaggggaagaaattacttgaaggcttgttcaagactcaccaccacaaaaatacat

SEQ ID NO: 26405 - DNA, 1848 bp, Mus musculus
caactagacatcgatgccacactagaggagctatcagtgcagcaggaaaccgaggaccagaactacagcatgtacgtgagctagcatctacagctatgctggccttcactaccctgagcggggaggatgggtcctgtaccctgttgccagtaggccctagtgttcacagataagagctgagtgccagactttggtctgaatctatgaggcagtggagaaagcaccacatacaatcagcctgagtgtccttcagccaagaccttagcagtactcagtgtagagcagtgtggggagcatcggactaacacagctcagcagctcctctcagcggtctaggacctgcgtccatgctatttgtccttgcccagagcccttcctgttcacctgttggggtataattattaatatgagctaattaatagtcagatcaacatttttctaaaacagatggactagtactttgaattgagctatgctggcctgggagcagcctcagtctccctacatcccctctcagttcttatagaaagtgaggacaggtactcctgaagatgggttgtgtcgactctggcactctacacccccaagtactttggagcctacagaacttacaaagtgcttagacatacgttatggttcctacgtgtgggtcagcacatgcctgtgatgagagccactcctcgtgtgcgattgctaacttcctcactgaccataaccagccacactacttcactgttgtttggctaacagctactggcctacccagattccacaggagtgggtggtcctgcacctctgctgtgcagctcagttccccaggctgaggaaatgccagtgcagagggagagcatgggcttgggagctacagtgctaaagagacaggataggcaaggaattagtctgggtaccagggacgggacagttgactggcagacaggccctatcctctgcctaaatataaatgtaaaagacacactgatgcctgaaaaccatggaaaaagagggccgagaagaagcaggttcctcactccatgcccttttgcccctcctagcttccttgaaatgatggaggctcgaagtcgaggccacgcatcccctttggcagccaatgggcagagcccatcctcaggctcccagtcgccagttgtgcctccaagtgctgtatccacagggagttccagccccagcacaccccagcctgcccctcagctgtctctaggtgtctcctccacctgtccctcagcaccatctcctgtaccctctttggaggccatgccctcctctgtacactcttcagccccagccccaaccccagctccagccccagctccagcccagcgtcgcagtatcatctctcggctgtttgggacctcaccagctgcagaagtgaccccttcacctccaggtaagcctgggagcagctctctcatgtgaatttggggccaccttctggcatcttgagcttcatattcctcactggaatgtccctatgcccctgaaaagtcacatgggccagccagtccttagcctggttctaaaatagcctggaccttgagcctgggtgcatgccttgttaagtcccaatcccacaggcacagttttagggcttgcctagcatgggggcaaggaccacataaggaagaaacagcatttctctgtagagccagctccagctctcgaagctccagcaagagtccagaatgttgaggattttgtccctgaagatggccttgaccgaagcttcctggaagacacaagtgtgcctaaagacaagaaagttggagccaaaggtccccagcaggatagtgacaggtaagggtcagattgatagagctgagcacagggtcc

SEQ ID NO: 26406 - DNA, 1169 bp, Mus musculus
acctctcccatttggctcccagcatgagtcataccatgggtatcttgactgtaggatttgaggggggaggagcaaaaactgatgctcatgcgacagaacagccttcctatatggagggcaagccaccaggccttcctaccctgcagaagtagatggaggtgttgactccatttcaactaccccaggtacagactgtttgaggtgcccccccccatttctcagaagcattttgtgccacattccttcatcctggagctacagttctgagagcgaggcatgcccctccctggctcagttggctacctggcagattctttagtttcacagaagggtcagtctctttcttagggttatgtccagcatgaccaaaggatagagagaaatggaaggagccaggtagaagatgccctgtctcaggtcaccttcattttgtatgctcgttgagtccagagatacttctaaatatgaagtaggtaaattgaggtcagcaagctaagggccattgccaggactgtatgaggccatggtgacctgctggccaagcacaggcaccaatgagataacaggctgcttctctggacgggccacgttcccatgagtcagtccatggtcaccctggggctaggagcttgtggcagcagagccacaagcaggagggaatgaccctgttctctgatcaatgagtccgaagtatagggagtagaggtggccttcccagcccccaggaatgggggtcctgcagagcacttcaactgaggttgcagcttatgtacgtatgtaggtgtgaggtagatggagtgtgtatggggggggggtgtgcatgtgggtatgtgtcatgtgcaggtgaccagtagtgtttatgggtacacaaatgtatatgtacaggtgcaagtatataggatatgcacaggtccttgcaggtgtgtttaagtgtgcacagttatatattcaggtgaaggcatgcatggatatgcacaggtgtactcaggtgtggtgcaggtatgtgtacatctgagcatatgcacctgcccatacagatctataagaagcaggcatgtacaggtgtgctcggtaactctgtcctggccccacacactggtgagacatcatctaaggttggctcgcagctgagcaacctgcgcaggcaagtgggagccagtgctctgctc

SEQ ID NO: 26407 - DNA, 2059 bp, Mus musculus
cccgacactgaagaaatctacaaactcactggcacggggccaaaaagcatcaccaagaagatgattgacaaactatataaatacagctcagaccgaaagcagtttaacctgatcccagccaagaccatgtcagtcagcgtggatgcactcacgatccataaccacttgtggcagcccaagcggcccacggtgccaaagaagacccagactcgtaagtgaccatggcaaccaggactctgagaggttgtgctgacgggatccctatttattattttcatctacttggtacgaagttgatgagccatggacagttttctacagcggttcctagagaacagagaagatgctctctcccctgcacacatggatgctgggcatgacatatgcaggagtgagtcctgtgctttcatgggcatggctgctgtggccctgctgaccactgagatcctcagaataagggacaccatggagtgagatcctggcctgtgggcccctcacttgaagttcttcagaataagttaaatgtgatctgctctctggcctcccttcacccctgtgcacattgcctgatgccccatgttggccagctgtaatcgtgcgtgattatagggccaaggctcattcgggtcagggtgtttgaatgtcttcataaaaggagttcgtatgggaaatctttttcattttagaaattgtataatatttattgactgtgtctactgccaacctttatatccagttctaagattctgaaaaaaagaaaagaaaaaaaaaaacctgttccttgctgctcagaaaaagtttactgaaaatgtcagttcactaaaagcactgaaatcggtaaagtttgtcttctgctaaaatgacgtttacatatgtggagtgagtatttctgccacacagttgggggctgtgggtactgctagctgatgctggcctcattggaagccggcagctaagccggcttagccaccactggttaggtctggggaatgtgctggcatgttcactctgataaaggcagattttggtatagtagcgtactttccacccttggctgccggttcctttgtggtgctgtgaaggcctggcttacctaccacggttcttgcttctggaggaacagcgtgctcagtgcagtgtgcagtctcaggtgaggtgggtaattctgctttttgcctcttttaaaacttggtggttatttgcggttatttcagaatggtgtagctgctttgggtctcttccccgctggcccctgtggcagctgcctgcctcagaacaggcgttcctggggagcagaggtgccccagcgatggatcagctatgtgaagaccctggagccacttgtagttttgcacatttctttttgagagtgttacttgaatctgtcttaactgcaggagagacttgaagatcatagagggaactcagacatcttagtgttagcgctagcagtgtcatgtagacagaggaaaggagcatgggacagaacgccggaggcgtgaggcgaggtcttgtcttctcttccttggtgactgtgtatccagtcaggggtggcgctgtgctgtatgagcattaaagtctgtggccacctgtcactggatgccctgtgtgtcttcatttctcactgtgcacttgatgttaccatatttattttaagagagcactaaaatataataaagtaatgagctggctttctgttaaccatgtgtgtggttgtcacaactccttctgctgacagtgtcccacatcttctggcttcagggcagctgcgcatgacttttgggttacctaggaatttatttttcatgaagagttggaagacctggtgtagagcaggaagttgcatttctgctcgacttttaatacggtgacttggcatgtggcctgtcctgaaggctgtctcagaacgcagggtctgcatgtgaagtacagtgccagtgtctcaaggccgggctgtggaggccatgtggcttgatggctcagaagcactcgtgccttctgtgttccatgacacagaagtagttttgattttttttttaattaggaagtttccggtaca

SEQ ID NO: 26408 - DNA, 1146 bp, Mus musculus
atggctgttacactgaaagaacttccaacggtacagagttagttacttaacactgaatgtttcttccaaactacagatcagcggcacaggtcgaattctttaactcgggttgatggtcagccacgaggtgcaataggagcatggccagataaaaaaaacaggtgagtcactgaactgtttctgttgggtgctcattagactaagcagcagttctccagatgtgttccagggacccttaaagattcaccacgctgcttctgggagctggcagctagtgataccacagcaatggcagcatgtgctggcacagcgactgtatgatgtatggtgtcccagcaatagagggagctgtgagggcctcgcagtaggggtctgtagtagcaacaggtgcttcctgtgctatagacgcttttgtttttcatgtttcctgtggtgatttttattcagggtttaaaaaatatctgagctgtcatttgtagtgtgctaaatgtagataatcaaggctcatcggggccttggttactttaaagggtgtataaaggagtgctggggcaaagtgtttttgagtcattcactaaatgttgcctctgcggctcttttgtcctaaagcgtttgtataaggcttcttcctgtaagactgctgctctctctccatatcttgagctcttcttcaggctgctgagcagtgagttggtttctcctcttgtttcaggcctgtgtcacagccaacatcatttgctctccatcatgctgcaagttgtgatgtggatcccagttctggtgacagtgtcagcttagctcgctctatcagcaaagatagcttggcatctaacattatccacctgaccccacagaaccagccccatccctccgctggaaagagcaatgggaaaagcctcctgagcaatgtcaacattgaggatgaggacgaggagcttgtagccatcatcaggacagatgtgtctcctccttccccacagatgcccaggacctcacctcaggccccaggcctggtagcaagtatcaggtctccccagagacaggcagacactttggagagtaagcctgacagtttttacttagaacccctgatgccagcagtactccggccagccaaagagaagcagattaccactaaggaagatg

SEQ ID NO: 26409 - DNA, 1219 bp, Mus musculus
cagaaattgagcagaaaactcccagctgcactcatgcagatacttgagatggcctgtgaggtgccatgggacagatgggggtctaaaccctgtgcctggagccagtgggaagtgtgtaccttgggatgggtgtagatgggtacgtttgtgccacgttctacctttggtcttgtccctggccattttctcttttgccaaggccatgtatcacagtcagtgggatgtacccaggaatgcctgactattgacacagtttcactactgagagcagcatgtgttctccctgtgtagttttctctctacactggtcagctctagtcagccaggtcagtagaggattaggctggagctgagcacctccctaatctttggatggggacaggctcacatgggcatagacaaagggcagacctgtagcctggtcccctgattttctcaagtttggaactgttctttgctattgtgaaacagagttgtaaaggggacaggttaccttccagttaaattgcctggtgttgtgattagctaaggtcatgcacactggaaagcctttgctatcagaggctgtctctaactctcctgtgtgagcatgtgtgtcatggccacacctggacctgcagtgctgacattcctttccaccttccttcctgcttcctgagcagtctccctccaagtggtattggaagttagtacccgtaagtgacccaggccaccatccaccatctgcaaagccatcttgttgccatcatgcgcttccattaaaattgctcgcacccaagattggtttttgtctgtttgtttaagtgtccgcctgggggctgtgcggcttgtctagcatgagccctgctggccacgctgatgggttctgttatgtggcacattgggatgccatgttcattcccctaggctcttagtgatctctaagtgaccagtacagcatagctgacaggacactgtcttttctagcagatgctaagaggactgggggttacctagtggctggaatcatttcatggccttttctttctgctgttactttgcctgggggctggtgtctctaaccaccttccctagaacctgtattctaggctgtcagattgaagaggcattctcccactgagggtacaggtggactgcagagagggctgtcgatggtgtattttgatgtggtcttcttgtttctacccctcaggtcatatggaggtcagctcagattctg

SEQ ID NO: 26410 - DNA, 1232 bp, Mus musculus
cctgattcactagaattgtgattaaacagtatgctgcctggaccaaagataacggaaagctggttgccatgttctgttgtggtagcagacttggcgtacttcctaaacaaaagctgtttggtctctgcttggtacctgaccttgactttggaaagaagataagcagagctcccttctcagaatgaatgtcattgtaccatagccccttctttaatccgatggcatcttggtttcctttgagctctctagcatcccaggaaatttgtgcttgcgtcccaccatcattcagattatgctggcctttgcacaaatgcctcattgtgcctctgtcgtgctaatgaggctgttagttgaccctagatctttgtgtgttgtgtgtggtaccttggctgggattttgctggacggtgcttttgtgtgttctcatctggctggtgatgcttgagactggactgtgcatgtccattcacccagtgctctctctcctgccatagacaacatccctgaggacctccgagacccgttttacatcgaccagtatgagcaggagcacattaagccacccgttatcaagcttctcctgtccagtgagctgtattgccgtgtctgcagcctcatcctaaaaggggaccaggtggctaccttgcaaggacaccagtctgtcatccaggccctgtcccggaagggcatctatgtgatggagagtgatgatacccctgtgacagatgctgacctcagccaggcacctattaagatggtgagtgttgccgggcgtggtggcgcatgcctttaatcccagcacttgagaggcagaggcaggtggatttctgagttcgaggccagcctggtctacaaagtgagttccaggacagccagggctatagagaaactctgtctcgaaaaaccaaaaaaaaaaaaaaaaaaaaaaaaccaaaaaaaaaaaaccccaaaaaacaaaacaagatggtgagttgtctgacaggcattcctctgttcccttggctgagcaggcaagactcagtgcccttccattagggtcagatggtgaggtttgccaatgtgtattggtggaccttaatgacagacctgcattttaaagaatgtcatcattctggaaagaacagcttgcttttgggttttcttctcactgaagagacagtgtagcagggcacaccactgcagagccttcctgctggatatctgcactcagccagaatcggttgctatgttct

SEQ ID NO: 26411 - DNA, 1256 bp, Mus musculus
ctttccagagttggaatgccatgagtccaggctgttgactaccccacttgtggactgtgatctggaatactgtgagcacacaggcagtccattgctctgtaaaagatgtaagcatgggcagctgaccaccttaccctgctgatggctctgagttgggggtgctgtgatctcacaggcagtctgcttccctgccaacagcctctgaagtctttttggtcagtagctcaggcactatggttggctcgtaagggtgagtgtcagggccattgagaaaggctcagtatgcttgttggtgttgggtgctaccactcagctctgtcgtcttcccacagcatttgaagacatgctggagaatccgcttaacagcacccagtggatgaacgacccagagacgggcccggtcatgctgcagatctctaggatcttccagacgctgaatcgcacgtaggtggtacctactgtgctccttggctgtgcagtctcagcagtctgtgaggcagtgggcacagggttcagccgggatcttgcctggaccacagcttctcggactctcctttccagacctaacagcttatcaacttctgccacatggcttgaaagttgcagtcctagcttctgacaggtgtctacagaaagtggctgttgcattgggaaggtgaatgattgctgcccgtccctccagatactctgctgggctcctgaagtgctacttgaattgacccttaggtgtttgcttgtggagcccaatgtatttaaaagaaggcatgttctgatccaaagtgttatgtcaagtgtgctaatttaaccagactgactcacagatggcttctttaataaataaacccttttcctatttttacttgtgttacttcatggcagcaaggacatcacatgtatcccctaggccgtgtacacattgtctctgcccagagcaggtgtcattgccacttctttctagatactatttctctgtgtagccctggatgtcctaaaaatcactctgtaaaccaggctgcccttgaactcagaaatctgcctcctgagcgctgggattaaaggcgcgtgccaccacctctcagctttcatggctacttcttcacttggaaacctgaatcctctgagcccagctcaagttgggtttggggctgtgacatttcaagtagcaggccttccccccagccacagcagatggagcagggtgtgtgtgtgtgtgtgtgtacactcacaggtgcatgtactcatgtgtaccttgtgcc

SEQ ID NO: 26412 - DNA, 1131 bp, Mus musculus
gattaaaggtaaggcccaatatgcccttgtagatttggagggctatgtctgggatagtgttgcagatttaagcaagtttgttggacattctgagaaataatctttttggtttgtttgatttttgagacaggtttttactgtagaattaaggttggcctcaagctcccagcagacttcttttctcagcctcgcaagagcagggattacaggtgtgcatcactgtaccgggcatgatctctttctttatcctactgcagttccagacagaactccggaagatcctcgtgtctctcattgaggtggcacagaagctgttagcactgaatcccgatgcagttgaattgtttaagaaggcaaatggtatgcgtgggtcctaggctgctcctaaaagtgtccccagccctcacactgaaagcaagttctgctttggttaatgggggagagggtttggtgtcagtaattgctaggtgaggtgagcctctactgatgaggctggggggcttcaaaggactctggaatcccctcatggcaggccttgtctttctcctcagctatgctggatgaagatgaggatgagcgagtggatgagactgccttgcggcagctcacagagatgggctttcctgagagcagagcctcaaaggcccttcggctgaaccagtatgcttgctttcttcttgccctgggcttccctgtgattctccttccaatctctggagtcatacttttttttttaatttttatttatctgtgtatatgtacatgtgtgtatgggtgcccatagaagccagagaggaagttggatcttctggagctagaattacagactgctgtgaactgcctgacacaggtgctaggaaccaaactcaggagctcttcatcttaatctaggagccagctccccgatcccattgagtcatttctaattgggtgttctagtagaggcaccttattgctgtgcttcagaagtgctttcatatatgatcttttggggtgtgtgtgtgtgtgtgtgtgtgtgtgtgtgtgtgtgtggagggtctctgttacctatgctggacttgaactcctggacttatgtagtcctcctgccttaggctcctgagtagctaggattgaaggtgtgaaccatga

SEQ ID NO: 26413 - DNA, 1145 bp, Mus musculus
tgcctccccctttttgttttacccaaagtgacttcaccatgctattgcccagcttccactgccggtatctaggaaaggggcacagtgagtcctcttttctaaagggggttagtggaagtctggggtgatggagctgtggtgtggaggagcttttctgtagtgtaccatctggatgaagcacatgaattctccttcaaagcctaaaccgtcccaggtcctgtgaagagttagcccctgttatctttttttttaaagatttatttattcatttaatgtatatgagtacactgttgttgtcttcagacatcagaagagggcatcggatcccattatagatggttgtgagccaccatgtggttgctgggaattgaactcaggacctctggaagagcagtcagtgctcttaaccactgagccatctctccagcccccatgacctgttatctttccatgatgtacagtactagatatgagcagaagctaatgacagacacctctgggatatgtgcacgtgaagatagggttgtggtggtgtgtagtgtgacgacctgtgtcatgtcttgttccggtgtgctgctgacaggcttcagaatacagttagtaggttctaattgtgtttcatactgtattctgaacttgacaaatctgctagaattaaccagggattttagaatttcaaagcatcccacttagtagtttttgaagcagaatggggttctactgttttggttgttatgacctggtaccacatcaaagcaaatgaaaggatgtttattttagttcatggtttggagggatacagttctttctggtgatggggtacggtggcaagtggctctgccagggggagcctgaggctgcttgctcacatatctttgaatcaggaagtagaaagggcagtgctgctgctcagttgactgacttatgggtattcagtctggaactccagcagcccattcgatggggctagcacattcaggcttggttttcttccccctcatttaattctctgtggaaagccctcatagacacccagcagtgtgccttattgatgccataggtatttcttaattcaaacaaattgacattattaaagagtcatttttaggttcaaggaaagttgaggttgtctgcttcatcacaat

SEQ ID NO: 26414 - DNA, 1158 bp, Mus musculus
ccagcaagtggcatttgttaagtttacttacattcagtgaacgttgtactatagttagccttttagttttagttaagtcttggaattagttcttgaagccttcctggctctaactgctcccagttgaagatgaaacagatgtctgttagacactggtagcctatggaagcaccatgccagacaagattagtgccagatagctttttagaggggactcttcggaaagttagggatctacagcagtaggttgtgttaaagttcagcattgtgtttcctctaaaggcagtcttcaagttactatagcagctgcttgcaaagggtagtttatcatctgtgtgcctttgtgtagtcagtgtgtaatgtcaggcaggctccaagagatctgtttcaagcccctcttctgcagtgcattagatgttgagtaaccgtgggtctcagtgtctgtggttcacctcaatgaggctcacatacaggacaaaatgtattttagactgcccaaggagtccccaacctttaagcttgtgttgagcctgtggattttctcaatagcaagacccagaggctcagcagaagcttaaagactggggcctccttgggcatctagactgttccctagcatccatgctggcctagtactatgctgtgtcatctcctaggtcagttcctcgggggctgagcttggagtaacttcaaagtcggtgtaaggattgaaggaatgaaaggtgtcagcctcaaaccacatgagcatgggatgtcaccttcactgctgtgatctcttgcctaactcacttgtggtgtggatatacgtaatgagcatggcagtattctatgaagggggtagggagatgattcacagatgcttgctaatacattttaggggcagtatggttaggcttaggcagcaggttttgatatgatgctaattatttgtgatgtttaatattccagttgatattggagttgtatcattttgaccatttttgtcattattcttgtttaaattgagactattctactccacattttccagggcagagggctgaagcagcaggagaatttcacagcattctagatcacagggctggagagcagaggcattagaactgacccacctccgggtcccatcagctctaggagtcacactgcatttattagaaa

SEQ ID NO: 26415 - DNA, 1146 bp, Mus musculus
aaaaaccagactccctcctttgtttacaagatgactaattccagaatcggggctgtcttgtcctgtcacgtgaccctgacttgtccagaccctataggtgagagcctctcagcatttgtcagatgtctacacctctgttcctagcttgactactagcaatatgcacatactatgtagagtctattgtagaaactattgctacatcagcatctttgccaggacgacagtcgggactggatagggttggagctactgggacagagctggatccagccatgagtcttatgtcctcccagagcagacaatagtccctgaggcagctgggacgaatacagcaggtctggggcaagggaccagagacagggctgatagtgtgagcttggaggtgctgcctgtctgcccggctgtctcagtacttgaattctgtattgttttctataccagttgcttcagctaacatctgatttggtgtcttactttgcccttggatgtagatgcagccagtgatgtatgaaaggcaattgaggagagactctgaggggtcctttgtggtgtgactgcaggtgtgggcctcgaagaaaactagatgtgtggtgtttgtttagaacctaaaggaaggcagaaaggggctgtgagagctggcaagctgacagggccagtcccctccaagggactgtggggtgcctgctgctacctgcttcaacagcaggaccttcccaagcccagtgcatgttgtgctctgccccactgtcctctgcttgggttccctaaagatggtgattcttagctgacttggggaagagcaggtggcctatcaaccagctgaaaactcgaaagaccctgttagaacctgcttgccgcagatcccagatgggaatggcgacaagcacatgatctgtcagctttacgcacttcacttcgtggaaaggtgctgctgctgggtggttctgcatgtcaggcagctcagcctatgctgctagaagaagggctcagtacaaagtgtttcaaaagtggcaaaggtgtttgctttgtttgttttgttttcctagaaaggaaaaggatgcaggatctaaaaccttctgattgaatagcctctgcttgtgtcccattggtcccctcactgcaagctcgattgtgatttttatg

SEQ ID NO: 26416 - DNA, 2161 bp, Mus musculus
tcgcaccaagtacaacaacttcgatgtttatgtcaagacccgctggctctatggctttatacgcttcctgctctacttcagctgcagcctcttcacagcggccctttggggcgcgctggccgcgctcttctgcctacagtacctgggtgtccgcgtactgctgcgcttccagctcaagctgtcagtgctgctgctgctgctggggcgcaggcgcgtggacttccgcctcatgaacgagctgcttatctatggcatccatgtgaccatgctgctggttggggggctgggctggtgcttcatggtctttgtggacatgtgagggcccaccctccatggggctcctgattgtgccatacctagcttctctcttggagggtggggctggtaggggcttttttttttttttttttttttttttttttgccccatcctggaggtaaggcctgaagcacacactcccattgaggggagaaaagggctgagactactctgtaatgggaacagcacacagtctcgctgttggcttctgcgctgtccttgctgtgcacgttaccagatgtgctgtccccgttagcctcttgccttgggttgcctgtgtgttttcaggttgtccagtgggtggcctgtctgtcttttttccaccttgagaccttctgtgtgacattctcaccaacatcaggcccacccagtgggacacaaaggggtgcctttgggctgcacagcccctttatgtgccctcctcctggctgtcctcagggacccacctggctatacaagcagacatactactgccactaactgcgcccactttgagcccatggaccactctctgctgttcacaagtagccgtgtcagtcttgaaccccaagtcaggcctcagagtcaccttggtttgcataggtgcagtttagcagaacagcatatatggcattggctagaccctggtacaagggagcacaggccccaaggcttgaactccagagcagggggctggtccacaccctgggcaggtctgtgtgtcaagccatgctggaactctgcaaactgaaagggcctagaaaaacacttgtgcttaacctggggagtttttacagtctctgagggatggggtctccagcagcctcccagagtcttggccagatctgtagaaaacgggaataaaccgactgtcccccctcagtggtttttactagtcctgtgggcagcctggatgtgctagctacaccttccccacatgttgttaggcctggtttgtgagatagaagatggagtacctgaccacctttggcctctatcaggggtgggaatatgactctcactggtgacaagggcctaggtggcaaatgaagtggtttgagcagtaactctgggtgcaggacattgagcatatcctgctaccacatgcttcaccccccattgtcaccccacatcctgggcatgggagtggcccctttaaccctaccctgccaagaaaaccaaacagggaaaacaaagatgtaggactattgacctagctctttaacttgtagccagctgtcgtcgttggtctggcaagagggctcatggaggaagtctgtctgcctcccaggatagcagatgaggtgccttcccagtggaccctgctgctgctcgcttgctgcagagaattgtttgcactaaaccccactcttcccccaaagcaacattgttctttgttaattagctcatgtatctcagagtggcctgaagccccattttgctgggtgatggtgggtgtgtcagggctggtggtgggagggaatgatgggaccttgtcactcagtgcacacccagctgcctagtgtcctgagtgcctgttaaattctttatgagaggaatcacctgcattaaacctatttttttaatgtgctgatggagtgattgcttacgtttttcctgtgctggggcctcacacatgctgggcaagtgtgacaaggggacagcgctggcatctctgcaaagccggaaatcttgtcctttccaaaggacgtcatctatagtgtcatagttctgaaagcagtcaattttaatgctgagtgttgaagtcttaaaaccagtggttctacagtcaggtggtctgccaagggcctagaattgagttggtcaataaaggtgagggcttggtttctggtgctctccagga

SEQ ID NO: 26417 - DNA, 1605 bp, Mus musculus
ggccttgagggtaacttaaaaacaacaacatcaacttaaatacattatttgtaaaatctcaatggtaaacttgtgcctaaagacttttaacaaatggactaagtctacatttctggaaacattcttactgagaccctccatagctcaggagcttccttttatttggataaagcaagctagtctctctctgtgtgtgtgtgtgtgtgtgtgtgtgtgtgtgtgtgtgtgtgtgtgtgtgtgtggtgagagcgcatgtgcgcatgtgtgtgcatgtgtgtacattccattttgcatattctatcttttatatttgcatccttcccaatgacagttggtcacatgggtaccatttaagaccctgtattatcgatgtccctgctgccacttaagaaaatggacagctgtctccttgggctgttattaaccctcctttcatcacatggcaggatcagttctgagagccagaccttggctggggcagatggccagactcagccacgtgaacctcctgcctcacttccctgtggaggaagtttcttctttgaaacctggagtcctgtgcttaaaaacaaacaagcccagatcatcgttaggtgtttccaaggatgaacactcctggtctgtcagcttgagaattgggcctatttaaggacagctccagtgaaatgtctgagcccgaagggtggccctggggctgccatagcaccccacagtgcctggcgtggctgatgtttgcagaagcccactctgggcagatcctactttcagctgctcttgtacagtcccaggtcatcccttctgggggacaagcttgccacggacatccctgtttgaactgttcattctgcagtgaaaaggcttgcatccctccagggacccatctttgggccaagtgtaaggtctgttttaaagtctgaagttttatgagaggtattaagattaatatctagaatagttcagtaatttaaatgtttatttattttttaatgcaaagattttgagtaaaaagcaattggcatgaaaatgtcaatgaaatttcttaaggggtacattttgtatttaagtaaactctaatgtgcacattgtaagaataaagaaatttgacatttagtaaagttgtttcagttttttgaaatgtgagcagctttatgtaaagctggattcagggaattctccaaacccttttctcccatctagtttgcagacacaactctgaagttctaagaattttttgtataaataaactagaggcattcgggaagacagcctaaaggtcaggcagatagtgaagagagaatggactatgctgagacctgcatcctcagattgtctctgaacccacagagcctgggaggaccagccagtcaactagaaagctgttgagcctctcaccaaatttccctcccatctgtgcccagcctggggcagattgccctgcaggcacctgggaacttctgctcaggacccttcagctcttcagtagctggtgggtttgcatgcatgagccttttctggaaataggggttggagaaaagggactaaaatctgccttcagagtactggatgcaggtggttgagttcgtagttggaggcttctgacctgtg

SEQ ID NO: 26418 - DNA, 1184 bp, Mus musculus
tctttatgaagcctgtcctctggctagctcatgcccgtgtagctttcattctgctcacttggcacctcccagtctcccctctcttccctgcaggtcctctctccccttcatgtggtaacagtctgattgaaaaaaatatctggtggagtgtgtattcacggcaaatgtgtacatgtgtttttatgtgtgggcctggccaagtgagaaatgcctcacaggttgtcccccaggcaacacctggcattgctggcatcaggagtcatttgcctgtgctagcagtgtacgtggagttagcaggtgcacctggccactctcaccaccacgtgtgtgagatttgtcactttgccttgtgtcctattatctgctctcagctgtgtggtttcccactgtatgcatctgctgtgacaggatgtagcatgtcagtgagcagcggtgcacccagggttgtgtggatagtgctgcagccttcactggccttggctctgggcttgggacagacacctagagccacagccatgacccaggttttcttgtgtaggacctgacagggagctgcggacagtcaggcagacaatgatcgacttcctgcagaaccatactgagggcacctggcctcctgcatgcccacccctggaccctattcagtgagtagctgcattgaaaggtggcctgtggggcccagagcattgtgatagtagcctgtggcaagtgggcagccctggtccattcctttttccaagttgcctggtacagtttgggcatggtttttaaaatgtctgtgtgtatagtgactggggtactggcatactgtaacagcttatgatcatggagagcactgaaggtttttctttcttctgacaggtccagtgacatcctttccttcatggatagccacagtggccaataccatgctattgtgtttgaaagcaatggttcttatgttggacgagaggtaccgtgtctcatgtactttgggactacagctggggtggctgggatggactgtggttagtgtattgatagcaacaaccttgagctgccatttcagagatcctgaggaagcagtttatagcaaaaaagaaaagaaggaaggaaggaaaaggaaaaggaaagaaaaggaaagaaaagaaaagaaaagaagtaagaaagggaaagaaagaaaatagtgaagtgacaggacttgc

SEQ ID NO: 26419 - DNA, 1230 bp, Mus musculus
gttttacgtatgtgagtacactgtcactcccttcagacaaaccagaagagggaatcggatcccttccagatggttgctgggaattgaactcaggacctctggaagagcagtcagtgctcttaactgccggttcatctctcctttttcttagtcactatttccatgacaccagactatacatcctgggcccttggctctccaggatttagttattttttgtttgtttgttttgtttttgtttttcgagacaaggtttctctgtgtagccctggctgtcctggaactccctctgtagaccaggctggccaggatttagtttttacatgtgttcatcctctgtgggaagcttgcagctcatagtaaaatggtatgaccagcctagtcctagtgattgtaccagctgtcactccagctgatggccgtcacacatccagggacgcgtgtttgtcatggctccttctaacctctgcactgggtttctccattctggagaacttggggtttcttcagctatctgtgctattgacttccacttcagttttatgagcaaaagtttcatgttattaacacttttaagaagccaccactgtggaggccttgtgacctccttcctggagtgactgcaaagccatggatggactcccttgccgtcctggaaacccagcaagccacaatccctagcagtgtggccccccaaggccaaagaggactcctgactgctgcttttggaagtattttcaaggccactgtccccataggagcaagcagagggccagtaagctacagaaggggccagctggggctctgcataagtgtcccacccttccttcccatacagcactggaagcttttgcctcaactcatcttgtaggctagacagcagcgcctgtctaacagctacactggctgggcagggctagcaggtccccacgcccacctcaggctgactcttgaagggccaccctgaaggagaggctgtggcacgcaatccatagaggactatagctgcctacagcttgtagattttgaccaagctttgtcccactgcacctaccctgcaccactgtccttagacggcagatgaggatatgaggcagggccatgttagaaaagcaactttcagaagcctggatccaggaggaccttggactgcccatccagttcagatgagcaggcagggagggctcctctgctcccagagtacttctacttccctctgttctgttcctg

SEQ ID NO: 26420 - DNA, 1190 bp, Mus musculus
gtctctgctgctgagaaaaaccagctgcaggtgccctatgagacccacagcactgttccaagaggagaccggttcctacacttctcggacacccactcagcaagtttgaaggatccggcctgcaaggtaggccctagaatgtgagcaaggggaatagtgtgtgctctgtgctcttagtggtcactatagctgtcactctggacagtgtggcagtttggtttctgacctggcaaaagccttgtccttttattcactagaattgttgcttagaactggtttcagagttgtgcagtagcagtggccttcataggagctgcagcctccattgtccccaagtcatttgctttaaaggttgtaagaatttctgcttaagggcacttagatagtaggcagttccccatcctcaactgccatgagtcgtggaggtgtccttgggtagtgtcagtccaacttggctggctgtgcattgacctgtccccctctgtcctcagtgctgggcctggggccagccagattagctctggcagtggctggagcagccttttggactatacaggctgctctgctgctctgcactggggattgctggagggacaatgcagtcagctcagccatggtactgcctgccattgggccagagcatctgtcttagagagggcactaagacaggccctactttaaggccacattagccttaccacagagtattttcgcaaatagcaagtggtgttcttacaagggggcgttaaacgtgcacagtggcaggcctgtaccagatcctcttgatatacagcctgtgttgaaggtgcccctagagaaaatgccgaagttaatcaggactcgtccacccacccagagtcacacactgatgaaggaaagaccgaagcagccactcctccctagttcacgctcagggtctgaccctggcaacaatacggctgggccccatctgcggcagctatggcatggaacttaccagaataagcagagacgcaagagacaggctctacatcgcaggctccttaagcacaggcttttgctggctgtgataccctgggtgggtgacatcaacctggcctgcacacaagctccccggagacctgcaaccgttcagactaaaggtactgcccagagcactttggggaacttcctggagccagggtgggagcaagtgccgctccttgatccat

SEQ ID NO: 26421 - DNA, 1138 bp, Mus musculus
ttgcccacaagttgtcaagtactagtgatgactcatgcagatgtccttccacattgctggtgggaaggtccccagcagagaggttctctccttttctccctattttctttcagtggtttgttcagatgtattttagtttacctacactcagcagccctgcagaatcccattcaaaacaggcagacattttcaacagacttgtctccagagatgcacaagtaaccagaaggcccattaaaagatgctcagtcacttatttcaagaatgcaaatcaaaaccacagtgaaatatttcgcacatgtaggggaattgttttaaaacacacacacacacacacacactaacaagtattcctggggcacagatcatagcctccagaaaaaccagagcatgggacagcattgtgctggggcagtatagtctgtacctgcaaaactcccttgtcccaagtgtcccaggagcttgtatattagacaagaatgttaatagaacatccttcattgtcagaaagaaagtgtggggtacaaagccggagtgtggcatttgcagggaaggtcctgataagcgctgtgtgatacatgtggcgccgtgggaacattctgaacattccgtcaaatatttatcaagacatgctcatttctctcaagagcgtctttgggtcggtgactcttgtgcttggcctttggaagaactgtcatctgtgcaaaatgtctctatattgtgctcccacaagcagcatgtgaggcttgtggctgaagccgtccacgtgtttgtggaatagactttgacacagttgtctcacagcagcccctcatggctaaccgtgtgtacaattgcttgtacctgctggcttcttacatgtgtacatctctttggaaaaacacctgtcaagtcccttcctaggtttaaattacctgtctttggattactggcttttacatgttcaaaatgcaagtccctagtcagatgcactaatcaacggctcttctctcccttcttcacaaggcgccttacagcagtggttctcaccgtgtgggtctcaccgtgtgggtctcaccgtgtgggtctcaccgtgtgggtctcaccatgtggttctcaccgtgtgggcctcaccgtgtgggcctcaccgtgtgggtct

SEQ ID NO: 26422 - DNA, 1649 bp, Mus musculus
tctcatgactagatatgggacttgcggtgggactactgcccacatcactgagagtactgcatcatcagcttggcctaagcaaagagcaaaattcagaatcagtttctgatgaacttatctggcttgcaacctaccatctttagttgccttccctaagcttcactatagggtggctggcctgtgcacaggcacatgggccagagggcagccacacagaatccagtgtggcaaacctggttgatagctctgggctctctcctttagatctgtctctggctgcctttgcacggctgaaataatggccctggtctctctctgctttaggcagctggtgtctggggcagacacactgaaccttgttgctgaaatcctcaagtctatcgacagaattagtgaagttaaagatgaggtggactcttgagacgctctacctgccaccgggtcccgtcacctctgcaccgaaggcaccacacatcttccgaatgtgttcctgtctatgcagtcctcatcaaagcatttcacggcctaatcatgtgactggccatctgcagtacggggctcctttccaccagttgaacctaacagtttacatgaagtcccactgttcgatagactcactgatttactggaagacacttttataaaaccactaaagctgaaacgacagttttgtaacaagcttctttcaccaccctctctaggacgaggtcgggctcagcctcagtgttgtcaagtggaacacgaagtgagccagtgtgtaagtgagcagcctgtacagagacgcgtgcctcactgaggcagcaccgcttggtacgtgctgccgtcctcccaccaggaccataggaccaaggtcacacactgtgcacagtgcaaagcttcatacaccctctactgtgtgctgtcagctttggaaagccatttggggctgtcgattttgatgcacgttaatgtgtttgtgtgccttttgtatagtgcaattcagactggaattaaagcacacacccacctggggggtcagcaccagctctttgggctggctggctggtttttgaaggacaggcaagacataagcagctccctgtgctgtgctgaggggtcaaggtttgggggccactttcctataggttgtttttttgttttttttttttaatttattttcccttttcccctcctgttgagatcaacagctttctgatctaaataaatcttaaagatcatttagactgtcttgtcatttactcagggattcatgcttgagagctaccctgctcttttaacttcaaggtctgcatctgaagatattcctgcagggtagtggtggcgcacgcctttaatcccagcactcgggaggcagaggcaggcggatttctgagttcgaggccagtctggtctacagagtgagtttcaggacagccagggctacacagagaaactcgaaaaatcaacaaacaaaggatattcctgccattgctgggttatcggaccctcaagttcttgacccttggagtcaggcattcacaagagccactacatcaacatatcacaacatatcacatacatatcacaacatatcacatacatatcccaacatatcacagagccactacatcaacatgccggatgagccacatcctagcttcacactaagg

SEQ ID NO: 26423 - DNA, 1210 bp, Mus musculus
tgcttacgctggaaaaacatggtggtatctgtgactgccagacctcaaggtatttcatgtccatctgtcctcctcatcatgtcctcctcatccttggtcagagtctcttagagtctctctgaaaatccacagcatgcctgatgttggggacagaaagcattccatactagtttcttctctgacatcctttgacctttaattgtccaggcctttacctgggaagaatgctaagctaaacaggcaggctgctgctggctatctgaagctgggcatgtgtccatgtgaaaccagtcttcatttagaccagctggttatttgtccaggcctaggaagccctgagtgagagacttcctctgtgaagagaggagaaccagtttcctctggttccaaagtatctcatggagagcttcactgtgggcagttgtggctcccagaaggccttcacacccaagaaagaggtagtggtagtgtctttgctggcatgaagggcctcagtgactgagttgttatctggtgtaaaccatgcacctgctattgtggcttatttcctttcagagacaccaccatgtatgctgtgtctgctgacagcaaaggcttggacactgtggtggatctgttggctgatgtggttctgcacccccgactgacaggtgtggctctgaggctgggtggtcaggaggagctttggaagggctataacttcctgtggggaggcactgttagagccgggcactcatgtgccaatcattggagagtgccagtgctgaaacaagcctgcagtgttctacacaatgtttcatcctttaatatatctaaacgagaccttaaagggtttactaaagttctgctcagaaatgtccctcatcccgtgtgtaagcatgaatgccatgcctacagaagtttctcttgcctggtctcctttatcctccgagtctttgagtcctgttaggatgggagagggcgcagcagctagccctgccagctgctttttgcccagtttcacagcagcctggccgcatgtctccagcggaggaatggagccctgactcagggggtgtctggttcctaagtgttaccacagccaccttgtgtcctcacaggtgtgttttggaacagacagcaggtgaagcagcagagcttggagcaggtccaaaggtctgcagaacagaaaaagacaagaggccgggggccctaattttcatctggcctc

SEQ ID NO: 26424 - DNA, 2320 bp, Mus musculus
tccaggcctgtgatttttgaggatgtggggaggcaggtgttggctacacattcaagaaagctgccccacgagctatgtacactcattcgtgagtatgccctaaagcttggcttgggatcatttgagactgccctgatgcaaacagacagacggatctcctgttgtctgccataccacaatccccggcttccccaaagtcctttgcaagctccatcctgtactaataggctcctcagccttgggaaggaggcatctggtcactgtttgagtgcacacagtttgagatggagttggaaactccactcttgccctcactgtcttttactctctgttgtaggcaacgtgaagccagaagatatcaagagggttgcttccaagatgctccgtggcaagcctgctgtggctgccctgggtgatttgactgacctacccacctatgagcacatccaggcagcgctgtccagcagaaatggacacctgcccagatcataccggctgttccggtagagtcccttagagctggctgtagagtgcttgtgtgcatgttactgttggtgtagacactgcataaggctagctagctgtgtgaacagtgccaacagtgaaactctggaaacttgaatgaaagttactgttgccactgcacttttgtgtctttcaaacacaagtggcttatttttcatctaacaagtatttttcctgagtatctgccaaagcaggtgctgtctggccactagatgtttctggagcaaggaaggctgggaaagattagaaagtcttgggactctagggagacaaagcgccacactctgaaagcacacagggcctacccattggtagaaccactggcataaattgtactcatttttttccccttcaaataggatctcacagtaaaaccctgagtggcttgagacttgatataagatatactcatctcaaactcagagaccctcctgcctctgcctcccaggtgctaaaattataggcaagtgctaccacacctggcctcatttctaaagcttaagttctttaacaagcctaaaggtatttcacaatcttctcctttgttttttgagataaaatactaattagccctggctggcctcacagtgagcttgtctttgcctcagttactggtctttctagtaagagtcaccatgccagttgtatctcacaattatttacaagtccagttttaatttcccacttcatctgcactagtttacgtgtttaacttttccaactgaaatgccctctaaatgtaaaggctatctaaatgtaaattgctatggctgtactttgccccccgacccctaagactttatgatcttgatcttgggccaaactgggaagttccaggattacctcagtcttttctaaggtgccagagaatgtccacaaagaagcaccaaactgctgggctgtggtagtgcacgcctttaatcccagcattcaggaggcagaagcaggtggttctccaagttcgaggccagcctggtctacagagagttccaggacagccggggctacagagaaacctgtctggaactcttaccacatcaaaccttattcaagccaggaatagttgaggcaggattatgaagtccagggcagcctgtctgggagagaaaaggctgtcttcccagtagaatttgcagttcacagtggtttattgaagcaggtgactttccatattggagaagctgatgctgttgagtttcaccttattcgttggtttattatggttcactggagtcccaagtcgtcactttttccagctattgctgcttctggctgtgagcagggacagtacctagcagaaagacctgggatgggactgagtagcaggtgacagctgagaccaaatgtttggcctttgacttctatgtccttttaaaaccctggggtgtcctgaggccccaagatgcatgcagacttcttccaaggttcactctttggccagaaagagtttacaattgaatatatccttatttatttaaaaatataaatatggaaaaataaatgatttagaagactagagtggatgcccctaggtgtctgtacattcaaggctatgtctgaaggggtggggtaagattgagagcaatgatgctcctaagctttcttcaaggagtgaaacccagcaaggtgctgtctggtaacaatttctcatgcctttccgggactagcagcacaaaagcaaatggtctgaagctcctaaaaactatgagtttaatatagctaggcttggcctgtagagtggagaggtccctactcaactgggggttgggagcctgggaccaggatgtagaacctc

SEQ ID NO: 26425 - DNA, 1750 bp, Mus musculus
gcagcgtccttgtgctttcaggagtagaaaattataggccactggccacccttgcactcagtgaacccttagctgcccccccctcccccccccccccccccgctctgtagtgctaactcagctcttttgaccttgacagaattggcagaacaaaaacaaatcatgtctgcagtgctgtgggctaggaaatgctgagcagcaggaacttggcacatacagaaggtcttgcttacacttgaagctaacacagagtctgcccatttgttattgatctgtggggttatcctgtagctccatcgctggacagcctctgggcatggacacatgtaggtcattgctgttccttttgttctaggcttctgtcacctcgggaaattcaaggccagggaggattggccaaagaaaatatgcggcattgaactaggattgctgctggattcttatttggaaccctgagatgattagataactgttcttcaccaagaaccaactagctgcctcaggtctcgtggatcccagatggacatggcagtaactcagagccggtcatactgtgtgtctccttccttgcagcctatgtatatgaatgattgaaaaattgatttcaaggttcctttcaaatgctggatagaatgaatctaattcaaagtcttttatgtaaaagaacaatgtttcttttttagtcactttagacaaattaaggtttgagccacttgagaatatccccgcagagaggctaggcagggattcactacaggagagcacagttacttggacaccaaggcctttctcacctgagaaatggtgcaaaccaaccagggatccttaggctactgagaaggctgtctgcttacctggagaggactgactgctgggatgtctggcctaagaggagcctcaaactgcactgggcaactgtgccttgtcctgtgaactggggagtacatgccagctcctcaaagggtcaccagatggcagcggctcccaggctggggaggaagtggttacaagggcatgtctctccaacatttccagcctcactccattttctgtggcctcattagtgctgggtgcgttttttttttgctccgagctttccgtcatggctcagtcactggggagagccccagggagctgatattctgaagctgctgatctgattaaccaggtcaaaaactggctgtgtgctgcaacgtactgccctcctagccaggagtctgtatggagccctctagctgactcaatgtcacctgcagacagcacttaaagccttggtggtatcttggagtggcttacggtgtcctagcgcacactctggaaccttgcatctctaccccaaagcccaccagggaccttcagcagcgactcactggctcacccatatcacttcaaggagctgccaccacataagagtcaaagctttaaggcttcactgactgttcctaaaactatccttacactctaaagaggaagggaaagagagttaaatatttaaaaatcagcaggtagaaaacataaatggtttgtttggtattaaatttagaaattgtagaacatggaattagtacagcccttcccggttttctggttccttgcatcatctaggaaagactcacagaatggcttccaggacgttccatagatgagtgtacttggaccctcctgttcctgtcattaagaaaggcctgtccctgtgggtcagtagcaacttgtgtccttgctgggaccaggcaggacccttgcctctggt

SEQ ID NO: 26426 - DNA, 1166 bp, Mus musculus
gaaaccaagcccaatagtcaattctgctgtgcaccctcattagttcttctgattcagtgggaaccaaatttgttggatgttggaggtcgaatagcgctcaactgaatttgactctccctctcattgataggtgggtccagagctcgctatgtggatgttctaaacccaagtggaacacagcggagtgaaccagctcttgctcctgcagatttctttgctcctctcgccccactgccaattccttctaacttatttgtaccaaacccaggtaggcagcccatgtattcacccggcttcttgatcagtttccatctatgagcctgtggccctagtcttccttagaagaataactgggccaaggtgcaaaggaccaaaggcttgtatatacttctttggcaattggactttcctccctggttgaacccttacatttggactgtttggacagattgtcccagacattgggctggggtgatgacttcatgctccctcattcacagatgcagaagagccacaacctgcagatgggactggctgtaggggacaggcaccagctgggactcagtctaaggcagagtccaccctggaacccaaggtatatacagtgctgtagaaagaaggtgaggggctccctgtatcctttaggattcctttgccccctgcaaatcagtgtcaggtgtgtcaggtgatgactctggtcacattgtctatatttgtttggtagagacattagaaggttaatgcaaggcctgaggaaggcactcaaggttcaatttggaaagaagaaaaactctaaaggtggatggggttgatggctgttttaacagtatcgtccagccgggcatggtggcacatgcctttaatcccagcacttgggaggcggaggcaggtggatttctgggttcgaggccagcttggtctacagagtgagttccaggacagcctgggctatacagagaaaccctgtctcgaaaaaaaatgaaaacaaaaaataaaaaaaccagtatagtccattaatgtttcttgctttgaagtggtatgggtggtaattctatgttaaacatattttaccaaagtttttaaaatcagaaaaaaagttagaaaacaaagaattaggtagcagtacaaaaagtaaagaagggtaaaaaaagcagctgaatccccac

SEQ ID NO: 26427 - DNA, 1643 bp, Mus musculus
ttttttagtatttatttatgtacttttattttccacagaaacactgcctttttatttatatgtattgttttctatggcactagggaaaaacatatctgttccaagaaaataaactagttctcagagccttgattttcctggtcagggtgaagttccctgtgtgtctgtaaaatatgaacaaggattcatgatttgtaaatgctgtttatttattgattgcttctttccaaaatcgaaaagaaagaaaaaagaacgtgacaggagaagggaagctggaaactgccatggccagaattgcccctcccccacactcactgcccctccccccagcgtcacctgggatttgcagatgtgtttagaaacacgcccagaccttgaaccttgggttcatggattagttttgtatctaaaacaggaaacaagtcagatgatgtggtttgtacactttctgtaaccaccagtgtggacttgaagaagtgtcctcagcatgtgcagagtctactacccagtaccagtcgtgagtctgcaggctccagtgttctgtagtagtgtttatgggccttgggagtacttctcccctgccctgccccactgtccccttcctgacaacttgagccagtaagccatgcagggtgtggtgcctcctagagaaaacactgcctggactgttctgtgcatccctccaaacagcatcatccaaatccaactgaggacagacggactgtcccggcctgggcctgggctcctaacacctgactgccaaagggctccaatgtgcattgtggactcgccagagtagcctgcattgagactccaagaaaacagaagctatgtggcctctgatccccaaactggcctgggtggggacatgccttgagtgtgctggaatgtgggtggagcctgcttctgggccacccctcctggttcagggctgtgctcacagcagattcttgcagtatcaagtatacgcctgtggcagaataagtatctgtaaatacatgtttaaagatggattttgtttaaaaaatctaaaggaacaagtgtgtcgtgtgtcaagctgatgaggactgtcagactgtggcttagctcagtgtgacccagaccttgtgacctgtagctgccgaaccagtagctcctaagagcacaacccaggatggcccatctgctgcccaccaagtccctttccagccactgtgtgctgggggctttcgggggcagttgcccacctcctcagggcagctctttctggccttttggggggcagtgtctgtgccatgcctaatagatatgaccagacgcatcctaagatgttgattcttactgtgttgtataaaataaagtgtagtttacaaaaaaaagaaacgtaaaaaaaaaaaactacatgcaaaactgtaggtaatgaaaatgatgtatttttttcatctttttttgttaactaatttgcaataaaaatgatactgatggttgtccacattttgctaaacttggagtgtggtttggttcactttttggggagtgtgacagagaaagggccacccagcactgaaataaccaaatccaaaccctctcttacacagaaatacagaggttgccataaggacacaccattttcagaagctgcacagcgcagggcatcaaggtgg

SEQ ID NO: 26428 - DNA, 1130 bp, Mus musculus
gagattcctagcaacataggaaggccccactataaatactctctgagcctggtggtctaggatgcttgggtctagatagatctctccagataagagaagagaaagaggcagcacctgcttccctagcccctccccccaggccatccatcatcaatgactcagcaaattctacacctgcccgctccctcatgtacctcctgtccgtgtcctacaggaggagactcccctgttcctggccgcccgtgagggcagctatgagactgccaaagtgttgctggaccactttgccaaccgggacatcacggatcacatggaccgattgccgcgggacatcgcacaggagcgtatgcaccacgatatcgtgcggcttttggatgagtacaacctggtgcgcagcccacagctgcatggcactgccctgggtggcacacccactctgtctcccacactctgctcgcccaatggctacctgggcaatctcaagtctgccacacagggcaagaaggcccgcaagcccagcaccaaagggctggcttgtggtagcaaggaagctaaggacctcaaggcacggaggaagaagtcccaggatggcaagggctgcctgttggacagctcgagcatgctgtcgcctgtggactccctcgagtcaccccatggctacttgtcagatgtggcctcgccacccctcctcccctccccattccagcagtctccatccatgcctctcagccacctgcctggtatgcctgacactcacctgggcatcagccacttgaatgtggcagccaagcctgagatggcagcactggctggaggtagccggttggcctttgagccacccccgccacgcctctcccacctgcctgtagcctccagtgccagcacagtgctgagtaccaatggcacgggggctatgaatttcaccgtgggtgcaccggcaagcttgaatggccagtgtgagtggcttccccggctccagaatggcatggtgcccagccagtacaacccactacggccgggtgtgacgccgggcacactgagcacacaggcagctggcctccagcatagcatgatggggccactacacagcagcctctccaccaataccttgtccccgattatttaccagg

SEQ ID NO: 26429 - DNA, 1497 bp, Mus musculus
gggctaccatgaccccacgtgcctgtccgaggtcaacgagtgcaacagtaacccctgcatccacggagcttgccgggatggcctcaatgggtatggcagactgacctgggagggactagctgtagccttgggcagacacaggctgggtgaatgggtgctcctgtgagaccagtgatctgaggtcagcccctagtgtcttcccagcatccctgggctgtatcctcattggctagcatcagctcaggatatagactctaagcacactgtggctgctgaaacagttgtctgatactgtggtgacagcagccctttgtcagtgtgtgggggacgaggagattactaaggtctccgttaaaactattaaagttttatacagagggtcagcattgtcaaggtggcattgttccagtctggaacccttgcacggtcttgggccaggtgggtacctccagcccagtggatgatgtggccttgtcctcagactggaactgtagtttagcaggagagctctgagcccaggctacagctcaggcctctccgtaggtacaagtgtgactgtgcccctgggtggagtggaacaaactgtgacatcaacaacaacgagtgtgagtccaacccttgtgtcaacggtggcacctgcaaggacatgaccagtggctacgtatgcacctgccgagaaggcttcagtggtaagtgtggcgggtgacacagcagaatgggtcctccctttggtctctttctcggtccacctgatgagctagcatttctcaggcagagatcctagttctcttgaggaaaggcatagggcagaggctctggcccacctcctcttgctcaacttccttacaggccctaattgccagaccaacatcaacgaatgtgcctccaacccctgcctgaaccaggggacctgcattgatgatgtcgctggatacaagtgcaactgtcctctgccatatacaggtacgaacagccagggactggaattggctctggtggtagctagtggagctaagagtatatgggcttaccaggcactgaagaaggttctgttcctcgctgagggtcttaggtcctcagactggaactgtagttaagcaggaaggctctgagcccaggctacagcccaggcctcctgggcctggggatagtcaccagatgggcaaacacagaggatgcctaggaggaagctccaggccgtgtgtccgggtgtttatctggtatgtctggagtgaggtgagcactggactcctccagagaaagtctgggaggctgactggtaggtactgcatggatcagggtccactttgcctgtgcctctgggggccctggctgccctcctctgctggctgggcctgggattcctttgatggcagcttctttgtgtgaggagacaaggagccctctgttagatgaacagaggcagctcctgccatgggcactgcctgaggaatggcgagaaatagaccccctgcaggagagatgtgcattgaacat

SEQ ID NO: 26430 - DNA, 1097 bp, Mus musculus
aggcagtgatcctgggcctgctcggtggtttgccaaggtgtggccaactaagtgttgagggagtaactggccctgaagctcactaatgtccacctttcctgccatctaggttacacagggacccactgcgaagtggacattgacgagtgtgaccctgacccctgccactatggttcctgtaaggatggtgtggccacctttacctgcctgtgccagccaggctacacaggccatcactgtgagaccaacatcaatgagtgccacagccaaccgtgccgccatgggggcacctgccaggaccgtgacaactcctacctctgcttatgcctcaagggaaccacaggtgactggccggagctggcagtgggtggaaaagggtgaggccaggcttggaagctgaccacatgtcatgctgcccctagggcccaactgtgagatcaacctggatgactgcgccagcaacccctgtgactctggcacctgtctggacaagattgatggctacgaatgtgcctgtgaaccaggctacacaggtgagtggctgaaggcagaggtcagggtcatccctagagtctgggagggactgtggggctagccagggtccaagggctggatgtcacaagctgggtgtcaactacccagatcttgatctgccaaccagtagaggtatctatcataaagactgggtggcctccatatgcctcctttcccctgtcagtgtcagccctggccatgccagacttaaagccccagtagcctgaagtggggtggccagagctccgaggccaggcttttggatatgtgtttagatctgataaaatccttagtttctctgagcaccgaggacattgtccaccagaggatagaagaggatgggtggtctcaggctgaggtaaagctgggctgcagagtgactcagttggtaaggtgttgacctagcatgtgtaaaccctgggttcagtcctcctgccatgttaaccagatgcagtggcatgcatacgttgtaaccctagcactctgacattggaagcgagaggatcagaagtttaggtcattctcagctacatgtgagtttgtggccagactggatcacatga

SEQ ID NO: 26431 - DNA, 1238 bp, Mus musculus
tgatgcatattcatgacagaagctgggagagaaaagcagaccagcctcctaaatgagagtttcacagagtctatgtcgacatccccccacagggctggggggagggggctctgctgcgcctgtaggctcacttcgagtgtagacccagatttgaaatctgcctggtttgaaattcaggctggtcttgtctctagcctggccccaattaacagtcattattatttcttttttattgaggtgaggttcacttagtatgtgaaagtaacccctttaaagtgagcgcctccatggcatgctccagagcttacgtcatcccagaaacctctgcccagcaagcagccactgcacctccattctagagcctgattccagttgcacccactgcccaaggtcgggtagcctgtggccatgagagatgagggcggggagctgactgccctacatgtctgtcaacagctgcagcggagcctttgtgggccaacgatgccaggactccaatccttgcctcagcacaccgtgtaagaatgctggaacgtgccacgttgtggaccatggtggcactgtggattatgcctgcagctgtcccctgggtttctctgggcccctctgcctgacacctctggacaacgcctgcctggccaacccctgccgcaatgggggcacctgtgacctgctcactctcacagagtacaagtgccgctgcccaccagggtggtcaggtaagggctataggaggttgtgaacttcacggttgggacccttaggcctgggcccaaggaccctatctttgttgacttgacatactctggtacactaaactttatcctctcctggatcagagttaagctgggatctactatccagaaaaatcttggggattccttgggaactctggtccttttcaaccccaaactatctgatttttggctgccctgttccaggaccccaacctctcactgtttctgtgcgtaaagaatgagtcctcatgtagcccgggtcttaccatctccttgtcagggtgcctcaggtttccattgcttctctatgtggggtccaggagacagctaggtacaaattttagactgccattcctactttctgtccttgagcagtcacttagtctcttatgacttacagtcctctgtatgcagaaagatggccacattctgcaacagatactgagcatcatgaagataacactttagatctatccctggttggtacctacatgatgtcca

SEQ ID NO: 26432 - DNA, 1176 bp, Mus musculus
accaacctctgccctccagatacatctggctctaaaccagaaggagagagggagcaagggactgtgccctgttaaggttttctagtgtgcatctgagtaaagggccaggatcctttcctgctctgcctatgcctatgtcaactggtgagaactcttttgacacattgtcacattgacaatgtgttgacacattgtcttctctaagttatcttccctgtccctttggagcttcccagagatccgagcagctgtgacttaaagatgaggaactggggtgggggcgaatctcaagcagtgaccactctttcatgagggtttgggatctgtctacctgtccttgcataatggggaggtctgctctaaagacaagatggctggaactagctgaggctggcaggcctgaggagaggtcccaggtttcaggcctagggaagccatggctgtgtcatcatttgattagcagtcttcctctccaaggtttcagtttcctcaccagtgagaattgctcttccactgctgggttcttgatggggcaagcattgcaggaagccacttgtatggggacacagagcagcaagagtttcctgggactgggacagtcggagtcaggggttatggagacatcgtattagtttggaaagagaaagttctgtgtatagacagaggctgtagcactccaatattggtgccttcacatcctgagtgcagacaaatggttacaatggacttttttttttaatggcatgtggatttcaccataattaaaaaaaaaaagtagctttgaagaagcagtatgcatctgctgcattgtgtagagatagctataacccgttagggaccctttcccttaggactgcagggccccttttccttaggactgccagggccccaggggtggggtataccaatgtacatgtagaatggagtatgttggagtccacctcccctgctctgtcacagtaaagaggacataggcctcctctgccttatagccaacgcccatgacagtctgttttcaatgactggggctgagtagagaacaagtcgggtaccctcgatgggtagggagcagggctaatttgctgatttgcccccaggattctgtgtgcccaagtgtcctgtcctgtgcctgcctgctgttccttctccccagcttgccctcccttctctagggag

SEQ ID NO: 26433 - DNA, 1198 bp, Mus musculus
ggcacaaaaccagccattacaacctcaaagcctctctttggggagatgagtggagcttattacctaatgctccagctaccttgatgtgagatggcttttcaaactgggtatctactggttgctagctggtacgggctggagtggagctcagtggtgctcacttggctgcacacaggcctgagtctccatccctagcaccatgggcaagtgaaactgataaggggaaaagacgaagtgcctgatggtaggtccatgcagcaccgagatttcagaatgaggaagcatggtggagcatacagctaacagtgacagggggtgtcataaagcataagggtaaagggactactgcttcgggcctccagaggtctgggggtgcgacacttgtggaaggtctacattgattgttttctttggtacaggaaagttggtgactaaagtctgcttatgccaaatgcccagcaatgtccagttgaggtaagaggtaggctggagcatgctcagatgggatgtgagtggctgccctaaagatgctgtcctagatcagcaccacaggcatggcacagctgctcagctgagcctgtgacattggggcaaagagcaagtggctgtttctacgctcagtgctcagaagcccgtgagcactaagaatggtttgtagcctgacattttgcagagccgtggtgggaaggcactgggttttgctttgatgctgttggccagaccccagtgtcaaacctctagggctcaccaaagggttgcatggtcagcattttagggagatagaactttggaagtggagggagatagaaattaagttttctaggagacatcctgagggactggaaaaatacaagaaactctccattcctttcatcttccagatccaggagccaggaagaaggggggctacttggccaacatggctgatcacgtgcctgaggtatgccctctgacctcaccagggtaacacagaaccatccatacaggccttgggcagctggaaatttacactggtagctctcccatgtcctaagttaggaactggatttggattggcttgggtttgactcttatttccaagactggtgaggtaaacactggatggaggaccctctaaggctcaacctctctatctaattgtatatggccttaagagagataattgagttgggtggtgataactggtcacttgagttca

SEQ ID NO: 26434 - DNA, 1198 bp, Mus musculus; identical to SEQ ID NO: 26433

SEQ ID NO: 26435 - DNA, 1170 bp, Mus musculus
ggcgccagaacctgcgcaagaagaaggcagctcgggctgagcgacggctacagaaggcccacaagaagggccgggtgcttccccaggacctggagcgtgcaggcctctcctgagcagtttgcacctgccaagttcctggctcagccccttccctccatctccatccttgagggttgggatggtatgtggtgctagtgcaggtctaggcaacagactgggtctcctgtgtgaggtcaacacagttcttgcaccccacaaccatagtgagatctctgactgtgtgcctggttgtttcatcagcatctttaagaaggaccgtgtcctccaggccctgagagggatagaggggatctcccatgtttggagaggtgtgtctacgtgtctgtaagtctgcgtgttctgaactctctggagtcaggatagaggttacagtgaggcaccctcaccgactctttcctgcccacctgcattcccagtggccgtgagcgcacaaagccttggctacctgttctgtatttattagtccctggggacagagagagcccagggagttagtgggagaatctgatccagtcgggtatgtctctgtgccagagctccggggctgtctttgtgttggcatccagctcaaaacctggagtccttcctgagtccacaggatatgcttgctcacctgtgagccaattggtggctgagacttggggttgtatgttgcctagttttatgtcagtttgacacaagctggacttgtcagagaagagaggcctcagctgtgagctccactaccttgttctgtgggcaagcctgttgtgcgcttattaaagatgtggtagggagcagttcattttggacagtgctacccctggactggtggtcctgggttgtttaagaaagtagggcaagctagctgtggggagtgagcccttaagtagcactcctctggcttttgctttacttcctgcctctaggttcctgtcctggttcccttggtgacgtaacccttctctccctcaagctgcttttggtcatgttgttttgttttatcacagcaatagaaacccaaagataagtctgtgcttttggaggaaaggaggcagggcagggtggctcctgggatgctggctaggctgaggttgtgagtggagatagggctacttttaactaggtgac

SEQ ID NO: 26436 - DNA, 1285 bp, Mus musculus
tcatggagctggagtctcctggtgtcagacctatgttagtctcagaggatagcagcaggcaggatctgtcacatagctctctacagggccacttagaatgttgatacctgaaactttctgatccagagaggccttgagaaatcaagagtccagtgtaaaatatgtcgtcggaaccgggctggagaatggaggccttgccccaccccattagcttgaagttaaggttccggtcagcagcaccctgcctgactccccctggtggtaggtttgctcctgctgctgctgcacagaagctgcagtcaactacagatgtccagtgctgcagtggacatcttgttcccatcttagactcagtgtcactgccaagcttcagtagttctaaagttctccagagagttctggggttatctttggtctcagtgttcatcagcttagcagaaaagtgggagtatctactgtaccccaaagtggcagagacttagaccaacccagggtgagttcctcacatcttcctgtcactaccttgtagtacttcaaggacacttgagcggatgagtactgggacagtgactcagtcctgtacaagggttgaggggataaattgctcagataggaacccagagtgctgggtttccaaagcctcggcccctctgcatcacgtgcatacgtttctgggatgatctgtgtcctctttgggcaatcacctctctcatattcctcatggtaaagcagctgccccatgcctaggaatttccttaaatggcagagttcttcggtaggtgaggcagtaggttttgtctgcccctatcagcctcctgcccacaccaccaccagttgcccagcttcccctctgcatggctactcttgcctgtatacgaactgcttgctctttctggctttgccttccctccattctcctggggatgctactccctttgtcttgggtagttctgcgagagactgctggggacaggcatgggagaaagctagggccttgtgcatattagacagctgtagaaacagatgtggtccaagtagccactgctatgaccactgaggcattgtgcttgcctcctcctgtctctggctttccctgtgtaatgtaaggaaatggaatgtgtaaagcctggggcttagagctgtagagctagagtagtggtatatagagaaatgctcagacctgtattgctgactgttacccagttaggccaggaccctgtagggatggaaacaggtctgccaccaggagctctttgtaaagtctcatcactaccctactggtaag

SEQ ID NO: 26437 - DNA, 1168 bp, Mus musculus
agaaaacaggaagccctttgttccggagaacagcccagaaaggaatcactggtattatcgagacctggaagctatggccaagataacaggagcggaccccattttcattgatgcagacttccgtatgttgtggtcagcctgctttggggagagcatgcactattggatagcgttttagaggagaatcttagtatgtggtgtggagactgtttttgtggtattttggcgaagaatgtagctaccttttgcctgaagtcttcctgaggctaaggcaaagaaattaatattaattgcattaacaaagtctcaaaacagcccagcagactttctctggttgcacttaggggtctgacagagctgactcctgtctccacagacagcacagcccccggcgggcccatcggaggacagacgagagtgactctgcgcaatgagcacatgcagtacatccttacctggttagtcctgctgcctgctaccccctccacccaccccaccccgcacaggctataatctctttcaaccacaggtacggactgtgtgcggccacatcatatttgtggttccaaaaatttgtacgtcggacacccatcatgtgaagtaaggagcctgttcccaacaaccataaaataaagatcttgctatgtaaaaaccatggctcagtctgaaaccgttttacagggcacactcgcgccaacccaaataaccaaaggcagtcaagataattttgtaattatatttaggtacagaaaatttagtgtacatttaacccaatttagtggcgagttctttagcctttgctttttccagcttggcaattcgagccacagacttaggacccaggacgttgcctccccagtggcgacggatctgaaatgacagaagcagtagtcgttagcctgtcccccttacactttaaggcatagaccaatattttatgtatcaatcaaaattaagcctgtggcctatatactcacctcgtcatatctgtcattataattggtcctaatagcttccaccagcttagccagagcacccttgtcttccctggaaaggcaatgaggaaggtctcgttactgtttaagaagcaggagtaataaacccttccctccctgcctttttgcctcagacaacagtgtgaccacatagttgattcaggtgaagaaat

SEQ ID NO: 26438 - DNA, 2512 bp, Mus musculus
atacacagaatgatactttactcagcttatgcttctggaggcagggactcccaaggtcaaggtcacatctagtgggtcttgtggtaaggactctgtagattaccaagagaactcacggtatcccaagcttctttttatgggctagtcactcatcaaagtcttacctggcaaacatcactataggatttaggggattttccaacatatggcattcgggagagtacatgtaaggccatagcacctttaatacagaactctttgtaagtccaatattctgtattgttttagggtttgtgtgttccaggactctcactaagtcctggttatgtgagcctggctcagatacaagtgtgtccagcgtttgacctttagtctgaatgtcatttctttttgaatctgtgcagatcatccagaacattgtgggcacagctctgatgatcttagtagccatcggttttaaaaccaagctggcagctttgactctcgtcgtctggctgtttgccatcaacgtgtatttcaacgccttctggacaatcccggtatataaacccatgcatgacttcctgaaatacgacttcttccagaccatgtcagtgattggaggcctgctcctggtggtggctcttggcccagggggtgtgtccatggatgagaagaagaaagagtggtaacacacagatccctcccctccctggctgaggcacagggccctggcctggttcagggcagagtcaacaaactgccggcgtttgtgtgtccttctcccttcccctcccttggtaaaggcacagatgttttgagaactttatttgcagacacctgaaaattggagataaaatctttggaaatagtctggagtcttgactgtccagggctggcgagctggatggtcactccttagccaaggcttggaggagacagcgtgctgggctgtggcctcattcctcctgtctccgagttccttttggggaagtcgtactgagctgtatttttatcattcaaagcagtttcccttcttagttttgagtttacatccttagctcaaactactaaatgacttaggatagtccagccaaacaccaaacggttaaacctccagttcagaattctaccagtggccccagcattgcttctgcccctgtattttataggatcagtgaagatgttagagaaaccaagtcaagagaacagtacagtattggaaaggtgggtgttactgctgtcccaagtccttgatgttagctagctggatgctgtttactgggtgaaaggtaccttgggagttttcatggctccaagcagggatgggatggggtaagcagcaggaagttcttagaaagctgctatccctcaagcttggtggtggaaagggcaggagagcaggctgctcacaggatggcccacacaaccaccatggaaccagcctgggaacagcgatgccatggggcccagaagtgaggagtcccagtactcaagacacccaggctcaacccagttacctcacacttgaccttctcagagcaaggcctgaactccacaggttgtggtccccaacccccagcttaactccctgttccaggctgagccgaccccgtcgacagccctgataccaccattcccctgaggctgttgcttgctcagatttttgtcaacttgctctgctgtatgcagccaagatactttttacaatttgtgatgccttaccaatttgatctcagtcctgtatttaaagttttctaacattgccttacaccgtgtttctctttttgggggaggggtggggtgtctaatgctgtggtcttgctcatctgcatggtagtgccatgagggtagttgggttcctcctggatctctcccaggtctgttggagagaacagacagacttagaacccctggagggaagctggcagcttacctcacccttgggtacagagtcttggaggtcctcctttctggcatcagctgggtaggcaggactttgttctctgagtcactttgggtcagtcccttgcctcgctggctctgcaggctgaattcaccttctcaacacctagcccatgttttcctgcagccttatggcctgcctattcctcccaagtgagttccagcactggctcaggccatgctagttctttaccacagagctgcctcagtgcacagccacctgcagtggcagccccatgacattccagtctgtggagtggggcagaccctgggaggcaagtgcatgccgtgcagcagaagccctcgtcccagggttacttagccctttgaccagcctcctgtgggttctgcctgggatgggaaccctcatcccaagggtacttggcccatttaccagcctcctgtggggtgcgcctgggacgggagaaaacaatgatacacatattggtttggcaaaagttttctgaagatgctttagctttatgtgggaataggtataaacctcatttttatgctgtattttatatcttagttgtgtttgaaaatgttttgatctttggaaacatca

SEQ ID NO: 26439 - DNA, 1238 bp, Mus musculus
gcatgtgagctgcgggaacttcctcctgaactacccagggcctaatcatccagcacctgtgtgttgaggtagactggtcagatacagggcagaagtcaggggtgtaggttcgaggaaggagaacatcattggaatggaggagagtgctgcagagtctatgtctgctgaccacctgtgctaccacttaacaatgagcatagctggtctcagccagggcactcagcaccttcccttaaggagcaagaagcgccttctctgtcaggtaaggggataagctctgctggatccaagggatccaggctaagggcgttcagtctgctgcaaaccagtctggccagcacagcaaccgcccattgaggactttcttaaagctactgggctggaggtcctttcccactcctttgtcctttgcttggcctaagatgccaatgccccgccatgttttctccagagagtccttggggtgagccttggggcacaggtacactcagaggtctgagagcctaccatgtggaacagtgtaagcagaaaggccatcttcccactgtcctgccagcagctgttctgggtagcagcaattgcagagtgaccagtgaactttatggacttagctgacaactcctagaacatgtgcacccatgcatatgatgacagatgtctgcttttaatgcagctgtggactgaggtgtggctcagaggacacttgttcactaagtgtaagaccctggtatcctttcctagaactgtcaaaaataaatggatggatcaaatggagtgtgtggaagttcatgttttttcccatcatcaaggcaggaccactgacagcaggccaggcatgccagaaacagcctagggcttcttttattagtcaccatggggtacgaaattaatactggacctagtgatactttctcttaccacaggaccagaagggcagcatgtcagggcctgaagaggggctctccctgcagtggggcttcctgccctgcaggaggctcaagctgatcctcctggaggccaggttgtgcatttgcttccagtacctggagtatctcatcagcgtaagaaatcagctcctggaaggaggaaacgagaaccatttgctacagtggcctcaagatccgggagcaattactttgacgacataaatcctactgatgggatctttcaggtggtctggctgcacttcccatttgggattggattcagcccagtcacagggaaaggcatcatgtgga

SEQ ID NO: 26440 - DNA, 1099 bp, Mus musculus
atgtgtgagagcagattcagctggactgagtgtggagtgtagagggggagccatcctgccagaggtcctttcgcgaagcatccatctgtgtcctgggtcttttcacagccaggcattctcatctttgtctcatagggaagacatctggtttgatgatgtggatccagatgatattgaggatgccataggcccagaggcagccatgctggtacggaagaggctggggcagaagaagaggaccatctccctggagaaggaacaagcctttggcgggtaagctgagctcgggccatagctgctggcaatgttactccttctggggctgggatcatgggaggaggagcaagcactgagccatgactgcccagcagtcatgggggtgcagaatgaggcttggctcactggcctagaatcccagcccgtgatatctattacactggggcctttggttcccctagcttgacaaaagccttggccctggattgtgagatggtaggcgtgggtcccaaaggggaagagagcatcgcagcccgtgtgtcgatcgtgaaccagtatgggaagtgtgtttatgacaagtacgtcaagccaactgagccagtgactgactacaggacagccgtcagtgggatccggcctgagaacctgaagcagggtatgactgatgtccataagatttgagtgtagtggtggagatggtagcaggactcgtttctcttcaacttccccttctgtgttccagaacatggcatggcaggggtcctgacactgcttagctcttccccagactttgcagatacaaaaggaaagatacctttcctggctgttgtgctgtttgtgtcctgggctcttggattattttctgtcttgtggcagtagggaataaactggagcatgttaggaaccaggagggaaatcttgaagagtgagtaggctacatggtaggagctgggaggacagatcacagggtctctttgggaaattagtgcagtaatggcagagaggcctccagcaggatccttgtggtcatgacattgagtacagggtaggggtcagaagactggttctgaggcaggagctaggtagggaggtagctggaaga

SEQ ID NO: 26441 - DNA, 1548 bp, Mus musculus
tggtatgatgtgctgtgtgtatgtgtgtgtgtgtgtgtttgtctggtatgatgtgctgtgtgtgtgtgtgtgtctgtttgtctagtatgatgtgctctgtgtgtgtgtgtctgtttgtctagtatgatgtggtgtgtgtgtgtgtgtgtgtgtgtgtgtggctgtgtgtttgtctggtatgatgtgctgtgtgtgtgtgtgtgtgtctgtttgtctggtatgatgtgctgtgtgtgtgtgtgtctgtttgtctgatatgatgtgctgtgtgtgtgtgtgtgtgtgtgtgtgtatcgctgctagtctgcactgagaacctccttgtcaggatggcaggttccttattagtagggattaacctcaggtattcttcccaacttgcccctggcagcctggagcctttggagagctgggcagagaccagacccaccctacacagacttggccccttctcgggtaccagagcacagagagtaagcctgcatggttgggacaaggagagctgtttcactggcacatggctccagggacatgccttgctgtcccctcacctttctctgcactgttctcttcccactgtcctgtgacaccggcatcagtggcttattagatgagtccttggccattaggcacatttggtggcctggctgaagatgatgtgtcaagtgctgagccctgcctccctcctgcactagaccttcagccggacctgtccatggaacccagccctggagtcactgagtctccagggaatccttagcttctcagggcttgaggcccagaggagtagacattcattctccttggtatagaagctctgatctgtggactttggggatagcagaagttctccagagagcctggccatgctgaactggggagtggcagaaatgtaatagtgtagctagcttagggggtcatgtgccttcaccgttcatcagaggctatttttcttgagccagagataagtttcaagggctctgtgtatgtgtgtctgtatatgttggagcctatgttctcagtaagacctgtctacctcccaggaggagaaaaatccccacctgctcctctggttacttgggtaggcatggacttgggccagttctgcccaggcctcctgcctccacagtagaattcaaaggctacatgtatggtgagattgtacttcactagggaatccattttgtgctaggcagccatggggtgaggtataaaggtggaggccctcagatataggccaatttggggtggtcagtcacttaagtcctgaggttcttggcagtcccatggcacagtggctctggagcccattgctttgactctgaccatgggcactgtccagcccagactaggcctcattcttgtctgtgtctgggtgtcttctgtggctccttttgcacccacccctggtttgtttgttgactgggttacttttggagtaaagcaagtttgtagttggtatacacagtctgcctgtcacctgtctccagtgcctgtcactggcaaggaggtcctgtctatgctagctgggcctagcctggcctgagc

SEQ ID NO: 26442 - DNA, 1423 bp, Mus musculus
ctgctcaagatccagccttacatcatctctagttaactaccaactgtcttgggggtgaccaggcttcccttggctctagtctcctgccttccctcagggatacccttttcccatacttccactgccatcagagctgaacatatgtttgcttaatccagaaagccttcctgaatttcttcagcgtgtaccacgtatttgagaaacaccaaaggaaccatgtggcatgcttctcgtcaatgggaggagtgaaggactggcgctcacttccttccacctcaccctgatgttcttgggttcttccctatacttcccctcaagggctaggacttttcacagccgcccccctacacacacacacacacacacacacacacacacacacacacagcttaggttagaggtctcttcctgggccctagctccctcatctgcaatgcggattcagtacagcttatccttccatctactccacgttgttggatttttaaccaacctgcaaggagtcttggtgatttaaatgtacaaccaaatgtgagagtcgtggatgaaaacagtgtccaggtgcatggccgttcttagtgggtggaacgatttgtctggttaattccgataatgaatgagactctggcatgctaactagttacaagagcccctcgcggtcggcatcccccaacttcttagagggacaagtggcgttcagtcacccaagatagagcagtaacaggtctgagatgctcttagatgtccagggctgcacaggcgctacactgactggcttagcgtgtgcctagggtaacccattgaaccccattcgtgatggggatcggggattgcaattattccccatgaacaaggaattcccagtaagtgctgggggttggggggagaagaaaacagtgtccggcactgagccaaggtagcagagaaagggattctagttcatctgtccttgcctaggggagatcttcccaccaggttctgagaaaggctaacctgagtacctgagagaaacaggatgctttggggctcagggagaaggggctggggagctttctggagcaggctgctaagttggtccttgagggaagcagtagagggaaagaggctgaaggacccaggacaacctggcagagaccaccctacagcctgtctgcaaccctaaggcaattctgcagtcttctcatgccagccaaggcaatttggcaaggctcttgctgaactgttaattaccccccggggaccataaatgggtttacaaccttataaacaggagctctccgtccccatctccatttctccaagtgcaaagtggaagacgcagccactctgtggaccctccacccatttttggaatctgaatgtgtgctggggatgggggggtagggggtggggcagtgttctggtgagtgacagtgtgtttccc

SEQ ID NO: 26443 - DNA, 1168 bp, Mus musculus
agagccaggctggagcgcagattcctggtgtgtgtagccaggctcctcatgcagttgtcgctgtatttgtgggcttagggagtgcctggccatggatcaccagttttctcctccaccaggtcaaacatcaagccagataaggccaatgccaaccatcatagcttccagatgtacacattcgacaagactaccaactgcaaagcctgcaagatgtttctcaggtaggtgtcttctgtctgtccaaccctgggctccagaatccactgtgtagctgccctgtgacaccgtggcacctgaccaccccaccttggtgccatgtaatgtctcaaagaaccaggatgataactacgggggtcagcagccatggctattggagggtcgggtcccctgctggggaccatggagtgaggggccaggccagggtggtcagatgctccgggatggactgtcagccatcgtgatgactggctgagcatgcagggagctgtgccccacctcaccccaaccctcccacacacaggggtaccttctaccagggatacctgtgtaccagatgtggcgtcggggcacacaaggaatgcctggaggtgatccccccctgcaagatgagtgagtactcggcagtgtgtggagatgggccccgctgctgctcctcatcgtgaggaccacttgttcatgtctgccttttaatccaagggacacacctgagaggcactgaggccaagggaagggatgatcaaaagctatagctgtaactcctcaccaaagttcttgtgacttttccgtccgtctcctccatctctgccccacacccacaccctggtcccagggtgttctcagcaggaatgcaggcttctgtcataagtggccccgctcctggctctggcactatgtgcttgttctcatgtcatttttcagatgaggtggcttgaggccgagcctcgctggtgccaggcacaggaactcgaccgcggaggctaggagtgtgtgatttgggaatgcgtttggagttttgtaaatggtgttccatctcatagtgactagtgctcgccaaaagccgatgacagttctgagaggtgtcagggcctcacagctctgtataagtagtagatcctgctgagtgccaggatccattctctgtgcttcaaatgggaggtccctgtccttg

SEQ ID NO: 26444 - DNA, 2209 bp, Mus musculus
tttatcaaaagccaatatttctgtctcccatctgtgtgggagcctccagctggtagcagagaaacaaaaagctgagagaagaaccctaaagagcctggagggcctttcccaggctgctggtattccgctgtgtccctggcttgggaggagagatggaaggctataccggggtattgcggctcctcgtaccactctcgcagcactgtgcacatttgtccccagcatctaatgattagtcctatcatgctcagggttccagagcaagtgggagaggcttcagtagtcaactctactccccggccttgcagaaagtctgattagggcttccccagagctggcctgccatggcctaggaagccccaccaggttgattaaggtcgctctagggataaatatcagtgtgtaggcacggtggcttgtggccatatctgaccccccatgctctcccgagactccggtagctctcctaggaggcagtcactgtccctggtcctgaagaactccaggacacgaacatgtcctaaaggacagccaatgttctaatatccagcactggtgttggatctccggaattgtctagtccatccacagaggggatgtagacttcttgctgtggagggtctctgagataaaacagagggtttccccacttctcatcctgtccggaactagctaagagtgaggtaattggattcacttgtatgtagtgaggtaaaggcaggttctgctctcagagcccaggcatgagaagttctgcaaggagactctagaccttacgctgtgtcctggttcttccacagagggttctgggaagggctgtgacatggcttttgggactggggctgacagtagggtgagctgctagtggtgacccttacttccccaagcatggcttgaggacagtggacactgctgactggttcaatcttgtttgttcctccatgccttcagatcagatacatgcaggtaagttgcaggtaagacaagctaggtgggctcctgccggctgtctttccacctgttgggaaggtgtcagaggccatagagaaagttaaggactgtgttctccgtgagacattgtcaggcagatccaccccatgggcctcaccctaccacactccatgctgcctcagatactgatggaccacaccaagtcctcgctccatgctgcagagtgattgagagtactgtggtgtggcggcgcataaggggctcttaggaccaacaggaggagggtagctgggtaggcatctgtccagtattagctcttcagagtctttggggcagaccaggctttctgagctgagcgaaccaaaagaaagcatctgtaaagctcactcccacccgctcactgcaccctgtgcaggccatctcccaggcagggagtttgctcctgctagagaggttatgtccttaggtgacccactggtgagctgttatctcaggccttctgggtggaggctggtggctcctctgggaagtttggcctttggggcacttggttttggaagccagaatgggtcagctgtgggtctccgaggagttggccaatgtcaactgcaggacagggctgacccactcaaacaagtgccgtgagcacaactctcctgtctgcggtacagtcctctcctgaagctttcatcccaggctggtgaggatgctgggttctgagtcaggagtgaatacccaggagtctaaaagcctagtgacttccttgctgctaactctccgtcctctcctgtccacgtgcctccatttcctcagacatagagaatgggggaggggctggggctcactgtaaactcagtaatcttgtgaccatactggaaaggtgtcatcctgttgtgtgggacaggtggccggcagcagatacctgggtggccaggtagtggggtcctggctcacgcgtcatgtctcctctagaaaatgggcatgactgaggacgacaagagaagctgctgcttgttagagattcaggagaccgaggccaagtactaccgcaccctggaggacattgagaaggtgagagccatttctcctggaaagcccagggtcagggtcttagcacctgttccagttttctctctctctctctctgcctgtgaggaaactctgaccaaaaggagctgagggaagagaggagtttactttatcctaacttggagattacagtcccagcggggggaatcagtgcaagacctcaagcaga

SEQ ID NO: 26445 - DNA, 1159 bp, Mus musculus
agctttgctaagctgttctgtctcttaattcccttcttgaagtccggtagcttccttccatcctcctgtgacagctgaccagtgctgacagggagccccttaggtcctactcatcactggaaagtgtcacacacgcacacacacgcgcgcgcgcgcacacacacagggtttctctgtatagtcctggctatcctggcactagctctgtagaccaggccagcctcaaactgagtactgggtttaaaggcgtgtaccaccattacctgtttttttctttttcttttctttttttcttttccttttctttcctttttcctttccttccttttattcttccttccttcttcttctttccctccctccctccctcccggaaggccttacaagccttttctgggccgtctctgttcttctcttagctgtatgctatcctctttgcctccatcagatcctggccctgctaagtgagacttgccctggtggtacacttgacagcctggcttttttgcctgctttctgtcttcctggcagtgtccacagtccagtgtcttaagtgctcacttacactaagtcctagtaggggtgagttcctgtcaagcaatggcaccctgaagcctcagtgcatccgtgtgactctgatatgacagacgcttaagccttagtgtgggagagtctaagaagcatgggcccctgactggaccaggaggtctggctctgtagggacaggaggttgattgttccgtaggaggagccttggtttccagaggtctaggctactcatgtgtgtcccagctggggtctcacctgggaacctgcagcccctccagatggtacagttgataccagcctgatctcagacagtcagctactgatgtgggtcacacggtgggatgcttctaatcagtgcccgcccttgactcagtagaaatgtcgctgcacttcctacttctgtagcagttgacctggccctaaacaagacctgagcatggactgacaggtcactagatgattctggcattgcttacccactggcctagtctccactcagcagcctctgagcccctgagtcctctcacttcatggaagtcatgacaggtctctgtcaccagtaccatagactgagtcctttccacccgggagctcctgtatccatgcgaac

SEQ ID NO: 26446 - DNA, 2719 bp, Mus musculus
gtctgagactcagtggggatcctacctagacaagtgtcttagtgcagccttgtggccagacaggtgacctgtgacagtgtggcacactgctcagcaagggtctcccctcctgtgtccttgcagagaagtccggctcagctccctcaggaggcccatcaaggctcagcagtagcagctcctctgagtctgcgagcagtagctccagtggatcgagctccgacagcagtgactcagagtgaactcggactgggacagagctggacagatggacgtggtgcacgccaacgcagtgtcccctcctatggttaatatactttcgttccatggtgtgcaggttttcttttacttcagtgttatgatctcttccagctgtgctccagtagggcggagagcctcgcacgtgcaccagaccccatgagagggccgagctctgcgagggggaaatgcctttgcagctccatttagttgtttggagactgctcctgggatgctaacctgatggccatagacacggtgggctggaggcgtggctggatctgcccaatccttcctcaggaccagcctctcccttagtaacttgaaggaagctttgcaagggtgtttctctggaatgggttctgtgtttgaaagctgttagaacactaaccagcaggttacttctctccgcaggggctgaagacagatgtgtcagcccatgggaaccagcctgggccctagtggagggtcctggtagctgcagaccagagcctcacacctctgggttgggtgtggaggaagaggggtactgagttccctggtcctttggctgtgtgtgcagcgtgcagatttcgggacaccgaaacttttacctcaacttaagggaataaaaacaaacaaacaaaaaaagattaaaaaaaaaaacaaaacaaaaaaaacaaaacaaaaacaaaccttttttgtaagttcatccattttctacagaagtccagcccagagtccccactttgctagtgctgcctggctgccaccgcctaacgctctgaaccaccaccccaggtttatgtatatataaatactttatttattaacatcattggtcattttttaaaaaatgaaaaagaaaaaaaagaagagaaaaacccataaataagtgcattgagaagaacatggagaggatgctgtcctctgcaacagagacaggcccgtggcggggcgcctctggtcctggtgctcatcacggctggcttctctgagctcattggctgtttgtttgtttggtttttttttttttttttaatgaaatgtggggactttgcaagcgtagacgcccttcagctgtagcacatcttcattttatagtatctattcagtttgttcttactaacttctggtcttttaaaagacgtcaacggaggaacctcggttcttcaacacaagctttgtatgtaagccgagagaaaagtcatgtatatcaggcctaggtcttgacacttaattttctattgtaaaaagtaataatatacagagtctaacagaaggtcctgttgggtttgttgtttttgaggctgccgaatggttttggaatgcagggtcagccttggagtatctctgagcattgtggcctcagccaggagcgcactggccagtctcccaggcctggaagcactgcagtgtgcagaggctctccttgacctttctacttttgacacgggtccctgttcgagaatttccagttagccccagaagagactggttctcctgacccccacccgagagcgagagcgccaagtgcagggccttgtgttgtgtggttttacttgggctgggggtggttcttgcggtttcttccattgcttctaggcagagccaaggactcatcctcaccatccatacatgggagatatttaaagtttctaaagtcgatcccaccagccctcgatgtgcacaggcagtgggtgtcaagctcgggaagtggctggctggctggctggcatgtctagacgcctggtgagttatcagccagttaaacttgtaagccagttttgtttataataaagatataagtggattttaaggttccatttttttaaggttacccttgtttttcaaaggtattttttaaacagatctttaatagaatatttaagctgtgactgtaagaaataaacaagagtaaactgacaggccttccttcacgtggggtctcagtggtggcctaccatgacagcttggtcagtgtgcctaggcagggcacattgcctgggcatgtgtagagtgagtgcccctgtgagctgctaggcaagcagagtctggctctgaggtgatgtccccgcagcagggtggtggtacagagctgggcatagggtggaggtctggcattcctgtggctgtggtccctagtaagcagccttggtcattggtgcttttaactttttttttttttctttttgtccagacttaaattgttttgtcttcagagttttggaggaccccggtccccacaatgccaggctgcaggataactgccatccccttctgtgagttatgtacggggacttagactgtcctgtgcagaggtggagggcagctgtctacaggcttcctagaggtcacatgcaggactggggtggccacttggcagagtccttggggttcagacctccacaggctaggtagctcagcttgcttacagactggagacattttcttgtgtggttttctgggtttcgtccttctgcag

SEQ ID NO: 26447 - DNA, 1150 bp, Mus musculus
tcccattaggtgcactaggtgttgagcagggtggctgggtgcccttgctgtactcaggctggccttcaacttggagatccaaatggagatctggctgcctttgcatccaactgtctagtgcagggattaaaaggtgtgcaccaccaccacttgggcttgtcaggactgtttttaagtgtagtgggtgcagggccttaccaagtagtccaatttggtctggaactgcaatcctcctgcctaagaatcgggcttgctctaccatacctggcttgcttatatttttagtgcaagcacaagcactttgagcctccacaggggagtgagtctaagaagtttggtagagctgaaagtactggccttttcctctgggccaggtgttttgtggtgctaacactggctggatttcctgacagcatggtgtataggttagtagggttgatcttttactggtcatttggatttttgtccctcaaaaccaactgttttttttttcccttcccaagggaatatctgatgtagcgtggtcatcagattctaacctccttgtgtctgcctctgatgataaaactttgaagatttgggacgtgagttccgtaagtgacactggtcttccagggagtgcccatagttgagatgagttggctgtgtagatggttggtcttgggtaggtcttcaaatgtacaagaagcttgtatttggagattcagcccctggaagtcacagaccttggtatgctatgtgtgctctaggggaagtgtctgaagaccctgaagggccacagtaactacgtcttctgctgcaacttcaacccccagtccaacctcatcgtctcagggtctgtaagtgcgtggtttctcctccaagggtgatgtgtacagtgtcatattgtgcttggttggggtaggcagtttggcttttatgtggggacaggttctgggtctgagatcacactgttgctgctcctgttcctgtagaatcactttaatgtcctgtctcacctttagtttgatgaaagtgtgaggatatgggacgtgaagacagggaagtgcctcaagactttgcctgcccattcggacccagtctcagccgtaagtagtcttcctggcctgtcctcagaagttcctctggatgagccgacttgatttgctca

SEQ ID NO: 26448 - DNA, 1949 bp, Mus musculus
gccactgtgatatttcttgccaattctgtctctgcctggggaagttcctggtctgttctgtgctcagaggcaacaaatttttaatttttttattacaagagtgagttcagctcctcatgggttgtttttctctgtggttgttgttttggtattgtattgcccagtgcacactggaacaggacctacagccctactcccattccctgcctcctgccctggcctgcttgttcaattttcctgcctgtaatagtacccagcgtgcttccatgagtttctggaaacacagaaaggttgtaagttgtatccgtgtcaagtccctttgttcttttggagttcataggtcaacactgacctctcagtggttgaaatgtctccttgtctcactggtatcactcagtaagctacacacactgtaataaaaggtgggtatggactgggtgtggccctgagttctgaccaggctctttgacacctggctttataaagccctcctcccttcctggcaggagttggaaaggtctctgggaggatggatccttgttgtgcctcttcttcccagtggctgctgtgggtgctgagtgttggagaggaagaacctcagatgagaaagagtggaaggaagtcttggaaaggcaccatgtagtgaggttctggacctctttattctgtgagaggctcagggtcacctgtgcaggagggaggagttcaatatggtgcttgccccagcaggtacagcttcctgccttggcctctaaacccaccaaacctctcttatgtccttggcccccgccccaggtcaccgcctcaggtgaccaggactggaaagaggtagtggccaagctcaggactacacagcattttcacaactgctgctggctgaacccagggtgacctactgtggagcagactgcagaggttctgggagtacagatgggtggcggaggctgctgggcacagacatgggtggaaaggagattctgggtttgctctggttgcagcagcaaccatctgtgaggccaacactgatgtgtattgaagccacatcacccagggcagtagctgctctactctgcctttgccaaggcttgtccccagctgtggtcctgacagccctttctccctccatcgtgcataataagaatccaaaggtattggaaaagaaaccccatacattgtcacttccttgagggagatggtgtgtaaatgggctatcacatcgaagaagccattgttaaagagggtggcttgtcacactgacatgggctctggggcccctggcgtctgttggatagatgaacctgggttctggtcaatgttgtgggcatgttgctggggtttctggagggtagtaaggtccttccagctgtggcctggtgtgcggcctcctcctgagggagggagcttgcttgccatgtcgagcacagtatccccgagtatagtttattttttctacagttgaactctgttgtagatttatgtaaaaatacattctctttttaaaaataaagattttcatgccttgtaattttgttccatataagtttgttttttccaggaattcattctgtgtgcattcattgggtgtgtggagatcagaggattacctgtcattccctcccacttggttggcactcaataaggatttctttagcagaacaggcagtggaggagcacacctttagttccagcactcaggagggtctaagttcaagcaaagcctgtctgcggagctagtgctaggattacacaaaccaaggctcaaataacaaccaaagggagaaaaaaaattttttttaaagatttatttattcattatatgtaagtacactgtagctgtcttcagacactccagaagagggcgtcagatctcattacgggtggttgtgagccaccatgtggttgctgggatttgaactcaggacctcttgaagagcagtcagtgctctcaa

SEQ ID NO: 26449 - DNA, 1175 bp, Mus musculus
atcctgagcgacagctgacgtgtagccagccttcgctgcgcatgcggagacacggtggcgggagccgaggagtatgcgcagactccgtacacagcctcccccgcactttcagcgtttacaacccgtcgcccggaaatctaggaaggattaacaggcgctcgtcctctgattcgtgcccgcccacttccacttcccgccgtccgcaagcgtgtcccggttggacgtgcgcctaccctgttttgtttccggggaatctgctttgcccaagaacgttcacaacttccggtgttcccttaggcctgtgattggctagttttatgaattaattaaagcgtgtcgggtttgaaataaataaaccgtttttacttctaaataaccgcgctgaaattatcaaaccaccaaataaaatatgatacttttcagtaacaagcttttgtgactactaaacaaaattcaccattatctaaaaaggtccgatattgggagctttaaatacgccgcgggaggaatgtacttctgtgttgtatgaaaggagagaaggttagcactccccttgacaaggatggaagaggcccttgggcctaacaacacacatacggttaaggcattgccacctacttcgtggcatctaaccactgttttttttgtgtgtaaatttggaagctgaaggatgtaatcttttttttgtttggtttttttgtttttatttattacgtattttcctcaatgacatttccaatgctatcccaaaagtcccccataccctccccccgaaggatgcaatcttatacagatttcttgctcgagatttttattctaatcaccatccccaactctcttacccagcatatttgggacagatgtaagtctacttcaaacaggcaatttcattctgaagcttggaggactgccatgtgcagtagctcaacttgccacctactaagagctatttgctcatcaacttcggatattggggtgttcctgacagacataaggcacttaatactcaaacaacaaatgaccctgagcactactccagacggtggggagttcataagggctctcctagagcaggtggtacagctttctttattgactgtggcaccaaatctgtctttagtatcagaaatccaagcagtggatacaggtatgtgtatactgtgatcacagttgag

SEQ ID NO: 26450 - DNA, 1091 bp, Mus musculus
agaacatgtgtccaatgccagtgtgtcagccggggaatgatatagagtggccattcctcgatgcatgcacccttaccctccacgctctcctgggaagtgtttgtgagtgatgatggccttggggttactgagtttagggtgctgacatctgaagtgctggggtttatactgcctgagtctaggattgtgggcttgggagttttaaggtctggggttctgtgggaagaggtgctggtatctggagttcttgagtccaacatgttgtggttaaagtgctagcttgggggtactaaagtctaggttactcagatttgaagtgttagagtatggcgtccttgggtccggtatgctggtactgattgagggtgttggtttgcactgctggagcctggagtgctggagccagggccccctcttcttggaggtgccagctattcacttgtgctggcatgagacaactatgaaccaagccaagccatgtctgcatcagcttttaaaaccactggaatgagctcacttgtcatgctgtggtccaaatattttggccatttagatgcaaccttctgtgcttgtgaaattaagtgcattattaatcttgcctggcccagtgacagggtaggcagatcagataaatctcctcgaggtgcagagagggaaggaggaacacgttcttatcggatgaggaagacactggtttccacaggttcctggtggaggggaactgaccgtggggaggactggccaggcctgaggaaggcctgaggtgctgggggtgcttttcaagagaggaacatgttgtgtgtgtgtgtgtgtgtgtttgtgtgtgtgtgtgtgtgtaacactgcttctggatgttacacgggtgacatggggtaaggacaacacagctgaagtggggtaaggggctgtcctgccagatctcatactggacttgggggtggcggtggtcaagactatatctgattacgaaagtaataaaatccactggggaaggaggatgagaaaaagcgcagaggaggccgtgcaagctcaggctctctatagagcctcaccatcgtccatgagtggtgggtgcatttctttccagacct

SEQ ID NO: 26451 - DNA, 1177 bp, Mus musculus
ggtatgtcaccagctggggaatggccaggagcaactgcctgctcaggtcacagcatcgtcaccatagagtggctgtcctggctgatgtgtgtgagctgggcactgggctggttgagctgtcaccagtccttgaaacagtaggtgggcggggacctgatgatctagctgtggtagctgctttccgggcacagggcctcccttaagctgaggtggaacgagctggaggaaggcttcttggaggaaatggcaccgtgcaggttcagacaagggaacagatgaaacagtttgtgctcaggcccaggggtttaagagaagcaatggaaaggtgtagcccagaggctgagaagttcccaggggtctcacgtagggtgtgaccttgactttgtgatattgcagagctgtgggtatgctgtatgtaggggcaacaggacatttgggtgacctgcttcccaggctgctatttggatgctgttcaaacagggtagttcttaatcttccacttcagatgtcagcagcctgggcaggactttgcccaagacaggcagggattttttgtagtcttgggccctgctgggatttcaggcatgagcttggtgagtgtgtgtgtgtgcatatgcatgtgtatgttacgtttgtgcatatatgtacacgtgtacatatgcatgcatatgtgacacctctttgttaattgttaataaatgttagcattccttctaggctgtgccccacagttacctggcaatagccaggtaggcctggcttactataaagggggctgtttgctcccctttttgctctctcggactctcttctctccctggcccctttctccctctctctccctccctctcccacctctacatgtgttcctggcaggtctggccttgcctctcctctcctttttcctccctctttccccccacctcctcctccctccctttatccctctttctctgcctccactcccttctcaactcccatccccatgccctaaataaaccctattctatactataccgtcatatggctgataccttagggggaaggggtatctcagcatgggcccaccgaagtagccctctcacctcaccatacctccatctacaaacatattttttgctcgtttttaataaaacacaataagtaagtagctaattaattgttgcaggtgtgaggg

SEQ ID NO: 26452 - DNA, 1152 bp, Mus musculus
gaattgccagatgtcttcacagtcttagccatacataaacagatggaggccctggggactggtggtgcataccctgccctgtgtcggggtggctgatatcccatcccctacatctgccccacagaataggtttacaccaactgctgggcacagggtcagtgcaaccctgcatccagaaggacctggcaggccttttccaccgaggttcagctcctctcatttgtcagcaagacaaggggttcctcaaaaggacagatctagcttggctgagatgggggaagatccagcaatgcccttggcatcagcccacactgggtcagggaccactaagtcctgattggacacctcttacctgttggacctcaagccgttcctggtttgtctttttctgagacgatgtttcaagtatcccaggctggccttgctatgcacttgaggatgactttgaactcctgcttcttccttccttttctgagtcctgggattgtagaccatacccagtaacgacagtgctgaagttcaaacccgtggctttggctatgctaggcaatgtctgctgtgcgagcccagcccgactctgacattgcttttagttctgcttagcaggtgaatggaccactgcttagcagatgaacggaccactgttaaggatgggagctgcaaatgacagtacatacctatgataccaggaaggttgaggcaggaggatctgagctctgggatagcctaggctacagaatgaagtttggtcaagcctgaggtcttctgtttctgaatttttgtttaaccatatgtacttaaagtaacaaaacagcttttcatttgtgtgtgtgtgtgtgtgtgtgtgtgtgtgtgtgtgcacatgcatgtgcacacacatgctttttggtatgggtatgtgcagtgcatacctgtgggtgtatgtacatatatacagatgccagaggtagatgccagttgactttctcaattgctctccactttatttcctaaagattaaagaagattagtatgtcataagtgtctgctgtgtgtgtgcaggtgccctcagcatcctgaagagggctccccaagaattacgatggttgtgataagctcagcagttggctagactgctgggctagtgagctccagggctccaccagtctccgg

SEQ ID NO: 26453 - DNA, 1171 bp, Mus musculus
ccaggggaatacggctcaggctgcactgcaagcacagcatgcctgtttgatagccatactccaaggtggtaggaggggtcagttgggggtggagcctgggaaggatcaccctaacctcctcttttctgattgcagggggaaatcggcccacctggtccccgaggagaagatggtcctgaaggtccaaagggtcgaggtggtcccaatggtgatcctggtcccctggggcccactggggaaaaggtttgtgcttacaatcctagattatgcttagaggtttctgagtgccagatggcccctcctatgtgcaacacgggtagtgggactcctgaatagcccatgccacaacccctagcctttcgtcacctctcccagtcgatgtgtgcgcgtgcgttcgtgtaccctttgatcttcattctgttccaagttccccttctcatcccaccaccgccgcacaccttggaggagtgtcttccaccaaatataggcaaagcttgggcatctcacccgagcctcacacgagcacccatccctatcaaaccctgcctccactctgggggtgacagaatgttctcactacagcctgacatcatggcttgtgcgtgaggctccggtaggtgcctgtgtcctagcttgccctgtaacaacagcgcctcctacatctggtccccagaaacctgggcaggaggggactcaaggagtggttaagcctcccattccctctggtcctgtggctagaactcttacagagtgttcagaacccccacagatacgaatattcttcctgcccatggtgcccatggtgcccatggtgcttgtttggatttccacgcatgctggtaggatccacacaccctacttcctgagggcttagagacccactcagttcccggggagatgcagctgcctctgtacaccaaccctacccttccaacctgccctagctcctctcagaaccacccctccctgcttacaggacaaggttgagaaagtcatttatgatttatgagtctttttttttttcctgctcctagggaaagcttggcgtgcccggattaccggggtacccaggaagacaagggccaaaggtaactaaaccttgctaagtatgtcctggcaggcactgcctcatgtggcaccccacactccagacgccctcttccattctcta

SEQ ID NO: 26454 - DNA, 2151 bp, Mus musculus
agcctccatttttttttaaaacaaccctcaacacatccactcagaggccaaatgtcattccacacgtgcctttccgatggattaaaggtgcttatgtttttgtgagaattttaagtaaatatttgtattgtattgttataaatgttaagtgtgcctggctttcagtcttgcatggaaacccagccttaggcccatgggggcagcgggcagctgggacaagtcacccgctcgggctcgaaatccggctctcggtagagggcatcgccttacccccacccccacaagaatgtgcaataatttggaaatttgcccagtcagcaagaagcggcattgccactgcaggtgcctgggcccctttccagactctttatttttttctttttgattagctctggataattttttatggggaggggaaaaaggcatttgatatcctgcctttcctacagcactcagattaaaacacaggcttaaattaattctgattgcttcctttttccttgttccttcctgcagaggctgatgggacagtgtccagggctggagagccacgtgttctgtagatgataaataactatgaacatttggtgctgaattttttacacttgtctcttgtggtgctatgtgtccggagacccttaggtggccctagggtgcctgccatgcctcattccctcccccaccttcctttatcctggccatttctccacattctgagatttttgccaaggacctgaagaccagattggtgccagagacctttcttccctcctggcaccttgtactcatgatggtggggagtcccttcctgaagcctgtccccctctctgggctctgcttatgtcatttgaaaacacatgagcaaaacaaagacttcgtgcatggccggcccatggtgtacccatggtcttgttcagttgctgaatgtttgtggtgctaatctctgtgtgtgtgccaagatggaatggaagctgctgtgtgcccacctgacagccagacttcattgagagccataggtggcttgagaaatgtgggatggactctggctccagggtcgctgagctgactgagtttccagcagaggagtgtcctgggtgctgcagtcagtgctggggtccatagggatccctctggatgctgccctcttcctcctctccctcctcctccagggtgtgtgtggtggctgggcgggaggggtgctgccttctgagtgcagaggtctccaggtccaacaaggaaaacctcactgagagttacctgccttccaccacgagaaagctgtggtgcccacagagagtcactctggtgcttgtgtccccaccccacccctgaagtgaagaaaacgaccgtgaggcacccgggagcagccaggattgatgaacgccaccaacacgcatcccccaaagttccctgaagaacaagttctactcttgccaaagaaatgcctggcctggagagctctcctggaagccaggatgccatcgtgagccagggactgctgtgcatgcctctgcatgagaaaaagccatattggaagacggccatacgccctgtggattctgtgtaggtcatgtgattcggattctgcctcccactccatctgactttgctctgtcctgttcttctgtcggtcccttccacgttgtaatttgcattgaaacccaaaatgtgttctgttctcctcagtccactttagctccaatattttacaataaaattacttcttatatttgcagaaatgcctctggcatcattttccgtttccattttctctggtgtgtgcgctctctacatatatatatatatatatgtatatatatatatatatatatatatatatttttaaaaattgaacaaatgctgctgaaaatacacacaaagtaaacagaagggctgtgtgataaaaactataggaccttgggtcctttaaaattccaggccaaacggtacattgtatatttcccagcagtctaaactaagcctcagattttaacttctccccaggaagagtgttataaaatattttaaaactgtgtaacaaaggaatcgttgtaacagtgtctcaataaagcagtttactgtttacaccccagaaacttgactagctgtcttttttgcatggccaggccttccatcacctgactctcccgt

SEQ ID NO: 26455 - DNA, 1451 bp, Mus musculus
tgtagctcccacttttccagaagccaagggtccaagtcctcaccccgaggacatttccatgaaacagctgccaaatgattccaagaatactaacagtcctgattttgagaaatcagcgcaattttgacgccgagagatggtgtcctctctgtgttcctcctactcctgcaggtgggccgcagatttcagaagaaaccgccatgtatgtggatggaactgcagcccaaggctccttggctgtccccatcccaccccatccctctctggtccaataactcaaagaagcaaggcgatgactgttggcccctctcacccaagaacaacccactgttaggattgcatggacatttccttaggttgtgcccagcgagatgatgtgatggccattctccccaaccagctcccccagcccccgaggcactcgctcagtgtaggctgcttcagcccacacatatcgcagctgcctttttcttgaccgtgttgttgtctcttagattaactgtgctgagactcccggtagctcatggacctgtgtctagtactttcccgaagcgatggtgggtgtgcgtaggtgaagttgctgtacccacgttgttgaacttgcgtaccctgtagctagatcgtgaggtgtccgtctgttatcccccaaggtggtaactccgtgtgttcaatttatgcaatgaatgttgtcatgcaatgctgtagtttggattgataagtggatggtttctgtttctaaaaagaaaaaaaaaatcagtgttcgcccttataggagacatagtcaagttcatgttgataataacccagtggaactcttatcttgtcaaggtatctgaattgtgtaaccatggatgggaaggacgcatcgtgggaaacttccgtttcctacaggaaggaactccccaagggcagccatgtgtggaaagatcattttttaaagaaataaataagtcaaagagggcaactttgtactgttcagttatctaaggaacaataaagatattaggagataacctcgatttgcttattgtctgtggcaagagggacatatgtgatgggcaaccctggatgtcgtagctaccctctaagtcatgagaactcagaagggaaagaggacagtggattatgacctcctacttcccaaagccaaaaagtgcttggcattcccccgacctagggctgccccagagaccccacccttaattccttcacccccttctctgactcttcttccctggagcaggtacccacccatgtcagacagctctggcgccattggtatatgtcagccgagacctcactgatgctgataagaccatgatggtgaacccaccccacttccaacccagcctttcgccaagggctgccacagacctagggaggaggtgcccagggaccccaagatatgtagaccctagcaattccaaaggactcaacatgcagataacatc

SEQ ID NO: 26456 - DNA, 1713 bp, Mus musculus
agatggaggccctgcatcggctgcagagtcccaaggggtccgagggcagtgggacatctcctgtgcctgataagagccattccccataacagaaagcccttctcccacactagatagccagccctcttctgagcaggaaggtccttgtccaaccctggtctgtgtccccactccctgtcctcagcatcagcaccacagtcctatttccttagatatggccaccccaaagtccaatgatcttgagctaacccttatctgtctcttttctgggaacaaactcaggtaaagtacctagtcacatggcctctggcatccattaagacttgaacatagctagccaagtttccgcttttcagttaaaattaatcctccattgtctgctaattaatccttcattctctgaagaaaattccaagcaaaaccaacactgatgtccctcaggacccccagtagttgcctctagacctgtaaccaggctaagcaggctcccagagggaagataggaagtatagtccatgcattgtgctgcactactaaagaacttaatgagtttgctaattcattcaagcagaagtctggggaatatatgtgggaatggattttaaaggtttggggtaatggaaagaacataaaactgaatcaggctgagttttatggatatgggcttctctggagctcttatgtttaatatggaagctcgcacagtgaaaaaaggtgtcaaaagtttgttccatgtttggctgaagtattttttaaaagaacctactgatgggagcacaaaagtccttgagcccacagatcaccaaggaaaccaggaatgttaatcacatagggttgactccccaaagaaggaaatccatacctgtttcccacccagaggactgggcgtggatgttgttaatgacctggtgacctttgctatttgtagagccagacctcacccaaatgccccctaaatgtttgtcttggactcttccttcctagacctttatttttaacttagtttctccaccaataaaatccatgcttaggggagatgtcacaagtattttataacctgctgacctctacattatcttggtcagagaccataccagatcctaggcccttaagctataggacccatctttgtggtcggtgtactttgagctgagtttcaatgtaattatgcctcttatacccgggattgtattacatcaggaaacttttccagaattgtactattttaatatatgtttacagtaaaccacctggtgtcagactctctagaactttgaacccgtaccaactaagtcaggcaagttttctttcttgcctttcataggccctgatgcttgcagggaccctcaaatcatactgaaaaggagttggggatacctgataactcttggcttagtagtgatgaagggctcttaaggctcagggaaactgcagtgctagagtggcacactgtaaaatctaatcctccatgatgggaaggtggtggaaacaagcctctcactaaccctgtcatgtaagagggacaccagcacatttgaagagctttgctgttgcccttttccttgtcctagaccttagggttggagatgcttgctctgttggatgaattaaatgtagtgggtttaattgggcccccgcagggtgacagcacggatcaccaaaggcaaggtggtcgagcatgcattatcacaatgagcagcatagacaaagcag

SEQ ID NO: 26457 - DNA, 1359 bp, Mus musculus
cggggacgggtccatacggcgttgttcttgattcccatcgtaacttaaagggaaacttacacaatgtccggagcccttgacgtcctgcagatgaaggaggaggatgtcctcaaattccttgctgtgggaacccacttaggtggcaccaaccttgactttcagatggagcagtacatctataaaaggaaagtgacggtatctacatcataaacctgaagaggacctgggagaagctgttgctcgcagctcgagctattgttgccatcgagaaccctgctgatgtcagcgtcatctcctccaggaacactggccagcgagctgtgctgaagtttgctgctgccacaggagccactccgattgctggccgctttacacctgggaccttcactaaccagatccaagcagccttcagggagccacggcttctagtggtaaccgatcccagggctgaccatcagccactcacagaggcctcttatgtcaatctacccaccattgctctgtgtaacacagattctcccctgcgctatgtggacattgccatcccatgcaacaacaagggagttcactcagtgggtctgatgtggtggatgctggccagggaagtactccgcatgcgaggtactatctcccgtgagcacccctgggaggtcatgcctgatctttacttctacagagacccagaggagattgagaaggaggagcaggctgctgctgagaaggctgtgaccaaggaggaattccagggtgaatggaccacaccagctcctgagttcactgctgctcagcctgaggtggccgactgatctgagggtgtgcaggttccctcggtgcccatccagcagttccccacagaagactggagtgcacagccagccactgaggattggtcagcagctcccacagcgcaggccacggagtgggttggagccaccactgagtggtcctgagctgctgtgcaggtgcctgagcaaagggaaaaaagatggaaggaaaataaagttgctaaaagctgaaaaaaaaaaaaaaaaaaaaagaagggactccaatggtagaggatgacacacttatccttaagccacgcccatacctcaactttttttttttttttttttttttttttttttttttttgagacagggtttctctgtgaaagcctggctgtcctagaactcactctgtagactaggttgcccccaactctgcctcctgagtgctgctgggacgaaaggtttgcaccactactacctgacatcttaacatttcaaaccaattcgagctgctgatttgactctccaaaaatgcgtacagatcatctgtttctgctggcttcagccacttcttatatttggttccaaa

SEQ ID NO: 26458 - DNA, 1341 bp, Mus musculus
ctgaaggtggccacggacaatcccagcaaggagtcctcagcctctgtgtagaaaaatcagacgaggtttgtggagcaatgggcaacactcttcctggacagacaagttttatgggctcagaagctttaaaatcacagagcaccctcttctagaaacaggtgccctcctctctaatgagtttagcttgtgtcaggtagacataaactatccagcacaccatgttttgctatatttaaaacaaaaaccaaaaaacacaacagacagttgtggctcatgcctttaacccaacactcgggaggcagagccagatggatctctgagtttgaggccaagcctggtctaaggagtgagttccagagcattcaaggctacacagagaacccctgtctcaaaaaccaaaacaacaacaaaaaggtaacccactacttgtggctggtgaggtcatttcaaaaccaacaaaagttctaacagaattctaaacacttagccatacccaaagataaatgtagctcttacccctcccctcgccaaagaagcttctttttgcagcatcgtggaaagccacagctggtcaaaatgtagagaactgaccgtggggtgcccagaccccgttgataaatcgaaaacacaaccctgacacctaaggctcaggaactatcacaaaagagagtgtggaaagactggaagaggcagaagacctgggcaggaaatgggtggttgtctgcttcaaggtagtcttttatgttcgacagtggagcattacctagaaatatctcaacaatatccttgcctaaacaagacttaaaaaaaaataccaccacctattgacaggccgacctggatgggtgtggtagtttgaataggctaggcccccatagattcatctgcttggatgcttgaccatacagagtggcactattaggacatgtggccttattggagtatgagtggccttgttgggggaagagtgtcactgtataggtgggttttgaggcttccaatgcttatccccttctgctgcctttggatcaagatgtagaactctaggcttcttcagcgccatgtttgcctgcctgctgccatgcttcctgccatgatgataatggtctgtatctctgaaactgtaagccagccccaattaaatgtcctttgtaaaagttgccttggtcatgtgtcccttcacagcaatgaaaccctaactaagaagttggtaccagagactggggtattggtgtgataggcttgacagtgatttttgtttggaggaatgtggagtgctttaagtggggcttaatgggttatcttagtaagaacatgaaaggcagttgtactgaggatgat

SEQ ID NO: 26459 - DNA, 1201 bp, Mus musculus
tcctggaaacctgctctggctggaagtcctagccagcagagagagccgtaaaggtggtgtggagagacttccttaggctctcattgacctctactggggtcgcaggagaggtccttgttggagctggattggaggactcccaaggccctgctgtggcctggccgggaggaggctctcaggaggtgggggcatctcagccgcataaagcaccactccctgtccctctcccaccagagctgaagattccagaaaacgccaatgtgttctatgccatgaactctaccgccaactatgacttcatcctaaagaagcggaccttcactaagggggctaaagtcaagcatggagccagctccaccctccctcgtatgaagcagaagggactcaggattgccaaaggcatcttctaaggacgtctcctgggacgggctgactggctggagactaagcacttacagactagagtggccctggccacacaggtacctctgcccacctgccagtccaggctacccccctactccactttcaccctgaacctctcctgctgccgggattgacacctgccactgacaggctgacctggcctctggggaccacttgccgccttcggtgccttctgctctctgaaaccagaggactagctgacttttgccaaggagtgttgccaactgggcatgggaccttgcctgccctggacactatccaccacactttgctgacacctccccaggtgcagatcactgccacccatgctcccggatgctccaggacacacatacacccagcagggctgccgactgcattctctccttgtgcccacaggcactggcctgggactttcatggaggtcctagcctttcctcccacactctagcctttctcaggctgcaccaaagattccaccttcagggcctacagagtgagggagcctcgcccaccaggagcccaagccctcccttggatcagagagagaagccctctcgtgaactgcccggttggtattgaatcccagtccactgaaagtgccattgaccaccgctgcatccgggctgtacaagacgacacgcagtgggaggtttgtggggaggaggaagacaactgaacatttgtataaaacgtaaaaagtttactgattggggtgggacaatatttatttgttgtaaatagaaaatgctagacttgaatattatattaaaat

SEQ ID NO: 26460 - DNA, 1268 bp, Mus musculus
ggcgagtcatgatgggacagttgggacaggcttgtgcccccatccaggcagtgagatgaggatactgggcaaccccaggctgtgctcagcctgacttcaccaaatggacctgaaaacaccccgtctcacatcttccttttgtctctgtcaagcggacatccatggaaggtccctgggtgtaagccccagagcagcagcgccacttcctgaagggtgctgcgccagagatgggccattgccttgtgtctctgtgtggcctctgtgccttgaacagcctggtgcacacagtcaagtcacagcaaatccaaagccaaatgcctcgagccagccgagattgaagatccattgtttgatttgggtcaagtgagcactcctgggaacttcccagtcttgcatggaatcagacagaccgaccctgtgtccccgctgaccctgcttcctgctgcttcaaagaatgctcagccctgaggcaggaagtagctcttccaaaaggctagccagccttgcctgtccccataggacttctttcctggtgactgccaggaagcttcagctgggcgttttctcacttctagttgctgcccatcctggttcttggggaggagaccagggttctgatcccatgtacccaggaatgctttgactctggatgtgaggaggttctgagtgagggccccgtgccctctggaggcctcacttacacagagcccagggcgatggccattcctgccataggttggacagactagaaggacttcctgaagtctagccacacttggcaaagtattgtaactgtcctgaattcccatgtaaatcaaagtgcttttggtacaataaatataaaactcccccaaagccagcactggtgtttgatgccctggtcacctggcatatgagtcacagcactgagtcttgttgcatagtgcaccctgtattgatttgtttttgatttgtgttttgctgggtgtgtttgagaaaaggccacttgtctccacagaacaaaagcactttgtggcacttgctagccaagattctcgagaagtggaacagttagcacttattataagcagttggctctcagttaaggtacaggtctacagtcttcagggcatggtataggatggagattcagagaagggctgcagttgaatacaacctgctggctgcatactcccacccctacccctgctgccttccagccctgcagcaggctgtgcatgaagcacctccgctcggaggtgaggcagcaccaactgacttcaacaaca

SEQ ID NO: 26461 - DNA, 1102 bp, Mus musculus
gttctctggaaagcagactcaaaattgacgtgatagccagcacttgggaggcagaggcaggcggatttctgagttcgaggccagcctggtctacagagtgagttccaggacagccagggctacacagagaaactctgtctcgaaaaaacacaaaaacaaaacaaaaccaactaaccaaacaaacaagcaaacaaacaaaaattgacattataatagctcagagttgagtaatactgatttcagtatgtccttctccagtcacagctttctgttttctcttgtgctactgatgaaagatgagattgtcatcgttctctccaagttcaggaggctagatgctccacagagcacatgggttcctgcagggtagaacaacctcgtcttagcaactaaaacttcagcaaatatcttttagtctttttttttttttttttaaatcccatcccctgttagagggttccagggacaggaaagaattacctggctaagttgagtttgacccttttgctactggttcttgggaaatgttagttttgtttctttgttttgagatagggtctcactatgtagccaaggctagtctggaactcatgatcttcctactgtggcctcccaaaagctgagattacaaggatgtatcaccatcccctggctagtttttaccttttttctatataataccttaagatgaaatttgacaaggattataatatttaaaactcctcttacaaaatgaaatttgatgtattggagtcaggtaaatgaactgcagttatcttaagaggccgacagtagcttgtccaaggagagtgattctgtgtccataaggagaggggtggcaggaggactttgtgttttcctacagaggttggctggagagatcctggggcccaaccaccaagcccgggagttcagtgttaggtctgggacttggctatacacaatgaattgcctgtccattcccagccaccaagactccctttagctcagtatagttggagtttgaaagttttcctaagccattgcagattctgaccacaagaatatgagctaaagttgaaactcccttcaccctgtctgagggtatagctccattgatcaa

SEQ ID NO: 26462 - DNA, 1121 bp, Mus musculus
acatcgtaaacatgctatggtgatgtcttttggtgtttgagatggtttccttagggagagacatcaaaaatgcctagccagcctatttgccaggaagtcctcctcactcagctgggtcagggctgagtggtgagggcactgtagagttaccctgtgcacttatctgtaagtactgactccagacctttttataggaagtagaaatgatgaaaactgcatatcggaaagagctagagaaaaacagaagccaccttctccagcagaaccaaaggttggacgcctcacagaggcgagttttggaactggagtctcttctggccaagaaagaccaccttctcctagaacagaagaaatatcttgaggatgtcaagagccaggcgaggtgactcactggaaaggtgtgggtgttggtgtgggtgtggcccctcccgtattctgaaccatgctgtctttcagtggacagctgctggctgcagagagcaggtatgaggctcagagaaagatcacccgggtgttggaactggagatcctagacttgtatggcaggttggaaaaagatggccgcctacggaaactagaagaggacagagcagaggcagcagaggcagcagaagagaggtgagtgcagacacgtcaggctctgtgggaggaaggcaggctctgcacagcagctgggctgccatcctctgctcgtccttcttgtttgttggctgtactcagtctgccctcactattgcagattgtcatccagcatagctccaggtgtcacctggacttcagtgaaactcttacatgtagctgctgttaccctgtctcgaaaaaccaaaaaaaaaaacaaaaaaaacaaaacagaaaaaagggggtgatggcttggtggataaagggttactgctcttgcagaggacctcagtttggttcctggatgtagggaatcggatactgtcttctggcctcctcaggtttcaggcaggcacatacatacatacatacatacatacatacatacatacatacatgaaatatttaattagagaaggagcatgtggagttgggacgcaagtgtaattttgcatttcctctgcagtgctgtggttgtcagctgcactctctctgggtctctt

SEQ ID NO: 26463 - DNA, 4601 bp, Mus musculus
aagtgtcttgcctaaagcagtttgagcagaagccttctgcttctagaaacataatggtctcttctagagaatctaaggaccttcttgtgagtttggttttcgtccttgctttggtcggggactgtctctggctccagagggctgaagtggttggtacatgacactgcatgtgccagtacaccttaaagtgtgtaatgctggctggctgcggctggggcttgctcagcagactcagctgcccattgactcattcatatggagacattttcctaaaactatatttttgaagccaagaataaaatcatcttaatgtatcaaatgatcaggtgactattagaagtaaataattgtcatttatttttatctcctgtcatcagattttctggcccagctctttaatatgtaagaagagattaagtatccctactcttcacagccccacttgatgaccatgtggtaacctagatatttgtacatccaggggaagtattgtcttcctttagtattaaagtgaagcctcagtatttctaacattggcttatccggacatctccctgagcatttggagggaaagctggtctagagacttgtggagaaagatggagttggacgtccttgagctctgtgctccaagcatgtgcagctcaagtggaaaacctaagagtttcctctcctgccaaaggtccttaatctttggaacacaggtattcttctgtgggcttaaagaggagatgtgcactgtcaattgactgctcgctcttaacccagccctgaagcattctggagtcacagtcggggtattagagtaagtttcctgggattggtgctaatgaactggacacattttgaaactgtgcaattggaaatgagataggaaatacagaacatgaaatgctttactccttgatgattctgttttatcatgagtattattttaacacactttcccactttgattttatatctttagcaaaagaaataatgtcttagtacttgggtaccacggcgagagacaggtcacctgccaccctgccacacttctgcactctgggcacagaccctgagaggcacttccagaagctgctctgaattgtcctgttaagactgttgccctgtgctgtgtgtttaatggattgtttgttggggttgttaatgtcctgacgtagggttgtttcaagaacagcatctctccagacttgaggggcagcaaggaaagagccccgagtgacccagttcagagtctgcatggctgcagcagagcctgccgctgttactcctcagagggagatgacaggagtggagatggtaccgatagtcgttgctagtctgtctaccgtgcgtgccaagcttcctttctcttgctctttggaatcaatctccctaggtgttctcacagggaattcgggggaacttaaaacttggttgtttaaagcagtttgcatttctgtgaaattttatcatttagaagtaacaaaagaatttctaggatctgtacttgtgtaaaggaagaaacgtgacaactggaacacaagttttcagcaagaagcctagccctgcaaaatttttggactctgagatccagccacagccaagtgtttccacagccagtagagatgtccccctcccctcacaaacaccacactgatgttaatcttcagagctgggtgaatgagagaatttggggttgatggcagcctcctgtgtgcaacctgtgcacttctgaatcgctctccaagggtcagcatataggcccacagagggttgatggagagaccttggaaaagtgggagtggcgccagagtcttgcgctatgcctcttgcagcttgaactcacctgtgctgcttgagggaggagttcagtagcttccagttgcagctatagtagctgtttctgcagggggaagaagagtagccatcaaattgctgccctgcatttagaagactggagcagactctacagagaacttacacgctgcagcactgctgtgtaccaggttccatgcctagatggtttctgttactctaggtaggaatgggtagcttgttgtggttggcattcaaaccaatgtcctgatatgttcacccccagacttgaagctgtctctgctcctaccagatctgccagaagctgtcaatgagtaccagcaaagtttatgatgggatgtaacaattgttctgcttgtccctctggggtctagcaagtttttaagaacatctgtgtgggcacaggtaggctgaacctagcaataagtttaacaaatgaattgcattgggaaagttttgttttctgtttgttttgttctgttttttggaatggggtctcactatgctatagctctggctgccctgaaactcttgtagaccagactgccattgaactcaaatatctgcctgcctctgcctccaatattgggaaagttttaagggttaattattaagtcacttgattggttatattggtatcaaataaggtgcagatggtggaacacagccctagcctgggagccctgcatccctggcagcagctaaatggcctgggtaaatgacctgttaagcagctgcagtttctgaagtagaacagactcagcttctggccatccccttcttactttaccttccccaagaagtggctcccagcattaggatgcattcaaggccaggaaaatatataatgataagcatttctaaaggctaagtcatgtgggtcttcctaaaaaaaaccagtgtctcatggtaagagggccaaggtactcaaggctgactgccggctccttgccaccacagtgttggctgttgatgctgagctgaatggggtacattccaagtcggtctggaccctcaacagtcagacacacacagggctctttgaccacagcacaccttggacttgagtaaccacagctaggctttgcggtcactcatggtatggtagactgcaaaatctcaacagccttccctctcccccccccccaagtatcggcttggaaggacaccctgctgggtacaagaaagtggataatctggagattatggaaaagcaccagtgtcccctaaagtgtcacactttagaatgtgcctcagattggtgtggccatttcttgtctgctctttcttgaagctaagacgttattgaaggtaaatctgctttgagtctgctgctcaactaagtgctcagtaggtaagatgtccttaagtggaactaagctgtgctcatggtagcctcgtttctagcttccacagacatggcagctctgtccacagaacaggcaggaggcagtgttcttggattgttttcttcaaggtcatgtttatatcgaggggagagaccctgatgcagtcaacaggttctagtcatgaatttatttagagccagatggtgtggttcactaacaaggcctaagtcttccttccttgtgattaagtgaagcagaaaaggaagcggtgtacatctgaattacactgtaggctcacaagcaaaaacgtggtcctatggtgaacagatgacatctcagagttctaaatctccactttatttttaagattagaagttctcaaagctgaggctgtagcttggtggatagagagagcacttgcctagcattgacaagacctcaagttccatcctcagcacttggggtggggttattatttatatcactaccatgaaattatattgttttcataaagaaaaatactctaaaatagactgggtaaggcattgtggcacactgtgttctaagcacccaggagtctgtgaggcaggagactcaagttgaaggccagcctgagctgtgtggagagagcacgtctcagaaaaccagtgctcaggttgggcagcatcagaggcagtgatggcgtagtgacattttcagaccaggtgtacatttggctgacgcgctagggtgagtgctggtgttctcgctgtctctgtaaggtactaatataaagtcccacaccagtgtcccatgaactgtcttttccaaggcttcgtttcacagttgtattttgatacaacatggatgtgagcatcacacttgtttaaacagatgtctgctgtgcttagtggttttacctctgtttacctgatgcctgtgtaaagtctgtgcttggctttgaattgtgtgtttacaccttactgtctctaaataaagagaaaattttatggttatgcaaaggggatttttttttattcttaccatctaatgaattttaattttcaagattttagctaaaaactaagagtaataacaagtgtttcttggaataactaccaacccagccatctgttttccccagtgtgtgtacacagtgctgttagcctgtgtgtgtatgcccctccagggccaggactgtgtctcagttcatgatgctggtgagctggtaagtggggctccccgtccttcactgctcttcatagtcagctgcatggagccactaagacaggaaggcaaggctgacaagaacatgacacaaccctgtagtctttttaggctttccagacccatcagagctgctgagggtgctgaggtccaactggatgctgttggaaacacctaatcccattttctagcagacatggctcccctttaaggatgaagagt

SEQ ID NO: 26464 - DNA, 1166 bp, Mus musculus
agtctttcacagttcccagccttgaacctcctatggaattactgttagggaaatgccccaacatgctttgattggcccttgtccatttattctcatatttagggtgtcagttgtatatcatgtagaattagattacagctgtgtaggttccagtgtgttttcttttgaatgggaagagcatggtggtttattagtaccgactgtggagatgaatgccattagtgggtttagcagtcaggctgttaacatagtcaacactatctagactttgatcttagttgtgaaatatggttaatactttcggcaaactagcagctaaagttgggttaagaagtccaggtggctgctgtaaactgtgggcacagacttcatcttacatcccaaacagccctactggtgtagtgcccttactttgacttgagagaaaatggtgagatcagaactagggtgttgatgagcactgacagtgtagagccagtgctcaggtggattattaaccaataaagagaagagaagagaagtgaggagctggaagagccagcacttgatcaactgtctctggcgtgcaccatcagaggctgaagctgaggagctgacaatgaaaggagaaatggtacctcagtagccttcaagtgtccctacagggacttgggaacagatatggaaagacagtcactgcagcaggaagccctggctgctactccttagccagtcctaagaagatcatgttacttgtgtaggttggtttttgttttttgacaaaactgagtttaatctcaaggaaacatgagataaaaccaattgaggggtactctgaaaaattcctgactggcagtcttcgagagggttgagggtataaaagagaattactgaagaatgttatagatgaagaattgtcacaaacagcatgacaaagcaaggcagtggcatgcatggggtctagctgaaaacagacacctagaggtcagttggtaagatttgaatgaagcctatcgattaatattgagtcagcgctcatttcctggttctgataattctgtagtttcaatgatggtgtgtacaaattgagaatgttggagttaattgtataatttgttcatttttacttttttcgtaaaagcctgagcttccaaaatgaacaggttaaaatttttttttaatcagtt

SEQ ID NO: 26465 - DNA, 1133 bp, Mus musculus
aagcttttgctcaaaccgtaccacaggctccgctgcctggccccaccctcactgtccctaccttaaaaaccgggttttgcccctccccttcctgaacttcactatactctgagaacgggtcagctgctgttttgtgttaaattccttctcattcattacaataccacttttttattgacatggaaataaaacttacaatcaatgagctcttatgaaatatacatcaaagcaggaagcagcagcgcgagggtttcatctgttctagggaaggaacaagggtttagggggagggggagacacggaacattttccttcccgattacatgatgcgattttcaatgaatctataaagaaaatgaaaacataaatacagtgtccaaacagggtgatccctgcagctgtcaaaacttaaaacagctcactttccctttgatttctgttttaagttctgaaatgtacatagatcattctcagcttttttctttctttctatccctccccccttttctttttacagggagtctctttttaaaatctgatctttcctggatcctccagctttgacccttggtggccaaactgacccaataccgggtaccctggacactgcttctcagccctcagcctgcccaagcctccttagtggagacctccctctccacattgttcttcccttgtcagtgtcacactgaggtacaagggcccccgccgcctgggatctatggacctactgtgctctacacgtctcagttttttctagccagggtctgctgcactgggggtgggggctgtttgtgtgtatgtttaagggtaatgagacacagacacccaaagaagtctagaagctgttcagagttaaacagtagagaattatgggctggggaaatggttcagctatgaagagtgtgacatagtacccttgtcagtcaggtgcctcatacctgcctgggatctctctctgacctcctgggacactgtacttaagtgtacatggctacaacagatacatacacacataaatttttttttaaaaaaaagaccacggtgtaggggaagtggttttatcagtaatgtacttggtctgaactttacctgagtttcatccctagtacccacgttaaaagccaggcatg

SEQ ID NO: 26466 - DNA, 1655 bp, Mus musculus
tgaccaaacttcagcaagtaagcaaaggagatgacctgaaaagctgaggaccaccaccagaaattgtcctctggactccacatgaacaaacacacacacatctttaaaagtgttagtttcatgttgatgttggtgtgcttgtgagctgactgaatactctgtaccattgtattgaagcagttacactgctggttccattgaaccagtgcagccaccagtcctaggtgcatcagagaacattacacccagtaaaatgagaaagctgcctcccctgatggctgtcactgtgctctcttccagcgcctctgatgtgcagtgactggatcgtctcttcctcaaactgctctctgttcccttggacctgtgttgtgcattggctatagatcccgctcgcatgtgatacctctcctgtgctgggcaccgagtcacacggtgttctgctggagcattggtagtctgcatcggagcccaactggtagccttgaagagtctgtcagctgaacacagccccactggattctcaggactgggtgaaaggggtgctctttggtcaatcaggagagtcaacccaactgtaggggcttcagagaagaaaacttagggtttgggtaagaagaagtattccatgagatctgtgcactatggagataggtgggggagtgggaagtggggtcacaggattgaagccaacctgggctacatagttcctccagcatatacacacacagtgggatgctggagcatcctccaaaaggagaagtgcattgcccagagagcaggagagtactgcagagaagctctagctctgcaagccccaatttccctgtgttccttctagctgttcccatactcaggctgtctgttgttgccctgcagagaaatgtgtccatgtgtgacccttagcagaacactgctgcaagggagtctgggacacccaaatgttcagacattcagacttctgccccatctgtgctggggagacagaagggaaagtgaggctaatgaaaccgcccatatactgctgtctacgttggtgccactcagcaatcttctgtctcccgagaactctcagacatgatttctgtggcactattagaaggtggactagagggctggtgagatggctcagtgggtaagagcacccgattgctctcccgaaggtccggagttcaaatcccagcaaccacatggtggctcacaaccatctgtaacaagatctgactccctcttctggagtgtctgaagacagctacagtgtacttacatataataaataaataaatctttaaaaaaaaaaaaaaaaaaaaagaaggtggactagaaggagcttctgcttgccatgtacctagcacttccccagatgtgcagataacggagtagtcaggtggaatgcactaatgcacccagcattcatgtggggtaggaggagcgggaggtcaaagtggtccttacaaatagcaggctctaggccagggtggcctatagatgactctggctctaacaaacacacaaataaaacattgtgtgaatgatggtattttagtacatggttctctacccagcccctctgtccctcaggcattctagactctgtgctgacaggactaaattgctcctacaaaaataatagtactaatgtataagccaattctata

SEQ ID NO: 26467 - DNA, 1113 bp, Mus musculus
tgggttagcgcgctgcagccgggcctagccggggtgagacgcgccgcggacaagccgcgagcgggcgaacgagcaggagaggagagcgcgtgcgcggtgaggggcgcgcggcttactgccgttgggaacttgcgcgcggcctgcgggagcgggcgcctgctgtgacccttctggagagctgcgtttggtgagagcggcggcttgccgctgctaccaagggcgggcagcgcttggtgtttcctgcaagcgaggcccgcccccggatctctgctgttctggcatcagcaccgccggccctgggcaacgatgtacagcgaggacccttagcttcggggcgagggaggcctcccgggtaaggatccgaccctctgtcctggcgtcgcttccgcatgggcacccggacgccctccccgccgtaccaggcgttgcggtgtggacagcctcccgtacgcccacagcggatgtgatcaagtgcctatttggcccctggaggagaacagtccctagggaagttggggggggggatcagtgttaagccgttccccccagtagtgtgtggatctaacctgacctaggtaactcattagatgacacaaggcccaggtgagatgcataatgtaagggacattttatcagtttttattttaatttcagaaatgttctttttgggggccaaagtgtgaatctgtctgaatgcagagccacatctcacagataagcccagcaatcacaaagagcatcacttctctgtaggaccttggtcaaggtaattgtcttattaaacaataacttcttttttagttatttgataagtactagagttaaaaatgtggcatagatccataccttgacatgccctcttctggtgtgtctgaagatagctacactgtactcatataaataaaacaaatctttaattttttttttaaaataagtctaatgtgtgcagtaacctctggcagcattttgttaggaatttttggaggtaggtcaggtgaggcagagagattagacttagtaattcgggcaaatgatgaaagaataggaagactcaagaaaggaggagtgctagactcagatgcagcagaggagagggacaaggtgatcctgagg

SEQ ID NO: 26468 - DNA, 1157 bp, Mus musculus
ctcttctggcctccaggaagaatgcctggaaaaatctttaaaaaaatgaagaaatctttgaaaaaaagaaaaagaaaaagaaaaaaaaaagtctttaaaaaaatcttttttaaaaaaaagtattaaaggaaaaagttcatgcataaaaataggtttgagcaaatctgtgttatcaaaccagatgaaagaatagattggcttatagaagtcttaagtgtattgcttctaatagacatatctaaaatgtaagtgagcacaaaagattgatggaataaatggaaaaattaccaaatgcttataaaaatgttaaatagatattaacatagaacaggttcctgctagtctttaaatgaatgagaatgattgtttcataaatgatgtgtagtttgtttgaatcaggattaaagaaggtctatatgcagtaatatagtccccggttgatcagtctactgaactctgtaactaggagattttctttgttcattgttcattgaattaatgaacctacaatgttatttataatacaattacttaggttcggcgatgggctattctgactgcaagaaacctggggaaggtggacagagatgactattatgacttacaggaagttttaacttgcctttttaaagtcattgagctggggcttttggaaagtccagacatttacacatcttctgtgcttgaaaaaggcaaactgatccttttgcctgcacacatgtatgatactaccaactacaaaaactattggctaggtgagtattattacatggacatgtcttccctagtgttctcagcacagagcaatctgagcaattttcttattacaaactttcatggttcctagttctttttttttttggttttttttggtttttttgagacagggtttctctgtagccctggctgtcctggaactcactttgtagaccaggctggcctcgaactcaggaatccgcctgcccctgcctcccgagtgctgggattaaaggcgtgcgccaccacgcccggcggttcccagttcttgttcctttgctaaattagcttaagtattaaatatcatttattctaaatgccttccatacagatacattttcaaaccctggcaagtcttttgtttgaagtagaagtgtcagtctgatgttgattattattac

SEQ ID NO: 26469 - DNA, 2222 bp, Mus musculus
ggagtaaaaaaacctaagaggaaacgctatgacaaagttacagctgaagatcctcagaggccttcctcttctgttggaactgatcaattgcctgatcgcagagatcttactgaaagtgatttaaagagtgcagacatggggatggcaactcccagttcaagtgttgagagagattctacaattttacagaagtctacaaaatctcgaactcactcaaaacctgttaggaaagttccagcctctaaggcaactaagaaaacacattcagacaccagaagaggacagtctaagagttcatgttacataagttgtagaacttctcctgctattgtgccaccaaagaagcttcgtcagtgtccagagccaacttcaacagttgaaaaacttggtctgaaaaaagcccctaggaaggcatttgagttgtcccagaggtctctggagtgtatagtccaattacgtgaccacgggaagactgttggagtagttgacgcccccaagaaagctaaattaatttctcctcagactctttctatcaaaaataataagaagcttctgacaagccaggatcttcaatttcaaaggcttatgagatccagatcacataaaaaacgagactttgattacaaaaatactgatactgtaagagtgtcacgcatagtacagggatcagatgtacttgaagcagactctgatgagccagatgatcatagagtaagtgagccacttgccatcagtaatgaaaaacagttagcaaaatgcatgctttccaaaacagaagtggcagaagcctcttctgatccttgggtgacaggtataacttgtcttgtgaaccagtgtgaatctagagtgttaagtggaggagtgccaacagatgtggtgatggtctctgcttcagaggaccctgtggatggaggtgctgtcacagttcaagttggggaggtggcatctgtgaaagctgcagagccagcgtctagtagtgatacagatgatgatgacaacttattcctaacacaacatgatcctcaagatatggatctgtgctcacagttggaaaataaaaccattatcgtggctcataaaaaagatacagttcagagagaagattctttaagtcggcctcagttggagtctttgagtatcacaaagtgtaaatacaaagactgtgtcgaaactacaaaaaaccagggtgaatactgcccaagacactctgaagctaaagcagcagatgacggcctgttccgtaaacctggcttgcctctttctgtagccaggcccttgagacctactactaccaagatatttagctcaagcagcgcttcacgaactgccaatctttccaagtctttggaaagtactacacttcagcagtcagcactaaaaaataagtcaagtggagcgcagcctaatttgaaggtgacaccaccctcttccatgggttctcagaagccagtggctgaggtgaaaagtctatgcaatatttttcattttcagactccaagcagttccagcaaacagagttgcaagcttacatttagtgagaacaggcctacatcagctgcttctccagtgaatattctcttgccatcgcagtctatctttgacaccttcattaaagaggtcttaaaatggaaataccaaatgtttttgaactttgataagtgtggtgctccaacaagtctctgtcagtctatctcaagacctgtgcctgtccgatttcaagattgtgcagaatattttaatgtttttctacctttgattatattgaatgcttttgaaacagtaagtattctttaattctttgcccctactgtagatagagaaatggttataagcatatagcctgctttctaagtttctataagtttgagtctatactcacttcagtgagaaggtattggaagatttggagttggtcagtatttagaccagggactagtaatacacagtagcttatccttacccaacatccttggttgttgggtagagaataaactgtggaaaggctaacaggtctagtagactagttataggttggttacagctacttgggggtaaaatgatagtggctttgggtggtagctgtggagatggaaaggctataagggtacattttagaatatatgactgatgagtggaaattgaaaagatgactctgtttggaggcttaacctggttatgttatgtttactgtctgccaggagtgaggtagaacttgagttcac

SEQ ID NO: 26470 - DNA, 1234 bp, Mus musculus
tggctgagctctccaaataaagagaatttctatcagttgcaattacgaaaatttccagctgactataaaaaatactgggagtttctgagtaagttcatatgcaacttggaatatataatataataactggaaatttttacttgagagatgccaggggctggtaaggtagaccagtgggacgagcatgtatagctttcaccagtagtacagacagtagccagtgatcatgacgacagccgtgtaaactcaatctcatttagctcttgttacaatgagacattaaggcagaaaacattgagataaaaagaacaaatggtcagaagtttagttaataagttctgtaattttagtgcatgtgtgtgtgatatatagagaaaatatgaacagataaaaagtaaactgtacatgtgactggattgttttgtttttttgaggtagcctcttctgtgtgtgtctccctggctgtcttggaactcaatagtagaccaggctgccctcatttcacaaagatctgcttgcctctgcttccctgagtgctgagattcaaggcacactgcacacaacacacctgacttttgtactattaaatcagtgaagagtgacaagtaaaatacaatagaaatgagtgcctcttatataccaaatctataatatatccacggagatactagtacatttatggtagagctggttttgtagttgtcgaactcttgtggattgtgagtgaagcaaaccctgatattgttaggaagcagctctcgtggaagagggtttatagtgggttaggtgatgaacccgggaacttgggttggaagaaccaacttttcacattcaaattttagagtttacagaaatgtagaactcagactccacagagttttcaacaagccttctcacatgttaaaatctcacatacatggaacagtgatggaatcaggggttagcattgctctagtacagagtatgagagaggcctcattcataacacagctgcggtcccagtgatgcctgttttctgtcctgggatccagtctaaagtccaaacatctggagttgtgctgtctcctctcagtccccagtggtctagcgtagttcactcctcagcctgtcttcactgcatgttctttctaccagttagtttgtagaacacactctttgtttcccagatgttaccttagacttgaggttttatgcatttggtaaaaatagaacagaagaatagcttttcttggtg

SEQ ID NO: 26471 - DNA, 1146 bp, Mus musculus
aaccctcattgtgtactgaagctttcatggtcattattcagtcattttgcaccttcaaaggagttgacttagccatactcttaacctctttgattcactaaactatctaaattgaaagactaaatttagactaggtctggctgttttccaccttgtgacattgtattaggaaagaagagttcttagaactttcactgtcgaagcagagaattaaatggaaaatatcagaatagctgaagaaaagttatttaagaaaatttattgtcatatttgtaaaaagcattaaagtacaattataaataaactgatgggtatggatattaactagtaattagtgtccaattaggttttctctagttgtgaaagatcagtcacttagataatgattttatttgacatggactggaagaaagttgaataggtgctgttcttctcccatgtgtcaccacagaaagaattcattacatcttttctataggttgcctacttaaaagactttaatgaagaccaaaagaaagccatagaaactgcatatgccatggtgaaacactcaccatccgttgccaaaatctgtctgattcatggaccacctggaacaggaaaatccaaaactattgttggtctcttgtaccgcttactgacagaggtgggtgtggcactgttagcctggacatggttccatttgacccacattaagagatgtacctttgccctttatttacatgtgtatttaaaaagatttattactactattgtttgtaattttatgtgtatgggtatttggctcacatgtatatctatgtactacttaaagagaatagaaaaagataagatttccctggaactggagctgcagacagttgtgagccatgatatgtgtgctgggaagtgaacctgagtactctggaagagcggccagtgctctttattgctgaggcagctctctggccttttgaatggattcttggttgggctgaatattcattaagtaatagtaaaatgtaaggcctagtgcatcccaacagttgtgataaactttatggcagagaaggctttatgtatgtgttttatgtaggagtgaaaattaggatcttgtatatgctcacaagtgctatgtctgttgaactgcgtgccacagttacttat

SEQ ID NO: 26472 - DNA, 2700 bp, Mus musculus
ggatggaagtaacttctaattcttgatctgtttgttggtcttgttttcagtactttttgccagttgtatacacttggagagggaatttgtatgcctgtaatcttgttcttgaggtcagaaattcaaaacattgggagcttttgttgtaaaggttaaactgtgaatccatatagcaaatgcagatccttttacagtgtaaaccacatttcctgcctcagcctaaagcactggtcattttccaacagaacaaacttccaatttaaagagagagaggaggacagatcctttcaaccattgtgtggtagatgaatttaacagcctcagtactgggagttagtcaagtttgaacaagtagctagtgtcttcagctggggtttcgtgggcctttagaaagcagcacgttgggagttgtgctcataagtgcactttgaaacaaggcagcttggcacagggcatgactgtgacaagttcatttacctatattggtgtataggttttctggctaaaaatctttcccttctcaaaacggaagaccaattcttgaatggtcattcatgcttgcaaagttttgtgaggttgatgtaactggggaattgtagacagcttagcaaatggaggatttgtgctggcttggttggtctggcctggaagagtccatttaggatgcttgtgaaggcttgagagttgcccggaaaattaaaaaggatgcattttaagggatcccatgggagctacacaggggcagaccagatagcatatctcaggcaggagagaaactccatgagaaagaagagcagccgtctgggctgcaggaccatccagtaggtaggtgaaagtgcagtctatgttgggtcactgcaggcactggactccatcagacctggtgtggttgtgagaggaaagcagaggggcctggaagtcaagtcgggacaagggagggagggctgtttaaccagtctctatgtagaagggcatgtgagtgtgaggtctctggtaactactgtgtgcacagcccgttagctgccttggggcaggaagacagccctaaaacttagtgtttgctgttaggagggatttttgccatctgttcttacacaagggttttgtgttagaaattctgctgaaggaggttttgtttgttaagagctttgaaaaaatgcattttgccaagtttcaacacttgagtttcctgatctctttctgctagtgcccagacatgaaccctaatatctgctgaatacttgtaaagctggggagtaggcaccttctcagagcccttcagcctcctggatgtccccagctaagtgggaaagaaatcctgctctggctagggcaggggttcagtaagctcctgcatatgacattggcaggaaacctcactgtcacttgaaattttctttcctagtatctgtgagaagtgctcagtttagccaaaagtgtgcttctgagaggggaataacaacagcaatagccaggacgtttccttctctaaagacccaagaagtacatttgtaaaaagaagattttccaaaacatgtagttggctgctctccaatgagtatgttgtaggacattgtgtgttcatctgctggctcatggctagccacatccgagtattggaatttgtattgcagcctgcttattttgtgaatgtaagggctgctgggattagactctggccaagggatcttccttctcagcaagcagacttgccttagaactgtctcacagcagaatgtagttgcattatattagatctgaaaccttatttattccagttggtaaaggtatttgcagaaagtgtttgctgtgtcaaggggcctttcctgacagtgctgtcagaaatggtcaaccctgacaagatgaaaaggtcactttgtccttgctgtggttaaaagaacatgccctgactactttcaaatgttatttcaaggtgaatatattatacctgtcttactttgcttctctcttgatttaccacagtttgtccagttatgttttcatgaattatcaggagtaaatttgaacaaaaacatgtgaataatctcctgtaaatgtgttttataacaagagtgtgctaaactattttctaaaaattacttgtgcattttgggaatctttctgtagctttgtgttttgtatgctctggattcataactggattttggcaaatagtaaacctattatctttgttaaaacctaaaatttaagagaaaatggcagaaataaaaacaaacaagaaaactggcctgggttagaagtactccatgctgctaggttaaggctggaagaccctccccctgccagctccttgtcttcactcccctccttgcccagtcccacactcctcatccttggggtcctttggtgccatggaccaccctggccgggtatgggggtccctgggaggtgggtaaggattcggtggtgacagacggaagcaaacacagaggctctggatctattttgcagctctcaagggtttttatacatagagaaacaggtgtgacagctctgaaaaggtgtgttcagtgacgcagtgaaatagacataacaataatcatttggtacatcaaaatatgaaatatcatccaagtcttacaacttcagaaaaaaaagtattttcagaaagacatccaggtagaacggatattgttatgatcatttagtacatcaaaatacaaaaatcatctaaggcta

SEQ ID NO: 26473 - DNA, 1189 bp, Mus musculus
gcagctgaattgttgagcttattgtagaccctcattgttacagggctccctttataaagcacctaaataattacagtgtgactatggtgtggcattggagtaaggctgcttgtaagtgacctggcatccagcagtctgatgagaactgccgagtctccagctctcagctgagcactggagcagcactcacagccctgccatataggggatgagaggcaggaacttaactaccgcatggagtttaaacgtgagtttagcagagagttcctgcctcattacctggtgtgctagctagtcttaagtcaacttgacataagctagagtcactggaaactgagagagaccctcaactgagaaaatgcctctattaagattgggctgttaggcaagcctgtgtgcattttcttaattagtgattcatggggagggtccagccagttgtgagtgatgccatccctagactagtgatcctggcttctgtaagaaacaggctgagcaagccacatggaacaagctagtaagcagcacccctccatggcctctgcatcagctcctgccaccaggttcttgctctgcatgagttccagtcttgacttcctccagtgatgaacagtgatgtggaaatataaactaaataaaccctttactgcagtttgcttttggtcatggtgtttcatcacagcagtgatgaccctaactaagacacttggtcctggagacccagaaggtctagagaagaaatgaatgatttcagctagtcatagtaagatgggctagatatcaagttgacaatggttgcaaggtggatttagcagctcttaatacagccaggcatgtagtaaagggtattctacctaggtgggagtgcggccaaataaaggtgccgaataactgatgtgtggtcagagtcaccctccagacccagttcaacagtaaagctggtctgtttcttcaaatcagggattgcaaacggcaggccaaaacctaattggctgtctgtttttgtgaataaaactttattgaaacccagcctcatgtatgtagtcgagctcacaaagccaggagtaactgttgtcctctacttttagggaaacatgtagaacaagtgaaagtattgtcttatatttgggtaccaggagataggaaaatggtctgtaactgggtgagaggtgtttgcagcataggaggt

SEQ ID NO: 26474 - DNA, 1196 bp, Mus musculus
cggcccttaactcctttatggggagtgggttctgtctaagcctaagagccaggtcacatgagtgagtggcagatctcttcctcagaggacagatgtgcttctagcacactctgatctagtgtttagactctgaattagctctctgatgacaacgaagaaagcccatcctacagcccacgttaaacgactcccagctgctctctgcccctccccttgacagcatgcttgtccccaacacatgcttcactagctctccaccccagcatagtgcagctctgagccactgcagtcttctgtgtggaagctggtggacagtacctctctcagttctccttccctccctttgctcctcgtttccctcccaggaaagccttcacaggagcctgctgtctagagcaggtctaagtgtccctttctggaaggccctggggaggaagacccacagtggtggtctctcccacactgcagcctttcatctcagtggcctctggtgctctgaggaactgacccaaggctaatttatggcatggatctgagctcatttcaagttgatctttgggtgagaggtgtttagagaccaaagccagacagagctctgttgcagtgtttccagcccaccttccatgactgctttaaaggtaaagagacaggcagcctttacccaaaacactgctcttaaccccttgctaaacaggatataaaaacattactgtaaagaaactagatatttcagtccctgctctgtggtagtgctttagtttgtaaaggatgttggaactaaacattattcatcaggcagcctcaaaaaatcatgcatagcttactgactgataattctcttgtgggccataaacccatttacagattcagaccaagaattttgggtgacttctcaaacatgcacagtagcactttgattaaagtatccttggatccaggatcacagtgccttacagtagtgaatcacagcagactcaggcttcctggaaaaagaggaagtgctatgtttccttccatggtcacttcatgactcctggaaatttccattaaacgcagtggattcaccctgttgtccctgccttcctcccctgaggaaggtctgctagggtctcacatgctaggacagggctttgcatcgtaggagccctgcttccttaagatctggagggactgtgccttgggctgttgagccctta

SEQ ID NO: 26475 - DNA, 1262 bp, Mus musculus
gaaccctgccattctgacccacctcatctgtctggagaattactgccctagaataggatccaaggacaatatgcatgctttcccagcccaaagcagtactaagcaaaaacggaggctaaacaaacaagtctttaggcaagagggagttccatgacctctttgctccaaaacatgttggtcatcacccactgtcgcagaagcagacctgcaggaaatgctgtgagctgttttgatgctctgacttgtgataggagagtccttggttggccttccttccttgctggggtgactgttggtaggtagaattcgatggctgggactgtaggatggacacatacacagtgctaatgttctctggatgcagctttgttccctgaggtgagaacttcttcgctgtcagacactagctgtctctttgcacatggatcctgctcagagcccttcctcctctccctgcaaccttgcctctttcccttagatctgagtcttcaaaaaaagtgcttatggaactccagggtcactagtgagagctggtgacactgcctatcccaagaagcctagccccttcccagcttggttgagagaacatggaggtaatttatcagagttggtgaataatgagaatcaggccttcccaggtgtctcacagtcattgcgcacttggctatggcctgaacagtaatcattgctcactatagtccaaagcctctgtctccggtcttccctcaggaatggttcgcccttccctgacacctgcatgctcattatggctctcaggttctgggacctgagcaggaagcacagcttgtgtcctgacagttaaagtcccagctcttccaacagcaggaggcgctgtctcaagtaggtctctactgaaaagtttcatcactcagcagcactcctgtagccttctcctctgcttcatagctcggcctatgcagttgactctggggcttgcttgtgacctgtgacctgtaaggaacattggctgtgggaataggtagaccacacatgcaggtgggcaggtgtgtgtgtctctcagggtgcatcttctcacccaatcagatcctgccctcccagatccactgtgtgctggactcacgagttccttccgtgaaccgtttctggatctctctaaagtaagccctttaccctgtcagcatttagctcattctgaacagggggcatttcccaagctggcagagcgtgtggacaggtttccattcccgctcgctccatccggtgccttctgtagcctgaaa

SEQ ID NO: 26476 - DNA, 1103 bp, Mus musculus
caggcatctgcctctgagtctaccacttggctttgaaaccctgcatttgtcatttgcaaaatgtagttcttgtgattagcagaagagcctcaagcaagagagctgcccctagataagacagcccaaaagtaggcattggcaaatgggatgaggggagcaggggaaagacaagagacaaagggggagtgagagcagtgttacccaggaccctccctgccctaccccctgggcatggtcacatcccaccccaaaggaccatagctgtctccccaggcaaccattgggagctttaaagcttgactacatacctagcctgctgctgccagccaccatgataaaggctggtactctggtgccagggccagtactgagcacagcacctagggagagtccaagtcatgaaagtaacttcctgtgactgtgtttagtggccttttgaaaaagcaatgtggtggcttatccatatttccttttttgttttgttttgttttgtttgagacagggtttctctgtgtagccctggctgccaagcaactcattctgtagaccagactggcctcaaactcaaaagatccgcttgtctctgcctctcaagtgctgggaataaaggtgtgtgccaccaccatcaccactacccagctcatatccatattcctaagaatatccaaaacttagccatcctgaggctgttccatgcagggatggcctgtctctagaggcttccctcacagtcaacacacaccgtcctcttgctgtcatccacctgggagctgcaggctgggtcagattctcagtactgatgtgcaggccacccctcccaccctagcagcctggccaccagaggaatgaaacagagtagctgagaaataagctgccaagacagcacaggccccatcccctggcaactctatgccagcgttaacagagaaagtcagtctcactgaagcttggccaacatcaggcggctctgcctttaatgaattagcttcaagcaaacagaggttgcctgtcagtcttcactatcttttttactccaaaaatgggttgttcgtccaggcatatcttttcagaagagccaactctgtttccatctttcctgccta

SEQ ID NO: 26477 - DNA, 1148 bp, Mus musculus
tggggtagtagaggttcgtttgcacatgtggtgatcagcacagagagtgggaggaagtatagcctcctttcagatagtgccatcagcctgcaggtccctttctgaaagcagtatagtcatgaaagtctgtaaggggttgtctggcattctggcatgaccaacagcccccactaggaaagacaggacaaccaggccatggtggtgcacacctttaatcccagcacttgggaggtagaggcaggtggatttctgagttcaaggacagcctggtctacagagtgagttccaggacagccaaggctacacagagaaccctatctcaaaaaacaaaaccaaaaaaagaaaaaaaggaaagataggacacaccagccatgctgagcctcagttaacctaaccaccttttctcttgtctgttttctccttcccacattcttgtttgtgtgttttctgcctgggttctgtagtacaaatctgtgtttaggtcttactcccaggacttcatgcctcaccaccaagcctccgtccaacctttccttccgcctacctcctcttcctctccacatttcccacctgtccacacgtcccagagctcggacttagcggtgcccaccgtaagcagtccgcctcccagcaccgtggacgggcctctctcgtcttctcaggacagcagctttcatgggaaccctgtccgccttccttccgaaacctctttcactgactcggtgagaattcagcacacacatctgtgcacgctggcctgcagggttttagaaaacgatgctactgcccacagagggccttgtcctccctccctcggcccaggctgctgctgggttaaggctactcaagcatgagtaggttggcacctaggggactgcagttctgattgatccacctgttttcagaacagaaaccaaatcttttgtataggatttctatcacactgggaattgggctagtgaccatttagaacagtaaattgtcacaaagatgagatagagaacactgtgagctttctgttgtatgtctgtgaagaggtgcagactcctgtggagtggaagaaacagaggtaaggtttcttgtaggcccatgcagaggccctgtgcttcatcagaacacagggaggaactacactgcagagcagaggg

SEQ ID NO: 26478 - DNA, 1106 bp, Mus musculus
gacctgaactaaaacagccctgtgaatttgacagacagccctgtagcttttggctcaggctcccacccaaatgccaggcgataccagagcccacagataggttatgcaaagagctctagtaccagcaggcctgtgctgtgtctggcatggcacagcacagccatccttgagtctggtgtactctcctccttctcccaacacgcgcgcacacacacacacacacacacacacacaggctttctctgtagccctaactgtcctggaactcactctgtagaccaggctgacctcaaactcagaggtcttcctgcctctgcctcccaagtgctgggattaaaagtgtgttccactgctacctggaatgtctggcctaccctttgtctcacacataagtttctttaccttccagcctgtgaagtacggctatagtgctcaccagcacactagaacacacccttcaagaggtcacaggctcctgcagtgctcctctgcgtttgtaccccttgtatgcccaacctctgctctttctagaaagttccaacgtaacagggagttggttagaatacaactttgaggctgagcacaactcagggaccaggccccccacacctcaaaggtgatggcacacagtgtgatggtatgacgtgccacacagagccttgagccccctctattttgggaaatattaaaaagatcatcagcaagttcccaagttacacccagctactctcagccccagcagtctctctagccagttcttatctcatggagactttctgactcagagctccaaaatctctctacccaactcgctaagttctcactggcgagtcactaccatgccagccccacacttcaaaactcccatggcctttgtggtgcacatctggcaaacccacactctgccaccatacctttctccctttctctcttgaacccagtcaaaccactgggtgaaggaaaacaccacataaacttagttcagaaacagtggtaactcaatcactgggcacaataactagaatcctaatcttgtaagccatgttaaatctaaatcctctggtggcagatcctggtggatgcaccatggaaaccaggagacactc

SEQ ID NO: 26479 - DNA, 2192 bp, Mus musculus
cacctggccgaggaagccctgtgggaactctctctgaagatcaagcctaggaacataacaaggcggaaaacagaccgcgaagagaagacctaggagcaggctggctgtgagaacgctcaagcagccaggagaggacctggaccatcccagcctcagcctgtccatgcctggctgtgtggcagcacctgagtctcctggccggtctcctgcctccttccctatggctaaagtcccagggttcacaatgagctggctggcaggcctcagggctggcttgtgtactggtggcccctggtctggttttgttttctgttttctgtcagtgctccctcctgttccctcctctcccctgcagctggagagcagcagacacctgagcagcagaccaggggaatggcgggcttcactgtccccaggccaccctagcctccttaagtggcagataagtaggggccccaggacccttgggtagactgccctccgggaccctggagccaggggagctatggctgggagacagaagaaggtagaaagggaccacgcaggcatcttgtgctgcccacttcctgctttttaaacatggagggagaggcatgtcaacctggcccagaaagtatggtgggtggtaggcaagagccacagagctgacacttctcacagcagtggccccagctctgtcctgccatgcacggccactaaccaaggcacctgctgggctgacagcagcagcaccagtagcacctgtcgcccaccactggtccagccccagccccagccccagccccagcccacatcaccggtactctggggatcgggaagaggaggcagaagggacagttcatgctgagctggggccaagactgtgcttcagagagtgaataaggatcttcagtgacctagggagaggcaagcagcccctccgtgcttgctgtgtgccttaaatgccatctcctgttccttccaggcctgtgggcttccctcctattttgccccaccccccgcagccagcaggttcctagtccccgtttgctctctgggagtgtctgttcccaagaagtctaagcaggcctaggacgtgagggcctccagaggtttcctgattccagacaggtggcagagccaccccctgctgctgaggttgacaatctgttcagggctcagggctaggatctccctgggcatggccctgtggccaccactgtgggctaaatggcagggtgcagttcagaatccagaggtgctgctggccctgcaccatacctccaattagctttgcatggacaagctcccttttcttctggtcgtggggcttggtcaaacgaataccaggatctctgcttcctcaaccagtccgcagagcagaagaaaagacagcagcagctgctggccgggtactcgtttgaaacaactgtcactctgaaccctcctgggtttcggggtttgtttttttagcagcttttatcaaataagaactgtgggcccctcttctgtttatttgtgctgtaaatagagaggggacatctgtaaacagccccttggtcagctccctctggtggcagccggaattggattgtttaaggagtgtgtgtgtggagtccggcttgtgagcagtcatgtgggtctttggtttgttcctcttttacaggtcctttcatttcagtctttgcccctgcttcctgtccttcaccagctctaagtgctgctgtgtgcaagtggggaacactgcacatgaggtccttcctcccagcgctgtagaggcccctgcagcctccctgtgtagcacaggcctacctgaggcctagcctactggtgctgcagccaacagagtgggtctatggtctatgtctactggttcccaagcatgagctgggcagaaaggagggcttaccttctagacccagaatcaccaggccctcctatgatcctgggagccttaggcagactaagtcaagagccaggacagctctggagtttccgtgtggggatatcgaggtgcgatgtgtgggtttaacttattagccagcaggcttccccagtcacctgcctctggctgcgactgagcccagtgttcaggcagcctggcttccacatgtctgtttcttagtggtggggtctgggagagctgtgaagattcgtctttgtatacatactaagcaacatggacagttgggttcccagcagaggccagccat

SEQ ID NO: 26480 - DNA, 1552 bp, Mus musculus
caaggacccaagctccactttggagttggaaagctgttcagggcagtaaagggccaggtagcaaccagatggagagcaaacaggctcttcacaggtcagaactggtcactccgcaggagtaatgagatcaggggcccctgagccattatccttgagacacagactaactgcagaggcaagcaggtgtggccatgggggcctatcgtcccagctaattgggaggcccaggttagaatcttaacagttcaaggccagcctagggtttcttagtaaaaccttgactcagagtcaggcatgatgtctcaggcctgtaatcttagccctccagaggtagaaaggaaaatcgtgagttcaaggccagcctgggctacttgcagtgttcagcttttcaactgatgggaaatgccgctgcctcagcactccttggccgtgagcgatgatcttttcacagagggaaagtcttttttgctgtttcaaggtgtctcacagctgagatctcagtactactcagctgagccaggaggatggctctgagtttaaggccagtctgaacaagtctcctggagtactttgtggtatgtgtcagtatttaatcctgccagtcaatcctgcaaacctgtaattagcacctgggtggtggagactggaagatctggagttcaaggtcatctttggctacataagttccaggctacatgaaacgttatctctaagacaatataaaaagcccagaattattttttaaaaggttttctttcttatgcatgtgagtatttacatgcatgtatgtccacacctggtgcatcatggaggctaggaaaggatgtaagagccctgtggctgggcttaaaggcagttgtgagccaccaagaagatgctgacaatggaccactagtcctctggaagacagcttaaccactggtccatttcttcagaatttaatttaattgcctgccctgtgatacaatgctgtaactatcccgtgccccggctgtaaacacaggctgatgattgttggtgtctgcagtgtgaacactaacaggctgatgattgttggtgtctgcagtgtaaacactaacaggctgatgattgttggtgtctgcagtgtgaacgaacactaacaggctgatgattgttggtgtctgcagtgtgaacacttacaggctgatgattgttggtgtctgcagtgtgaacacttacaggctgatgattgttggtgtctgcagtgtgaacacttacaggctgatgattgttggtgtctgcagtgtgaacactaacaggctgatgattgttggtgtctgcagtgtgaacactaacaggctgatgattgttggtgtctgcagtgtgaacacttacaggctgatgattgttggtgtctgcagtgtgaacactaacaggctgatgattgttggtgtctgcagtgtgaacactaacaggctgatgattgttggtgtctgcagtgtgaacactaacaggacagcaagggatggtgttcactcagtggtgccggtggaaggcgtggtgcagagaagacatcgggtttataaaatac

SEQ ID NO: 26481 - DNA, 1141 bp, Mus musculus
cagtgaggaagcacaagtgtcaccctcaagaagacctgtggtgggggctgagacctcctagaggaaacataccagttaggagagcagtcctgagtggcgactgtgtagacaagaagcgtgtgcttagtcgggtgtggtggctcacgcctttaatcccagcacttgggaggcagaggcaggtggatttctgagttcgaggccagcctggtctacagagtgaattccaggacagtcagggctacacagagaaaccctgtctcgaagaaaaaaaaaaaaaaaaagtgtgtgcttgatcccacaggtactggaaacatggtagatagggaagaggtgtggccagttagcaggacagaacaggaggaggagaccaagggaaggcctgtgaagagacagggctggaagctggttgtggtagtgaacccttataatatagcacttggaaagtggaggcctatcttctactacacagcaagtttgaggctagcctggactatttgagaccctgtctcagaagaggcaggtctgaatgagattaggctctggggtggggtcactgtcctgacctccaggcccctctgacttcaggaaacatcgtggggattggccagtgcttactccacggcatgactgtggtgatccggaagaagttctcagcctcccggttctgggatgattgtatcaagtacaactgcacagtgagtgagaagggacaggcatgagcagccccatccccatgtccccccccccttgccacccatacactggggcatctgagcagctgagacttcagaatgctcccttgggcagcgtcttcattgctcggatgagagggaagggactgtcgggccactgtggggaggtgacgaagtgggcacccctagagtctggactgacaccacacccaccccagattgtacagtacattggcgagctctgccgctacctcctgaaccagccaccccgtgaggctgagtctcggcacaaggtgcgcatggcactgggcaacggtctccggcagtccatctggaccgacttctccagccgtttccacatcccccaggtggctgagttctatggggccactgaatgcaactgtagcctgggcaactttgacagccgggtaaggtccagattggggcta

SEQ ID NO: 26482 - DNA, 1531 bp, Mus musculus
ctactctgctgcccatcagagatgtcgttggacatacagtgtccccgtgtcctttctcccctccctagctctccctttctcaacccgtcatcagatttgtaggagctccaacccctgccttgcactttctgacttttcttacccactctctagggaccttcaagttccagaagacagagttgcggaaggagggctttgacccatctgttgtgaaagacccgctgttctatctggatgctcggaagggctgctacgttgcactggaccaggaggcctatacccgcatccaggcaggcgaggagaagctgtgatttccccctacatccctctgagggccagaagatgctggattcagagccctagcgtccaccccagaggggtcctgggcaatgccagaccaaagctagcagggcccgcacctccgcccctaggtgctgatctcccctctcccaaactgccaagtgactcactgccgcttccccgaccctccagaggctttctgtgaaagtctcatccaagctgtgtcttctggtccaggcgtggcccctggccccagggtttctgataggctcctttaggatggtatcttgggtccagcgggccagggtgtgggagaggagtcactaagatccctccaatcagaagggagcttacaaaggaaccaaggcaaagcctgtagactcaggaagctaagtggccagagactatagtggccagtcatcccatgtccacagaggatcttggtccagagctgccaaagtgtcacctctccctgcctgcacctctggggaaaagaggacagcatgtggccactgggcacctgtctcaagaagtcaggatcacacactcagtccttgtttctccaggttcccttgttcttgtctcggggagggagggacgagtgtcctgtctgtccttcctgcctgtctgtgagtctgtgttgcttctccatctgtcctagcctgagtgtgggtggaacaggcatgaggagagtgtggctcaggggccaataaactctgccttgactcctcttagcctgacagcctggctccttgcctacctccttcccctctagcccctttcgcttagcccttgggataagcccttagccagtcctcttttccaaagctctgccttcctataactccttaggagagactcccaccagatctgacaggatgttaaactttggaacttaacctttaaagtaagcatgtggctttgggcaagtgtctcctgaattatgggggtaattaagggattcagaaactacacaaagccattaggagtgggaggatacttggcgtctttgagggaaagccctcccctgcacagaactgtccatggacccatgcgctgttgctccatcttctgccaaatgacccattggagcctccccagccctctgaggctttctatgaaagtttcatgtctaagctctgtcttcttggccaggaggcctctgcacccgggctgagactgacaggcacctttaggatgatgcatctgatccagacagactgcctgacct

SEQ ID NO: 26483 - DNA, 1163 bp, Mus musculus
gctgcaggaccaagacagcatcctcttcatctccacactgcacggcggctgaggcctccccagtgggcccaagcacctttgcaggggaacacaggacaaccacagcactcctcgatctgcttccaggtcctcagtcccccttggctgcctccttccctgctgtacccctgagcttcctctaggcagggaaaagaggccaggtgctaaaaatgagcctttctgggcaaggcacgtgagcagggagagcgaagagagagagcagccgcctgagtccagcactcctcccagcagctgaggtgggggagggtgttcctgtgctgtgtcaggagtagagggggctctgtgcccaggtgacccagctgcttgccactcatgtgtcttggtgtatctaagcactgagtggttgcctggaaggcactccagttcctgagacatcttcatggggaagatagatgggctggagtaactgatgagaaactcctcccttgccaaagattagaagggcctccgcctcagtttccccatctggacacagagagctctgcttgtcccccactgatgtcattatggaaccccagctggggtcccctattcagtgctcccctccctcctccacccagcagctgctctcccccccacccccttctccatcctttgaccctggctggcctcccccccacataggccaccagatgggctcctgagatactctccaggctgcctacaactcattctgttgcgggtagagaatggaagggagcagcctaaccgtaggcagagggggcggggcctcagcatgtgtaactccaggcttcctgaaacaagtgggatttgggtgtgcagcacctagtgggcagaaggctgtgtgtgtccctttcctctatcttctggagacttcatgcctgcagcagctggcctcgggcaaataaaaagactaagtgactaggttgtttactagccttgcttcacccttaaaactggtgggccctgtactctctgggtctgtgggttctaatacaaatgccctgttctgagccaagggttcagagatggccttcacctgaaaggtaaaaacatgaactgttccaaagagagggtggatgagtaggacggtgtggatgggaagggagtgtaagcccgtgatgaccagcccacattctaag

SEQ ID NO: 26484 - DNA, 2046 bp, Mus musculus
aactaattcaaggccatgtacctagtcctctgggcagcttgctgaggcattagttcaaaacagttaaagagctggttgttggtcgagtatgcctttaaccccccagcacttcagaggcagagggatgaagacctctgagttcaaggccattctgacttatagagtgggttctgggacagtcaggactacacagagtaacaacactaaaaaacacagagaaacccaaaaccaagcaactaacttcccccacccccacccaagggggataaaatccatctcaaccccgggcgctatgtgcctcccccagtgttggcaccttagaagaggatgcctttgtctctgattgcccattgttgccttcttattcttggcccctgttctctttcttcggttaggcggatcgcagataccagagccgcctgcaggatctgaaagatcgcctggagcagtctgagagtaccaaccgcagcatgcagaattatgtccaattcctcaaggcctcttatgcaaatgtgtttggggatgctccctatacatcctcctacctgacgagctcacccatccgctcccgatcgccccctgcctgaggccacctgtccagggtgtgatgcccgtgcctgacgccagacaactgtggagttagcaaaccatagctggcaagcccactcgttttcaaatgtgctcagggtctgttcctccactaatgccaggaaggctcctagagcagccagggatgagtcaggaacaatctggttatctttcctgacctgggaacctggtggaattctctaatcctcacagccgtgcatttgccacattaggtaccagattttgaaatccctggaactttacatacagagtctgcttcctttcctcagggaatgtttggacggactgttccatgcagactccttccagccctcctctttccaggcatctctctcttggggttttttgagctaaagttgcaggaatccttctccactgaatgcctacattgccttttctttcctttttatttatttattttttattttatttttttaataaaaatagaactttatttgtatcaagaaatagtgaaaacaggtaaattagtatctgaggtaaattagtcagggctcatggagatgagatgttcacggctcccttgctcctgtggaatctgtagctacgaatgtcatgaaaataaatacattgtttgcgtccctcattacatagcaactggcatagtcccagctacagcaggtgtgttcacaatgaactgtttggacacagacctaacagtggcaagtgtgcttgtaaccatgtggtctggtttcacagttctgggaactgcaactcccagcctcttactccaggaacaatacccaacggtgtcatccttgcgcaggggccatggtgatctgtattgttccagctgtagtggatgctctgctgaaggggagtcagcttttctcctcctggtgggtcctgcaggaagcagtgttctccttggtgcccggggaaacctcccatgtctgtttcctataggccacttgttcctcacgaccatccggcctgacaatcagaattcctatctcattgcttgtcagttctctttgtatctctgggattcctttatttttgaaatttttgtgtggttttacaggaaataaagtttgtatcactatgtcagactcctttgatttcccttatcccctccttactttataaatgatcaagctgagtgaggtgacacatacctgtcgtaagcactctgtgagaaagtccttgatgtgtcaattacccacctttcatttcattgtgggcaagataggcagctgctctttgttggtttcagaagataaaccatctggtggcctgaggttaggcacccatcaggcctcgatgcttagggtttgcggaggatcacttacaagcataggtgtggggtgtgcctatgtttgctattaaatgctacccactttctgggtgataagatttggggccattttttcttttcctgcattgaattcgtgggagagaacacttgattagaatgtg

SEQ ID NO: 26485 - DNA, 1421 bp, Mus musculus
gtgcccagaggctttctgacaacctccttctggcgctcctgatgtcctccgtcacactgtgtggcaggaggggcaacaataaagcaactgggacagcgggcttggaagaatcatgtcagattgagaaattcgtcagtgtgtttttatatatctgtaccccatgaataaggcttttatagttcacagcctctgtcattctcttgtcaggtttggtagttgtgttggcgtcacagacagatagagaagtggcctttctaattctcacaggttacaaaagagataagaaggggcacttagcacttggctgcacttggtctctagtgtctgtcgctcagaaagctggtgattctttctctgcttgactcggacctgtagtgagccctccattttccctccacactgccccactgttcatacacatactgagaaagaataaaccgccaagagtcccttaaagtgtcaggtactgtttgcagtctggggatgaggtaaagtgcttacactgtgtggcttgtggcgtatgtgtgtattcagaagacatgaatgatgttggtgtggactgaaccccagagtgtatcagggactgggtatatggatcatgactgggagcatgcactgtagagaactctgtccccttgatttagaatttggcccctggctggctgagggtgctgtactagattaggtacctttttgttgtttttccaacaagaattgagttgggttgaccatcagcagtgcgtgtgctggggtggaggagctgtctgtctcagttggaagttggtgtttgtttacagacacactaactctgctgcagaagccgagcctctgctctggtcatgagggcctgtgtggcaggcattctcattagcactctcgaatggcttaagcattttaattgtggactagagttcccaaaaatgtaataaagcttgagttttaaaagttctgtcctgatatgtggttacctcaatattttctgtgtcctgtgtatgagctgtgtatgtaaatcacatggacatgactctgtaggactagatatgcagtatatggttcttctctttatctacttgaccttcaccttgtaaagactggttttgcatgatccctttttttaaaatgatgttccagtaactgacattgatctagcaagagatgtagggggttgaggttatagcgtcacctaatgtgcagagaccttgtgctccagctgcaatgcccttcccaggaagagaagtgcgaatagctcggcctgctaatgttacagaagagagtgatcacttgggtcaggtggctgaactgcattcatttttgttttgtaacctgggtatgtctcacctctgaactgcacacctccatttacagagcaaaagaattgttgctgcagtcttcctgctgtgcctggtagtagattctgggtg

SEQ ID NO: 26486 - DNA, 1197 bp, Mus musculus
caggctagccttgaaatctccattctttcgcctcagcctcctgagagaaattcattgatgttgagaaatcagttgattgatgggtatatgctaaagactgtacttttaaagagggaaaggtcacttgccattcttagccactctaagcatagtaggaaaggtcatgtattgctgaattttagaagctttatataaaattacatctatttttcctgtggtcttaaatgactagagtataaaatggtttctttttctctttgatgctggcatggaactgataaccttgctaggcagttgctctactgttgttctctattcccatggtgacttaattcttataagatctaagtagcattatctttgtttctcacataataggtaaagttctctccttgacattaaatttggcaaaactgcttagaaaattgcatgtttaacatgaggtagggtttagggacctgagagatggctcagcagttaagaaatctctcccataggtcttgtaatgggatctgatgccctctgctggtatgtctgaaaacagcaatgtactcacatatataaaagaaacaaaatcaaaacaaaacaaaattagggtttagtgaatttacaccagtcttcacagtttctgtgataaataggaaagctggtttaaatgagagtaaattagaggtgggaaatatatctcaattttgttaaagtgcttagcatgcacaagaccctcagtgtggtccccagtacagcataaaacctggtgttggtagaacattcttgtaagctcaacacccaggagggtcagaaattcaaggttatctgtaattacataacaagtggccagcagtgacatgacacctccctttttaaaaagtcaccctaatggtgcttgtacatttctataatcccagcactcaggaggcagaggccagcctagtctatagagcaagttctatgacagccaggattacacagaacaccagtctcaaaaaacttaaaaaaagtaattcagacatctacaattcaaaatcaagataaaaagatttgttttgagtaacatttatgaattcttcaaatatcaatctttcctttgaatcttgaagccccttagctcttcactttaactacttcactttttgttgctatcaaaaccatcctctgaagagccagagtaggaggtgctgtgaggagtaaatagacagc

SEQ ID NO: 26487 - DNA, 1238 bp, Mus musculus
ctttaacaggtactagggctgtgagaacaaagcagagctcggactctggtgttcccagtgcacttggatggctgtatacctggtttgactggttgacttctgcagggatgtagatgagaccattggttggattaaggagaaagagcagttaatggcctctgatgacttcggcagagacttagcaagtgttcaagctctgcttcgaaagcatgagggtctggagagagatcttgctgctctagaggacaaggtgagtttgtttgttttgttttgtttttctgaccaggtctcactgtgtagctctgtctgtcttggaactcactatgtagagcagctggcctcatactcagagatccgcctgcctctgcctctcaagtactgggattaaaggtgtgtgccactacaccaggctataaggtgggttgaaaaccactgattatgttagttagccacagtgggagagtgatgctgatagaatctgtttttaggtgaaagccctgtgtgctgaggctgaccgcctgcaacagtcacaccctctgagtgccagccagatccaggtgaagcgagaggagctgattaccaactgggaacagatccgaactctggcagcagagagacatgcacggcttgatgactcgtacaggtagcaaataatgttttggtgctcagcagtcagagtttgactgttgtataaacaggagaggcagagggtcaattttagggaccaagaatatatctgtaccctgccaggaatcaccaattgtaaaagtaacttttatttattattacttatttatattccaaatgttgccccccttctcaatcctccctcccagagtttttcaccccattccccatccccttgcgactgagagggtactcatccactcacccacccccataagagtaacttttactccccaaacctaattgtcgtcttggaggcttactgctgaatgagctcagcctttctagatctttctgaactgtggctggctggtacagttcagctgttctggctcaaactcctctccaagctgactgattcagtctggcttctcagctttccactgaattgttcgacttagcttcaaactaacactgacaatttgttctaatctgcttccttcttattctctggcttcagctgcctctgctgacctgcactgaactcacagatgaatttaactccactgtactgtactcactgcactgactcccagttgaccgactctctc

SEQ ID NO: 26488 - DNA, 1127 bp, Mus musculus
ggcgttgtatatatgtgtgtgcactcgtacatttgcatgcatgtatgtatgtaatatattggaccaagagacttttttcaagcatgtatgacacattccttattctaaaaggactttgcagagagtcagtcctgctttagtagttggtatgactaggagacagatgattgtaaagtgtctcaagcacttgtgcactctcatttgcagctctcatttgagagtcctcttcacatagtcttgcttgcagtctttcatctatctcccagtcaccttgacaatttcatgcagattgtttatgataatttgacagtaaattctaggttagtcaaggtggggttcttatggatagcacacacatgccaactctgtagtatttctctatttcctatgataagcttacatacattaagtactattgcacagagaaatgcctaaagtctagcatgaggagtagactattctgggaagctctgtgtctcccagaaggtaaaaggtaactttgtttcccattccccaagctgagcatcctctccgaggagagaactgccctgctggagctgtgggagcttcggaggcagcagtatgagcagtgcatggacttgcagctcttctaccgtgacactgagcaggtggacaactggatgagcaagcaggaggtaatgtgtactggaaccctcaaccagggagttgaaagggtcatgccctgcttctccagtgaatgctgactgtttcagaacgttggagccatttcagttttgaatagagtgaagaagggaactaagcaggtttcttttgtctgccttagtcattgctgactcagcaaggcccttagaaaagatttgtgcagtacaaaaacgatttctaaacattagagtttaaccctgtgtgtaacctgaatgaatgaaaagctgtaagggctatgtgagaggtggggttggtgcctgtttgcattctcactaagaaggctatggggagtggattgcaagtttgatgccagctgggctccttaccttagagggttaaagagtgtctgcactgcatagtgagaccttgtctcaataccctccccacttaaaggaggaaattatttgaaaactgtttgatagaatatatagtaagtattcttt

SEQ ID NO: 26489 - DNA, 1152 bp, Mus musculus
tccacttaacagtgatgttcatgtctgtgtagctcactcttgagaactggatacttttccccctccctccaaaatcacaatagaatctcatacattttaagtttagggttttcatgttactctaaattcatggctgtcctggggtgcatacagcccatgagccacaggttggacatacctgtaaatctgtaggtaaacataatcagccacctgggcccagtagtaagtgtgtgtcacagggcaagcctggacagagagattagggtgttgggtgtttttgcatggcttcatagcacatgcctttaatcccacacttgggaagcaaacacaggtaaatctctgcgttctagaccagcctggactatagagctatttccaggacagtcagggctacacagggaaaccctgtcttgaagagagattgattaagagaaatattgagagagagattgaaagattaggatgtgttctccatagtccaggctctgtgctcacagtgacaactcctgccttcctttctaggcccttgatgaatttgcaaccaaactcatccaaaataaccactacgcaatggaagatgtagcgactcgacgagatgctgtgagttccctgggcatgtcgtgctcctttctaagatgcttgatgcagctcagtcaggccagtcaccttttggggagtataatgtagagtcatgtaatctatcttacagctcctgagccgccgcaatgcccttcatgagcgagccatgcatcgccgggcacagctggctgattccttccatctgcagcagttcttccgtgattctgatgagctcaaaagttgggtcaacgagaagatgaaaacggccaccgatgaagcttataaagtaataaaatcagagtttcctttagtagttgtgtagtaagctaaaccttgcaaaaactacttggagctaaaaaaacaaaaccaaaaaacacaaagaaggtcacacaaaccacactagttagcgtaaatcttctgttttatgagtgtgaagtagctatatatattctccagttcaggcacaaccctcttctttttttgattcgcaggatccatccaacctgcaagggaaagtccaaaagcatcaggcttttgaggctgagctttcagcaaaccagagccggattgatg

SEQ ID NO: 26490 - DNA, 1069 bp, Mus musculus
ttgatggagctagtgttgctgagctggcaattagagtcagcactgtcctttgggtctgttttgtcccctggcctgctctgtgcagtaagtgtgtgcagtacagggaatgcagccttacatgaagcagagttgtcaggaacatgaaggtaaactaaccctctcatttaattttcctgctgtttctccagtgatttcgttcatggcctgggctgcttctaagagcttttgaaggattcctatgtttttcccatttcaagcatccgccatcatggcaccagttggagctgctgctttttattcccatagattaatcccactaatgtgtgcatgcttttgctgtaccccctctgtgcaggacacgcataactaaggaggccggcagtgtatctctgcgtatgaaacaggtggaagaactgtgagtaggctgagaacctggctgagctcccatgtcactgctacacctgtccattcctctctgccgctcttctccaaagcactttccattgagaaggaggtggtgcaggggacctgccacatcttcacagctttgctgcctgtgggagaatctcagaactgctctccctggttgcttctgcctgcttgtgtttggaatggtgttggctcactctagctttgtggtagagcaggagcaggtcctccataaacctgcagccagttctgttgtattcctcaatagggaggcaacaacgtgtgacttagaggttaggggctctgatttctggtgactgttactttttgtttgggaagcttagatttagtgatgtttttcagatttttctttaactttgaatttcatttcttactcagatttgtcatttttgtatcttgaaagatagtggtagttcagcttataagtcttagttctcatgggtgagaaagttcttttgattcttctcaggtcttgtaggtgatggagttgtgtacaaactgcacactaccttatattctttcactgctcaaaaatagagatcaccatggagatgccctactggtcagagatggaacatcctgtattggactatattaaagctcatatcttccccctctt

SEQ ID NO: 26491 - DNA, 1147 bp, Mus musculus
attagatatgactttatttgctcttcaaaagatctctgttgtggtacgctgctgtttgcaagacaatgaaaaattacaggcaaaaaaattattttcccaaggtctggttgtgggtgtggcagacaggttagaagagaactgacattatcattctcctgtaggagctgaatgagcgttggcggtccctgcaacagctggctgaggaacgtagccagctcttgggcagtgcacacgaagtacagaggtttcacaggtgagggtaccaagcattagctgggacaggaggaaataagaactttgccccttgtagacgaggcttgctgagtgggacctcagcataagtagctatgccttactgatgtttgggctcttaacatcaaagccatgtaagaacagtggatgttgttaatcctgttgggagtgaatgtgtgcaactacgacagatatgcatatgccagccctgggacaaggcagtggtgcttgtcactcactcatgtgtcttacctccagagatgctgatgaaactaaagaatggattgaagagaagaatcaggctctgaacacagacaactatggccatgatttagctagtgtccaggccctgcagcgcaaacatgaaggctttgagagggaccttgcagctcttggtgacaaggtgagagatgcttgaggaaagctgaggcctgaactctgcccgtcagagctgtttccctgaattttcttacaactctttgctcataggtgaattcccttggggaaacagcccaaaggctgatccagtcccaccctgaatctgcagaggacttaaaggaaaagtgcacagagttaaaccaggcctggaccagcctagggaagcgtgcagaccagcgcaaggccaaattgggtgactcccatgatctgcagcgcttccttagcgatttccggtaaaaaaaaaatgtcttagttatgtttctatttctgtgataaaataccatgaccaagtcagcttatgtaagaaactgtttatttggggctcacagtttgggagagataagggtccataaccatcatggcaagacacacaacagcaggcatagcactgaaactggaactgagagctcatccccgccctgccccctctctttttctgtttttttgagagtttctc

SEQ ID NO: 26492 - DNA, 1420 bp, Mus musculus
cctgtctacatagcaagttccaagacagctaggactacacagacttggtgttgtggataggtgtaacagttgggactgggcttcatgacttgacaggtgaaggatccccctttttttggtacacaaataagctatataacccagtcctattcaatttatgtctaggttaacctaaaataatcctctaatgcagaagagatagaactggttcctagacagaggcctgcttgattccagatagtgtagtaagtattcctctgtgaatcttgtttctagggacctcatgtcttggatcaatggaatacgagggttggtatcttcagatgaactagccaaggacgtcactggagctgaggctttgctggagcgacaccaggtaggtcctgctggcctagtggccttacccgtccccgtcttgggaaccagggcttgacactagtatgggcatcttcagcaagttatctaatccctttactcctcttggcaggaacaccggacagaaattgatgccagggctggcactttccaggcatttgagcagtttgggcagcagctgttagctcacgggcactatgccagcccggagatcaaagagaaacttgatattcttgaccaggagcgcacagacctggagaaggcctgggtccagcgcaggatgatgctggaccactgcctggagttgcaggtatgtacactatgtctcatcaggtattttcttacaagtggccaactcctccttcacacctacttgtccactctgtagctgttccatcgggactgtgaacaagcagaaaactggatggctgcccgggaggccttcctaaacacagaagacaaaggagactcgctggacagtgtggaggcactgatcaaaaaacatgaagactttgacaaagctatcaatgtccaggtaggtcctggacctcgaggtcctagtctggatttgtcctgagtcacatcttatttgtagccaggagtacatagtgagaatctttcccttaaacaaacaggtgcagtagagtactgcctactatgcttgagggtcctgggttcaatccccagttctgcaaaaaagctcacaccaactaagattttcataccagttacaaaacagaaacattatattgggctggctacatggcttcctggttaagagcacagatttactactcttggagaggaattgatttcaactcccagcatcctcaagtggttcacaagtacatgtaactctagctcccggggtgcttatgtctctctctgctgcgggcccccacactcagcgtttacatgtgcatgaacacatacctgtaatgagaaataatttttttaagaaaaagtatattctgtcatacatccaatgaatactttcaatgaatgttgtgaaaatgtgtatatgaagaactatttttaaaaatgg

SEQ ID NO: 26493 - DNA, 1128 bp, Mus musculus
ttgttagacatctgctggtgtccctacacttgcacacctcagtatgaccttaagtcctcttgaattaaaccctactctagtaatgatgataatcaagctggcttctaaagtgtcgatgtgttccgatcctgctaccagttagtttcgtcactcaaagtgtaactatctcctctgaaaactatcaggctgacaggctttcttcagcccaccctgacctctttgcctgttgcctttaggaagaaaagatagctgccctgcaggcctttgccgaccagctcattgccgttgaccactatgccaagggagacattgcaaaccgacgcaatgaggtccttgaccggtaggtgtcctgcgatggtgacagtccccagctctgagaggatgaatgtccacatgtgagaagccatacctattccagcttcttctcttattggaaagaacactcatatttggtcttcacactcaggtggcgccgcctaaaagcccagatgattgaaaaaaggtcaaaacttggagaatctcaaacacttcagcagttcagccgggatgtggatgagattgaagcctggatcagtgagaagttacagacagccagtgatgagtcatacaaggaccccaccaacatccaggtaaggggctcctaggacacttgttctgaagtgccttgtcactgagtagagctgttaaatgggactctttaagggagtacacctataaaactgtgtgttccatgataaagcttagaaaaagtccactgggtcagtagagccatttgaaagctgctcccttgctagactttgtcgaagctataacctgtctaatggagctgcccctgtgctgttcccatgcgccgatcttcctggggaagtatgatggcagagtgaggctctagtagctgagacatgttcatatcagttactgaattcttctttccatctgtttttgtagctttccaagctgttggtaagtttttcacacttttaagagttctagatatttgagctctgggatttatgttctactctgtagagtactgttactgtggttacatctggtccactggtgtctgttcatccgtcatcagtctaatccccagtcactccatccaagtgtccctgtggggtgtgg

SEQ ID NO: 26494 - DNA, 1160 bp, Mus musculus
ttgtcgtgtcctatgagcctgaacccaacagttaattccagaccttcctctctgaaagtactgtctgccttttgtcccttaggaagctaagctgtgtttgcacacagacatattcatggatattttaaaatattttatccactgctggagagatggctcagtggataagagcactgactgctcttattccagaggtcctgagttcaattcctagcaaccacatggtggctcacaaccacctgtaatgagatctgatgccctcttttggtgtgtctggaaacagttatagtgtactcatataaattaaataaataaataagtgtgtatacacacacacacacacatatatatataaaatccaacggagacttttttttttttttttttttttggtgctggagattgaacctgagatctcaaacacactagaccatggccaatattaccaagttataactccagccccacttagtggatattaaggacgtactaataatttcccctccccccttctataatcaggggccagcggctagaggagtccttggagtatcagcagtttgtagccaacgtggaagaggaggaggcttggatcaatgagaagatgactctggtggccagcgaagactatggagacactcttgctgctatccaggtcaggaaagctaggcgagtgcacagacagtggcagtaccctcgagttgccaacacagcccacagcggagagtcctttttccttccaggagcagcctctactccaggctgtttccacacctccatctccctctgtgtgcactctcctctctggcattccgtctacatgcccatctgtccaaattgaccttgttttgttttgtttgtgtttttttttttttttttgaggacatgatcttactggtaagagatactgcaaaatatcccttaatgacctttttcttatgttcatggccctaaagttaagctcatcccatagacacttccagttgattaacagctgctgtgtgacaacttgtattggtaggcatgtaacctccactgtttccagggtaaaactaagtgagctgaaaagcctcagttggccacagtcagacttgacaaccggggcagcttgttgagcccacataggctctcattcttctataggctagatcagcttcccc

SEQ ID NO: 26495 - DNA, 1149 bp, Mus musculus
cagctcttaggaggcagaggcagaagaatctctgtgagttttaggacagccagggctaatcctgtcttgaaaaaaaaattaaaaaagagggctgggaagatggctcagtggttaagagcactggctgtttttccagaggtcctaagttcaattcccagcaaccacatggtgactcacaaccatctgtaatgggatcttatgccctcttctggtgtgtctgaagacagcatcagtgtaataaataaatcttcaaaatacataagtaataatagtgacaataatgaaccactagtgctcacactgctcacactgtgcgccctcctcatgctttctgtgcactgattcctggaattggattgctagtcccaggtcgtcacgctgagatcttccttcagtatcatccttaggacgcagatagcccacaggacagagattgagcgtttgtctgggaacctgctgcagataggtgactgcagctggaggcaaaactaacttctgcttcttttcctggcctagaacaatcaccatgaggagaacatctcttcaaagatgaagggtctgaatggaaaggtgtctgatctggagaaagcagcagctcagaggaaagcaaagctggatgagaactcagccttccttcagttcaactggaaggctgacgtggtagagtcctggattggtgagtgggttcagcaaacccaaagcttttaactctcataggctaagaagaggggagagcacacagttggatttgtgcaatagagaagagactgatagcacatgggctcagagagtggcagcaggacaggcctagctgctaaatactaaaagacatccagaagtcagaattgccacagcagtgcctacgccaaattggcataagggttcaccaaacaagggcctgcaaacttttgacaggagcaaaacaaagaccgaagtactagtgggctcaccaaagggtcaggtcacatgagaactgcttgccagctgtcctggccagtcagggtccagctgcagcagggtggtgggtgcaggaagtaggcagctgggtgagtgcaaggaagctgtcagtaacttattccatctgccattttgagggctgtgaggggctgggacagtttagatgctttgttttgcaggtgaaaaggagaa

SEQ ID NO: 26496 - DNA, 1891 bp, Mus musculus
tcaaagaccagctgctagctgccaagcacattcagtctaaggccatcgaggcccgacatgcctccctcatgaagaggtggacccagctgttggccaattcagctacccggaagaagaagttgctggaggcccagagtcatttccgtaaggtaagggtaggattgagctggctcggtgggatggacggtagacccatgtgcctcgctgtgccgccatcctgggaggaagaaggaacctcagtggaacctgaggcatatggggcccttgaacttgggcgaatttatcctttgaccctcccaggacaagcatagctcgtgctgaggaacagcaggcagaagactagtcaggaagattttgagatgggcagagtgcaccagacccccagcagaccctactcgttgattcccaaaacttcctcacccactggcattttgcccctctacttctaggtagaagacctcttcctgacctttgccaaaaaggcatcggctttcaatagctggtttgagaatgcagaggaagacctcacagacccagtgcgctgcaactctctggaagaaatcaaagcccttcgagaggctcacgatgccttccgctcatccctcagctctgcacaggctgacttcaaccagctagccgagctggaccgccagatcaagagtttccgggtggcctccaacccctatacctggttcacgatggaggccctggaagagacctggagaaacctccagaagatcattaaggtacgcctgactagcgagccatttaacaacctgtactccctgcctctgggctgctttgtgtagggccagcttcagtaggacttcctgcccccttccttaagtaccactagcctttcccagggtagaaccatgttatgctgagcccatctgaggctcaagaagcaaccgaaggtaacagcacctgcctcccttttgtctcaggaacgagaactggagctgcagaaggaacagcggcggcaggaggagaatgacaagctgcgccaagaatttgcccagcatgccaacgccttccaccagtggatccaggaaacaaggtgcttgccctctagagctagccagggactgtggtgctcctggcagctggatgccaagcctccagctctgggacacagggagcttgtttgaaacctggtccctagccaggcatctggctacagtttggcatctgtaattccacaatccaggaggatggctgtgaactagagtccaacttggttcatatttatttgtgccatttgaggccatagcaaaaccctgtttcctcagaaaaaatggggtggtggggaggactgcttagactaagactatcatagtctgattggtttccagagcaatagcaatagcgggctctgcatggttcattgccccaaagacgatgttggcaactgtcccaagggaggtagaccagtcacacctggcacacaggctcgggcagaagagtgctaatgttctgtattttcttctttctacatcatcctgattgctgctgtatgtggatactaccacggctcctggacacttggatctccatagaacgtatctcctcgacgggttaatattgccttcttttccgggctcctggtgtggtggtgtcttgtgtgcttgtccctttgtcccttgtccccagtggcctggcttgcaaaagatcccaggatgggcctcctgtccaccttgtccattcccattgtccctgctagaagaacccatagtgttggggggtagggggtgtcacttcccctctttcaaggtagggactgtagctgtgctaggaagccagagtcaagtctgaggaccctgtccatgcctggtcaccagaactggattgcctttccctctttgcctgttttcccacgatgacaaaaaat

SEQ ID NO: 26497 - DNA, 1832 bp, Mus musculus
catagccccctgagctatggggtcccagcctcacactgcatttgtcccacccaataagcgcaagcaccaggagattcgagccatgagaagtcagctgaagaagatcgaggacctgggggctgccatggaggaagccctcatcctggacaacaagtacacggagcacagcactgtgggcctggcccagcagtgggaccagttagaccagctgggcatgcgcatgcagcacaacctggagcagcagatccaggccaggtaccggtgtgggggcccagcaggagccagcctagagcccttgttaacaagggacgggtacaggatgggaaacaagccacttcagcatggagagcctgctccctacttttgttcttttaggaacacaacaggagtgactgaggaggccctcaaggaattcagcatgatgttcaagtgagtatggcccaggtaccctggctgaggttagctgggtcacaagggaccatgtgctgagccctgggctatgtgctgcagacacttcgacaaggacaagtctggccggctgaaccatcaggagttcaaatcctgtcttcgctccctgggctatgatctgccaatggttgaggaaggagagcctgatcctgagtttgaggcaattctggacactgttgatcccaacaggtaatgtaaggggcagtgatggacagagtcctgcctccctctgccctccttgctccattgtacctgtctcccacagggatggccacgtctccctgcaagaatacatggctttcatgatcagccgcgaaacggagaatgtcaagtccagtgaagagatcgagagtgctttccgggccctcagctctgagggcaagccttatgtgaccaaggaggagctctaccaggtaggacttgggactggcacagctgatgctgaaggatgcacggcatcagaagcctgagcctgctggcagaactagtatagtgcaagtctttacctgtgggcacttgaggtcagcactggttgacgtcactgtaccatctctcctccagaacctgacccgggaacaagctgactattgtgtctcccacatgaagccctatgtggatggcaagggccgagaacttccaactgccttcgactacgtcgagttcacccgctcactctttgtgaattgatcaatcctcttggcttgtaggcaagcctgacctacactgcttgccctgttatctctatctatctatcacctttgctgcatgtcacttcctctgctttcaaggagaatattccagacagtgttactttccagtgtaaccataagcctgcttagcttggggtaagacttagtagaaaatggtgcttcaataaaccgcttccagtcacaatcaccaatgttgtgggacccagacccatgtttgagccagctgccctcattcccacttaaatcaaagcagctggctcagctcccttgtttctcttcccaaatcctgttttcatgtaaaagaaaaataaaggactcatttcccctctaaaggctttgctcctctttatctagcttgtttagcacacagccatcctgaagcatgctaccaccaccaccaccaccatgctccttggggctctcaggtagagtttttttttaaaagatttatttattatatgtaagtacactgtagctgtcttcaaacacaccagaagagggcatcagatctcattacggttggttgtgagccaccatgtggttgctgggatttgaactcaggaccttcagaagagtagtcagtgctcttacccgctgagccatctcaccagccctcaggtagtgatttctgcttctagctgatccaagtcctcc

SEQ ID NO: 26498 - DNA, 2099 bp, Mus musculus
tttttaattttctccagtccctgggagcaagttgcagtcctttcctccctgtccctctgtgctcagtcgccctgttttgaggtctcaacatcatggttctcaattaatttggggggaagtatcttgagcaaaatacaacaggaaaagaatctccgtttctgttcttaattcattttttatcctttcttgtctaaatttgtggattccacaccaccatgctctgtgggaaaaaagaaaagccctccagttcccttggctctgctggagggcgctaggcccctgtgtagtagtttatagaattttagcttttcttcttttctctgtatattgggctcagagattacactgtgtctctatgtgaatacagacagttagcatttaccaacatgtatctgtctactttctcttgtttaataaaaagaaaaaaaaaaagaaaaaaagggggggtatagacggtgagcaagggtgggtttgaggtgtctggggtaggtgggcatctgacaacatggcttctcctttggcatgtttaattgtgtggtttaacagacatccttgcaatttaaggtgacacttaaaataaaattctctcctgatgatgacttgagccctgacactcaatgggagaatcagcagaacctgtatggttttatttggagttgacattctgttgtaattttaatttttttctttttctttttcttttttttttttttttttttggttttcactggaaggaaaaagatgctcattttaaatgttgaagtgtacaagttgctttgttacaataaaatcagtgtgtacacaaaggacctgatgcttttctgtcaacagatgctcaacagaccttccaagtttgactgcataatgacatcacgtcaaactttgtctccccaacttcgtattttttgatacgcactttgcaggatgacctcagggctgtgcagattgagaaagggatttgaatcatgtcttaacgtctccgtactgagttgtgggcacagcttgctgctgtggacttatacccttgatttttatctcaatttggcattttctttttaaaatgggcctttacccggacctcacggcagcacctacctgctcccaccgttactgacccgttgctctgtgccatctatgagggacagccgctgacgtgtcctcattggcagtgtgaactgtcagggtcagcagtcagtgaggtggttggtagtgtctgtcacaggtatgtagcagaagctctcagatgtgagactgacgtaggtggatgaagagctgtctgctcagcgccatcgggcagaggataatgtttgggaagctacctgatgcgtaagctttttaatgctgtaaaatagagctaaaattcaatgccactttttcagagatgattaatggacagcctggtcaaattcaaagctttctgatgtataaaactttataaatggaactactccatcaataggcaaagtgtaaccaaaatctgtctagatggatagtgtgtaatttctgcacaggactctgtttagtaaatacatcactgtatacgtcaggaatcttgctccaataaaggaacataaagattttttttggactggggtcattctccttgttttgtagtgacttagaagatgcagtcatggctggggttcaagtgatactggcttggcagtaatcagggcccaaatggtgtgcagaaggttggttgtggacaccagattcataaccatttgactctgcatgtggttgggggagggtgctgacctaaatgaatactgaccccaggagagagagtatatgtgtgtgtgtgacaaaatagaaatagcattgtatcactgagctatgtctctacactcccttttgtttttgtatgtgtgtgggttttggggaatatgagcttcccatcacccactgcactgcggtcttccttatgtgtgctctgtgtgattatttgtatgagtattttgcttgcttgtatgtctgcaagaacagttttctggaaggacgggagagggagttaaaagtccttgggcctagagattctagttcccctgctattgttactatctcacataagaatcaggtgaagccatgcggtagtggtg

SEQ ID NO: 26499 - DNA, 1199 bp, Mus musculus
ctctcatgcatgatttatctggaagtagaagtgacatagctcaggttaagggtgtgtgcaatataggaatgttatgctggctataacacaggacagcggcctttgaagaaaggccctgggagccagtccctctcctcactgagctgcctgcctgagtcctctctggcacacactccttgtttagacaggaaagtcatgcagagcagactcagcagcatttcacggaatctctctcaggcccaattctgcctgcagtggcacaggccaattgcacccatgtgaggaaggctggaggcttatgtgaggagtcagatagtcaacctggcaacacctatgggattgcaaaggttcccagtgctgtggggaagaaaagctggtgctctgagagaataggagcctcagtttagaggaggtgaccttgcaggatgtgccggtcatgaggagaatgggaagagctttctagcctaaggaactgatgcaggagtaccctgaggcttggggtaccgtccaggaatcctctcctttagctttctgagtgccacttctctgtccagatcccttccagataacctctggatgccagggggcagtcaccaggctcttgctgcctttctgctcagactggcgttggagtagccctgcccgtaatatgatctgggccaggtttaggtcaagagtcccatcctgtagtagttttgtggaggaattaggggctcaggttctgtcttattggtgatggcagtaggttgttaaggtttcccaagggccaggaagcagtgtgctgggcctaggagctttgaggagtacatgtgcatgcctgccctgtcacactccagatccaagccgccctcctaatgttccatgcatctctccatgccagcagaggacgttctgtgataaatgaccacaggcaggccttatacattgcatacatctagagacagatgggtggaaatagatgattctcttgttggggattgaactcaggacttgacccttagatccacacatgccaggcgagtgctctgccaccaagtggcatcctcagctccacacaagaagtctcaagaagtgtctgtggtctgtgagaatttggctgtgtgccatagaaacacttaaaatatttacacgtgttccttttcacagacacatatgaagtaactgtgcagatgccatttctactgcctttttaaaaactg

SEQ ID NO: 26500 - DNA, 2407 bp, Mus musculus
tttggggcctaggaggctgacagggtcctgccatgcctctgcccagtagctcctcacccctgtgctttcatcttccctgagtcctggtcaggggaggcaattagctaatgggccagaaacaacttctgagtgttggtgctcagactgcctggggaagcaccccagaagagctgagtgactgccagttctagggccaccgtttgtccctgtccggtgtgtttgcttgtggccggtagggttgtctcccaggtctctgctttgtgtgtgtgtgtgtgtgtgtgtgtgtgtgtgtgtgtatgtgtgtgtgtatgtatgtatacatgtgtgttcacacatgccctggcagtggggtgagggtatgtgggaaccctctaaggccctgcttcccctctgtgtctacctctgcctgtcccttttcttcctttgccagaggcgtgtgtggctcctgctgtctttcttttgtctgtcctctttaccctggcgctctcctcccctctgctccctgaggccagcattcaggagtgtagcttagtgagaaagccctggaggccaactttattggcatcctgttcccatccccagcctgaggcctccaggtcctctatgtcagagcaggaatccccagtacctgctccaatggcagcctgtgatgctttgagcctctcgcccattttctactcaagaatggagaaaggagggatggggagagccttcagttggagagtaagataccctggctgctgtgtgcctgggagttgccatttcaggagtgatgtcatctctttgatggccatgttcccatctggtgtgtgtagttctcatcaagggcaagggaccaaagaaagcttctctgggtccagggtggctaaactggaaggcctggagcttcacagtaccagagggctacctctgccatctgcccccatgggaggcggagcggggaggcggcgggggggggggggggggggggaggcttcggaggtgctggccttcctggtcatgtgcttgatctatcttctgactttggggctgggttccctgaaccctatagacttttctgaccatgtttcttccggaggtcaggtggcttgagtcctgaaggcaggttggcagcaagggctcttaaccttctccagagactggccagcaggagtgaggctccagtagctggcacctgaagccttcctgagagcagagggcagggctgcctccttcccaggccattgctttagccaggttgggttgagtgctgctgggactctacctgcctttttactaccttctctctcaatacacaacacctgggacgtattttactatttatttggacacaggctagctatttattgcagagtggcaagtgacctggggaggagtggccaggatgctaaaggagttggagaattcaaatatggattgtcttattccccaaggttaaccctgacatcctctccccgttcctgcctgagagggctgccagctttaccctagagccgagtataagggaggccatatacactcccgccatcttgaccgcccccagacctaggacttggtagctggtagctcagccccagtactgctccctttgttgactgggacgcagcaaatgctgcccaggacgcggatgcattcattccttcttgcctgcctcccccaccccaccccttgccccgtttcctgggaccatgctactggaatcactgcatctgatttgtttctgtgggagacctgcatcctgtgcccaccacttggtccttgagatgaaggccaaggacatggagactttgtcttgggtagggtggctccgcagttggacgctgcctgagggaaggatctgcccttgattcttaagggggaaccccgagcctgagctcctgcagctcccgggagctcagcaggccagggctgttgatgagtcgtccttaataaactgtgctctttaccatgcgtgtcggtgctgtgctggctggacttgagactttggaggagaggaaacagttggagcaaggacagagccagagtcccttagagtgttctaagacagaccaggagatgcttgccaagacacttgcagttcggctgcggccagccagagacggccttaggaaggaggaggtgcgcctgggcacacattattattaatcttcttacattatatttctttgtgtgcagcctgcgggtgagggagtctagctggcattggttccctcttgctatcatgtgggtcccagcaaactcagggctgctgtgagcacctttacccactgagccagccatctcacgcacttccggcagcgcattgttccttaggtcatttaatactatgttttatttagttttgctatgtagttcaggctactcttgttcatcctgtagagcctctgaggccagggtctctgcctcc

SEQ ID NO: 26501 - DNA, 1198 bp, Mus musculus
atgtcaacacatgccttagccagggcagccgtaccatccgcaccgaggtgagccgcagcccgagttcttgcagcccaccttgcgtgccttttctaaaatttacttatgaatgttttgtctgcgtgtgcttgtgcacatgaggagagggcatcggatcccatgagactacaggtgtcaatagttatgaactgttatgtggattctgagaattgaactcaagacttcccggagagcagccagtactcctaacccatctctccagccccagcctaaagagcttttctgaagctgggatctttaccacagccaactagtagcagggactgaacacaagagcaattaagagttgcagtcctggccctgtgccctgtggtagccctgtgttcttaggttgagggacccaggtgatctgtctgtctgtccctctgcagggcttcttgcttccgcttccttggttgtatcctaggtccctctgggtgttgggggaaagtgtgccacaagctctgagcatccacaggatctatgcacccatcctggagactagcatgggattcagtgcctgtggatattatgggggaggctctgttgctgtcagcctcaggggcagtgactatgcagacgggcagccccagtctccctgtctctgaagtcttgcccatatcactaattactgttccaccagtatccctcctgaccctgaggtaggtctcacatggggcctgaaaacaagcagctgggaaggctgcctggcttcctggtcccaaccaacttcttttcttccaggaggccatactcatctcgctggctgctctgcagcctggtctcacccaggtgggatcgaggcccgcctccccgctttctggacccaggatgtagaggaagcagcaggacaggaggatcatgggagtagagatggtcaagtcttctctccaaaaataactgcctttaatgtgagtcagcccatctccccaggggctccagtgagtcctccaccatcacttgctgccagcagtgatagccttgaggtttccagctcgagccagaatattgggcacgaagagcaatcccgaggcccgctcgatgctctcgatgggcaccaggaaccgctccagagggatggtctcatccacgggggcattgggcatcacgtaggaacgtagctcgatctgcccaccggctgcctccaggatcagcacct

SEQ ID NO: 26502 - DNA, 1258 bp, Mus musculus
gctcttctctcctggggcaggcttttatttttgtttgcttttaaggtggttttttttttgttgttgtttttttttttggtgtcctgtttttttgttgtttttttctcctccatgggtcttggcaggcacccttttcatggctgtcagccaaaaggaaggctctggagctgccaagaaagggggagacttaggctggctaattcccagatgaacggtgctccattcccctccctacccccacaatgcccctccacacacacagtgttaaggagcccagagcagctgcttcccctcccccaactctgtccccacatcatgggtttgctcagtgccacccctcacctcttctgcttacattagctctgtcaccatctggtccatcgtgaagagctgacatttagaggcagattgggcatgagaggtcagcactgggagggcaggctccccagttttagggttccaggacagtttgtactgggcacctggtttgcacacagtacagtttagcgtctagtggcggtaagccactctgctttagatcaatcactagggtccccacttagaagggtcctcgccttagatcaatcacatggacactaaggcacgttttagcgtctcttgtcttaatgattatgtctgtctctccgtccatttgtgttttctgcgtcgtgtcatggatgtaacccttggaaatactgcacactagcctttgacaaccatgaagcaatccgttacacgtgggtctgacttgtagactcagttcagatatcaaataaatctataacacagttgcctttggaggtctccatgccatagaactcggggtgtcccttcacttctctggggtgttttggtcctgcttgactagtttattgagggaccactgctcaggctctgctcacttttctgccctgtgaaacttgagcattgtggaggcagttgccagatgtggtgagccagtcagagcacctgtaagctccgggcgtggtcaaccatgtcagctcctgacgaggggtctatggccagcacattttctgttgtcccaggcacttgttatttaggccctcacgagctttgattggtcagggctagaagaagaatctacaataggagccagcagccagaagtcctggttccagtccagttgtcttgtgctgagcccatctcccctcttgtggcctctatatccccatctgtgccttgggcgtctctacccttttttcagaagatgcttggggttccaactcccaacgcttca

SEQ ID NO: 26503 - DNA, 2343 bp, Mus musculus
tcagtttttttccttgctttcatgactttgagcagttctgagtagagtggcctagtattttatacagtgtccttcacttggacttgtctgatgtccttctcattatggacttgaggtctgggcttttcagaggggaaatgccattcttatatcctttcagcgtctatgtgctagacccatagaacaagtggtgatggtaccattggtcactctactgaggagttggaggacaaggacttctgacatggacctctggccccacatatactgccctccaacatgtttaaataatttaacatagcaaaagagatctacaaataacactattataactagtttataaggcacatgcctggtcttgttacataggcatagtcagttctgtgttacaaagtttatagacgtgaatgtgtattttacagacactaaaggaaaaaggaaggccagtgccattgagtgttttttaattttatacccttgggggccattgtgaatgaggaaataactgagtgtttttctcatagtccaagttcagctgaaagagtgaaagctaataaagacgtagcgtcacctctgaaggagctgggcctaagagtcagcaagttcttggtgagtaaaaattagcccagggtcagcatatgcttctgtggatgccggtggctccattggtaatgacgttagtacacgttccaagcttcagtggctgttgctcacttcatgcttcttgctttagggtcttgatgaagagcagagtgtgcagttactgcagtgttaccttcaggaggattacaggggtactcgggactcactaaaggtttgtggctctgcccatctcccattgacctttctttcttgtagagtttgggcccttgccctttatagaagaaaataaagatatacaggtataaagaaagacttatttatttgggttttttagacagggtttctctgtgtagccctgttgtccaggaactgcctttcagagatccacctgcctctgtcttccaagtgctgggattaaaacggtgcatcaccacgcctggctaggcaagacttttaaaggctggaaagagatatcccttttttttttccccaatttttttcaatttttttattaggcatttgcttcatttacatttcaaatgctatcccgaacttcccccttgaaacctccccccaccctgctcccctacccacccattcccactttttgtccctggcatttcctgtactggggcatataaagtttgcaataccaagtggcctctcttcccagtgatggccaactaggccatcttctactacatatgcagctagagacacgagctctggggtactggtcagttaatattgttgcagacctatagggttgcagaccccttcagctccttgggtactttctctagctcctccaccctatgtatgtttaagaagacacctgtcttcatccgtgcaggggttgaaatatcaaagaatcacatgcaagtgagagatctgagagaacatccagcctgctgggcttcagtcttttgtatagagagagagcagagcagagcagagggaaggatttgagcaacagtttggttagacttggcttaaacataaggtagaaatgtttacagaaacaaactagaagggcagtcacgaagggtgtggtgcatctttttctttgccagttgaattctccttgtaagacagcttcttgactgccctgttttccttcagacagtcctgcaagatgagaggcagagccaggccttaaccctgaaggtaagtactgattgctgactcattctttggtggacacttgtgaggcagcttcttggcttcctgtctcatcctgtccggtcccatcccgccccccccctcccctcccctcccctcctctccttttgagccagggtcttactgtgtatccttggacagcctggaactcactatgagccaccatgtggttgccgggaattgaactcaggacctctggaagagcagtcagtgcttttaacctctgagccatctctccagcttgctggaactcactttttagactgcctcactatatagatccacctccctctgctcctcagtactgggtaataaaggcatgtgagacacatcctcaccttgcttcagcttttaggtcttagctgaggcttttattttttttccgagacagggtttctctgtgtagccctggctgtcctggaactcactctgtagaccaggctggcctcaaacttagaaatccacctgcctctgcctctcatgtttgggattaaaggcgtgcgccaccacacctggctagctgaggcttcttaagcccatgatccagctgaggaattt

SEQ ID NO: 26504 - DNA, 1114 bp, Mus musculus
tgccaggatggagttatctggaggtgagtgaaagatgcccattggaaggtgtcccctcagtgctgtataggcacgttgagatcttcctgctaaggacctattgtaggtgctgtgagacttagtgtgacgttgcctggtactgtcttaggacgggacagtaaacttaaacgagtgacactctgagggtgtgctgtgtagttagtggctccccagtgtctgcagggccctgggtttgattcccagcattggacagggtggtaggtgggagaaaggagaggcaagccgagagccaactctgtgtagagtaaggggagcatgggtcaggtgcagaatggtgaggcctaactgagaagagcatgagcagtagtctggtaggaggttgtagacaggcacagacagctggctgaaaaagcaaaagctctttgtgcggcccacgagtgcatgtatgactgggtttcttgctgggtgttggcaggtgtacagcttcctggataaaatgtctttctacaacgaactccataagcacaagccccatgatgtgctctctcatgaagatggaactctgtggcggaggcaaacacccaaactcctgtaccctctaggtaagaagggctgtttcaaggggtcttttcataggaagtgcctgtgaggcccttccccctcttctcaggacttgttgaccactgactgctgagcagcaggctcagagcagtgtgacgagcagtgagtgctccccagctgagtagcactcgctcttctccttctcctcctctccttttttctttcttcttttttttctttttgttgtttgtttgtttgcttgtttgtttttggtttttcgagacagggtttctctgtagccctgtctgtcctggaactcactttgtagaccaggctggccttgaactcagaaatccacctacctctgcctcctgagtactgggattaaaggtgtacaccaccactcccgactgcttgattgttttgagagcatcttgttttgctgttagcccacgctggctcagaatacatgattttcctacttcatactgagcttctgccttttttttctttttttttaaatgaatgtttttgcatcactagtttcccttac

SEQ ID NO: 26505 - DNA, 1186 bp, Mus musculus
aaataaagggttgttttgttttttaaggtttttctgtggtttgtaagcacatgtcacccagctatgtatggccgtagaacaacttctgtgacttctatgatgtgggtcccaggatttgaactcagatcatcagtgttggtggttggtgccaactcttctcagcagccccagttaaacttttctttttttctttttcttttatgtgggagtggggtgagcgcaggactgagatggtttctctgtgtagccttggctgtcctgaaactcgctctatagaccagactggcctctggctctgcctctggaatgctgggattaaaggcttgggcaactactgcctgtctcccagttgcacttctgaagtggaagacacagttttatttatggacttcttatgtttatataagaataattgatttatgagaaacattttaggtttaggacattaaagtatgacaaaataccagcaagggggactagagatatgggggctgtaggaacggaaaatcggcatttcaacacatgttttcatcctagacccaagttttgggagaatttaacaagtccgctgtttggaactctctctcctccttcagagacatctgaggtgagctatgtagagggtagagcagaggctagggtacctgagcagaagggttggtctgtggcttcgagaaaaggaccctcccttaagtcacatgcagaaggcttcacatccagcccatctccagagcagttcctgcttcctgtcctggggggggggggggggggcagagagacagagttgctctgggtggaaagctctggcatctccacattgtgggcatggcacctgtccattggcattggccttttgtgttctataaaggtgtgttttcttgttttctaagtgttaggcccttgctgtcagcaggggtgggtgtggagggttttctccatgtaattaagtgtgttttgctctcccttccacagcccagtgtcctggaaacctgtgccctgatcatgaagataatatgtttggagatatactatgtagttaagtgagtcttcccccttcagtggatttgttactgtgattgtgtagtactgggggttgaactccaggtattttgcttgctgaacaagtgctccaccaatgagccatgtctctagcactcttcccaaagatatggggtgggagatggtg

SEQ ID NO: 26506 - DNA, 1186 bp, Mus musculus
tgggagaagtcagggttaggtgaggagggcctgtgtgtctatctgtgcagtggaggctgcttctaagcagccagactcctgactgctctgccgctcctcccctcagctccttgtggcagcatctgtgaactgcctccggctgggctccatgatgtgcaccctgctgcttatcctcctacgccagtggaagaggtgagtgctgggacgagagctggccgcccgaggctccatctgcctcagcactgcctgcccacccttcctcacccagaccgtctagtatacttcacagaaaatggagcaactcggcagacaagcctgcagtgagggagactgcctgtggcttctgaggggcactggggacactgagtgaggcatgctgctgccttggtctttcagagagctgggtgctgtggagaaaatccttgggcccttgacagagatcctggaaggggtgcttcaggcagaccagcagctcatggaaaagaccaaggccaaggtgttctctgcattcatcacagtgttacagatgaaggagctgcgaggtgagccccagctccaactgggccgtgggatttttacaccgggagtgctttatttcccactaccccttccccttcctcttggtactctactgcctttcgtcagaatggcccacctgtgtgacagcaccctctcatctgttctgcagtcggtgatatcccccagtactcccagctggtgctgaacgtctgtgagactctccaagaagaggtgattgcactctttgatcagacccgccacagcctggcatccgacagcgctgccgaggacaaggacagcatggagacagatgactgccctcggccccggcacaaggaccagcgtgatggggtgaggggacatcagcaggctgtctgacagcacacaggctgtactcaaggctgccaccaccctgggggaggacgggaaggtgggagcctgtgggcgcaggctttgagggaagccctgggagaggcatggctctcagccatttcagcagagctagtcaggcaggcatcgtgtgccgggaagatcgggtggaccgtggaaggtgtgagcagcttcaggtcagcatctgctgtgttctgatccctggttggtgtgagcagagtgagggcaggggtgggctagagagggttgctttatagggcaggcatgggctctttaa

SEQ ID NO: 26507 - DNA, 1161 bp, Mus musculus
tggctgtagtctgatccaaacaacataaatgccaccagggccaggttattagcctagacagtatcaacccctcagcatcgtgtctctctcttccccccaagtcctgagggccagcaggtatgtcttagtctggcgtcaccgtcagaacccctctcattggaatctttatgcctgtttagtcttcttcatctagccaggcctcccttgatttacagggaccatgttaagggccagagaagggcagggatacagccaagcagacatgtctgggtagtggcagaccagatttgaaaccttatgctcttcttgctgagtctgatagccttgcctctcctagctctcctcatacctagtgacaactgtccacttgaagagacttttctttccagcaactgggccacaaggaggctctactgctttgagtgggttcctgtggcatcaatcctgagtctgttgccatttgtcatagacacctagcacctctcgaaagtccctggatgccccatcctggccaggagtctaccgcctgtccatgtccttaatggagcgattgctcaagactctacgctacaatttcctgacggaggctctagactttgtgggtgtccatcaagaacggaccttgcaggtgagaggctacctacgtcatagaagggaatattcaaagccacttagcatgtggctgtaggacttggggtatcaatgccctcgtctttgagcaagagggcatgtccccctccctcccttcccctctcttgtgttcatggccggcctctacttctctactctctccctctctctgccttaatctgcctctactaccctcttactcccccccttgccctaaataaactattctatatcaaaaagaaagaaagatcccagcacttgggaggcagaggcaggcggatttctgagttctaggccagcctggtctacagagtgagttccaggacagccagggctacacagagaaaccctgtcttaaaaaaccaaaagagagagacagggaaagacagacagacagacagactggctggctggctggctggctggctagctagctagagatatggctcgcagttaagagcagtggccgttctttgagaggtcctgagttcatgcaaccacatggtggctcacaaccatctgtaatggaat

SEQ ID NO: 26508 - DNA, 1151 bp, Mus musculus
accctgaggaaagaggggggccgcctaggtctggcttcctgtctcagactcttgccttagcaccatggtaggttgcaaactagatggcctcggaagctcctggaaagcaggtgggaggtcagcctgaggagcaggtcagaggtaagatggaggaaggcaggctaggctggcagagtagactggttgagttagtaggtgtctattgactgtggggggttggccagccacacctctcaccctatgccctgggtgaaactcccgcacaggccatctgacccctctgctcctcttctgagcatgccactgtgtgatttgtgctgtcattccatggctggccattgtctttgagatgtcaatgctctggcctgttaactagccctccaacagggcacacgacaatggtgctcactgtgggctgtgcattctgctggcccagttcaactgtccatgtgtcagggtgttgtcctaggccagatttccacaaatgaccataaactgggtctcctaagtcatggtggggggaggggggcttttcttccctagactctggatgacacttcccgctcccctccctgggccgagtggaaggagaaacatcccggagggtggaggctgccctgtttttttcttttgccactgaccccaagtgtgactctggcccgaggctgccttcctctgccggaggacagaaaggttcagtgactggcccagggtcacttgtcctgtcctgcctccaagcaggagtcagggtggggtggggacattcggtctctaagacccactcagagttgggggaggcataggaaaagtacaagcaagacttgcagctggctggccctgcatgcagcatgctagagggatgcgtgccacctccctgcccttacaccaaaccttgttccagcctcagctcctggttgggctggggtgggttgtgcaagatagggtgggcagaggttgggtccctgggagctggagcaggcacaggctttggcctctggctgtccctgctcttccactcaccagtgcccaccttgccttccttgctgcctggtgctcttctggtctccatagctttggaacgatgaagtcgacaaggtgagttggggtttaggaaactgggggataaggtccagaaggtagagggtaggggc

SEQ ID NO: 26509 - DNA, 2270 bp, Mus musculus
aaaatgtctcaggacccaaacccaacaccagtctcctacccctagcaccagattgtacaatacctgagggacatgttcgacctggacaacgtgcgctacacatctgtgccagccctagcagaagacatcctacagctgtcccggcggcgcagcgagattctattgggctacctgggggcacctgtggctagtagcatcgggctgaatgggccactgcctcgagaaaatgggcccctggaagagctgcagtaacaggggatgggctggaggggagaggtggctgtttgggcctcagatacaaggtgataggagagagaaagctgccactcccttcctttgggttggtatccaagggccatggtggccaagggccattgcccctaagcttgctccacttcctcacctgggaattcccaacacccaggggacaaatttccatggagaggaaccactagaagcactgatagcagctgcccttggggttccctgagcagcagaggcaggccagagtcagcagggactggccaggggcaggtagcaagagagaaaggtgtgggagcaaatggctcttgagtatggaccacagaaccccagtccccccctgctgctgagggagggcaagggatagttgagggatagaacatacagggctaggtggtgacagtcacagggtcctgcaattagcagccaccaatagctacattaagtcccagcacctaggcttctggccagtatggaaagccatgtctgggccatccagaggtgggcttgccccatgtgtgctcacatctgagcaggtactcacccttcacaaacccttggcgctgttctccacattcccacaccctgccaaagattgtttttatcccctctgtcaccaaagatggaggaggcaggactggccgcttcctgctctctggtgagccaggagctcctgggcagtgctgggccccagtcagagctcacagtggcccatctactgctccaaaagtgagcacggaaccatggcagggtgggcatgggctgcacagcgggcagctcccccttcccctttctgacaggaagctggactcagcactttgccttcaactccatgcacacgtgctttggggctgccaccacccacgtcctgcagacagttggcatttgtcacggcagctgcagtagtcctggcagccctccttttgcctgagctgggaagtttttatttattgccttaatactttatttggctgttccatcccttccaggttgtgacaccaggagaaaagactcctggtctggagttgagcactggctcctggaaccaagttcctctccctggaagggaaaagggttccccagggtcagcaggatgcagtaaagagagggcagccatggctctgggtcctctctgaggcttgtgctcagaagggagcagccctcatgcactgtcttgacattccattcatttgcacttaccctgagctgtgaatgtgaccctgggctaaggcctgctctgctctgcccctgacccatacagtgtggtattttcatttttgtcctgttcatgtgtctatgccccaccctctagcactcaaccagcagtggtagagtgtgtgtaaggcctgtgagtcagataaaggaccgaagcgactcttctctgtgtcttgctgggtagaggtgggggcaatgctgagccaaaggctggacacttgccctgtaccatgggtagaggctccaggaggaacaggtcaggagcagcctgatacggccaggtgaaagcttgacaggatgtgtgtgtccctgggatgacaagatgcagatgtgtagtgggtggcctgcacttcttgtcctcagttcccacatctgtaagtcatgggcattgtgcccagctaggtgattcacagcctgtcaggtcttaatgtgtcttcataggcatcgggcttagggttactgctgctgtgaagaaagaccatgaccaatggcagcgtgggcaggaaagggtttatttcactcacagttccacatcacaggccatcatcaacagcattaaaggcaggagcctggaaggaggagctgatgaagaagccacgggcagaggctgtgtagtggcttgttctctgtggccatgtgggccaaccagtttagctgaatcatcatctggtctcagtgagagctcctgccttaaaacacgactggagagcgattaagagaagacattcagtaccgacctctgtagaacatatgtgtatatagacccaggatttttctgttttctttttctttca

SEQ ID NO: 26510 - DNA, 1448 bp, Mus musculus
ccactgacctttcttgtcttgcccatcccctggctcacttcctgagcttgaaacctaggtcatcgtgatacagcccagacaaatgctcttcaggttccagtcatggcagcggctctgattggcccggctctggccccgggtggctgtggtttggtgttgagactaagcagggagctgtgggactgactggccactcagtaccagacatcccccgatctaagccagccccattttgcaggaacagacagcgcaaacttggaacaaaactgcagtgactggtgggtgtggctgcgtctagcctccgaatctggcctgcaccatgccttgcaggatggacagaatgatggatggaggggtgaagcagagacctctacagaccagagtcaccaagtggagcctttttttttcttattttaatttcaatggacacggtggaccaaagtgctgagtcaggtcctcagccaggaccctgggagggcctgctgtgtgtgggtcacatggccagagcccatctctgctgctgccagctcctggctgggtggaaagtgctcttggcacgggcctcagcgtgcgtgtagagcgtgtgtacctctggtcctgagatcaggaagtgcaggtagcggaatgcgcactatttattcttttgggattgtggagttcatgctgaagaggccactctgcagcagctgccctgtgtacacagggcccaggttagctcccagaccctgtgctctgagcctcaggcagtacagcctgcctcctgctgggcctgagcagggcctagggcccagggcccaggagcgaggcctcccctgctgtccctgccaccatcgccattccagaacccttgtcagtgtttcctcgtctggggcagggcccagagtcagcacctgtttatccgtctgtcggctgggctgctggcttgtgttcttccctctaccaacccgacatcacaagggctttctccggtcctctatcccttcctgacaaaagagcctgcacatacgggtgagcacacccaagcgtttacagctccttttgtctggccatcgggtagcagtctgtcttcatccccacttgaacaaaagagaggaagcaggagctgggatgctggctgtgtggcagtgcagacaccctcccccatcgcctgcccatgtgctctggatttgtccctgtccttcctggcctgtcctggaggctggaaaccagtgcaggttgatcctggggtctgcctgggagtgggctctgatcccagctgccaggagtcccttttaagggactctctccaggttgtcctgccacagctgtggagatgcttccagaactgaagcagcccctgggggagctgttgagccctcccccgtttctccctggaggtccctaacctgctgctgaagcacaagtttttggtgctttcctttgtgtttgttaaaggccgtgtccaagcc

SEQ ID NO: 26511 - DNA, 1289 bp, Mus musculus
ctttctccctgccccttcaacacaggtatcttgaggttatgcggaagttgcagaagacatacaggatggagcctgcaggcagccagggcgtatggggtctggatgacttccagttcctgcccttcatctggggcagctcacagctcataggtactagtgagtggtcacatctccacctcgtacccaatgggtgcagctgtgttcccctcctgcccaggacacacaatgacagcttgttgagcaggacattagaccagcttagcccagctagtgatggaggttatgtactgtggacctaatgctgtgagccagtgtggccagctagaggaggtaagggtgggatgccaccaagagagcaggaagtggggaagcaggaaccagggccgcatggcctgctgcaggacagacaggtgagtgcatggcctgctgcaggacagacagacaggtgagtgcatggcctgctgcaggacagacagacaggtgagtgcatggcctgctgcaggacagacaggtgagtgcatggcctgctgtaggacagacaggtgagtgcatccggctcctgctcctggcagcagctgtgggcttgacaatgaaaactagggcctcttgtgatttgtgatcatcagtgtcattcagttaggatggaactctgtgcagggtgtgtgtgtgtgtgtgtgtgtgtgtttaggcgagttgctgccaagtgctgagtcctgtgtgcttcccagtctgctctatctgctccttacagaagaggattatccaggcatgatcagcatcttgggatctgccattggacagggttgctggtcactttagttccatgaagagtgaactgctgctaactagtactcacagatacctaataaatagctgagaacttgccatcctagccactttaaccacagtcttctcagacactgcagaggatacctagcactgtggtgtgtgcttccacaccatgatgcctttctgacacagcgaatgtgtggttagctccactagagggacttttatttttcctggctagcctggaactcacctatctctgtatgttggcagtaaaggtatctatcaccacacccagctgaggtaacttttaaggtaggtaatggtgcttaaacagcagaggttggtgctgctgacaaaccaggtgcagagctgttgtcatggttacaggatgctcaggtgtgtttgtcatctctgctgattggtagcacatcaggtttgtgtgcacccttatcaccacgggtacatgcatggtgactaactgtgtacagtgagcaagc

SEQ ID NO: 26512 - DNA, 1165 bp, Mus musculus
aggcagggtccttgctgagccagcctggagcacctgctgtgagacaaagcaggtggtcattcactcaggggtctgtaggggaccctgtttcatagttccagcctgcaagtgtgcagaattggggcaaggaagtagagagattgacggtggagtctttgcaggagtgttgggatacatctcggaagctgagggcactgtaaactttgccaggctcacagagcctttcagagtctttctgtgtagtatggggctgtcctctgagccctgttccccaaaataaatgctgcctgtaacctggggagggagtgaggagggcgtgccaggctgcatggctagtaaatacaaatggactggccttgcactctcactggcaggatgcacttgggacataggcttccctattcctgtgccccagccgaggctctgatgccccgggactgcactggactgcagtagtgctctgccttcctgcagtcagagtttgagcactgatggactatccatgtgcctgctcgtcttgttgctgtggctttttctgccctactcttgaccttgttaaacaaacttccctcctgtactgatctggagcctccctctatctctgtctctgtctcagaggaccagatccatcagggcctgtccacagcccctttcctgtcctccaggcaggtctagaccacgcacctacagtgtgtctgcataggaacacattctactttcttagggtagggatggtctcttcctgggttgctaaatttgatagacattgggatggagcctctgttttgtctgtgtgaaagaggtaagcagaggctgtagatgagagaagttctgttttttcaacaggccttgtaggtcaaggctgtggtgtgtgtgtgcgtgcatgtgcgtgtctgtgtgtgtgcacgcctgcatactgcctctctagttcctggacttcttttccagatgaagactggcccctttgcggaacactccaaccagctgtggaacatcagtgctgtcccctcctggtctaaagtgaaccagggcctcattcgaatgtataaggcagaggtgagtgggggctggccatcctgcctgcccctgatggcgcttggtcctgagggtgagctcatgacttctgattcttcatcacattgtttgctcgggctctgaggccagc

SEQ ID NO: 26513 - DNA, 2118 bp, Mus musculus
agcctcttctcagttgtgttcagatgtccctatactgctagggtcaggattcgggtgggggtggggggacctttgtcatttcttatggctcatcccttctgggtcaagtgatgtctcttagctgcctgtcttggcttctgctgagtatgggtgcctttgagtgggaggtggggatgaggtgaacgagatcaccttcctcctaggccgggggctgctctccagcacaggtggattcccgtggaggtggctgcagttggaaacctcatgtttgtctgggttactggggatgcaggaggcgagacaggcctcacctccctggttttcccctcctttctcagtgcctggagaagttccctgtgatccagcacttcaagttcgggagcctgctgcccatccatcccgtcacatcaggctaggagaggctgaactaccagagccaccctggccaggttcctgtgctctctgtgacccagcacccctcccgcccaccttctgttctttctgtttgatgagaggctgtttactgagatgggtgctaagcagggcctgagttgggggaattgaccacagtgtgcccagtttttgactgtcctccgtctggtggccgagtaagaagagaggggcctggacgtggtccccggccctgcccatccctgtgctcctgcttcctcccacggtcaggcccatgtggaggagacaaggacaccctgctcttgtcattgctccccctttcctccccatgatgtaatggttccctcattaagagcaggagttccgtgcctccagggccggctggtgggttccccgctagctgtgttccactgggtatctgctatggagctgaagggtgaggctgtcatcagctgttgggagggctggggttgggggaggttggtttgtaggggccatggatgatgaggctggtcttctcaaggtaccatcctaggccctgggggacctgtgtccatcctcatgctggctttgttccctggcccttggctttgctaggtttcctgactgttaacataacactccccttcctggggatagcctagctatggaagctgccctgggctcctgggaaagcccattgcttgggtgagatctgactttccagagctgtcaagcagggagaggaagagactccgggaggcagtaggactgttgtgtctgtggagaacctagttttctccagtcagtctcaggcctgctgattctgctgcctctgcctgctgagtgtctgaagcttcccccgaggccttggcttgctgctccgctcccttgggtcggtttgtggctcgtgtgggagagcaaagaaggtagcagccccctcctcccacttccctctgtgagatgagggaagtgctggcctgggcctaggcatagactcagaatgggtagggctgctaaggggacctagccacagtcaccagttttctctcagcgtgtggctgaactggaacctgcaggctttcctgtcccacttgggcctgcccttcttcactgcccatcctgtgtttgtgcccgcttagctttgtggagtggacactgagaagcacaactcaggggcttggccaggaattaactatggtctgggcagagcggggattgaagtcatcagagtcacaggcagttccccaggaaaagcccagtgccagcttccttccagggccaggccactgccttcctggctcccttccctgtccctgcgtccccagccctgcgccttccttgctatttggattaaagcctctgttttacacctgtcccctgtgtgagacatcttttcctgacatgtctgagtgactgttcctcagcaggtggttttgttcctcaggagggtggtttgtaggggccatggatgatgaggctggtcttctcaaggtaccatcctaggccctgggggacctgtgtccatcttcatgctggctttgttccctggcccttggctttgctaggtttcctgactgttaacataacactccccttcctggggatagcctagctatgaaagctgccctgggctcctgggaaagcccattaccagttgactttctggggatgggatatgtgacaatgactaaagcaggcaagagggttcaaatcccagccatcccc

SEQ ID NO: 26514 - DNA, 1234 bp, Mus musculus
gcccgggtgcgctgcgctccagccgccgcacggcgcgccccaccgcgggcagcacttggagccgctgcagccgggtcccgcgccgctgccgccgcccgcgcccgccgcgctctgcccgcgggaccctcgcgtcccggccgcttgctctgcgccctcggtgcttccgggggctgccccttcgaccgtcgctgcctcctctccgcccgcctctacagccccttcctcatccactggcttctaccggggcgcgtacccggccccctcggacttcggcgtgcactgcagcagccagaccaccgtgctggacctggacactcacgtggtgaccacggtagaaaacggctacttgcaccaggactgctgcgcctccgcccactgcccctgctgtggccagggcgctccgggacccggtctggcgtccgccgctggttgcaagcgcaagtattaccctggccaggaggaagaggacgacgaagaggacgcgggcgacctgggagccgagccccccgggggtaccccattcgccccctgtaagcgcgcccgcttcgaggacttctgcccggactcgtccccggacgcgtccaacatctcaaacttgatctccatctttggctcgggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcatggggaccctgggccccgcggggctggggccagacaaagactcggccaaggggcgatagggagcgagcgggtcctggccactcggggctgagctggggacgagcagaggctgatgttttataaattgtaaaataaaaaaaaaaaatctaaaaatcttggactttatttttgcagagaaaaagcgcctatttaagtatgctttgtgtttctcttactcttttccccccctttttattgtactgattgcagtggtgtttagcgaggagcctgccacgtgaggcagggctgctgcccggaggaggtgcccggccgccgggggcgaggctgggtgcccgggcgcgccaggggcgcaacgcaggagggcgcggggccccggacgccgattctaatcagttgtcaagagccgggaagcccgacgttccgctctcctgagtgcctttctggggtgaggaacgggtcttgtgaaaccctgag

SEQ ID NO: 26515 - DNA, 1188 bp, Mus musculus
ggggaggggcgagttagtcgcgcggagagaagttctgggcgtgtcgagtgagcaggccgtggagcggggttggctgtgggggcgtggagaggtgtgagcaggccctggagagggcggagttggctgtgggggagggacgatctggacgtgagctgcctgtgggacgcggcgatctggccctggggaggggctatctgtctgtggagagggatgagctagtcttggggcggagtgaactggcctcggggcggagcgatcttgagtccagccccctccaggctcggggaagtgacgtgtgcggacaaaggcagaggccgcgaggtgtctggtccggtagagtggtggcggctgctgtgggctacggtctttgccagcctccttctcaacccgtccttttctctcgggtccctggagccccgacccaggtaagtatcgcgagggacgcggccagggaggagggaggtgctcaccccaactgcctgaagcggtgaggccccgtcgtcaagtgacctgggcctggccctggcccacgtgcacgtcccatggaggttcaccgatcagacctgggcagggactctggtgaccacggattgggttggaggaagccacgttggtggaggctggcaagacgtatcttcactcgcgcccgtacatcactttccagtcctcagtttcccctctgagataaggaaagcagccactgcaaggttggtgtgtggaatcggcgccgtgcttggctcaagtcctcgcagttaagtgcttggttgcacgggttgccatcacgtttaactgcctccagctctggccaacatcgttactgtcatgagcccttgaggccaaggtcagcctctcttctgcaaggctgcctgccatcttttccagatgctccaggctttgctgctccaccaactgtgtgatcattttggtctttaatccttttgataagggcctaggacaggtgctgtaactgatgacaatgatgtatggggtggggcactcagtgactggggtctaagtgagaagcctaaatcctctcctaacttttggtcctttcccaagtgctgttttaaggcacatcgtttccttaagctggctttcctgtgtgtgtgcttgtgtgtgtgttggggggaggggggatgctttcctgaaggccagagccacataatcaaaaggtcagagtctgcaggt

SEQ ID NO: 26516 - DNA, 1155 bp, Mus musculus
agagacttagcaaggcagctgcccagtggagcgtggtgtaattagatgactccaaggatgtacaggtgagcatgaggcctctctgcccatgaactagcctcgaataaatacacagccacgctgccctgacccttcctatccatggccgtgcagtttcatggagcaggggaaggcttgttttggctttattttgtttttccagacagggtttctctgtgtaaccctggctagcctgaaattccttatgtagatcaggctgccctgagactcagagatccacctgcttctgcctcccgagtgctggaaataaagatgtgcacctccaccggggaaggatgtcactcttgatgtctggaatcctcaggagccttggggccatggagcagacactagggggctatgtttggcagggcctcaggaagtatgtgtcttcatgagatggctgtaagagcaaatcaacccagaacttgtatttccaggcttggatgtgatctacccccacacctaccccagctgcttcctagaagcaagtgggattcttgtaaattagatttctcaagagactttggcagatcaacagatgatgttggtaacagtgtcatctggtttgaggggtctgggagtctccaagagtgagaaatggctgtccctgtgcatgctcactcagtcactaccaccaaccagcaagggcccttaaactccagcaccacaaaggctgtgccagatcctagccctgctcagaggagctggcatcctggggccggcagacaggcagagcctgctcccttctctggttctctcccattctcctcagctggtaaggaccacatgttctggattgcccatgtgctggtgggtcctggggagaaatctgagttgtcctcgtggtgaagaagatggctttgacatcagtcggaacattttcttaggacttaggggcagcaggggaggctggttgctgggccccagtgtaagcgggctagcattgagctcctgtgtggaagaggtctgaatgttgtcctagctggtagtggttgtgacatagttgctatggtgactgaagagtcacctgacagccttctggttccaggtcatcctccgtccccaggcaagtacacggtgatgttcaggctgaggctctctgtctactctggt

SEQ ID NO: 26517 - DNA, 2505 bp, Mus musculus
ctcagacaagggctgcaagactgtgcagtcccggctggatttccactgagctcttcatccagtggagtgggaagattcaggggaacctcccaccccgttccaggccttgtcatggagcactttgaagagcccccttggggctttgcacatttgcacctgtggacttgggatgctgtcagtgcggcatctgaagatgaactttaagaatgctcacactttactgtgaatcaagtgcctaaaaaaaaaaaaccaaaactgtctgaacgcaggccaaaagtcctgtgtggccaacagcacccatgcctcagatgccactaatgggcctgctgcaccctgctgtaccctcagggaggcagggtttcctaccactgggctgtttttttcttttctgccttgacctggtaatcacaatttcggaagctggtggcactgacagatgctcactgctagaggggagcatgtgggcttgaccttggctggactgtcagtgtgagcagtgggggctccctctgaggcccctggagcacacagggacacagagcctttgagtttatgccttctgttcgctactgctcgcagccctggctgtgggatgctctgtccagtctcccactgtgtatgggtcacaacctgccttgtaccttgcctatcaattgttagattcacccagcctcatccctgcttgcatcaggatgagctgtcatttttgaaggaggtctttggaccctgtttgcctgttacacttgctctgaaggtcaagctccgatttgcagaacatgcataggaagagaagctctaggctggggctgacctggccaaaccccatgggaaggagtgtgtctgctgtacaccagagatgccgttttttttttttttaaaggacatgcacatatttaaaatttatatttttacttctaaagcttaggtaataaatgtaagatgccatgcattttaaaacctaggaagtgccacaagtgctggggcacacctttaatcccagcactcttgaggcaaaggcaggtagattctgggagtttgaacccaaccttgtctacttagtgggttccaggacagccaagactacacagccctttttcaaaaaataaagacctaggaaggacataaaatagaatgaggcttattctcaggtttttaacgttgctggatatggggcacaatacccatgatcccagcaggaagatcagggttcagggttcctcagctggcttgagtttaagaactgcctgagttacatgaaactcaaaagaaaaaaaaaaagggtcttattgttaattgtgtagagagtagaactatactggcacaactcagcttgtgggttctgggtgtaatctcaggatgacgccttgagtggcatctgggctgctctgactgtagggagctgagcctgtgagcctatccttgtgaaccattctgtcctacagttgctatgcagctgcagacatggaaactctgccatgtttttatacaatgtggtagaatggctatttttataacacggaaatgccttaaagagaatcacagcttgtcacttagaaatgccacgctgagctgggtgtggtggtgctcacctttagtcccagaacctgtgaggccatggcaggactgtctcaagtttgaggcaagcctaggctacacaagggaatgccaggccagtggtgtgcatgcctgcaatcctagcacttcggaagaggagtttaaagttagttgagctacgtacagagagaccctgtctcaaagcaggaagcaaaccaaaacgtgccaaggtgagggtgactttcaggccatagtcttggactggagccgagttactgtttgtgacctgttgggctcccggttttctgtttacagtgatgtaatacgtggacacgtgttggccacctttggactgctgttactgatctccaactttgaaaggcctggtgtggcctgccccagcctccctgtgagaacagagatggacgcaagataataaaagcattgcgagacgtaactttcctgagcttttccttgtctgtgtggtagtgcacggagctcagaatcaaggctctggagcggcccgcggccttcctcacctgcatgtgcaggttgaccccatcacgcagaaatcaatgtttgctttgaatgctgttacccacacacataggacgaggcaatatctggtgctggagagcttcctcgggtaggtaagggctttttctgtgctgtgtttacatacacaaggggcaggcaatcacatctctacatatgccaacttgggcacctttcttatttctccaccttccaaacaggctctggagctcagagccagctagacaggctgggtagcaagatataggagctaccagagtcaggctttcctaccacataacatccccccaactgtgagcaatccgcaactgctgggtctgggtcagaactcgacgcaggctctgtgccctactcttggccctcacactcagtgccttggagtttgtggtattctgg

SEQ ID NO: 26518 - DNA, 1180 bp, Mus musculus
aggccctggggaccaaggcatctgacttagaccccctactaaggaccttctcctttccaaactgtggctcctcctggataaagtgagaagtgtagagttagcggttggttgctctgaggcccccaagctggaagctagtaaagactggctttgaaagttttggtaaaggaaaagcaaaaaacaaacaaacaaacaaaactctttgagctctctgtggcctccattctggggctgctgttaggtgtgactccaaccaggttttcatcttgaacagtagtatctgccggttccaccatgacaggtaacctctgttctcctcagggtcccctcccaaccgcaagcgtcctgctaatgaaaaggccacagatgactaccactatgagaagttcaagaagatgaacaggcgctactgaggcagcggtaggggctggataacgatgtgatgcacaggggtgcgtttgtgtgcatgtgcaagcgtgggggcacacacacatgtcctcttgcataaaacctgcttattagctcttgagttccccatcagatagtgcttctgctcagtggctggatttctgttctggttttggttggagactgtagctctctgtgtatcctaggccatgaactccctcctcctccctactactgggattttagaccccccaccccctgcattttcaagcactaactttgtaactattggaagaaaacaatgtgtctatgtctatctatattgtttcctacctagggcaaactctcctcaagagtgttattaaatcctttgtaaatatgttgcctgtcttctaatgtttttccaggctcaggaagaaccagctgtgttcactgtgggccaatactgacaacataggggaggagtgagtgttaagattcattattttatgtatatgggtgttttgcccatgtgtgcatactgtgcccattgaggccagaagaggttgttagctatcttggaactgaaattataaatggttctgagacaccatgtgtgtgccaggtcctctgagagagcagctgcctgtgctcctaatggctgagccatccagcctgtttgcattgtattttgtggttatatacgtagccatggcttatttgaaatggagttgaaaaatacatctgtccttgctgggtgtggtgacccatgcctttaatcatagcacgtggg

SEQ ID NO: 26519 - DNA, 1181 bp, Mus musculus
gcaccaactcagagcaagtggatgaggatgcagatgtggacacggccatggcgtcccttgatgagcaatccagagaggcccagccaccatcaccaaggtccaccagcccctgccagaccccaggtatccgtcagccatgtcactgtttgggccactgggaagtcacagcttgtaagccctgtgtccattgcctgcctagcactaacatgctagagggtgaggggtggggttagactccgcccccaagccttcctcacaggctgggagcagccacagccctgcctagtcttgggcctcagttggaaatggactggatggcatcccggtgtgttggatggggttagggatggacatgcaggaagatatggggagtcaggcattatgcctaggaggagatgctggcagtctctcttgctctggcctcagagctggcatggagggcaccagcttggccaccctggcccagaacttccccttcttgtccccagaaccagacaacgaagcccacatacgcagctcctctcgtccctgcagccctgttcaccaccaccacgagggccattccaagctgtccagcagccctcctcgtgcaagccctgtgaggatggggccgtcgtatgtgctcaagaaaggttcggggcagcgatgaactcagctgggggtgacatagtcaccagtttggggcacttcaacctttgtctaggctgtgtgctgctcacttgagcccttgaacccttggaacagccttggggtgtgagagggagccccattttataaacattagcgctgaggtgccaaggggtgaagggtgtaaacagtgagggcgccactgtctgtgcctatgcctgccaggcaggggaggctggcttagccctgtgctgtgctcccagcccaggtgccaagcactggtggtcggaggcggaaggagcagagctaccgcagtgtcatctcagacgtcttcaatggctctgtcctcagcctggtgcagtgtcttacctgtgaccgggtaggtacctaggggaggctggcatcgcttaccacctgggcaggatggactctcccatggcattgcccctcccaggagcagcagaccctggcaggagtgggcagcaggctgatcttcaccatttaggtgtctaccacagtggagacattccaggacctgtcattgcccatccctg

SEQ ID NO: 26520 - DNA, 1190 bp, Mus musculus
agagggtgtgtctgccctgcagctgagctgctgtgtgcctggtacagaggctgagagcggctggtccgccctgagagatgctgtgctgggaaatatattcgctcggaggactctgtcatcgctgtgtccccaaatttgccctcttgctaacttgggcccagcttttgtcccaggagccccatgctgccccttaggtaatgctgacccctgggatggggggctaggagcagctgcaaccttttgggtattatctgctgtatacttggcccaaccccttggggactcagagaagtagatgtctacacacaggggcagaatggatgcagggctctttgtgtaggccagcagcccctatatcatgatggagacccctgctgcccgtgtttgttctgttgactattgtagtgggacagagaaagggcaagctttgctttagagggtagaggacctgccaccttgtcctgctgagaccactggcagaccaactgtcatttgctctgtgaagaggctcctaagaccctgggggagggaaaacagatacctcatgcactggcccactgtctgacgctccttcatcctctgtgcggtctggagtgagcctggtcccctagccaccccctagccttggtgtcttgagccaattctgagatgtggtctgtgtcctggacctgctgagcctagagagattgtcctatgtatgtctgagatcctggagaaacctaaccgaacttccagggcagggtgttcaaagctaagtctggagtggtgagggggggatcctgggaccaagagggctccagtggccacctgtctcttcagaagtgggtaccagcagctcatccccaaaggcctgggtgttcagtgtcccactgtggtgggtggcaagtgggtccatggccggctgctgctgggacgtgccctgttggctgccatcttttgaagtctctgttgtagagcccttagctcattgcactactgtgacgcagtctggtttgtgttcagaatgtcacaataaatacttgttcctctcctgcccctagcttgtactgtgacactgtggcgtctgccttcagtggtgatgaacacagccagagaccctgtggaagcttctggcaagagctggtggaacacttgaaataccaactgtatctttaccccaccaacccaccaaccacacagagggcccagca

SEQ ID NO: 26521 - DNA, 1129 bp, Mus musculus
gcaagttgggctgaccacagccccctccagagtgttttttatgggtctgttcacagatctcattaatgcatgaaggacaaggaaagacttgccacaaaggtaaaatggagaggctgccagtcttcttcagatgacctttaaagcctgcgcctgtccctgtgtcccctcacttcttttttaatttcctgtactaccttacatccagaaaggatggtggatgagcgtcttcaggccgttctctgagaaagtcggtctgccgtggacatcctgtggaactgtactggctctggggggaagggaatgcaggatttccccagaagctctacactccctgtccccaggacccactgcctgtcacccctagctgctagtgtgctgagacaagaatgactcactgtaaaagaacctgccctgcagatgacttagagatggaaataaaaggaacgtgacatttaccgctttttttttttctatgcaggacgtgaagctgcaatggcccctccctctaggctgagcatgcttatccagggccccagcccaaacaacacacagggaggccattaatgccttctggtggcatctgtagtgaacgtagaatgtccacatgaagttaaaaaaaaaaagttccgttcctgccagtatttttcccagaaattgccgttttgtgattccttttgattttgtgtctgtataacatccaaaatgtctctaatactggccccaacttctcttttaacctgacatcaagcaccttttaaatcatgcgtgtgcaagttcgtgtatgtgtgtgtgtgcctctgtatgtgtgtgtgtgtgtgtgtgcgtgtgtgtgtgtgtgtgtgtgtgtgtgtgtgcgtgctaattctaagccttgagggcagggcactgttgggaaggccctcagagctgtcaggtcttggtcttgcctgtgactctggaggtggaattaaaaccaaacaaagtgctttcagtagagagcactcttacccatgtaattaaatgttagtcctttcaatgttaaataaagtataacttctagtgtacctggttctctgttgtatgaagaaatgacgctgggcctggggagatggcttagtgggtaaaaagctgagcacagcaggcgcctgcc

SEQ ID NO: 26522 - DNA, 1176 bp, Mus musculus
gaactcactctgtagaccaggccggactcagactcacagagatccacctgcctctgcctcttgagtgctgggattaaagaagtgcatcactcccactccgttgataggcagaagccagcagagttctgtgtgtttaagatcggtctagtctacacagtgagttcctgaacaactagaactacataagatagaccctgtcttaaaaacaaagcccaaaacatctcaaagagagaggtccagcagtgagctggtgaacggcctgctaggtgaaccggaggggtttccctctggtttgtgcaggtcctggcttaagtgtgtgctattaagttgactaccttaggatccgaacagatgaatgagttcagcattgactaactgagtgatgctctgtagtttctatctcctcagtggcgaacacagacatttcttccaatagtttgctgtttaaaaagggagactggagatgtgtgtcaggggaaggtggctcggtatgtgaagacatttgtccccaagcctgacgaattctagtgctgtccccgggactcacatggttgaaggaaaagaccaactcccctaagttgacctgtgtcccagaagttgacctctgaccttcgtgcaccatggcacatgtgcacacttacacaaaacacatacaaatcaatgtaatcccagcacttgggacccagatgaaggtagatctgtcagttcaaggccagcctggtctacatagtgaattctatgccagccagggctacagagtaagatcttgactcaaaacaacagaaaataagtaaataaggagagagctgagctgcctgcagccttcttttagctgaggaccatatctgaggttagcagccatgcaggagccgcccccacttagcctcttccacaccctgccctcctgcctccaacaccagtgggcccagctgctcttccccaactcccagaaactcaaagcacttctcagatttttaaaaaataacgcaaaggcactttctctctctctctctctctctctctggtatcaatgatgtgcctaaccattgccaaactccttagactcctccaaccctttgccttacggtggcttttgacatcacttcctgtttgaccatgtctgtgatcctgcacagcaggatatatttgtatatattgcactttggaacctagaag

SEQ ID NO: 26523 - DNA, 1148 bp, Mus musculus
gaggatgaaaccattcgggacctcaaggcaagctgcagaagtacctccatgaagccgcaaatgggacacaagtggggggggaggttggcgggaggactgaaggtaacaagtctgacacggtgtctcctggcatctaaggccttagccaacatggtttcttgtgtagaaacagccatggtcagtagggcataggtggcacaaacctttaacccagcactggaaggcagaggcagtaagatctctgtgagttcgaggccagcctggtctatagagagagttccaggatagccagggctacacagagagatcttgtctcaaaaaaactaaaacctaaaactaaaaaaaaaggaggggggcgaggggaagctgtggttagctatctcagaggccgaatttcctctcctaacccaactcactgactcaccagcttaaaaaaaaagttcctattctaagaacattttacatgcaacactgctgtagtacaaagacacaccaaggtggtgtgtgtgtgtgtgtgtgtgtgtgtgtatgtgtgttgtgtgtgtgttgtgtgtgtgaatgaatcagactttcagaacggatctacacaattcaaaaggcccacatcgccagtggacgtaagtcaaagacaaactgaatgagactcaggttatcttgttgccattggaaagatcaaacctttacttcaaaattctaccgagaaaacccggggaatctccccagataaatccaaatgagccaagtgtgggccctaccatgcatgagtttgcttaaagaacttttttttttagtaaatatttttacttaatgtgtgtggtgttgcctgcatgtggcctgtgtaccatgtgcatttatcatgtctgtggaggccagcaaaaggcatcggaatcccctgccactagagttacagacagttgtgagctgccatgtcagggctgggaacggaatgaaacctgggtcttttgcaaaagcaacccgtgctctttacaactaaggcgtctctccagcccccttggatcttaattaacactgttcccacctggcctctgcatgggagggaggcctttggatgaaaaggtcagagggccattgttaaccagaaacagactacagcccagtgttctgtactgctaaagataaaatcaccc

SEQ ID NO: 26524 - DNA, 1193 bp, Mus musculus
gaacctagagctgggaggagactgcctgttatactatccaccgtggtccaaagctttccctcgttatcctgtgtgtgtgtgtgtgtgtgtgtgtgtgtgtgtgtgtgtgtgtgtgttcatgacgacaagtattgttggttctctcctttctttatgtgagaccctggaatggacctcaggcatcaggcttagcaacaggcgcctttacccaccgagccatcttgccagcccttaccccatggtttgggattctggaaactctcagagagaagtttctgcacttttgtggaagtgcttgttttcctgcagtgagttgttgagatccttgaaggagtgttagtcaattggtgagaggtgagaagaatttgtagcccagctccctcaatttttgaagggttggttgtgcggtgtccccttaggtgttgccatggaaagaaatcaagcctcttttgttgttagggcttcgctgagtctcaaagctagagagtgcagtggttctcaaccttcctgatgcttcacccctttaacacagtgagtgcctcatgttgtggagaaccctaatcgcgaaattgttactccacaaccataatttcgctgctgttatgagctgtaatgtaaatatctgatgtgcgggctctctgatattgcaccactgctatagaggatcagaacccatgcatgactaccaaccagtgactggctgtggctgaccttctctggtacaaactggctttgggaaatactggggatggctccccttctagccagtgagcagtttgtcacatacaacctacttttttttttttttttttttttttggtttttggagacagggtttctctgtatagccctggctgtcctggaactcactttgtagaccaggctggcctcgaactcagaaatctgcctgcctctgcctctcaagtgctgggactaaaggcgtgcaccaccaacgcccagcacaacctactttttaatcacacatcacaatgtggccagaaaaggactctactgtttcgtagaacaaaagaggacagctgttcgtgaggtgcccctgtacttggaaacctttccaatttacttcaaatgccaaacaacggggcagacttaatgacatgggtacacctttaaccccagatctcaggaggcaagcaggcctctgagttcaaggccagcctggtttatgtagtaaa

SEQ ID NO: 26525 - DNA, 1155 bp, Mus musculus
tactttaatgccacaaactgtgaacttcaacaaattcacttggagccaggaggtggtggtacacatctttaatccaagcactcagaaagcagaggcaggcgagtggatatctgagttcaaggccaaccagaactactcagagaaacttcgaattgaaaacccaaacaaacaaacaaacaaatcgatttgttgggactacactgtctaattaaaaaaaaaaaatcgccgggcatggtggcgcacgcctttaatcccagcagaggcaggcggatttctgagttcgaggccagcctggtctacaaagtgagctccaggacagccagggctatacaaagaaaccctgtctcgaaaaaaccaaaaaaaaaaaagaaaagaaaaaaaaaatcacttgggaaaatatggaactaaaagtgagatggttttggaggccctggttttgcctctgtgcttgcacagtcttcatacactgatataccccgaatccttcccctgacttaaaaaccaggccaagttcagtcacaccctcttcagaggcaacagtagaacatgcaggtggagacacagaggttggggtttatcttaagatgcatttcagtttcatgggagggaaaggcagtgacactggctggctggtggctagccttgtcttccctttacttgggtcttgggccatctcttttgaatatgcaatcttccatgtttgaacaggattttcatctgatcccacccccttacagatagataatgaaacctagagcaggaaactctggaattactcttttgcagccctacacagagaggtgagaaattattttctgagtgaacttgattggctatgtgatctacgttatgtcatttataagagtcctatgagatgtcttatttcctttcatcagatcaggtttggttagattagttcagaggcagtctgtctgggtataaatggcccaccagcacaggcagactcaccctgctcacaaagcccaggacaaaagcccgtcttgcctcattgagaacgaggccatcgcatgcgttgttggaccggaaagctgtatagataacccagatttttctccttgtttactaggtgtgagatcagtgtcagggaacattaggtagctttttgaagatcatacagcccttgggcagttttag

SEQ ID NO: 26526 - DNA, 1173 bp, Mus musculus
ttagtggttgccctgatggcaggctgaaataccctccagctttggcctactctgctgcagtggggtgagaacaggccctgtcgtggaggcaggagatggagggctgtgcatgtggatggaagccaaggcctaggacattgattcacctagtatgtctcgactgtagcatctgtcctcaggagcacccctcccagtgcctaagtggggtgtccctgagagcagggaggaggctgcatctgcctagagcactgcttgtacccgatgcctggtgcaagtcagaacttgctcactgagtattgacggatgaacaaagggtgagaaccagagagtttaatgttaaaccaacagcaacaaacaaacaacacagttctcagacatgtagagagatgagagtgttgggcagtctgccagttgttgccccatgcctgctgggtgtgtatatacttgctcctgttgcttgtatgaacatgtgtgtacacacatacacatggacacacatacacaaggacacacacaaagacaatgtatctctggacttcaaaactctcagaaggcctctgacagaactctagttgttaaccgccttgctaacttaggatctctggaatttctgtgggcatcctaagcgtattccccaccccaccaccaccaccaccatcacaaatcatgagccagaggggagaggaagaggaaatttgaatgtctgccacccacagtcccattcttaaactgaatcagtaattgaatgctattaagcaaaattaatttgcctcctgcaggaaggctatgatgaatgaaagcgttgctaatcggggagggagccaggctaccctctacggtcatcaatatttcatagccataggcagtgtcaggaagctgcgcttcctgctttagctgaccttgagtgttcttgaaggtagggcttaacgagggagtctgctttcaaagggcttactatgaatgaagcccgtaagggaaacggattgcacctgagaactgattgagtttgctcctgtgggaggtcctcgggtggtcatttatgccagcctgctgctgattctgattagggggcagctatccctctcagctgcggtgtagagctggagaggttagccctggcccttgtctattctgagaccccaaccatagccccagtttctgctcatagcttcc

SEQ ID NO: 26527 - DNA, 2320 bp, Mus musculus
gcagggtctttttggaaggggcctcgtttcacttgctgggttttaggagagccagaggggagaagttgtaccacccagcccacagagctgtctgggtgcacagccgagcgggtggagggacagcctgctccttccagggcatgggtgcacgggctgggaggtgtgctacagcagtatcctcccaagtcttgccctggaactgctgtaggtgggaagccaggcatggcgggggaatgggaagcctaacctggggctgggaagactggcctggtgcccaggctgtggaaaggaaagcttctagccctttatcctgcactgtaagcgtatctcgtatctcgtctccatcacttgagagctgtgagccagcattccgcggtgtccttgggtagaggagtctgattggagtccagccgccccagctcacgagctgtcctctgcagccttgagtcttagcccacctggcttcacacagccctgtttcagtggtaaagcccatgtgttggaggggctgagcaaaaatggggtgtgcattgcactgccactctggtattaacagctctgctctgtgtctctcccccttctgcctgtgtgaggtatccatactttgagagtgctgtggactggaagctgtgggctgtgacatttaataaagtgtggtagataattatttcttggacaacaagagcaagtgttcaactctgaattctggctctaacaggactcagcctctcatgtttgaatagcagagcatagtctaatgttgagcctgcctgggcttcattttctttagatagaggggcagctcactccaggtcacatcaagcctgagtcttcagttctccttcaaaaaccacttcagagtaaatacctaagtgtccccactctctagccctcgcctgtgcagccagccagggctgcccaactcctgaagtgctcgcaggatttctgcttcccttggtcctcgcgtcctcctctcacccctctccttccctcgtgccctctccttttctctctccctcgctccccacactccctcctgccttgccactgactccctggcctctctggcatactcagccgcaggctggtgcactgcagcattggctgcctgcagctgcgtgcagaatgtattttctaaaccagggagcattttatcaagagagtgcaaactatgcaaactcactctgtgtattgctgctctgaccacatggtgatctccgcacaccgcaatgcctgtctggctcttggagtgcagtctaaagcaagtctttgcagaacgggaagcccatcagcaatctctgtgttcattttcagtggcccctgaccacccccccacccacatcccaaagcgtggtccttgaggaagcattagtctgatggggttgctggcccagttccacacacccagaaggacaacctcgctctgccaagctgctggtcctcaaaggaagattctagcctaccccccagccttgttcccacattccatcacccacctgagctcacatgctgacctgcccccctcctcagcactcaccgtgtgttcctcaggggcctgcgctgcccactgctgccgcctttcctgtctagggctctgtgaggactttattcaccctctcagctatttagagcagaatagtgttctcaaaggtctgccttttgttcctcctttcctgaggctgccccagcaagattctgcaaaacattcacaggagtccccctcatacctgtaccacctagaatgtgttcacaggccaaggagtctcccagttcctccaaggccttgtctgtcctgtagaggtgtgtttgttttgtgcttaaaaagtatcatacaaagctgggcgtggtggcacacgcctttaatcccagcacttgggaggcagaggcaggcggatttctgagttcgaggccagcctggtctacaaagtgagttccaggacagccagggccatacagagaaaccctgtctctgtacaaacaaacaaaaaaaagcatcatacatttaggtgaccctctgcctggccagggaccacctgcctgcttccccacactataaagagggacagacagaacaagcttgggagcagatgtggtcatgactggcatgtcaggacctggtatgattttgaccacagggagacttcatcctggccagtggggaaggcacacaggctcctagtgtgtgcatacagagcagagtgaggcagacacattcctgagacaggatgctcatttggagttgaggtgcagtagacggggagggaactggaggaccagtcttcttagcatccaagtgctgtgtcctgctgatggggctgga

SEQ ID NO: 26528 - DNA, 3162 bp, Mus musculus
ctagcctctttctgtgccatgaggccaccgcagcctgacaccgcccctgtgcccacccagccttcctcatctccacaaagccagccgcccttgagcctccaggccctggttctcttcccccctgccctgcatccacctgccgcctgaagccactggttccaatcgtcaacaacctccgcttgtccaaaacaacgacaaaccgaaacggaaaggctccagccctctgcaaaactgagcgcccggctgtctccctcggcagccaccccattcttcctgctgtccggcctgtgtgctttctttttttatttcaaacggacattgtaaaagaaaacaaactaccttctgttctaaaggatactgaccattgggagaaggcctctgtctcagagaactcagtctctgcctggtcccctgaagtggtggtgaccagggccagtgaggctgctggcagcaagggtgttagtggcagtggctcacgtgataacagtattgtgcgttttgtggagaaactgagggttttttttatactcatatataatcgaaccttttatttattggttgttaactcttgctgctaccttgtgtgtctgaaactcccaggatgctgggcctccgtttacatgtgcacaccctcatccacctgcctgcctcacttgggaggatggtggcctgcagcggccaagaagccaaaaatcttttcctcttttttttttctcagatactgtgccccatttttggagaggggaaggtgggcattgctaaatggctaatgtactgttcccccagcttctgccctggagtccccacccctcgcctctgctctccttggaatccataacactttttttcaaaaacaaacttgaggttttttttttttttttttttttttaattttgcaactttaaatttgatgttaacagcagaaagaaaatggagagccttgttctgagagtaggagctaggagagtgtgtccggcacacagtagagagcgtatgaagtgggtttccctgcaaactgctggcctcagcctccctgatgctaagaggctgggtaggtgtggcatgtgaatccctctgctctcctgccctgactgctttttgcagtagtcttcttccctaccaggagtctgagaaagaaggggtaggaggataacaccaggccctgttggtcctcaggactgggtccagagccagagagatggctccatacttgtcaccaggaggagcgggcaaccatggcttctctgggactttgtagtctttcccttctcgatcagcagggctggaaggcctggtggttggctttgttgatcttgtgtgattcttagcccagagctagggttcctgtgtttgtgacactgttctatggctgggttttctagtctggagggcacaggatcgtatgaatgacagtacaaccctcatatagtctctgggcacagccttggttgccggagtgtgtggtctgcctcagaggctgactgtgtctgatggcaccccctttagcccctctttaggatttcccagactcttgagtccctttgggctcatcctcaccctggggagctttccggggtgagcctctcagctgcagaggcagacctaagctcacagttcttgcttctagtttgtgtaacctctctgcccaccattgagagggggaaattggttcccggatttttcttctgctctgactctcctgtaatctccagcatacttctgggagaccaaaatcttccttgctaatgacctgtggatgagcagctgtcccctggaggattgatgtcccccatcaataggtggctttggctgcctgtccatccctgtggtgggaatgcttagctagtccatgcacactccctcttcctgggtagaccctttgctcatgctgtgcccattgctagcccaccagatcccacagggaaattttctttgagacctctttgggtcatcttcctgcttgatccctgacatgtcctagagagtagatgtggtgtcataggttgagaggccctctctctggtctctggagactcagctgtccctctgtcagtggacatttttggtggcatcaagacccagtgattccaagctgaggagaggctcctcagctaaggtgttcacttttttctgtgggtccaggcttcctctcaggatctcggctttttggtttgtagccttcagtgtggcttttggtcttcacagtttatgtccttgggtccaagcctcggactttgagacagccctgggctgccttttcctggcagggtgtgggacactgtttttgttcaaggacgcgtgctgactgatgtctgtctctctttcaccagcagttagctgaggcacacagcacgcccagaatctgaggccaggcctcttctgtgcagcctgaggacctctccaagttcatttccacagaggccccaccccatctgatgctgctttctttaggggtgtggtccagccagtgaggccaggcccctggtacctcggcagaccctcctttctagggccaggaatgctgtgaccccctcttcccagcatctgctgcccaccttgtgtcgacggtgacttgggagcctatcacgacttttcagtatctagccaggtttaaaataacaaggcaaatgtatgcagcattgacatctctttctttaaatggtctacagtttgacaggccatttcctaggaagctgtgtttcctttgcactttgggggaccttgtctcttctaggagatagtggggtgtgcagtccctggggatccctggcatctctcctgagaaagcccccactgctggccaagcagaaagcctccaagattctttccagtgtgtttctgcatttacatgatctaaagatgcatggggacgccccctggtggtgatgagccgcagtggcacccggggatgcagtggtccagccagaggtgaggctagaggtgggaaggccaaggtgggggctgtgatttccgaggtcctgggcccccagccctacatatctggcagcatgcctcccacccacacctctgctaggtcagctgggactggcaaggtagttggcataagggcacagtgggaagctttgccctcccaactttaattttttaaaaaaatatctgcagaataaatccaatggttaatttttgaatgaataaaaggct

SEQ ID NO: 26529 - DNA, 1184 bp, Mus musculus
gtctagaggggggtccctgtgctatgaaggcacatagtcctagctctccacgtggcctccctccaagcagccttcagttctgggatggcaaataggccctcggagtagcttaatgctacttccccatccagggtctagagcagacatcactaatcgagccgtggcacttacagtccttcacagtctcagaatctgtagtcgtgatgtcaggcctgtgatttagaaactccaacctagctagtgcagctgaaggccacaggacaaagccaaaaccaaaagtcagttcttggctctcatagcagaagtccgggagacggaagccttcaggcatggctggatctgggcacctgcctgccctgcttggtctccaattggctttattcttgaccttttcacagtcagcaagatcaaagcccagctgtctcaggctcactagctggtagtgaagcctaaggctcctcccactggcagaggttcctctctatgcctgcacctggggtacatagggggaggggagggcgtaatgagctcccaccaccacccctagggagaggatcctcccaggggagaaggtctgaggaaaggactctgttgctttggatagtgatgttggcctagggccaggaggggtctctgtgtgtagtctgctgcctttgttacctgctacaaagactgggagggggaggggaggggatggaattcacctggtgagtgtcagaggtgtgtgtgtgtgtgtgtgtgtgtgtgtgtgtgtgtgtgttagcactacagtccccagagttgccagctggcaggttgacagctgagcaatctcagacaggtagagctgggccttgggaagaaccaggatacgaagagcagcctgtgggtaccggtagggacccggcaacgggcccaagtccacaggcagaataggtttagcaccttctacccacctgtcttagtcagggtttctattcctgcacaaacatcatgaccaagaagcaagttggggaggaaagggtttattcggcttacacttccatactgctgttcatcaccaaggaagtcaggactggaactcaagcaggtcaggaagcaggagctgatgcagaggccatggagggatgttctttactggcttgcctctcctggcttgctcagcctgctttcttatagaaccaagactaccagccctgagatgg

SEQ ID NO: 26530 - DNA, 1205 bp, Mus musculus
agatggcttctctgtctggcaatgtgccttaggttcccggcagccaccccaggtctgcagagacctctctgcagccacagcccccaggcccctccacctcctgcctcctgcttcgcctgtggcttataaccccataaaccttttgaaatggcccagaacataatggcctcttcatttctcctattgcctgttaaatgctttatcttcaacaatgacaaacaatgttttcccctctgataaattaattacattatcctgattggaggagccaggggaggctagggcaggagaggggactgaagaaaaagacaacttcacatacatcttaacaaacagctgcccccaccgcccccatcctgcctgaattaattgaacggagcgcatgttgttattgtgaaattacatttttctttgttttccatctggtttacaggctgaaggagtaccatcgccttcagagcaaggtcactgccaaatagaccctgacaaagaggagcgggcctccccactctgcagctctcccaggcttcagcattaattgttgtgataaatttgtaattgtagcttgttctccaccacctgactggggctgctgtgtccccccccgcccccccacagcctttgttccctggtcccctatagcctacaaaagtggtcatccaagggaagggagggtggcgggcagctgcagaaagcataaaatgacaattaaaagaagttacattagtcttttatttgtctctgcgtgtgtgcctgtgtgctcatgcctagcccaaccttgttgtcttcctttaaacagtgtattatgccatacatgtatatatgtacatgtatacatataaataaaatggggtgcacatgtatattatatatgttatatataatatatataaacataatgtacacatataaatataatagggtgcacatgtatatgtatgtttatacataataccatatataatattatataccacgcatatatataatagggggtgctcacctggtgctgcactacaagccattatgaagccatcagacatgggcactgagaacctaacttgatcatttgtaagagcagcaaacactcttaagctcctaatgggtgacccgtctctccgaatgcccccagctcctttatttttgaagtgtggtggaagttcatctttgccaaagaacctgcttatctggcagggggatcctcc

SEQ ID NO: 26531 - DNA, 1145 bp, Mus musculus
acacatgtacatacatatacacacacatatatatatatatacatatatacacacacacatatacatacatactcttcatgtacatatgcacaccagaagagggcacaggatatagatgactatagttttagatcactgtgagccaccatgtagatgctaagagttgaactcaggacctccagaagagcagccagtgctcttaacagtaagccatctctccagccagaatgcatggtttttgtttgtttttaggcagggtatatagccctggctagcctggaactcactatgtagagtaggctgacctcaaacttagagatccacctgcctcagcttccccagtgctaggattgaaggcatgagatttattgatatattgatttcattttttttaaaaaagaataattggattctcagtataagggacaacacttttgagagtgaaatttctcatctgtgtaaaaaactgttcatgagctatgaagatagttgagcacctgatgacctgaggtcaatccatacaaggagagacctgactcccacagattgtcctctgagctccacagtgcatctgtgcacaaacacacaaacacaaaatacattaaaaattaaaaaaaaaacaacttagtgatcttatataaaagtccacctcaaggttgtccaaattcaggtaaccatttttaaattgctgctgctgctaagtgcaccttatggcctccctgtttttgttgagtgatttctttagacctaggatgggtaagtgtgttaagggcagttctgcccaagtgaagagtgactcagagaaacctctttccctttccagggctttgcactttgttcctgtgggatgtcgatataaaataaaatggagttgtctggctctaagcacagagcttcttaatggatggtatctctctggtccagtgttcccagaaatcacgatcaatcatgttacagcttactgggttctgtctagcaattcagcctgtgaaaataaagtgtgaagagagggcagtggtgtcttttgcatagggaatccctaaacatttgctagtgaaaccctctggcaccttgaagatgcttttctcttgtctgaaagaaatcagtaaacgttttaaatttatcaataaaaagcactgagtagc

SEQ ID NO: 26532 - DNA, 1153 bp, Mus musculus
agtcctcaagcagtgttgctggcaacacggagacgttggaattgagaggctgaagcgtggctactaacccttgctttctccgtctctctcatcgctccttctcccccaccctcgctaacaagtgtgctgagtgtctcctgtgagggttgtgctagatgggggaacagaggtggacaaaggacaaaagagctgcattgaaggaggcagggctctgaggatgcaggcaggtgcagagggcagacatgaggggtggggtctgacagtggctagcttctgagactccaggggaaactatgctgtgctgtgctgtgctgtgctctgctgtgtgttacctttgaattgcagtactgtagcgtggcgaatggttgagacctcccaggttatgaggcaggagcaggagctggcgctggatggagggctgccttgactcctttgtgttttccctggtacctagaacgtcttaaacaaccatttaatgctgggtctcttgtgatttttctccctcccaaagacaagccaaacggctcctggggcagatcgtggatcgatgtcggaatgggcctggctttcacaacgatatggatggcaacagcacaatccaggaacttcttatccctgcatctaaagtggggctggtcatcggcaaaggaggggaaacgatcaagcagttgcaggtgatttgagaaccgtttggtgctgcgctgggctgcccttgcacactcaagagccgaggctcccttacagacctctcttcgaatgccacaggagtcctccttttttttgttttgtttttgttttttggttttggtctttcaagacagggtttctctgtgtagccctggctgtcctggaactcactctgtagaccaggctggcctcgaactcagaaatctgcctgcctctgcctcccaagtgatgggattaaaggcgtgtgccaccacgcctggcaagagtctttcttttgacaggcatgtgctgatgctaagtgtgtgaggcaggagagataccatgggacagtttaagagtcagcgctcctgaaatctgcttcttgttaataatgacccatgctcttaaatatgctcatttagacagactagggatatatacctggaacttcacccctgggctgaggacaggaggatcaggggttcaa

SEQ ID NO: 26533 - DNA, 1146 bp, Mus musculus
gacagtagtggagttgtggggcctcatgaggtgttcatgaggaactaggttcagagtttgagaaggctttggcttccaaccctgcctcctaaagaccctggttgaagccaacttcacgggggctgaagtgagccatggtgggagttgatgagcaaggcctgactgctgtctgttttctgcacaggccagcagagtcagccacagaacagccagcccgactacagcaaggcctgggaggactattacaaaaagcagagtgagtgcagccatcatgcgctgtccagggtcacccgtaccctctctggggctgtgtctaggtgcccatcttgtctctccatatgtcctgtcagaggaagccagatgtggccagtgcctacggggtgtgttgtcctcagtctttgggggccatgtcagggcaggcaagaggtcacagtgcagagattggggctaccacttcactggctgctggtacctgtctttcctttggagtccatttctccttatactaccaggaaccagatcaggcctgagggtgatcgtcattagcgaagggcctgggcatgttgcagtctaagccatttttgggtctagtgtaggattgcacggcaacatcttacacctagaaccattatgtgctgattggaaggcccagggtaaagctgcttggccttgggggccaaaaacatctctgggctgcactggtgactgatgggctggtgtcaggtgtctcctcactggggcttggggcctatttaacacccacccaccctcacccagccctacctgaaagctgccctgcactggctctcccagctctgcctgtgcccagggctgttgcaggcagtcagggcagtgtagtcctatagaagtgtagcatctaggtgggctttggctgaggctggtaaggcctgagagaagggacctcccaccccctccccttctttaactcctgtctgttctttgtcctccaggtcatcccaccagtgctgccccacaggccagctcccccccagactacacgatggcctgggctgagtactacaggcagcaggccgccttctatgggcagactttagggcaggctcaggcccacagccaggtctgtagccagtccccagcgccatgatgccacgcagcctttgtgct

SEQ ID NO: 26534 - DNA, 1704 bp, Mus musculus
gatgggcatctgccgcggctcttccccgaaatcagtgtgagagaaacctgtttgttacagagatttttagatttgcaaaccttttgatgaagacctttgttttgttctgtgaaacactatatttagattaacagaaattttctaaaaattgggaaaattagttactaaacattgctggtaatttttacgtcatgatttctttgtaaatgtgtgagctccggggctcttggagcgaaacctgcaagctcgggtgcccaagctctcctcggagcctggcatttcatcacacgatggctttgtcttgtgtctttttagttacagtttggggtgggtttgttgttgttgttgttgttgttgttgttgggtttttggttttggtttttgttttcccttttttttttttttttttctgttacaacagaaaaaatggcttggaagtcttaggtggtaatgtaacaaattctttaaaaatttttgaagcagtatttaaatattcgtaaatgtaaattcattgtgtttcacctctaatttcttgtatcttggctgtctggttttattgcattttttaaaaaaaactgaactattatgtattgtaattaatgatgtgaattttgaactgagacgggtccttgtgttgcgggagggtcatttgtgggttatgtcatttctagcgttttgatggtgatgcagagacgcggtctgccttcgtgtaagctgctcgtctccattatccagggcagttgtgtgtctaagacctccaagctggttttaaaaacaaaaagcctttctctattctcagaaatataaatactgttatttttaatattaaaaagaaattcaatataacttttaacaaacactgtggacattaaaccatataaaaaaatgtagtaactattttttaattccagggtgtttttgctttttttccttaaatattttcttaatatttgtcaaattaactagataaataaataaatctagtattaacaacagtatgagttaaataattttgatttaataaaagggatactatgatttccaatgtttactgtagtgtatctgtacagataacatgtatttttaaaggaaacacggagttgaagctattttttcctgcattttggattgacctgaggaacattccgtttgaaacgtgctcgttacggtttgccgttcttgttttccttatgatgcttgaaatgtctaactattaaaaaggcattggaaatgttatgcatgttgttttttaaagatgttctttttatttgactgacaattcattttacactctatataataaaatttccacaagatgtcttgtgggcaaagtgttcttagtctgttttgtttgctggcccctgtctcttgccctgcctagctgataatggctctgcatcagcccaactctttgatatacacagcctctggggacttctgaagtaaagttcgttttatgtggcagctttacacttgaccctttgacttaaggccacactaaggaccggccttcacagtgacagcatctgagcgagaacagtcctgcttggtcctgagaaaggtgtggtccctgaggaagccaatgggtcagcaccccactgagctgagaccctccccaccccccactctgaggtggcatgttctcacctaaaagcacaccagccctgccctgtgtgtgcgcgcgcctaggcggtctccctgcct

SEQ ID NO: 26535 - DNA, 1099 bp, Mus musculus
gccatgagaggcttcttgcaggaaggcgacctcatcagtgtatcctgcacctcattctctctcccccacagggctgcgagcgtgtcggactctgtctggccaggggaacagaaccttgtgggactgagtccagggtaccatgttcagggctctgctgccctacactcattttccttagctcagaacgatgctctgggttttgtaacttgtgattcatggtgaagatccaatggtctttcctttcttattataaagggtagcccaggctgtcttggaactcactgtgtaccccaggctggcctcaaatacacgcattcttatttcagcttcctgagtgctgagatgtcaggcataggccatcattcttgcccatggacctgcctgtgtccaaattaagaaaatgtggacccaaattttctttgtttgttttaaaaaatatttgatcatatttgtttgtgcaattgctgtgtgtggaggtcataggacaacgtgcaagagttggttctcttcttttaccttggtctgagggatagaactcagcttgacagacttgatggcaggtgtccacctcaccagcccgcagatgatatgaccatgtatccatgaaaaggttggttgtagcaagatactcttgccaaccaaccagggggaagctgaggtcatagtgatatctcccatagagggccatcaaagatggccagagtgacctgctggtgatggtggtgggggagaagctggctgcaggtaggtggcacaagggagggttgccaaggctactgttgttccttcatcacatgagtaggcggaggtccaggctgtgttctcggatggagctgtttctctgcacacgaggagcctgaaatatgggaaggtaagacaggctatgaggctttaagttcagttctgaatccgagtagctccctgcatgctgacctaaagacctggtagttagctgggtgtggggtcatgagcctataatctcagctccctggaggcagaaggaggtgattaaaactggaagccagcatggttatatagagagactgcctcttcctgcatgaccccctgcccccaacctccaatctaagaacaaaaagca

SEQ ID NO: 26536 - DNA, 1399 bp, Mus musculus
aggagggatgaggccgagagctgaaggatgggactgggcaccccctgggccagttttgggagtgaaaactctgccatgtggtccccaaggagcatctgacaaacacattcctcacctgcagtggggctgcagagccaggcctgtctttctgttctgagagaaaactagggggaggtaatggtgggttgggctcttgggtcccagtagttttaggtctttcagagcacagtgtcccggcctgatgctgacttaccttggaataacttggagaatttatgacttccaatcaccccacacaatgtaatgccccatgaaactgtcctggtagaaaacatggtgacctggggatgtatctcaggagtggaccacttcctaaaatgtgcaagttcccaagttccatttccagccttaccctaaccccagaaaaaagaaaaccaaagacaaagacatggcagtgccatcgagaatggtctctttccacttccgctctgtctcctttaatgcacaagtgtgtggttggagagaaggtggtggagtcaggccagagtcaagtggatatgagaataaagggagggctggtgagatggctcagtgggtaagagcacccgactgctcttccgaaggtcaggagttcaaatcccagcaaccacatggtggctcacaaccatccgttacgagatctggcgccctcttctggagtgtctgaagacagcttcagtgtacttacatataataaataaatctttaaaaaaaaaaaaaaaaaaaagagaataaagggaggtagcagcctttgttggagtctcaccgcgtgttccgtctgctgacaggttcgagggatccataccctctacctgggcttccttccccttgtgtgtgagctgtttctttagcatctcaggtcctccttcagcatgtccaccagcaggaactggctggccttttgtgtttttcccgcctgtgagagtggtttgtaaaaagctgagccactggtgatgacggagaataaatattctgggcaaatagtggtttctgatgctctgataagaaaacagaaaaaaacgagccaggcgtggtggcacatgccagcactggggaggcagaggcaggcggatttctgagttcgaggccaacctggtctacaaagtgagttccaggacagccaggactatacagagaaacccttgtctcgagaaaaaaaacaaaagaaaaaaaaggaaggaaaaaaaaaaagagagagagaaaacagaaaaacgagttgggaaaagccaagttctgtgtaattgaaatggtgatgtattaacttttcaatagtgattcaaaggggacaggatacaagtccttggcatagagtgcaggtttccatgcttgctttccttctgacagtttaaaatggcctcgc

SEQ ID NO: 26537 - DNA, 1109 bp, Mus musculus
agctgttctgaagcctgatgttcctctactcagttctttagcaggagttgctcatttgggagttgttaccttgtgaaaattttctgtggtctgaggggttgatgcatgatgccctgtcttactaagttgtcagactgacctagaattcttcatgtggctcaaggtgctgtcaaaatttttaattactctgtgtgtgttcgcgtgtgcctgtgaatgtgcgtgagagagagacataggcagagagagacacacagagagacacacacagagaagagtatgtgtgtacacatcagtgtgtatgtgtggaggtcagaggacagcctgcaagagtaggaccatttgggttgtcaggcttggtggcaagtgcctttactgactggcctgccaggctatttttgaactcaggattctcccactcagccctcagagtactgggattataaatttatgccaccctaattcaagtacagggtgattcttgtatgttcatatgatgaaccatgtcatttcctctggacttgaacgttttccaagatgctatgaaggcagctctgtatttacaaactatactttttttgggtggggaggtgttccctagttttggtgaggaggcccacggcttctagctcagcaacttttcagtgggctttgatgtgggtgcacaggccgtggggttatgctgcagtgaacactggagcagcctagggtactctgctgctgttgagccctcccttgtagactactataaggaactgggatcacggttacaactgcacgagtaagtggtgggctgggtgacttgctctcttttgggtcattcgctatctttctcttagaaccttctctgtgatcttttttgattgttcatttggtttgtttttttgagacaggtcttactatgtagccctggctgtcctggaacttagtgtgcagaacaggctgaccttgtactcaagagagtcacttgcctctgactcctgaatggcttgattaaaggcatgtgccatgattcatttaaaaaataatttaaaaattattttatgagtatgagtgttttgcctgaaaattatatacatctgtaagtgcctagtagttcctgcgtaggccag

SEQ ID NO: 26538 - DNA, 1145 bp, Mus musculus
ccccaggtcctaacactggaagctgctcagctcattcccttaaagcctttaggtgtgcctccccttccagacacaggacttcagtctaagccctcataaataaatgaacagccaagtttcattgaaaattctagaagaaggagtaaagtagatgcacagaaaacgggaactcagtgggactagaggacaacaagaggagctggaaaggacagctcttctgatcctcaggaacagcacagcatcaaacagcacgtgctactgacagcaggagaaagaacactttgttgttgttgttgttaatctgttgtttgtatagcagagtcttaagtggcccaggtaaaccttgaactcactatgtagctaagcctggccctgaagtcctatgaatcagtattttactaatgaaaaacattgcctgggcagtgatggcccatgcctttaatcctagcacttgggaggcagaggcaggtggatctttgtgggaattaaaaaggggccaggggaagagtagggagggaagatatcccatgtccggccaaagttctacctatgctctggacaggtggacgctgggagggctgccagatactttccactcagccccaggcgggcatccgagcctctgacccactcaatggggggtggacaaggggcagcccccaaaaccaaaaggggccccgggaatacaccctggagccccagggttatgggagagagggcatagggaagagaggttcccacacaggcgagagtgagcgcagcagaccttgactggagcacaggaacgccttccatcgggagattagaaacagctcattagaagaaagcctatcccatcctccaagcgcagtgggccttgatgaacagacactgtctatggttttagagctttattatagaaaggcagggggaaagagaaaatgtaaaagagagagagagagagagagagagagaccagccatggccaagaggagaggagggggaaaaggagagagagagagaaggcaggctagggaataagaggtagagagaggaagagagaggagaggagaagacaaagagaggagtgagagagtgaggaggggccaaggagccccttttaaagtatgctgctatcttttctgttgctaggtaactggggagga

SEQ ID NO: 26539 - DNA, 1139 bp, Mus musculus
ggccagcctagaacagagcaattctaggtgaagaaaaatttaaatccaggtttggtggtccatacctttaatccctatgcttagaagtcaggcatgcagatctctgaattcaaagtcattctacagagcaagttccaggactgcgaagcttaggcagtgaaggagctggaaagagaaagctggtggagatgtaatagaataaggggaacatgttccagccccagcaagcagcagaactcggcagctttggccacgtagttctggctttagggtgaaaaatagaagggactgctgggacattgatgctggttagctggagctaagaaattagtggtgattaggaagagaccagcatgactgaggtgaaatcttctgggaagtgttttttgagagcacagagaagctccagagacagccaaggctgtaccttgcactgtagctgtacttggaaatgagtaagagtcacccaggtggtactggttttgaagacatgaagggttatgaagagcagctgagtcttggcactgtgagaggtcatagaagaccattggtgaaggtgctgccacagttacagttggtggcccaggaccgaagggatcatgcaaaggagtcgaggcttggcaccatgaagagagcctatgagaggctattgcagcggaagcctcattgtagcggaagactccagggtattggaaatgccagtaccatgggatggtcaccaagaacagccatagcagtggtggatcaacctgagcttagagtgctgcagaaggcagagctggagaagtgatgccagccctctggaggaacccagatcatgtgtggatcccagacattgaaacaaaaagctgtaacattgaagttgccttggagaccccccaagatgttcgagatgccagagccatggggtatctgctgagaaaagctgctaacagggagtggaaacagcccaggagaaagaagttgttgcagtcaacaaagatgaaaaaggagttggagatctgaagactgcgttgacatcagccatagagatgcagagttttgagtttgcccagctggtttcctgtcttgctttggggattacagttaagtgattggatgagtctcagaagagactttgaactttggacttttaacgt

SEQ ID NO: 26540 - DNA, 1167 bp, Mus musculus
gcctgggccagtggagcagctaatccctggggaaagaagtgtttcatttctgagccacttcggatttagttgaatattaaatgaaattcgtaaaaggccttcttcctgatagtcttggttccctctgaaaccgagcattcctgaggccagcactcactcggtaaagcctctctctgcctgggcttagcttcattgtgtggcttttcctccttttctttgtgtttccttgcctaccagctgtcaccgggtttagggatgtttccatggctggagaattatatacatgcaagccggttgctgtttttaaaacccagagtgttttgaccttcaagtgtgccacaattatctgggtttgcatgctttgctggtggaagtggcttcctagcagagtgacaacctgtgcaggagggagcctgatgggcttggcccaactccgtcatgcaagatgttctccacgccactgtggtgacctttcctacccaattaactcaagtgtgaaacctcaacatgagatttcatagccaggaataagtagcgtgtatgaaatgctggcagcccctcggaagacagatctttttctgctccacgagagcccaatccaaatgctcctgtcgctcagcaaagtgtagcctctgatgctgcaaattgagatttcctgacttctggctcgccttgcatggccagctccgttccccctccattcacatactaaaaatgccttaccaaaaatcctattaggcacaactcttgtgtgtttaatttttctctcattgctggtgatcaagctgtatcacgcagtcgttgccctgagctgcctcatactctcattccttggttcccagttacctcaggacttcatggttaacagccatgaaccaaagattagacccttcctcccgtgaagattcaggaggtgattatatgggagagtttctcaaacacttgagtcaacatcaggaagcaagaagaaagtagggatatcacatacagctgcccaaggcacaccctgttactgtcgtcattttatatgtgaggtaattaacaactccaggtcatgggacaggacctgcccccattgccaccctgtctgcttgtggtgttgctgctgtagcccgactggtatttgctgaggaactgttgctccacagcagggtatttgaaagcttc

SEQ ID NO: 26541 - DNA, 1112 bp, Mus musculus
ccctgtccttgcagaacgacctcctctgatggaccttcttgtcaccaaggcatgggagcccctgtgcttactgtacctgcacctttgatgcttacaaactgtccccgagagcctgtgctcactgtgttttcattggaaggaagctgtcgctttaagggtcatgaggtgctaaagccaggggcccagatgggtgggcactggaaacaggagctgggcagtgtggtctgtcacctgctctcagtatcttcagcagtgtgcccggcagatcttggacagcaagcttgagttttatgggtggcagtcactggctggctaggcacatagccaggccaaacctaggcctccaagggctccccaaaatctgaatttctgagtagtcttcatcccctctcctgctctaaggtcaggtccatcctctctggtccttaccttgatgacaaggatccagccttctggtgtttttgagcatttcaaaggtctgcatagaaaggaacagccactaggtacaaacaggcaggaatctgggctctcctgagccctgactgcttctcagaactgctgcttaaccactgagaacagtgctcagcccagagctcctgagagccatgcacatcacgctggggttgggtgtcccttgcagactcagccaggggggccatatcttcctcctaaggcaggcaggaccagagctgagcacaggcacaggtgtgggcgactccttgactaacccagagccgccagcctaggcctcgtgccaggctgacccaaaacagggcgcatgcctaggccttgtaccaggctggaagacacctccacactccctgcttctccactgcaggtgtgctgtgctggccccaggcccacactgatcacctagatgcgggcctggtagagatgatttcctctggatggtcttccatggtcctcgtagcacctcacctcgttacctccaaaggctgctctgcagcccaagggaggctgtgccacactgccagcgaccttgaatagccagacaccgccatcccctgacactgtgctcacaaggcccctgctctgttgctgccgtgggtgccactatattttgtattacactttgatattacactcttttt

SEQ ID NO: 26542 - DNA, 1138 bp, Mus musculus
caagctgcttgactctagcagcaggagacaccagggagtgacttccactagggggcagcaggagacactggggagtgacttccactggggagagacttccactgtggggtgggggtggtgggactgggatcttggttcacacagcaaaagacaactttagaatgaattgttactatttatttacacctttgtatgtagtgtgtgtgtttgaacatgggtgtttgtgtgtgggtggtatgtgttaggacaatgtacaggaatctgttctcttctaccatgtaggttctggggtttggggatcaagcaggttgtcaatcttggtggcagataccttcacctactgagatgtcatttcagccgtgggccccttcctttcttccctcccccttcctttcctccctcctcccctccctcttttcctttttttttttttttgagacaagttcttgctatgtagttgtgtctggcctgcaattcatggagacccacctgcctgtagatgtgccttccgacattgccccctcctctgaatgtctgtgtttgaatccaggttaaaaccttttaatacactccaaattcagttcattaaaaataaaaagggtgacttagtgatcaagggggcttgctgctctggcagacaacctagattcattttctcgcaccccacgtggtggctcacaacccccagtgactagttccaaaggatctattgctctcttctggactccgagggcactatgcacatagcgcacataaaaaccctcatacacacaaaaataaatacatctttaaacaatttttagcttggtggtggtagtgtgtgtcttaagtgcactcgggaggcagaggaaagcagatctcttgagttcaaggccagcctggtctacagagtgagttccaggacagccagggctacacagagaaaccctgtcttgacaaacaaaagggaagaaagaaagaaagagagagagagagagagagagagagagagagagagagagagagagagagagagagagaaggaaggaaggaaggaaggaaggaaggaaggaaggaaggaaggaaggaaggaaggaagaatatgggagggctggagagatggctcagtaattaaaagtgtgtactgctcttacagagg

SEQ ID NO: 26543 - DNA, 1122 bp, Mus musculus
ctgtccatgtttcagctttcttcctctttaaggagagatccttttgtgtctgttgggtgatgattatgtatatttttttagtatatatattgaaaagtgaaatctctaggtcttttgtattgtttttgatgctgaagatttaatctgtgccatagacacacaaggattctgtcatgttatgtttttagcccttccttggttttctgaggtaggatcttgccccaggatatttcagtttgtccgtgaacttaaaattagtttgcctctgcctcccaactgctgggactctatgcatgttctgctgtgcccaggtgatgtgcccttccttctttgatgagctttatagaaagcttgtgtctcaggaaggttgtgccagggttcctattcaccactgccagggctccctgctcaggctttagtgtgtgtgtccacatttacaccgagccagtatgtgaggaggtgtctcgacggttttcttttcttttccttttcttttctttccctttccctttctgtctgtctgtctgtctgtctgtctgtcttttttggagacaggatcatctcatactgaactgggaatcactttgtagtgcaagatggccttaaattttcaacaatcctgcttcagcctcccaggtgctaggattataagaattatataggattataagactgttgtagtaactcttgggtgtctgctgaggttcagtttaaaattacatttatcgagatgtcttctcataatcttagtaagtcttttcgatgggagtacaaaagtactggctaactcctgatggatgctttctgtggtggaccaagaatggtcagtcagtgaaggattcttcacagcccctcagataggctctgaggaaggtgagaaaaccatgtgacatacaggctgagtgagtcacccctgtgtgtcctagagcagaacatgacagaatacagttcctattcagttgactggtggttgggtttctgttccttatgttacccagtgcaccttcagagctcatccctatgtgtgtgcacagacttttgtatccagtttctggtgacacttgagcgatttttgccttgagattatgagctatgtagaggccaaagaagctgcacatatga

SEQ ID NO: 26544 - DNA, 1236 bp, Mus musculus
tgggctatgaggattacccatacattagctgataccaagagtaggagggaagcccttacccagggcactgtgttgagagcagtctctttggggacaatgtgtccattccatgtctccgagatgtcacacgtttgttgtgatgtggtgatcataaacagaatcttcattccttcccacttgagagctgactctgggagtgctaatgttcctgtgcagagcaagcggtcatcctgccctttcacaagaactctgccattagaaccatacgtttcgtccctgactgaagagaaagattgcctgagaagggcaatcagtacaaatgtgatgaattctattttgctaaatccaactcttttcctggtttctttttcttgctaggggcaggaccccctactaaagagccaacccagcttgaggcattctcatttggcgggggaggcaaacctttctctgaggccattcctgggaactcccctgccacaggagcaacatcggcacccagcacttctgtaacagctgcctctctggaagactctgctccatccagcagcaaacctgcagctcctcctgaaactactgtgtcctctgcttctagcaaattggaaactccaccgtccaagttaggagagcttctgttcccaagctctctagctggagagacgctggggagcttctcgggcctgcgtgttggccaagctgaggattctactaagccagttagtaaggcctcctccacaaacctagctggagcccagccagctaagccctcaggggttagctttcctaatacttcagtgttagggaagccagtggagcccgctgtgacctcctctgtgagccccgccccagcagcaccagcctcagctctgaatgtgagcactagcagttcctcagcaactgtctttggcagtgtgccccttaccagtgctggacctcctgggctcatcagttttggtggggctgctttggctagtagcaaagctagtttctcatttggaaaccagcagactagtagtagtacagcatcatcagctaccccaacatcgacctcagttgccccttcccttccagcatctttccctactttgtcatttggtggcctcctgagttcaccatcagcttcttccctgcccgtgtcctctggtaagagtacagaggaggcagcaccaccagctgttcctgacaagtcagacagcagtgaagtttcagcaacaacaccctcacttccagtacagc

SEQ ID NO: 26545 - DNA, 1193 bp, Mus musculus
ggtcagaacatggagctggataccttggaaatggagttacagatagttgtgagctgctacatgggtgtgggaatcgaacctaggtcctgaaagagcagccgttgtttttctttttttaagtttatttattttattttatgtatatgagtacactgtagctatacagatggttgtgagccatcatgtggttgctgggaattgaatttaggacctctgctcgctctgggcggcccctcttgttctggcccaaagatttatttattattataaatacaccatagctatcttcagacacaccagaagagggcgtcagatctcattacagatggttgtgagccaccatgtggttgtaggatttgaactcaggaccttcagaagagcagttagtgctctgaaccgctgagccagctctcctgctccatgaaacacattgttaaattctgtcacctgcctgtctgcagtctgtcactgcctgcaatgctggtcttattggtgggagactggagtgagggttttgggagggggcaggatggtcctctggaaagggagccgagcctctagcaatctgtcctcctcgggagtgggcagtactgtttgcccttggatggatggcctgttttgaatagttccctgcctgaggaggtgacgctgatcttggagtggctgacccagattagaaagtgaccctgaggtgcagtggcttttagattcatgctgtgtttctttctaaaaccctggcttgacaactgagtcctaggttactagttcttagcatcttttccttagaatttggtaaaaggtactagaaataggcattgcaacttcgtttgggggctacatacagaataattaaaaaatgaaaaggacacagcttttagctctaatacaaggacaagtttggagctggtggtactgacagtcagcatggccacttggcaacctttctttttttttttttcttttttctttttcaaggcagggtttctctgtatagcactggctgtcctggaactcactttgtagaccaggctggcctcgaactcagaaatccgcctgcctctgcctccccagtgctgggattaaaggtgtgcaccaccacgcccggcttctttttttggggaggggggtgcaacctttcttaaaaaacaaactgggtggctcctgatcagtggcctcccacacagctcatgaca

SEQ ID NO: 26546 - DNA, 1959 bp, Mus musculus
gccacaagtggttgtaaccactgagccatctccccagtgccttttcccgacctttaatagttggttgcttgacataggtatgtctgtgttggggttttactgtctgaagtcacagcatgtcctctgagttcacatgtattttttttttaatctttcttgtgtaatgtcctggcttatttgtggcattttcttctgcaggctgtggttttgattttgtttagttttagatgggttttgcttttcttttgtgtgtacatggtggtggtgctggcggcggcggtggtgggggcggcggcagcggcagcggcggctaaagaagtccagaggacagtcgctaggtgtcctggagctggagttacacggtggctgtgaactgcgtgttgtgggtgctgggaaccagattctggtcttacctgctgagttctctctccagaacacctccccttttttctggtttatgagaaaggcaggtacccccgggaacccccaacgcccctctttgcctactgagtttaggatggcaggtgtgagtaacataccaggttgtttaaattctctattttaaaatctttttttgggttggttggtttgttgaaaggaggtatctgtccgtgacatgagactcactatgtaaaccaggctggtcttgaacttggagtgggtccctctgcttttcaaagggcctgagttcttcatcgatttgagggtttgaggagctagaggtggaactcagtggttgagggcttgtctgacccttgtagcctgcgcccatccagcccgcactcccgcccccagtccccgaagtcaggttttcgaacttattgaggctttcttttcttctgtcttttctttccttatttttagacagggtcttgctgtgtagcccagggtagcttggagctaacagcaattctgctgcctcagccttcagtcataggcatggaccaccaaacctggcttctttttgaattgttttagcctctgtggacagagattttgtttgtttttctggattttggactttccctcaaggctgatacaaactcctttttgagtacctttgcgttctccctgggggcagggagctggtatcttctttgcacctatttgagtgggctttgtgtaccaagctgtggaaatttatgtatattttctcttgtgtttatgacttttattttaaaattgctctgcacatttacgttcatgtcgggtccattcttctgtgtgtggcttgtccccgacctttgcagagtagctctccgccttttacttgtctctcctccagcatcactttgtgcgcttcgtccacacagccttgagtttatttgttctcactgctgaatagtcaacacagtgtttacccactgtagggtgatgggcatctggcctacttccgttagatcacgaggcaccaacagtctcgggtcttcaatgcatgcgcctgtgtgttttgtcagtcctaggcagggtgtggcagcgataccatgcctttccagttgtggcttgattagcacagcaccggcagtgcccagagctgccatgtacggccccacaggcttgccagcgtggtcctgagagggtgtagtttctgcctagactgatctccagcttcatgtaattccaggagcggccccagcagcctcttcttgttggcatttgtttagaaatatacaaaccgatttcttaaatttctttgaaaatgcaaaaagccaaaaataatgagggcattcctgaagaacagagctgaggggctgtcccaccaggtatgaggatgtcatgaaagcctcagtcatggaggtagtgacataaagacagaagggacggtcagtgagctgaaggacaaaaatgtctagaaccagatgcattgctttcgatagcctgtctctgctggtgagcttcctgtcactgttaacacatacctgtggtaacttacggaagaaggacaaaggtccacagttc

SEQ ID NO: 26547 - DNA, 1105 bp, Mus musculus
tggagggatgggagctgctgaggttttactgggcaggcactggcagtctggatagacaacagccccagggcatctgttctgggtcatgtgtggtattaatgctctgggtggcccaggttgccccgaaactccacacctttctgcttcagccttattagtattgtaaaccgccacagccagctcactgtctagtttcttaacatagatctagcaagttcatctcgtgtatgtgtgtgtatatgtgtgtgtgtgtgtgtgtgcgcgcttgcgcttactatgttcagcatgagcccagtgccctgtgcaggctaggcaggtcctctcaccactcactcagctacactccaggtcccttttatcctttaatccctgaggaatctggccttaagtcacagctggtgcggggttgggacaagctgcaaacccagtgtttcggacatgggactggggagagatgtaaggtagtgttagggcttggcagcgggctctggactggacagtgggctgatgggaggctgtgtgaggttaagctcgttgctgtctgagctgtagccctgatgaaggaaggggcctgaggactacaaatggaggttgatgtgtgtcaggccatggaaaggctgtgaactgagtgcaagagaactgagcctgggaagaaagtggctttgtttcttattttagtttttggtgctaatttgggctcagagtcctctggtggtatctcccataataaaccgtagctcattagaactccacaattcagtcctgtttcctctatgccttcctgcctgcctgcctgcttacctgccatccatccatcgagatagagtttctctgtgcagccctggctatcctagaacttgccctgtattctgttgaccacactggcttcaaactcagggatctgcaagcagattgtccttggtgaggtctccacagaggagagagccttggctgtggtgtttcaggcctggcttcagctgtctagacggaccagcttctgactcggaatggacatgtgggatcaccgctgtttcctaagggctactttgctacttttgctttgctagtgtgtgtgtggtgtggtgtggtgtaggtgtgtgtatgt

SEQ ID NO: 26548 - DNA, 1193 bp, Mus musculus
aaggctgatgtagagaaggaagacggtggtgaaggctgctcttggtctccgtttcattgagcagagctcactggtagtggatgggcacttggtgttgaaatgaatgaatgaatgaatgaatgaatgaatgaatgagtgggtgaattaagagtaaacaaggagaatgctgatagacatattgaagggtagaagcttccagtgttttgaggttttgtcttagtggagggggtgctggtatagtttttcatagccaccccgctctgttgcatggctgctgtttctccagcctttcttaccagcaagtcttgagttgggggtggggtagcccaggctatctgcagagcaggccacctggagggagcacctgtggatgaacgctggggacattttccttgggacagtccctggctgtctttacgtctccagcatgttggagattcctgacggacctgaattgtgattggtgacttaccccccctcccccctttccatttcaaaggcaaatcgggagcggtgccgagaaaatttccttactagatgacatttcatcgcaatgtccgatcgtttggggcaaataacccagggcaaggatgggaaaagcaagtactcgactctcagcctgtttgacaagtataaagggaggtcagtaggcgctgtcaggtcctcaggtaaggcccggccgaaggcccctcttgcgttctttgcttccgtcccttgtaagatggccaggcccgccaggcacttgtgtctctagccagtttgggcaggcaggtggggtgacagcgtttgcatagccttccccctctcagtttcctgggtctgacttcctagtggaaggattggctgccacccacaaggccttcctgggggttcttgccgcacagccaggaccatgtcatattgcaggggtggtcactgtgggctgagcttcctgggcctggctccaccgtggcgtgagctccacagcggcctcctgccaaggtagaatgtgcagatcccagcagtcctttgtctctagtctgggggaggagctggcagaggctggagtgactaccaagcacttgtcttggcttgacttggctccttagtctgagcagtggtgtgtattttggcctctctcctcctgtgaggtgtgtgctctaccccatgttcttttccttgcagttattcctagacatggcttacagagtctc

SEQ ID NO: 26549 - DNA, 1147 bp, Mus musculus
ggcatgcaccagcgattctaaggagccctctctccgcccagctcagcccagccgcagaggggcctcccaattcatggggcacggttaccagccacccacgtaccatgacatgctcccagcgtttgtaagtactcaaaacatcctgtccataactgtaggctcctgttcgcccctcagcctgagctctctcagggtagcagataggggccactgtggccggcagcagagtcccgctccctctggcctttccctgtccactgcccctggcttctgcccctgctgttcaatgccactgtagctttggttctttagaaaaagggaagacaggtgttctcagccttattggatccaaggcagatggggcactgtgattcattacaaagctctccactcttcccggttcccgacccctcgttttccactttccaaagtgaattctcatttaccatataattggagccatcattacaaaatctcagtcattgatcctgtatttcagatgtgttcaccacagtcatcagagaaccagactacggtggaacgaagctcttttccccttcctcagctccgcctggaaccccgtgttcctttcagacagttccagatgaacgaccaagatgggtgaggctgtgaccctgtggccgtgtgtgtcagtgtgggacagttcatgcgtgagtgctctgtgctctggagactggggtgggcggcaggacttggacccagcaaggagcgtggtctgcagggctaactcctgcagtgcaggagtctggtagcactgtggtggggttggcagtgagcatgtggtactgtggatggaaccgaaccgtagcaagaatgcaattgttcactgcaggtttcttctaaggaagtagctcagatattcactcagacaccagaggtggaactcgtttttggaaagtgactgtttgcacttacaggttgacatgagcccatcatcttttgtctgtctcaccaggaaagaaaggccaggcgtggcacggccagtgcgcccactgaggcagctggtggagagggcaccaaggcccaccatcatcaacgcggaaaacctgaagggcttggatgatctggacactgatgcggatgatgggtgggcaggtgagtgggtggagggccagcagcccttata

SEQ ID NO: 26550 - DNA, 1148 bp, Mus musculus
gcacatgcactgtagtgcacatacccaacacagacataaacacataacaaaaataaatcatatgtaattcttatgtacatgggtattttgactgcatgtatatatgcatgcacaacatatatgcctggatgccctggaactggagttagagacagtgtacaggcgagctgtcatgtacgtgctgggacttgaacctgggtccactggaggagtacactgtgcttctaacagctgagcagtttctccagcccaagaaaataaaacacagactgcacaagcgtgtgtggtctggatggcccagtgggtacaggagcctgctgccaagcttggtgacttacttgagtaagggcctcaggacccagatggtggaagaggagaactgactctccagagttgtacatataatacacacacacacacacacacacacacacacacacacacacacactcacacactttttttttaatgcgagggccatagagatggctcaggtgttttctgctctgacctgcaccccactccctccttcttttggcagaaacccacaatgggcagcatgttccgccagcactccgctgaggacaaggaggacaagccacccccacggcagaagttcatccagtcagagatgtccgaggccgtggaacgagcccgaaagcgcagggaagaagaagagcgccgggcccgagaggagaggctggctgcctgtgctgccaaactcaagcagctagaccagaagtgcaggcaggctcagaaggccaatgagaccccgaagccagtggaaaaggaagtcccccgatccccgggcattgagaaggtctccccgccagagaatgggcctgttgtccgcaaaggtgagaggcctccctatcccacagctgggagccttgaactgtcgactccactttactggctgtgaggtagccaaacctgtggcagagacaggagctctgtgttaaggtcagcctggtctttgtggagttccgggacagtcagtacagagagagccccaaccttaaacacatgcatgcacacatgcacagaggtgggcctggggccttatctgctctcagctctgcttttctgaattttaatttgtgcatgcactcgagtgtgcatgagagagtgcgcgtgtgcgtgtgtgt

SEQ ID NO: 26551 - DNA, 1319 bp, Mus musculus
cgttacgggtgtcctggtctatcggggccactccaggctctccctccccaacagccagagtttccaaatacaaaatgtagagtgtccttgtccatcttcccatagggatatgaggaagtgaagccaaagccctgtctaagtcttcctaggaggtctaaatcaactgagtgctggctggtcatgtgtgctgcctgggatttggcccatccagtccacacagctctgccgtgtggtgctgtgctcgctccccagccctgctgggcagagatctggctcctgtttattgtttttcttacctttcgagtggtctctcattctgggaaccagcattggcttctacgggccacaggcaggtcagatggtacacctgcataccagcaggctcccctggtcagagtaaagactcggttgtttaagggatacctgctgtgtccgtgtggcattaggacaactgccactttggaaggctatgttctgccttgtggcttccgccgggcattctgtgttagatgagagaggttgatcctttgccttcttcaggactgatgaagcccatgatgccccaagagtccctcagtgggactggctgtcgctctgaagatcaaaactgtgtgccctcgctccaagaacggaaagtgaccgccctcgacccagctcctgtgtggagcccagagggctacatggcactgcagaacaaaggctactcactgccccacccgaagtctgctgacactctggccatgggcatgcatgtcaggtgagcttccctctgcggctgaaggaaggctccgcagtcccagtggagggccctaggaagaggccccgtcccgggagacacagcccagggtgggtggggaggagtggaagcaggtgtgcttgaatgtttgatgcgagtggctctctctgatggccaggctgaggcacaggaggaaccccgtggtcgtcgaactgtgggcatggagtaaaggggcagagggtgggctcacaggccggtgggtcaagagtggggtctgggctcgctcctcctgtgcgtataggagctagccctgccaccccaggcccaggctccccactcccaggctccagcttgttcattgctccaggggaccgccagctcctctgtctccagggcagttcattgagctccactgacatcttcacggccacggacgccaggggccaccgagcaacgaaccataagctagaccaaatgtttgtgttttcttttctttttaaaaaactttttttttctttaaaaccaaaccaaacaaaccaaaactaagccctgttcagcatggcggccaggaaccaagctccaa

SEQ ID NO: 26552 - DNA, 1199 bp, Mus musculus
ccaggcccgtagccgtggccgcggcttcagagagttcaccttccggggcggccggcctgcaggcagcagcacaagtggtctttgtggcacgggtgtccttgggtctcgtggcatgtacagtagtggccagcgcagtaaccgaggcaggggcctgcgtgacttccccccaccagaagactgccccagagccaagccaaggcgtcgcattgccagcgagactcacagcgagggctctgagtatgaagagctgcccaagaggcgccggcagcggggctctgagcatagccacgagggcatgctcacggagagggacgagggtgccctgaaggactcatggcgctccaacagaacttacaccgaggaccagggcggtatagacacccgcagccggggatcccggacatgcgggagagccctcccaccccgcctgagcaactgcagctatggccgcagaacctttgttgccaaagaacctccccactggcagagcaggagcccaggcagctcctggcaggaatatggctcctctgacccgtgtggcccacggcgaggcaccgacagagactacataccagactcctaccgacaatctgacacatttggaagcaggctttttgaggacagccgcacggaggacaagaggtcctttttccaagatgaccatggggcagattctgaaaatgcagaaaacaggcccttccgtaggaggcggcccccacgccaagacaagccccctcgcttccggcgcctccgtcaagagcgggagtccctgggcctgtggggacctgaggaggagtcccatctgctggcaagccagtggccaggccggtccaaactctgtcctggggacaagagtggtcctggaggtcacagatccccagagctttcctaccagaattcctctgatcatgccaacgaggagtgggagaccgcctccgagagtagtgacttcagcgagcgtagggagcggcgagaaggcctcgtggctgaacccgaagcgcaaggggatggtggcctctctgggtccagtttgggtgaaaagaaggagctggccaagaggagcttctccagccagaggcccctggccgacagacagagccgcaagctggagccgggagggtttggggagaagcctgttaggccaggtgggggtgagccttccccccgctgcgagagccagcagagcgggacgcctctga

SEQ ID NO: 26553 - DNA, 1093 bp, Mus musculus
tggggtgcagaggttttacccctcctgtccttagaattcagagttcacaactcacgtgtacataccccaaagaagttgactcaggagaatatctgttaagtctcggtgtgactatactgcagccccaacaaggcatcatgaatgaactcaagagccctgcagtgagatagcctgtgctgctctggtctgtgggcctctcttgggtgcctccacccggcctcttctcggcactgcagtctgtggaagcagcatacagtgggagggaagagtactgtggagagggtactccagcagccttcaccctgccgcagaacaggaccagcacggggctcgcactgtgggcaggctcttgtgacccttgatggctcagtcgcaggaaccggaactagatagctgctgtgtctgtgtgtgggcctcgtgcattcagatcctcctgcccctctttcctagcctttgagtagtggagcgttcatggactcttccttcctttgcaggtctccagatgaggccttgcctggaggccttggcagccattcaccctatgccttggagagaaccactcacgccagctctgacggtcctgaaacccccagtaagaaatcagagagagaggtttctttgcctacccagagggctagtgagcaggaagaggcccggaagcagtttgacctgggctatggaagtgagttggggctctcctttggagtgaggggtggtgcaaaacaacccagcctcctgtcttatgatgcttccagccttgctgagccccagtgacatctgtataacttcacagacttaaaggggggcatccaaggccacatggctagcaagagactgacctgggtgtgtgaatctgcatctctaaagccattatctccacgggtgctgtctgagcacttgtgggttgtgcttgcaatgtctgctcacatgggcaggaggagggcggggcaccgtgtctagatttccacaggcactggtgacattgctccttggtgagtggacttcatcagttgacggttgggtgattctcatcttattctttgtgtggcctttggttcagatgctctcattgacaactgcgcctccagccctg

SEQ ID NO: 26554 - DNA, 1099 bp, Mus musculus
ggctgctcaggtaagcaccacgggccgagaggaggggaggactctccgtcgggcatgcactgtctcctgggacctgtcacaaagaggctggcttttccagggtctaatagccaaactgtgaccggctaggtcagagataagcctcagcgcccctagtcttcctcttcccttagtgccccagactggctaggtgatcctgcaggtcacagtgctcaggaaccctgacagaaatgcttgcagctagacactgcattcggccccgtctgtcagcctgctcctggggcaagtctgcctatcctggcagtgcaccctgagcccggggttctgaagacacgggtcaggcatctcaagctggtttgggtagtaatatgacactttcctaggagagtgtgcttaagccatgcagtcatggcttaaggtgggactgcatcagctcctcttccctgcaggtgcctgtcaaaggtcggggcctttcatcccggattcctcctcggtttgctaaaaagcagaacggcctgtgtctggagcaagatgtgactgtgcctggcagcagcctgggcactgagatctgggagaacagcagccaaggtgaggtgggtgcctgcctcaggagaggcagggcactttccggagactcacacctttgagccgtcagtataagtgtgtcatgacctattcctgggccccaagcagagtcagtgttgagcagcagctgagctgacttgttgcggcagtcacaggtgggggatacatctctggccccaggactactccaatagactagcagaacctctgcaccatgtcaccctcaggaaggcgccctgtttcagatggccaggagggagtaagggacccccttcctcagcacagagaagccctctgaattcctccctcttgttttctgtggaagaagaaaattcagactaacggaagttagttgaaaactatttccttacatcttttttgtttgattttaatgtccctttcaattgatcaagttctttttgaaggcctgcagtgagcacggcctgcacaacagggagcctagaagatcgcacagttaacaagagcttttctgtggcttctaagagagcgagga

SEQ ID NO: 26555 - DNA, 1147 bp, Mus musculus
atatcccttcacacgtctctgcaggcccaggcccagcttgggctgagaggtgggctccccgtctcccagtcccaggagatcttcagctccctgcagcccttcaggtgagatagcccaggtgtcagacctccctaccctggtgtcgtgtgtgctgctccggggccatggactgggtcaccacagactgctaggggttcctgtcccctctgccgggtctttttcccactaccccatgtcccatcccccaaaccccagccaacgtttctgtattcgtgatagcttcagtcttggtcatcactgggtcttcctgagcctgccacagcttggggttgttcatggtcctctggtcaggattgttccagtccactgaatcattctctggggaagcagggatctttagcaagtccttggtatctgtgttcatcagtgttggagatggctgtgtaccttgttcacctgtctctgacccccatctggcttttgcaggtctcaggtgtacatgcaccccagcctgtcaccacccagcacgatgatcctctcagggggtacagccttgaagcccccatactctgcatttcctggcatacagcccttggagatggtgaagccccagtctggctcaccctaccagcccatgagtggaaaccaggccctggtctacgagggccagcttggccaggctgccgggctgggcacctcccagatgctggattcccagctcccacaggtcagtttggtctgttggtagtctcctccctccttgcctctcagttgcctcttgtgtgctgatgttcagatgtatctctcagatgcagacagactaactagtcccacagcgctgtgttctgctggcttcccttccctctagagcgacagagatggtggctgtgggactggaaatgggccaggtgtcatgtttgttcctccatcccttctagtccccacttcagagcctgccctctctgtgtgttggagctacccccacccccacccccatccgtgggtcaaaatgtacccttcactcctcaccctcgggccctgtgtggcagctgagggcctttccctctgttaggcagctggctcgccctcttactccatctagatgtcctggtccatgcctgtgtgtagggagcatgcatgggccagg

SEQ ID NO: 26556 - DNA, 1712 bp, Mus musculus
aaatgttcaccaaggatgtgctactgacttgtctgtggaggaccgggagtcttcccgcctttctcaatcactgcacccttgggaaggacaggacagttctgactgcacgccaggctcctccctggttcctgtgaggatagcttttggtctgacactggagcagatagggagtggtctctacacattttgccctgtggtcactttggttttcctgttcatctgtcctaaggcaaagcgagtggatgaaaaacccggcctgggaaccgtgaagctgcaggaggcctcatcagccacctcccagatgaagcgaaccggagcaatcaagcctcgggcagtcaaggtggagggaagcaaagcctgaaggtgcctgggtctcttgcctcacctaacagggacggtgcgccccacaccctaacagggatggtgtgccacaccagcctggacagccaccgcctggcttggacagagctctcttccattcacgaaagctcctgagagttccatcgtcagccagcctgcatcgtggacatgtggctttgacctgcttgctttggtacaaaagagcagacttcctccttcccacccctctgcccagtgactgtggagtgagcctcctgtgcagtgcagacctgcccgcccgcccgcccgcccagttccctaggcacagtggtttggcagcagggtcattttagctggaggctttttgttttaaaaagcagctaaggtttttacaaaggggaaatgagaacaaaatgctagctacatctgtatagctgaacttttatatggtcctcgctgtcctctctctgctctgctgtccccagtggtcaccttttatctccgtcctgtttgacatgtcacagtgctaccttaagaggtgattcttaagagtcacacacacacacacacacacacacacacacacacacacacaccccggttggctaaccgttggggtttggaggatgtgattggacattctggttggtccctcaccaccttgggcactgtgaagttggtatctgagtttagttccctggtgtggagttaatgtttcagaataagaattatctgttcagggcccttttgctgtcattggacacagtgagtattgagcaccggaggaattgtggagttttgtaatccagattggccccacttggggactgcatcttgggctccgtgctttagccccctgggtggctttgttccccactcatttcctttcctctttgtggagcctgctgtgtccctctggatccctgtccattcactcctcacagcttatcaccaaaatcaatataaggacacaggtgaacacctattagtcaagtttgcgacaggaaagactatgtatggcacattcatcttccgtccttcactcctggtaacagggcagggtgttgggtagggtttctaagctataggtgtgttacccttccttagagaactggacagggtcaaggtataagtggcctacagagaaacctatgcagcctcaaaggaggctggtggtgtctaaagggtggtgtcttggggctactgcttgcaggttttgtgtgagcacctgtatgcgaggcttcttgctttcactaagaacaaggaaaatttcccattgctcaaaggaaaatgaagtgaatttcagggtgctcagctgctgcttaggacccccatttaatcacccatctggggtgttggagacagcctgcttc

SEQ ID NO: 26557 - DNA, 2717 bp, Mus musculus
agaagcactgtccacttaggagtccccagcacagatctgcctgtgcccctatcagcccttccaccccccggaagtgaccgagtcctctgccccactgccaagctctaccccataagtctcactcagtaaaagccacacagtcacctcttagaaatgcggccagacccacctcacccaatgcttggtgggcattatgtgtcaaaagaagcaaacatttttctctttcagaatttcacaggatgctgttacaaactcaaaatgtgccctttaggtgagcctgctgtcagaatggcagtactccctgttttaagaagaaaaattaggaggtcacctgttttcagtcctttctctaaccctgtatttccctcctgcctcccaccctaaataaaaacaagaaacactagaatttatttatatgtattgatgttgtaggtctagatggaaaaaaaaaagtaaatgtcccactgctctgtttatataatgtctgaattactctgtgcaggaaaggccaggaaattgcatgtgaaatttggtgtgctcaccacctctgtgatctcagctgtgggctctacccctctgagaggcacatttgcaactagacgctgaggacagagggcaggcttcaggccaaatgtccctactcctcggatgatctggtcaagccaagtttttagtacagaggtgttttaaggtgcaatatctctttgtgtggtttttagagtcaagctcaaagtataatagaacttgggccttattttggtttcaaacccccatctttagatcacacataaaaacaggagcgtctgtcagggtgccatggcctttggtgggaacaggtaaagtccagccctgccttttctactgctgagatgggtggaggtgggcagaatcttttactcctgcctgctgaagtcacctcctactgctggtggctttgttggtgccactgatggtgaaatccatggtttggcaaccaggactcttcagtctgttggtcctgatgcggcgtgtagcatctgtcggtgaagacttctgccgactgcatttagtctggtctcttaacagttgctttccttgtctgattcccaagtttagcattttcaaattcagagttcacagaacacttctgggtctaagcttccttaagggggataaacaaaggatgattgcagtacacatttagaaatgctggttcacatccaaagccacgcttgctctgccacttctagagatacttggataacactgtccaccttgctgtcctgtcctctggagccaccttccagatggtcagtgatgaagtcgtgaatgatttgacactcagggcccagggcacaagagtgtacccgctgaggccatgaggcaactctggctaagtccgccccccaacatccactggggtccccactctgccaggtacctgcatgttaactttcatgttcgccttgccctcatttccagcaagtctgggttagagggtatgttgggaatctttcacaggcaagggcacagaagtctggcttctgtattctttgatgagtggaaaagccagctctttgtgagatggctctaagacaagttaggtcatgtggaacagagtggtcagcgttggggatgagcacagtcacccagctgtgctctccactgtctaccagctctgactagtgatcttccaggtgcatgacacctgcagcccccagctgcttgcttcagacctgcaacctccccaggccccatctttggcatgtcacaatcctggagcagcagttcctgtgaaggctccttagctgaagggtcctgtgctctaggctttccacctcaaaccttttatagaaaaggacttgggggattgttctttttgagggtccttttgttttcctttgcttttcttttggccttccctctgtctttcacttagaccagctatttgaaagggcagacgatgctaaaggtgtactgtgcagcttgtttagacgtgatatggggaacttcttcggatgggaaatggaatcgtgaattcaccctcccttccctccgggtcagtccctgttgtttctcctttcaaatatgtgattgtactaggtctttccatacgaaagaactctccttatttaaataaaaaaaaagtataaaaaaataaagccaaacatgctttctcaggctgtgtcggttttctatcatctggaagagtacggctggcgcactgcttcccgggagactgggagtggccagaataccttagggagcgcagcactgtgctgtggtggtgttcccaaggctcacctaggcagccatcccaagaacagctttttctatgacttttgcctttgtcttccattaattggttattttaaaaccttaagacaggattcgaaagatgtcctcggtgtggagggaaggcgacttgggtaaacggagcaaggtctcaagcaatttagcagggactaggacacatgtctttccttcagggtctctgagaaggctaagcacggaaggggttgcagatcatacaaattaatatatattcaaagacattagttggtctacatggacatttttttctttacactgggcctcaggaaccccctaccacaacaggcagcctgtggttaaggcacatctcgaaaatgggcagcaccaagaagccttgtcctctctgtgggccaacccatgaccatcctatcctgtacttcctgcctgattgctatctgggtttc

SEQ ID NO: 26558 - DNA, 1105 bp, Mus musculus
ctgtgactgcttccttgttcttctgttttctcctgttttgttcagccctttctcagtgcactggtggctgtggctactgctgaccggggtctcttgttcctgtgcagttgggtgagttagagcccctgacttggatagtattcttcctgtctgtggccttgtctgtcttgtaacctcattttaattctgtctttttcaggatcaaatacatggggattttcacctacctgcttgtgctcggcattgcagctgtccacgcgtggaatctgatcggagaccagaccttgtcaaatgtaggtggtcacaccagggcctcgtgaatctgctgtatgtggggattagggtgtcaagctgtcctagggagtagttggcttaaagaagtggagcctctggatcctcagggctggagagatggcacagtggttacgagcactgactgctcttctgaaggtcctgagttcaattcccagcaactacatggtggctcacaaccatctgtaatgagatctgatgcccttttctggtgtgtctgaagaggctgacaatgaactcacatacataagataaataataaaattaaaaagtaaaaaagaagaagaagaaggaggaggagaaggagaaggagaagaagaggatcttcaaggcttcaggagcagggagtagggaagctggcgcccctgtgagcttctagcagcatctacctgggacaaagggcttcagggtttctcaggaacttccctgagcctccatgcaggttctggaaatggctaccgcactctgcagatcgaaagacctatcctctcacccctggcagatgcgcgtgctcagtcacttgctcgccagaatcgtggctctgctggtcgtcccagtcttcctgtacttactcttcttctatgtccacctgatgctgctctaccgctctgggccccatgaccaaatcatgtccagtgccttccaggccagcttggaggtaagaaacacacagagcaaagacagtcaggctcagcttctctgtgagcaatgcgggatctgtagccctcgggagggaaaggtggggcagggcagctagggctccatctcgagactttgttttcagtaaccaaat

SEQ ID NO: 26559 - DNA, 1229 bp, Mus musculus
gtgggcttcatggcttttctgcccacagccctctctctagtgaccctctcagctctcctgaggctcctagtgaccctgactagtgtcaccccatcacttggcctccctggtagccctgaagtaagcagcacagcacctcagggtttccccactctctttactgctggggtacctaaggtcaccttaccagaaacctgcctgtactgtccctcctatagatcttattctgacactcactctgtctggcagcccatcatccactgctcactgctgggcctcttcgggcgcctggtgcatcctgagatgaagtgagtcctgcctgagtagcctggaggtgacaggctgcttgtgaacactgaggctgacccacacagagtagcctgctgtctcagcgtgagaccactgtgcccatctcgcccagagacaacagtactatactgattttccgagttctgccagaccagtgatacactggggccagttcttagactcagacttccagttcctggaacagacattctattctcagagatttgctcacctgtccaaagagtgagtgacacccatccaattgtttgacatcaattctggacacacacaatgaagaccctccctcacagatacaccaacaaggcggttggatctgggcagtcctgcagttgagtcttggttctcagatgactttaggctgtgtcatgttgaccattaaagcctgccttggggtggcccacatcccggatacatagcctctgtgggagctgcatttgtggccagcttccctagccttggcaggcagagcaggcttggtttccaaaggcactgtttttcccttagtgacactctaaggaatagctctgctctgctcttgcaggcacgatgtcgcagccccactgagcccccattctcaagaagtctcctgctacattgactataacatctccatgcctgcccagaacctctggaaactggtgagttccgtgctggcctgggtgcagcagggtctcatggcggtcagtgggagcacctgctccctacctcagagtacccagaatgcctcctcagatgaagggttcaaatggaaacttggataagaaactttgatttagcaagtctgagatgtcccaatggggagcagtcacctcatcaggccgagagtcctctgggcctcaggcatggattgggaaagttccaagtgctgtgtcttccctgccagggcctttcgggtcagg

SEQ ID NO: 26560 - DNA, 1168 bp, Mus musculus
tgaccagcaaagcaggcatgcagttgttgctttattttgtccccaggatctcaagcacaggtcctacttgggaacgattttgagcaggacttaccaacctgcgagattgcagtaatggttcctgttcttcatggcctgcagagacattgagataccatggctgcctctaatgaccgacctgcttcagtggcagcaaggaccaaggcagctctttataatatgcagtgggatttatttcctcctccaactaaatccagagtcttgagcccaggcagatgcctgtgtatttgtctgactagaacagttgtcatggaagtcaggccagttggggtaagatactgtgtagaagccttatataagctcatagcactttccactggctcagagtggcagaccctggtgttctgcagccaggaggaggatgtttagagttgcactgttaacagctcctgcctgagttttaacacttgttacagagatccctgttgacatccaagatcccacagcccaggggaacccaagttcacagcagaggggagtcatgtgtcattgggaatgggtcccagaggagggagcagaaaatagggaaatgaaagtggctaaaaggagtgatcagagccataaaaggatgtggccaggtgtagtgggggattgaggcaagaatacaagagcagcctgagttccatagtgagccccagtcacagcacctccaggtcatatgacctggaccatgtgtcctatcactttcctgacttttcagtggatatttactgggcatctactctgtaccaggtaccctaagatgctggaatggtggtgaaacatgtgggttgggttttagtgttgatagtgggcagactgtgtctgctatcagtagatgaatagaaatgctagtgtattaagttctgtgaagggaacagcagagatgggaatactgaagtctgaagatgggggcaggagcgaagaagataggtgtgtcttaggcagagtagcaagaggagcagggttgggactggagagatggctcagtggttaagagcactgactgctcttctgaaggtcctgagttcaaatctcagcaaccacatggtgactcacaaccatcctaatgagatcatcaggcctcttctggcgtgtctgaagacagttacagtgtacttacatataa

SEQ ID NO: 26561 - DNA, 1212 bp, Mus musculus
agcctcagcaagggcagccagaggttctgccccaacccacacccttcctcagccacccttatctttataataataataaggtcagactccatcccctccaggggctggggaagtagctcagttggtagagtgcttgcctgctgtgcacacagccttgggtccccagtacctctgaaaaggctgatacctgtaatttgagtgcttgggaagtggaggtggaagaatcagccatcctcatctacctagtgagtttgaggccacactgggctacatgcgaccctgtctgaaaaaaccaaaagatcaggctcctatcttaatgggggacacagactggtacagatctgcctcttagccagggcagttttactttgtaaattcctgttacagaaagaacgccagagactcagtgatggagcagactgtgctgggtggcctgggggctttctcaccaaggagggcctcaggccttactcaggactctggggcagaacagagtggcagcattctcgtgcccaggtgcagtgcaggctggtaaactggcctagcattcagcagggcttctaagttttcaccggctcagtcctccctatcctccttttcctccccgcccccattttatcttcattttctttacggagtgtctcctgtagcccgagctgagcccctgcctcaccgctgtgcctggtggttggcagtgctaagcaggcactctaccaagtgatttacccccagcactccctgcctttttcctttgtgtggtgatgctggggatggaacccagggcacagcaggtccccagatcaactcccatcttctcagaggcactttagggcagtggggctgggcagcacttcatgggtcctcaggcagttggggctaactgcctcaggaaggcatcccactttggagggcttccatctttttgaggcactttgggacagggaaagtgggtaccattctctcaggccttatgacaattggggtaactacgccaagcaggacagaggctgctggggcagggtggccttcccctcccccggtgtacatattgtacctgtgtactattttgtatataccggggtagggacacccctgtatcatagtggaggttggagctggcaaatgggaagagcttctaataatcactttgggctgggaaccttatttattggtagtgttaggtcagagggcaggaggcggagacaaggttgt

SEQ ID NO: 26562 - DNA, 1184 bp, Mus musculus
ctcgcctcttctcgctttctgtctttcggaactgagtgtcccatgggcctgttaggaggagaggcaagggatgccccttgaggagggagggaggagcaggggcaggcaaggaggtcagagccgagggttgagaggatgggctgccacacgcacgaggctccaggaggcttcgtctgtatcacagactgtgcaagtgggcagtgcagaaccttggtatgccaccgagcgtcctagcagaggtagccgatagggctgagctcttgagtctggctgaagcaagtcagggacactcaaaagcctagacttgcacaggatgtgtggccaggtcctggtctgggtcaggtccttaggaggacccaaggggcccgggaaagagcacagaggaggactgtagggagcacccctgggacagagaatttgaacttggaaagggctctctcagagcaggggtttggttcccttaaacctttggccataaccccagagccctgggggtgggggtacctggcagcacctggcaggtgcaatcctgggagaggtggggggctgggtcccatgctcacggtgtcttctgttctctctctctctctctttctgttggtgtctctctctcttccccccatgcctggccatcctcacctacccttgagcccggccgcttggctttcactcccaccctctgcccacccggctgctccctcctctccctcctcctcgggtgcaggacgggcctcttcacacctgacctcgcttttgaagccacagtgaaaaagcaggtgcagaagctcaaagagcccagtatcaagtgtgtggacatggtagtcagtgaactcacgtccaccatcagaaagtgtagtgaaaaggtatggccgcctgggaggggctgggcccagccggcaccacgtcccagtggttacggcttgccaggggcagaaccatctacctagcagatgtgatggccacttggctccccactggaacccaggcagtccccggcctgaggtttcccaccatcttataaccctgggactgccttcactcaggatcctgccagacccttgtccctgtcagagggccataccccaccccattgttctcctttccattggtaaccacggcgatgacaggggatggcggctgtttaatgagcagctactatgtgcctcagtgggccaagtgctggc

SEQ ID NO: 26563 - DNA, 1197 bp, Mus musculus
tacctgccccatgtcagccgccctgatgagaagaaaacgatgctgaaggccttaattatgtcttagtgggtaaaggatttggttcagaaggacaagctggacactgcaagtgccacactcgctgtgagcccggggcaggtagtttccctgctctcaaatctgttctgagagccctgtggggccaagcgggaccagcctcacattccacgtgtgtaccactctgcttggagcctatttattttgtatttatttgaacagagttatgtcctaactatttttatagatttgtttaattaatagcctgtcattttcaagttcatttttttattcatatttatgttcatggttgattgtaccttcctgtcatcacctggtggggcatgggaagacaagatgggaaagtggctacagagtgaccttgcctgctgcccacactgacagtgtgtccgccccaccagaaacagagggaacggcacagggaagaccacccaggccgggtagggtagtggggaaggtggcagcttgacattctttcctggaccgggaggatttctttattttgccctttggaacgacaaggcagtgaggtgcttcaccaggaatttggtttgagggtgaggactgaaggacagggtggcctgccttccccaacccgtgacctggtctccctcctggcccacagctgcccatgctcaatgagtggcctgctggccacttggcaattgtgcctccattgccccagaatggcctgatgaggaaaatccaaacaggatgcaaagatcaatgcaaaaatcaccggtctgcatagtctatgctgtaactggagtttgtcaaaggcaagcagccttctaataaagtcgcttcaaatgtgacaatggagccagggtttttctgctctgggcttgggtgttgggggacattaatattttcctcatccattgcctgcatagttaccccctcatctctagggaggcacttcgtggtgttggttagattggggttgctatggtctccaggcactacagactgcttttgcccaggcctcccaggtgatagaggctggggcagctcagacctgtctccatcacacccactgaggtcgcctcagagctttgttagaggactctcattttgtacttgaagccagatgagtccctgcttgcacaagctcaccctccccaccagaacagctggtga

SEQ ID NO: 26564 - DNA, 1228 bp, Mus musculus
tagaagggcctgagcatcatggttccatctgcccagggctgggtcctgagcagctggccttcctgcaggaaaggaaggacgaggcccagccgtgctgggtaagcaaaggccttttcccctgctctcatgtcagccggcctgggctgggttccaggctagagagtcagccaggtggcctgtgactgggtgaactggagctggcttcctgccagacgagcctcagccctcctgggcaaggggtgtgctttccctggggagtcttccccctactactcaccctcttggtacctccccaaccccagcactttctgtcctataatttgcttaaggagagtataggctgccagctcagccctggataaattcccacccccttaagtttcactcactttgtatcaacccagcaggctggtgtttccttggccccttaaggtgtttttcctcctgagttcacagttcttgtattccttccaccccaacaaggggagataggtgcctctgttccccattccacctgcaccccagcagggctggggataggcgagtatgggacattgtttctgtgggtggggatggctggactccccaggttgggaaggtccttgcctagtttgtgtcttcctcagctagcaaaagttggggctgtggtcttagagctgcctggtgtcaggaccagatcatttctataggttctgtagccgttgttttaatcagcagatgaatgttagaagatgctgccaaggcaaggcagaacatggctagagaaggttccggcagctcagattccatcctgcccagcaggtgcctggcactttaagggactctggcagctctgttcctaggtgaggtgaccaccagaagatggacagagccctagtgtgcttgtctactaccttccccagtcagcattgttttggtctagttctaaattccagggctccaaaccaagcagttggtactgtcaggaagactgccccaaaccaagagcccctgcctaactcaagccaaggtctgggactggatggccactccagtagacgagagctgccacatcctctgcttccaggcactgggccaggataacttagctgaaaacatgaccacaaccaaatgaacactggtggcagccagaggctaagagcctttcctcctgcgctcagtgatccccacgggtgcccagagcacctggacttcaaattctatatacaaagatagaggatatattaga

SEQ ID NO: 26565 - DNA, 1137 bp, Mus musculus
cctgccccgcgcctacgccgtcctcctcccgttggccgcaggcctcctgctgctcctatttgtgggtaagtctcccgatctggggcagggtgtctggaaggcagcgtgcttccacatgctggcacctgctgtacatctgcttagactctccttgtcaccaatgctccccggggctttcctattccttaaaggccacgggcagaagctcctctagtggtgttcccagttttcaggttcctggggcaatgaggacatggctcccctttctttcctgtctcagcttcatcttcatctcttcaatgttcctgcctcaagtcaccctggcatctcttacggctctgtgggttgggaactgtgtctttgctgttacgctattctaagctctagcccaggagcctaaaagagtgcttgggttgactgaggaaccacatggccggatgatgcacaggtggttagccttgcaccattttggtgatagttaactgaccctcagtggctgtgtgacctagtgaatgactgcaaagatgcacccctaggggggttggttgggagcctgaccttgcatgcctggccacctagcttccactccaatcctcccagtccctcctattctgtgtattacaggattgttcatcacctatgtgatgctgaagagccagaagataaccaagaaggctcagtgaaggtccagcagggatgaggctgtaggggccttctccatatctcctccagaaaagggaccaagggtcacagcttacaagatggtcaagctggctgcactgcagccctctttgggacatggggctgttttcttctcagtttgacaacctggagccctctctctcttggtcatccttttagaagccaagagaaaggtgggttgggaagcctctcacttcccttaggctcagaggctgaacattgctggttggtcctgtccatctcacagtcaaagctccctgtcccttccaccgagttctctcctctcacctctgtgctcctcccactgtgctgatggattgagcaggccttcccgcctctctgtacaagtcctgtcccgtcacaaggcagctcttccgagtctgacacttcccaggctccatgaggacttctggacccaggaagccctggggaaag

SEQ ID NO: 26566 - DNA, 2074 bp, Mus musculus
ggctcagggaagggcagagatcgaccccactgaggctctggagcaggtaaggggtagaaaagacccctaacaggcgtccaccttgccctcctgtccctgattccccgtttgctatgcccagccagcggccccgcctgcagcgcatgccataccactactatgaacccaaggggccggacgagtgtgtcacctacatccagaacgagcacagccgtaagggcaatcaccaccgcttcatcaccgagaagagggtcttctcgtcctgggcccaactctacggtatcaccttctcccacccctcctggacctagttatcctgtccaccgatctcggacagatacaaacgaagtggctctggcccagccatttaaccatggccatcttccagccagttcaggctggctggagtatttcccagccaatcaaatcagggccttgatgagggttttttttttcctccagccaatcggggctggggttatctcttggccaatcagggatttggaattctgtatggtttaatcgggtgtcagggggtctttctcgtctagtcagggtctgagcatagtctatcagggtataggggtctttctgagtcaatctgaagcttaggacatgtcttttcccataaggctttgcttcagagccccaggaatgggcccccaaatcactccctccttagctgggacaatgaggtcctgtcctaaggatctgaggacttggtgttgccccacagttgccagaatcagagctactgtaggggggaggggctgccaggaggccaggccaaaggatttgtggagttctaggagtggtagggaagcctaggaggtaagaggcggtgtccagttcccggtttcttcctgagtgaccttaaacagaccctcttgtctttctggtatgctgtgatgacatcatagctccgtatgtggagaccctcactctccgttatacttaagtgtaaattcctcagctaccattcctcgctgggggactcagctccctggggatggggagcctggggtacccttccctgcctccttctagaaactttagggtatttttgtgcaagtgccccccatggttgggggatcctgacagaaatggggcaaacatgaagctgtttctctagcccctcaatccagctgccgttagcctggctctagaaaggccaggcacctcttcctaccctccagcaggagagcattccctgctgcccgaaggagcctttgggactgaggaaggggtatcccagccacaccagggcttcgtgaagtttttgtctggagatgctgagggctttggggagaagtatcctcccccaagtttgggatgagactagagatggggactgggttctgtcccttgcttaagcactttattaagggcaggactgggtgggggtgtgggtaacccccattcttccacagcctgcaagggaagggcttccagaaaggctgtggactgggggttgggggagactagccagcagtgagccctgcacagcaaggtaatgggggttgggcagtgacagccctagatctggttttgtaatgatttatacagaaataaacacgcctaagcccaactcagtgttctgtgtctttagtctgaactctttgcttgtgcccctctcccacttgggagtatcctaaggaccatgctgcagcctttgggttcggagcttgcaagagggggtgtcagatttctgttttagctgcctggagagtcttgggtccagactggatagatgtatgtgatgttgagcaagggcttttgtctctgagaccacagtgggcagatgcctgctctcaaacagcctgagttctggggagggaaggataccagagttctagggggaattctgacaagttgaaagaagttgacgccttgcatctgccactaaagaggaaggggaaggcatgtagggaaagagccagtctgggaccaaaagtcaacacttgggacccagggcctgagggcaggaaaacacccttctaggtagagtgagtttggcaggttgtataaatagctgctggcctcttagcacaagggctgtttagttagacaggca

SEQ ID NO: 26567 - DNA, 1192 bp, Mus musculus
gttacttgatttatttatttgttgggaggggtatgcatgttctgtgggatcaacatggccgtcagagggcaatgtgaagggattggtgtgcatcctggcagtggaactctggttacaaggcttaaaggcaaatgccacctttgagccattctgctgacccgtttgtccccttctttaccttactttaccccttcattttatgccatgcttagagtcaccagctcattgtacctcagtctgtcccctccctgtcccctgccctggtgaggatagggacagcaaaggcctgtagaagctttgtgtccaggcccaggacatttccgggctggaaaggggtttgctgaagcccaagcctggagagaggggcttgctgggacttcacacgctcccggaaagagggcaagcttgggtgggctaacacaggtcgtgctcccgaggggcccccggggagagaaggctcaagggtcccctgtgctggacaacaggacacggtgctggacatgctccgagatgctatgttagccaaagtggattcttccaatggcttcctgatcgacggctacccgagggaggtgaaacagggagaagaatttgaacagaaggtaagacccttgactggtcatcggcctagagggaggggtgatggaggcggagtctacagtgtgcaggtgggaaggccgcacaggacctaccataaccaccccaaagaaaggcgggaggaggaggatttgagagactttatcctgtggggcttgtcaccccacatgtacacaggcagacatttgcgcacatgatccatacctatacaagcaataggcaatgtaggatgcacacatgcacatgtgcacatgtgtgtgcacctggatgaagctcacactacacaggtgctgaggagaaaggggtagtaggtgttgaggaggggagggtgaagggctgactggcaccctggtgggctggggcagagtacctccagcctcactcctgcccacctctgcgcagctcagtcagaataggagagatggcatgtcacaacctctaagtgaatgaaagacctcaagaaaatgtttgtcttgctctgagtctcagcatgccaatcattgaaatgggagttggtctagcttcctttaggcgcaactctgaggcacatcttggttttcctcagctgcatgaagtcatttgccaccctcagggc

SEQ ID NO: 26568 - DNA, 1519 bp, Mus musculus
cactaaagaaattgccaaggagggttaggattgctcctttcctttgcttccagttatggtgattcatgctgccacagccggaggccccagcgtggccggcccattcttccctgtgcctcagcccagctgtcttgtctccctctggctctgctgggatcctaggcccttccttagccaggctgtgtcaaagcctaggggtccctgggttggcaggctgctctggggggtctggtgttcaccctgtttctcatagcctcgttgtgtggctttggccctaagccattgtctctctggagtgagttttctttttttctttctttctttttcttttttttctttctctgtttctttctttttttttttttttaagacagcatctcgtgtgacttaagctggcctcaaccctgttatgtaactaagggcaaccttaatccttctgcctccacttgtcttcctgtgtgctgagattacaggtgtgtgtgtggacctccaccactcctggttttgggggcactgggaatcaagcccatggccctgtatacgaggccagcacgctacagagtgagctgcatcccgggctgggcaggttttctgtgcctgactggggtctggcatgggcaaagggcaaagggccatgggctcaccagctggggccacgtggtcactgggtgccaaggagctgtgcaatgggcatacagctaggtgggaagctggggtcaggggtggccttcctgaagaaggctcccttggtatagacctgccaggccttgccatcctttggctggttttaaagcttgtcctgtcacgctatgtcccaacccttatcctcggcgttaagacaagagcatgcagattaaggagtgtgagctgccatagacaaggatgtgggatcaaggaccaggcctgggacccggagaggacacccagggatgccaagaagagctggcatctctcttctgctctttattctttggtctcattacacaggaagcctctgttggtactcacttgtcctggggccccgtctccatccctagtgacttcccctgtaagcccagatagcctgtaagccagcagccatggctgtcccagggacacctgcccctgggggtgacggtgctcactcctttctgtttactaccagtggggccacctttccttctgcattgcctatttaagctgtcctttaaaataaataaatgtatttcagttataagaagtgagtgtattgaaacacagggaggttcagaggaagagggcaggcatcaccaggcacagccttctgcctgatcaggtttgcctctgtcccccagggtgacttcaggaaagcaaaaggctctggagccccgcaccagtctgtgacagctctgctccaatgctgtgtgcatgtgcatatacacacagacacgcatgagcgcacataggcatgtgcacacatgcacacgcacactgcagccccgctgaacatggatctcttaaggccggcctaggagcagacagaggatgcacagaagagggg

SEQ ID NO: 26569 - DNA, 1156 bp, Mus musculus
gaactcagatatctgcccgcctctgcctcctaagtgtgggatcaaaggtgtgcaccaccacgcccagctagcttgtgcttttaatcccagcacttggtcggcagaggcaggcagacccctgtaaattcaaaggccagcctggtctacagagtgagttccaggccagctaaggctatgtagtgagaccctggagagaaagagagacagagacagagagacacagagagagacagagagagacacagagacagaaatcaatggaatgacccagtggtgaaacatttgcacacagcctgcttacctgagttcaagccccagaacccacaggaaggtggaaagaagaacagctccattaagccgtgctctgaccttcacctgtgtaccctgcccagggcacacactagataaccataataggttagttttaaaagcaaggtgctttgcactgcatggtatctgcactcagcagttctttcctgttgggtgttcaaaagacagtgtgatagaaactcactatctggcatcgttggtttcttggctttgtgcgtgttaaacctggtatttctaatgatacagtttaaaaaaaaaaaaaaaaagcaaggtgcagtagtaaaagatgcccgatgcctgatagcaaactctgtgctccacacatgagcacctatgtgggggtgtacatatggtagataggccacacacacacagagtatataaactgcacacacaacacacatagagagtatataagctgcgcgcgcacacacacatacacacagggtatataaacttcacacacatacacacacacacacacacaaagtatataaactgcacacacaacacacacagggagtatataaactgcacacacatacacacacacacacatgcacgcagagagagaggcagagagaggtactaataccttcactatgtattccttattggactagagccttaaactcacagagatccccctgcctctgcctcccgggtgctgggattcaaggcgtgctccaccctgccctacacagaatggaggaagtcttcatcttcccttctgaacttgtgaccctcctgacctcccctcctggatgctggattatattatattatattatattatatacaatgctggattatattatatattata

SEQ ID NO: 26570 - DNA, 1011 bp, Mus musculus
agctagaacttttaaccatgcagccatctctcagccctttattttgagacaaagctgtcatgtagactaggatgtccagaactgcaggtctccctgcttcctcctttatttagggagctagggttacaggtgtgcgccatcacttacacagcaatcttggtcctggaaaccatccgtcagcatcttctgtgtatgtatctgtgaggatatctgtcgttgggtttactgcccgggataatcccatcttaatcagttatgtctgcggagactgtctccccgtaaggccacgtgcttagggcatgattggagaggacattattcaacccgctatagcgagaacttagaaaagtctttgtggctaccagcaggtttcaaatgctcagtggcatgaagacaaactaatagagctgttctgtttcagaatatctcccctgaagtattcaaggaattcagccctttgctagagattgaacccagaaccgggtaagtgctctaccactgagccacgcccagtctcagggtttgtattcactgactccctccgcagcttcctggaagtcactgtgtataatagatttattgttggatttagacttcaccatagcccaggggactttctccagtcgccattttccggttaagtttcatggctgggaattcaggctctagtaggttccaattaattactctgatggagtagagtccattagaagtgaaggcctggggctggagagatggctcagcagctaagagcactgactgctcttctggaggtcctgagttcaaattccagcaaccacatggtggctcacaaccatctgtaatgagatctgatgccctctctggtatgtctgaagacagctacagtgtacttactatgtgtgataataaataaatctttcaaaaaaaaaaaaaaaagtgaaggcctggggagatggcaagtcagtcaagtgcttgctgtccaagcacaaggaagcactaaggaggtgagaggggtctggctttctggcc

SEQ ID NO: 26571 - DNA, 1164 bp, Mus musculus
gtagacaagtatgagctgtttgaaaagctggaacttgtgaagggccagaagcggaaggtgaaggaccgtctgaaggcctacgtgcgcgacccctatgctctggacctcattgacaagctgctggtgctggaccccgcgcagcggattgacagtgacgatgccctcaaccacgacttcttctggtcggaccccatgccctcggacctcaagggcatgctgtctactcacttgacgtctatgtttgagtacctggcaccgccacggcggaagggcagccagatcacccagcagtccaccaaccagagcagaaatcccgccaccaccaaccagacggaatttgaacgtgtcttctgaggccggaactggccggtgttgttcttaggttaggagtggattgcttcctttgcatggaacatgtgacatgatgggacatttgagattttctcctccagtacatattaactcccaccctggcactgggaacagctgcctgagtgggctggggtggagctatcctgcctgcccctctctggaggtctcagcgtggacacaaagtgaggtgggagaggctcacccactgtgactttctaagaactacttgcatggtgggaggaaggcacaggtccctcgccatcgccagctcttcctctggatgagagtttgagggacagaggcgcctccaaaatgggctacttttggtctggaccttaggggcgtggggctgtgtgaactcctggttcctttaaaaggagaattttattttgttttgttaagtttagagacattcctggacgcagtttgattggttaaattaaaagttggttatttttttccagtaaatggctgcgtttcctgtgttcagaccttccctcagctcttgtctcagctagaagctagggtttggtcagccaggacactgccagttcttctgtaccacccaacactctggagacgttcagggtttgccctcttctcctcctgggtaccttccactgcgctcttcacccccgctgaaggcgtgtccacggtgccagtgtcctgtgcttggtgttggcaagtgctgtaagctgagctggagtgagctgctggacccgggctgctttggctcctaaatcctcagactggactcataagcagggcactgcagccttacagtcatggagt

SEQ ID NO: 26572 - DNA, 1175 bp, Mus musculus
gaattggattccagataggaaccatcacacaggaacgattctctcgcctgtctttcaacctctgtccctcagtatagaccccaaacacacccccaccccacccacagttcctccgtctgttgtgctctcaattttgaccacttcctctttctcctccctagttccccatcacagccttgagggaaatcaagattctacagctcctaaaacatgagaatgtggtgaacctaattgagatttgtcggaccaaaggtgtgttgcttgcctcaggagaaaaggggggtttgagacaaggtttctctgtgtaaccctggctgtcctggaccttgcgccatagaccaggctggcctcacacttagaggtccacctgcctctgcctcccgagtgccggccccccatcttctctggtcttgtttggagttgggtgtctgtgggttggagggctgggagttggctgtggaaaatgaggtggatgcaggtttttattttttatttttctctctgccccttctgtatcagcctcaccgtataaccgctgcaagggcagcatctatctggtgtttgacttctgtgagcatgaccttgctgggctgctgagcaacgtcttagtcaagttcacgttgtctgagatcaagagagtgatgcagatgctgctgaacggcctctactacatccacaggaacaaggtggggcagaatggggcttctctgctcttgactgctgtgtaggccaggctccaggatgctatgaaacctgactgagctcttgtgtgtcctcccttcagatcctgcacagggacatgaaggctgcgaatgtgctcattacccgggatggggtcctgaagctggcagattttgggctggcccgtgccttcagcctagctaagaatagccagcccaaccgatacaccaaccgtgtggtgacattgtggtaccggcctccggagctgctgctcggtgaggactcccgagcgggcagaggggggcaggggccgggtgcctacctggccacagcccccattgcctggggccttttgagccatcagctctgggacgtggagtctcaggaggcccttgggcttaagaggcactcccggtaccctcttcttctcaggagagcgggactacggcccgcccattgacctttggggtgctgggtgcatcatggcagagatg

SEQ ID NO: 26573 - DNA, 1333 bp, Mus musculus
gtcccgtccccccaccatcacattgtccactgcactgtagtcccatcaccctctgccacattgtccactgcaccacagtcccgtccctcgccacactgtccacaatgaagcctggattcccgactagaaatgctcaccatggcctctgtgcctccctgcagatggcttctggcggtctggcatcatggaggagcacctgctggacgctgtggtgcccttcctcccgctccagcggcatcacgtgcgccactgcgtactcaatgagctggctcagttgggcctggagcccagcgaggaggtggttcaggcggtgctggacagcaccacctacttccctgaggtagaacagctcttctcctccaatggctgcaagacagtggcctcccgactcacatttttcctctgagaagcccaggtggcatcgctgcctcctctgcctggtcagagcaaacacgaaaggcctgggtggctcctggaagaaatctttcctaagctggttggcaagtgggacccagagcacaatgttaagatgaagaaaggtgttggccaggccaaggaagaaaggtctagaagcatctttgctaagaaactcctgggtaccccgcaacctcacagccgtgccattgccctgcagtctgagcctgagccttctcaatgtgaacggcaactcagggacgaaggctcctggctgcttccagctggggactcttactggcatgccttgtctggctcctttcccagacctcagcccacagactgtggctggacccagcaatccagctaggccaggctagcacctcacaggttccccaaatggaaggactcaagctactacatgggcctgaatttcaaagtttttaattttgtacaagagaacagagattaaataaacttagccttggtattagaacattgaccaaagtttcttactgtcctgggaggaggcagcttggctgaaatctgttcattgctcaggaagggcttcattggccctttgagggagtagttaatcgtcagaggtgagcttctctctgtctcctgggatctgttggacttcctgagttaaaaggttagtcagttccaagaagctttcactactgctgagatctgttgacgagatctcactgaagcttaagctatcagcagccttgctgggccatggagtctggcccggggtatcattggcactctcaccaatgtcactatgggtcgtgctgtgggtcaggctgggagtctttgttactttctggctgctgcgctgggccttgagtttccagccctgggcgcgaacagccttagctcttctgattctctcctttacgctcagggtaga

SEQ ID NO: 26574 - DNA, 1810 bp, Mus musculus
acagaaactgctggacacgctgaagaagctgaataaaacagatgaagaaataagcagttaaaaaataagctgccccccaaaaccccggctcccttcccaaaatgctctgcagctcccccgtgcgccacctcggttactctgctgcctccccagccctgcacgccctggccaccccgttgccgtgctgagttcttctcctgtgcgatgacaccccatcttgtcctctgaaaagcaagagagtaatgtgttgttttttaaaaatgagcatcttctgtatgtatcccacagtaagttcacatgcaagctccacactgcagaagcgtcagaactccggaccgagtgaattctcccttatttatgaccccgtgacctgtatatagccctgtcccgcgtgtgcacattgcttgaatatggaaaggtagatgtgtgggtgtctctccaagcttggttggattcatttctgtccttgttggtgtttgttccccggataggacatgctgagggagtgatgttctcgctagcccctgctcgctccctgttctcagcgatgagcagacacctctggaggctggcgtggaacgagcctcctctttgcacctatgggggaggcttagggtgtccacaggaagccagtctgagtgccggccagtgtggtctccagagcctggcactgctttccctgatctgtgtccatactgttgtaacaagttaagcccttcaggctaaatcagcctgcctagtgccctcggagcctccagagttaggtctgaccagccccctgcttgaacacagtttggatagaggccaagggtcaggggtgggctggaagctgtgagtttggcactctggtcaagggtgctttgctgtaggagctaggcctgaagaatgggggccctgctgcttagtcagagtcccctcagtttaagatacttcatcaatcttaagtttgtgtagtgtacagtcatgtgtcattgtggttgtatgaaaaggatcattttattctttgtattagtcatcactgtataaaacatagctagctataaagcagaaattccagaagccgatgctggaaggatggtctccaccctcaggacgcagcagccccctgagcatgctgctcaccctgctgctgtagtcgtgaaacaaagacagtggaagtcacaaaaatgtccccagcccagtccccgcccctccctcccgcagatttgtacgtattactgtgtctcgtgctgtcttcgcaaacgtggtgtacgcctgccgcaggtgtcctgtgcccttctccctccctgactctagagtctctcttctccttagttctcaggcctctcccctgctcctctccagtgaaccttttcccttaggactgaaccacactagcaccggttgatttcttctgtagcgcttctcccatcccttcctccggtcaagcaatgctcatgcttcaggatcttgtttgtcgaacatgtggggtttcctttatgttatttatataaataatttctcaaatggatatttaaaaaaaagctagtctgtcttgaaacttgttaacttgaaactcttgaatctcagtgtttaaagtatggaagcacaaccgtgtaccgctctgtaccgtcctgtactgcagcatttgagtctaataaagacgtcagctctcactcatggtgcctgggcccactgcagagctggtttgactttgaggactatagaggaggccagccaccccacagctggggcttggaggcttctggatccagggggttgtggcttgcattgcatctgtacctatctcccatctggggtacaaagcttg

SEQ ID NO: 26575 - DNA, 2026 bp, Mus musculus
accgagctccgaggcctgttggcccaggacctgcaggctgaaagctccccaccagccagccctcttctcaatggggctccagtccaagagagctcccaacccgtggcagtcccagaggcctcaccgccagcctcacccctccggcatctcccacctggaaaggctgtggaccttgagccccctaagcccagtgaccaagagaccggagagcaggtgtctagccccggtagccgtccccccatccataccaccactgaggacagtgcgggagtgcagacggagttctaagcatggcctccaggcttctgttggactctgcaccagggcgctcctccttgggcaccacagcctctcacctctggggaggggtactccagtttgtgccttgtgggaaaggtggctggggtggtgtggcatctccaggggtctggcctacccaagtcactttatggggttcagtacacctgttactgccccgttttctgtgggctgatctccaatgctgggtctggttttgagggtttcctctttgtgcaagggtctggggagcccctccatcccgccctcgtactgttacggcggcagatgaaagcagtggtggtgtgactcacgtataggaagctaggaagctgtcatctcactctggggctccttgggaccaacgtggcaaggaaaaggcagaccaggcctctgtcccgcccactccctgcaggtcccaaggttagacactggcctcactttgctagctactgctgtgggagggcggggcttaggggtcttacaggggagtgatgctagaggtcagaggtcatgatggaatgagaaaggcccagaatgtgttagtctgtgcaggggaagtgtcctgagggggagggagcttgggagtgtctttgccaggatggcaaagtgaaggtagctgaagttggagtgtcttgggtgacccgttcctgctcatctggctgacaacgctcattggcagggcttagctgtgggctgtttcactacgtgccaggaagctggtggggctccagagggacattgagggctatggctctctgagacactgctgaccattcatggcctctgctcccgtcacctaatcctgataattccagacccctcttccaatgtccttgtgagccatttgggcttgtctttccctcttagtcacaagggtcaaaccaagagtcagttagctagatgactctccccagactctgtcgccagagttgggagaacaaagcagagactgccgctccaaggcccccaggacgaggtccctcccagtcctgtgtcccttgctctgtggacctgctccccagacgcaggcctcagacccacaggatgtggccggtgctcagggacacccagtcccctgccctcactccgagtactgacttctttccatgttctctagtgccttgggggtttccaccatccttccagatatggtatgaagaatctatgcaaactgtgtaagcttctgctcatcaataaacgctttatttaaagctcatttcctcatgtgctgctggggtgggggagatctgggcctaccgtatctagggatccattcatcccagatctcttgggctcatcatatgagctaccaggcccctgatctgagtgtgttcctgcacgtgtgtacaggtacaaattcacatgtgcatgtggaagccaaaggatctcggatcattccgcctcgtgttttgagatgaggtctcattagcctggaactcactaactcggttagcttggctgactggtgagtcccagggtctgccggcttcagcttcctcagtactttgattacatgtactggcctggctctgtgagatctggggagccagacttccaaatgacaactaatgtactgaggcctctttctctaactcattcttacaatcccctattttagagggagaaactgaggctcagaaagaaggggagaggccatagagctttcaggtgactagccttctgatggctcatcagtcccatgtgtccaccatgagggtggcctcca

SEQ ID NO: 26576 - DNA, 1181 bp, Mus musculus
tctgcgcacctgcccactgtgccgccaggagatctcccagcgcctccggatctaccacagcagctgaaggcacagcacctaccagccctggcccttccttggtaccatctccaccactgctggactcccacctaccctcattccccagactagggcaagactgccataggcctttgtcacccaccacctgccaccccgacccccactgctctgagcactaggcaggcaggtggaatgttcctggcctgtgacatagctattctgaacagtgaacaaaagacagggcaaatctgctggtggtggagccttggggcagggggccaaggtccagcgtagggaggtggccctgcaggactcaggaatccatgttagtagccaagcctcagcgctacacccagctgtctgcccctcctggaggtgtccatatctgtggaatgtatcagccatcccgtcctaaggtgcaccagtgtctctgggaaggggtgggttgtgcaagactccccagcacccttttgcttctttctgaacacccaccctcccatatctgcatccttagcctacacaggcaggttgattcaaaacaggagcaccagtaaatctgactccttgcagagtcacccctaggtccatgagaacttgggaggggtaggagtaggcagagtccggggagagggcagctcttctggggaaaagggcgagagctgctgcccctgggtcagagggaaggcaacagaaacattgccccatggagagttaggcaacaccctcttgaaagagggcgaggggaacagagccagagatgggggtctcattatttatttataagtagcctgtgctcatgggacaggttgtgttcctgcaatgattatcctaggtgagggggctgctgaggcaactggaaggcatgttaactttcagaggggcagcccaccctcaccagctgtagtgaagggttccatgtgacatggcaccctactgccctccccagtatagtgtatatggcctacagcatgtgctcaacaaatattactacttgactggctctgggggaactagacattagcacctagctcaggcctggaggccaccctcatggtggacacatgggactgatgagccatcagaaggctagtcacctgaaagctctatggcctctccccttctttctgagcctcagtttc

SEQ ID NO: 26577 - DNA, 1172 bp, Mus musculus
ctttttctccccaggcaaaagaagctggggcagatgacattctcgacatctctaaatgtgagctctctgaggtaaacaggatgacgcaggctgtgaatttaatctgtcctgttttcttgggtccttggggaaaaaacagataatggcatgagactttgaaaatggcagaagtaaaagacgggcaggtagctccaccaatgaaatgctggacctgtgagcacgagggcttgctagccagccatccagttgagtcaacagactatgttcagtgagagactgtctcaaagcataaggtagggaaagagacgctcacagtctgcctcacctgtgtgcaagcatgcgcacacagacacatccaggagcactaattaagaaattatattgtgttcttttccaaaagaattgagatgatcttttggcctcaacataacttgcaaaagtcagggcctacttagaaagggaggcaggtggggtagaacgcacctgtattcccagcatcccattcgcaaggcagaggtggggagtttgaggtcaacctgggctacatagtaaaaccctggagaaaggcaggacagaaaactgtaggcaaaagtcggtggcagcattcaccatgctttcgaggtgcctggcatttaaccaggacgggaaagtcgggggagggaaactacatctacagatgcctgaggctccacctgtcgatggttcctggtaccacagaataggtaggccagagcaggctgggcagtcctgccagctgactgaagagggctgacaacgcccccagctcccctcttccatagccctctcctagctcagcactgttctcccagacagtgacttactgtcattagtcacctcccaacaccagcgccacagagagataggtgagacactggtaggtgacgaggtgctaacccgtctttgtcttatcttagattccatttggggcttttgcaacgtgcaaagttctacagaaaaaggtgagcagtcttgttcagactcacttgctggatgtctgcttgggggaaccacatgagacttagaggaaccctcattccccccacacacacaccaccaccagtgccattaatagaaaggacactcaatgcgttccgccactccctcagttagaaggagatgaaagtgtttacacacaggtggatacatgaaca

SEQ ID NO: 26578 - DNA, 1253 bp, Mus musculus
atgggtcttggcaaagatttccctgtcccggtgaatcggattttatccttgtgggagggctatacgacagggttcactgtaagtcagtagtaggtgccagggtgcaggagtccgccatgctagggattcaactctggaggtgaggccagcaggaagcaccttagctagccgagctgttttttcggggccctttagcgtgtctggtggtggttggttttctgggctgtgttcacatcaagtctctttgcagatcgaggtggtgccttctgcctcagccctgatcatcaaagccctcaaggagccaccgagagacaggaagaagcagaagaacagtgagtcggccccactccctgggtttccgctgcagtgtgctactcagctgtgtcgacccctttcttgggacctaggggtggaatgagatcacagtaggcgtctgttgtctgttccctttcctgggtgcagaaatgaaacagtgcctcaggggtttaactttatctgtttccatccctaaaatcgtgttagggctgctggtgaggacttgcttgtgccccagccacccgccactgcacctgaccagtattgttggctggtgcaatccagtggtgagctgacagtgagccccagcttttaggaaacagggctgtcctacatgtggatggctctgtgccgaaagcatgggaacagcccagcgataggtaaaatggagccatgatctcagaagacaggggaagctgtaaaaggccctgtacttgctttctgcagttaaacacagtgggaacattacttttgatgagattgtcaacattgcccggcagatgagacaccggtctttggctagagaactttctggtaagagcacgctattttccctgagtggtggctgccactttgctgttgaaggttcaagatttggattttcccatggatccatattttttccctgtgttcctgcaatggaaccctggaattctttcccctgtgactgaggccaccattcttactgtaggaactatcaaggagatcctgggtactgcacagtctgtgggctgcaatgtggatggccgccaccctcatgacatcatagatgacatcaacagtggtgcagtggagtgcccagctgtaagtgactgttatataagggggaagcagttaggctgggggaaagctggacttttgttgctttacttttggtgttttactggggcattgttaacttatattccctgttgtgattgacaatatttcttttccca

SEQ ID NO: 26579 - DNA, 1253 bp, Mus musculus; identical to SEQ ID NO: 26578

SEQ ID NO: 26580 - DNA, 1147 bp, Mus musculus
tatgagtcttaagtcagatggatgatacactaaagcttgctctggatcctccccatcctggaggtacagtgggatctctggcatagcaattgcattaatccttaacattttccataagtctggggaatgtggttttggtagatatctacaattaacaaaagctactaagtacagcagggcatattgaaagagcagcgtaaacctggaccaatggcagtagcagtaacaacacaagggaaaataatgctttgtgacctttgcatttttccaataaaattgtatttagagaagcaaacccagtgcaattgttggggctgcagcagtgacttgagtgggacatcaaatggacctgaatttgattcccagcactcaaggtggttcacaaccattccagatgggtaataggcatggtcagcattaacctaagccacatcctgctcaccagtctagtctggtggctaggagggaggcgccaaggaggcctgtgctgtcttgtggggtccttttttcttttttgttttgttttgtagacagggtttctctagccctggttgttggttgtcctggaactcagtctgtagaccaggctggcttaaaggcatgcgccaccacccccggctttgtggagtcctctttaccataaagggaaactgaggttacagtccccaggtcgttgtgctgtgggtcagtgctaccaagatccaagcaatgtcaccatactgtgaagcacttggttgtatgtgatgctttctctgtaggtatgggtttctagaaaccaattctctggagaaaatgcaatatcagtaacaagccacagagcacacaagctctctcctggcacaggctatagttgtggccaccttggaggctgaggtagatcttaagtacaaggtcaccccaggagaaaccatttaaaatagaaccctggagatgtctcagtttttctgccagaggacctagtcaatttctgatccacaactccctggttcccaaggatttgctggcgtctttaagttgccttttgcagaggacctgagtgtttcccagcacccatgtcaagaggctatcacctgtaattccagcccttggggattttatggcttttctgctgtgggcactgcacacatgtgaccgtaacacatttttc

SEQ ID NO: 26581 - DNA, 1199 bp, Mus musculus
accccacaggcacacctgtgctcatgtgcacatgctgacacacacacacacaatttaaaataataaaaataaacctttaaaagtttaccaaaaaaaatcctgttggaaactggcccactgataaaatgcaagtgtctccgtccagctttgctgttttacttgctgcttatgcacagccatgagtcacacttactcgtcttccccactgtccccagccttttgttctgctctacagattcagtagtaaagtatgtgtgatcttttttttttttaaagatttatttatttattacatgtaagtacactgtagctgtcttcagacacaccagaagagggcgtcagatctccttacagatggttgtgagccaccatgtggttgctgggatttgaactctggaccttcggaagagcagtcgggtgctcttacccactgagccatctcaccagcccagtatgtgtgatcttaatgggaaagagatacatgtacatgttcaagatcagaattccagtggggacgggggtgtaaagagtgagcagtgctgtggtggagggctgcattgagaggtgtcctctctggaagttgctgatggggctgaggcttgcccagcagggaagagcatcacccccaagaactaggaagcattccaggtatacggtcaggtggaaatgccctccctatgtatgtgtctatctagaaagccactgttacagaacagcatgcatctgtctcccaggtgtactggggacagaggagagttcagaagcacaaacctcagacctgggttttcagattcctcttttcctaagtgtgtgcatatgctgtgtgtgcatgtgtgggttcacgtacacacatatacggatgtcttaggttgatgtcaggactctttcactatccatcttctaccttattcattgagacgggatctcctaatcaaatgcaaggctccctggtacgtccacttttgttagccagcttgttctggggagtcccctttctctctgccttcctgaagtaggatggcaggcaccttcacaaacctaccaggcctgtctgtgggttctagggatgtgaagtccagttctttgggcatgtgtggtgagcactttaatcactgagccaccagctcaagctgggctctcaaactcttacttttgccattccacctctgaatcccagcatcttgcattgacctctcacc

SEQ ID NO: 26582 - DNA, 1168 bp, Mus musculus
atattaaaccaccacagagccccaagacaactttcctggaatgtccacctgaagcagaagattctatataatttctcatttaaactggggctctttgggaagtattaataatagctggacagcagaaaaaggagatgcagaccaggttcatcatggcaacctggaatcatgctcttctccctatcagtgaccttgaaggatgaaaatcttctcattccaggatacctagataatcccatcctgcatccactttgcccaatgactttgtagtgcttcatcctggcctgataacgtgtttcacaactccatcccctccaaggcctcagccaggatgctggtagcatgctgccaggctcagaatatcatccccatgaagtttcttaaagttttagccactgacatctctgtctgcactctcagctttgctcagtgcagacctgtcttgtgaatactatgctattgggaagagtcaaaagccaaaagaccttgatcccaggtctgcctgctgtttgcttatgaccagccttggccaaatctcttgttcctggacttctctgtctgtggcctgtgggtcctttctggtcctaatgagctgctagcatacctaatccttctgtcctctgcttactgtctattggctcagttggacccaatgccaggcttcttggaagcctcccagttagttccttttcttcactggttcttagagtctgtttcttggaccagcagcaaggacatctcagggaaatctttttgatgcaaacttccaagccagatgcaagacctactgagcgtggaacactgggctgggagccagccatctcctagcaacccctccagggctaccaatgctgtcaacctggacaccaagtatagagggccactgcttcactgcttcagtcttcctatgactactccagaagggctgtctgctagacacattgttagctgctttttgtgagggtttagaacagaagagatgccaacatcttagagatgtgtggctgctgtcatcactccaaaaacagaagaagaaacatgaaggtcatggaaactcaaaagaggtcgaactcctgacagaaccacagagattggggctgagagatggctcggggttaagagcaaatatgctgtcctcacaagacctgagttatgttcccagcagctc

SEQ ID NO: 26583 - DNA, 4097 bp, Mus musculus
gcttttcaaggtttttactggcttataactctaccttcattctgtactgtagaatcatacataccaggtaactaaatcgctccaccttgagttagtactccgactaaaggacaggaatttgtagagcttgtctacaaaattctccaagcagtgttgtggttttgttattttgttttctttttttttttctctcaaacagccagttcaggtgcacagcaacttttttctatgcagttcccagggaaactgcagaacttggaatttgtactttttgtaaagctatatactctacgggaattgcaagcaatatatctatcttggtattgtgtgtgctaatgagagccccagaggctccccactctcagtgtttcctgcttaaagaaaaaagtcagaactctctctaagatcctctgtgtgtcaccagatctgtgtgtgtgtctcacatttttggtcatgtggtgctatttttatgttaactatcttttaggtcagtatcggtctagaaaatgtgaaacctaccagtagtactgatttagttactttcctctcaagttcacagcttggaaagaaacctcaaaggcatgtgctggcaaactggttactgtctgagttgtgtctggtcagtgctttggagactgtctctgcttgctgttagattcatatacaccaacaggcttcacaaatggctctggtgctgtggactcaggcagagagggcagtttagtcatgcagctggctgccggggacagcggcgctctagtctctgcctgagaacctgagcctgagacatggactcaaaccaacagacccagaatctgaggaccaacctcaaaggctaggagctaaggaatacagaaatagatgtttgctggtctgtcatgcttttgtggctcttaagataccaagaacaatgggtttggggggaaaactttttcgttttttgtttgtttgtttgtttgtttgtttgtttttgagaaaaagtttgatcccagcccttgtgtgtagcagccccggtggcggctcagtagcacctccttagcacacaggatctgctcacatgtgaactcgcctcacctcagtgttaactcctgtagatgactaatcccgctgctcctggagcagcttttgctaatcgggtatacggtatgccttttcctcgtcaaactgcctaagtcgggatctcttctttccctggagcatttgttcagccgagaaagctgagcgcctcaaggggaggctgggccccaagtgtttacctacttaagtgtgttctgaggcttcaggtaaatgtctgtgattttcattttccttacatgattgcgtttgcttttgatttttttttaattaaatgcaaaaacttttttttttcgtattgtgatatcaattaagtttgtgacaagaaaggccctaaatctaaggatgtgagacatcgagctcagggaaggagcctccttttcactgaggcctggggccttctgaggagcttccagagctttctgtggtgaggctggcacactcgggcagcgtgtccatgtcctggctcttgtcactgtctgttggaactcacagacatggagttcttgtgtttgtcaacttgtttagctggtttgagtttaccaaagagtgacttatccaaaattgtctttgacaaaaatatacattgctttgattgtacagttcaggttcaaacattgtaatgggactgttaaagggcagaaaaccgatttgagttttaaatgatcatgattccgtgttttacaaattgcgcttgctcccattcgtgttgctaacactttaccctctccactgctagcagtgttaagaatgaattctcaagccataacacagtactgtaaagttcacagggcttcgagggggacagcgcccaggccagcacagcgctgcatagcctgtctgcacagtcaccctaggtgcctaccggtgggcatggctaccaagggcccactgtgcagatagcgcagcagcggttaattgtgcctagccacatgaggatgttccaggagagacagcatagccacctagcaggcctctctccccaaagctcactgtgcaactccttgtggacagcaaacctgtccctgtacagttgtaggttaggtctctcactatagccgatgcacaagtccactaagataaacaatatgtgaagacatcttttgcagtgaagtatgtcctgctttcatacaggcctgtgcgtgattgagtctcttctcagctacctttccatgttagacaatgtgaagacagccacagcgcccttccctgcaacattaccccattgcacaaactgtgaagatgttttatacttttgctaacacttgtggttttcaatctttgtttgttctcatcagtactctgccctcttgtttctactaaaactgtaaatacatttaggaaccatttgtaaatacagttacaaagatgagttcatcttcctggtcagtggaaaagcctcccagtcaattggctctgccttggcatttttttgttgttggtgggtttctctctctctctctctctctctctctctctctctctccttctctctccctctctctccctccctcctctcccttcccttcctccctctcttttctttctccctctctccttccttccttccctccctccctctcccccctctctctctctctctcttgtgtgtgtgtgtgtgtgtgtgtgtgtgtgtgtgtgtgtgtgtgtatactgttggttcactgttaaacagaatatactgtagaactaaattggtaatttttaaatctcccagagatctataaatgtatgcctctcttaatgatggcaagtataacccacctctgttttacaggcatgcatttgtgtgtgtgtgtgtgtgtgtgtgtttaatttttaacaacctagattctggggagaatccgaaagaacatgacgcaagggcggggggacgtctgtgtgagtgagctctgccttgggttgctgtgttttattctaagctttccgcttgttactgctatgtgtttgtagttctgttgttgttagattctataatggtttcctgtgaagccgccactgaaagggactcaaatatgcaacatctaaactattttccaagggctcatgccccttgaatggtgcttttagcctggtcagggttatttattaaattttatatatgaaagtactggggaattatgtaaactctttatacaagactatctagttcttacatcataggtttcattactcagcgcagctgaactgaaagttcagggaagtcattcactttgttccagatttgtaatggtcgtcacacatgtcgtcttcagtaagtgccagagttcccactgttcctgccagggcttgccaactccaggtgctcccctgggtctggtacagacagggctattgctgctcctggagcaagctctgctcactgccctgagtggcagcctgagcttacagacctctcaccgccctgcccttcagtgacaagcatgctgtgaatgtggcctcaggacttggagaccaagctccaggctgctgccctgagtagagcaagaggtaaactcccctgcctcccctgagaacgaccgttttcctaatgtgaaatcacctctcaccactttagcagtagggctaactagtcttctgttacaaatggctgagcaatttgaatgacttcacatggtgtcattatcttgcaatataaactggtaacctcaacgccacacttcatcaccacgtgaagtaaatgaagctagctaagcggatgctgtgtcactagtaacttgccattaagggttattttatagcatgaattgaagactatttattcaaatgatattttactcgtattcattttgctttaggtttgtgacatgaatatttcagtgctgcttcatttcgttctgaattcttgtttcttgcttgtaaatggcttttttatggtaataaattcgatggaaattgctgtttgtaaataaaaatgctgctagagcaaccttgctgtggtctctgtgttcccaccccacccatgtcctccaggagcgcccctgcctcagacaagcatctctatttctcaagccactgactct

SEQ ID NO: 26584 - DNA, 1211 bp, Mus musculus
ttgtcaaaagctgacaaagctttcgttcagttggaatgtggcagaccctgtgagaaggtggggtgtccacggtccagaaggcttctgacctgcctttcccagtagagagcctttctggcagcctgccctgttagagtaccagcctctcccctcaccactgccttaggaaataaatcctcacccttccagaagagcctgactagtctagtcgtgggcagcactgcccaccagtacaatgtatgtctccactctgagccttggctggttgtctccagtccgagtacaaagggcttcaaggccccactggttgcgtttcctaatctgcaggcacatgccttcaatctgggatgcacacgtcacaggagctcctcttgtgctgtggtttaccttgtgttctcccgagccctggcccaggacctgggatttctgctctcaccacctccgcctacatcttcagagcctgccctaaaggctcccttccattgcaggagagaggagtttcctgaaccactctgaccctgggccgccttttagctgttgggaaagctacgtgctaccgtgggtgatgtaccctgagaagttgaacattctggaaaaggtgtactggggctgagtccccaaggtcggggtggagctttgctgtgcccacagatgtggttgctccctaaattctcagatactttggaaatgctgagggccataggccaggctatccttggcctcctgggaactaggctgctttgaccgtaaaactaactttatccagagaatcctgggttgctttgggttttgtttttctttttgttctctctctgctatttacatatttaaaggtactagtttgcaaacctctactgatagtgccctgtgggaagatgctggaacaccttttgcaaatgtgattttttttttcattttaaatgttgcttgaagcctgtgtcatgtcagttgctgctgcctcctttccttttatgagggtcccaatgtttcttccagaaagttattttatttatgcaagtcaggtgactcttagaccacagaaccatgggatgataagcagattgtcattaggtgcatatcatggatatttgtgaaccacctgtgttttagaagttaaatagttctttctagaattgctgtcttcagtgtacagcgtggttttaattgaatgttaccgtttaatattttcttcttatagaagagaccatgtc

SEQ ID NO: 26585 - DNA, 1154 bp, Mus musculus
agctcttccagtcagcagtggctaaggcaggggactgggtggcagaatctaacccagtcctgcccaggtggcagcggccggctgtcactgttgtcctgaggtcttgttgcattttgttctctcctggtagctacagggcttctgggctttgctttggtagctgcatctctggatgctgctcccctcaaggctacagcaaggactcctgggctgagctgtgagcagagctcttttttgtctactttcataccgttctaaaggttctagctaaagccctggtgatgtcaggcggagcttcagagtccgaagcaggagacactgtcaccatgctgcagattctggataaggcacgattttatgtttaattctacttggtcaagtctatgggtgccagagataggtgtttctagttggtgtgttgtcctacgcttccctcatttaatggcaggggaagaccagtttgcagtgtcacacgacagtgctggctagcagtgacctgtggctcctctgccttagatcatggtgctacccaaaagggcagccagggaccacagctcctgagactaagccagaatggatggctgagggttctccaggaacaagacgttcccagactcagtaagtgagaggcagcaacttatacacagaaggcttgagaaaggaatcctaaaaacactggtgtggacagtgctcagttagagggtgcgctgagcaatattgtcagctctttgtggcttcagagggggaaggagccctacattaagcaacgtcatctacagactcatgttccccagtcacagagaaagctgcatttacaagtcccagtagtttatgcatacacacaccatacatacatacatacatacatacatacaccatctctgcaaggacaaggctgtccttgaggtctgttctgcatggtcagatgttttaggttgggaagaaagcttaagctcagaaagctttaagcctgtgacgggcctgaggctcctgctgggtaggggtctggtgtgctttgcgttactggccaaagcagcttagggaggaaaaggtttatgtcagctcacaccaccgtcagtgaggaaactccaggcaggaacttgaacattgacagtcaagactgctggccagacacgcccacaggccactcccac

SEQ ID NO: 26586 - DNA, 1137 bp, Mus musculus
gatgagtagggaaaggagagagagtgatgtgccagacatgttaagaacaagtgattgagctggagagatggctcagcagttaagagcgctgactgctcttccagaggtcttgttcaattcccagcaaccacatggtggctcacaaccatctgtaatgagatctgatgctctcttttggtgtctgaagacagctacagtgtacttagatataataaataaatcttaaaaaaaaaaaaaaagccgggtgatgttggcgtgcctttaatcccagctcttgggagacagaggcaggtggatttctgagttctaggacagccagggctacacagagaaactctgtcttgaaaaaccaaaaaaaaaaaacaaaaacaaaaaaacaagtgactgttaagaaaacctcagtttcttcacttgtcatctttcctgtctctcaagcatgacttctgagggactaaaggatgatgcaagtgttataaggaagacttttaagaactactgtgggcgatggctcagttggtgaactgcccagcaaacacgaggaccagagttcactccccagcacttacataaacagcttcagtgggggtcagacagggggaatcttttggaacttgatgactagccagcctggaggttgtcttaaaatcacaagtggaagtccctgagaaacagattaaagctgacctctggtcagcctgcacattgggtcctacctccacacgctcacattaaaaataatcataaactaacatctttaaagaacaatagcttttgatctttgagttgtctggctctttatatgttacttagaaagcttggtatttattgatgattggtttctagtattagatcgaggtgatacatggcagtgatagatggtggaggagtgtatgctcatgtgtgcactcgcgtggtagccagcaattgataccaagtgtcttgggtcattctcacctgcaacctgagccttccctcacttccccaggagctcacccattagccagtcctgccagctagctctctgccagaatgaggcaggccaccacactcacttagcatttacatagctgctggggatctgaactcccggcctcatactttgcagaggagtacttttcccctctgcgtcatctcccc

SEQ ID NO: 26587 - DNA, 1184 bp, Mus musculus
ggcgcggagccgtctgaaggtactgcggggcggggaggctgggcgctcgcgcgggaggtcgcggtcggggtcacgagtggccgcgacacgggacactgctctccctccgacggcggtgatgcgggacggcgcgagtgactccgaagccccggcgccccggcttagagtcctgcggcctcccgggcgacctcttggccaaggtcaccccgcggcaggtgcaccgccgcctggagctcttggagaatccgcccccggggcgacctccgggtcgagccacccacgcacgaaccgacgccgcgaaggagaacctcgctgccctgagtttcgcctctttgtcagaccgttgtcacctgttttgtcctcacctggcctcttgtcagctggagtttatactttgcatctttggtggtgacaacctttggactttgtctttacctctgtctcctcccttgcctcagtgttttttgactctgcttctgccccctcgggccgccctctggttcagggcccgaaagtcacactgacttcttggtcatttgtctgtctgtctctctgtgtgtgtgtgtgtgtgtctgtctctctctctctctctctctctctctctctctctctctctctgccaatgttgtgttcttgttctctccttcccaactgagtttgtttaggcagggcgggccttgcctggacctctgagccatggaaggtgactcatgaccctgtaaaactcccctggccgggcaccattaccagtggcccgatcacagtctggtctcagttctgacaagtgtcaccaaacctaataaagtgtcaggagctactgctttcacggtgaaggcccatctcaggatctaggcagtggtttgcgcaggtctccacaactctttgctctttccagaaaccctgggtggcctccagggctgtttggagctgctctgtttaaccaggccagcatctacaggcttaggaaggactagacttccatctgcctctgagacccttaacttagcacagtagcagagttctaggagcagtttactgaagaacttagaaacctaataggaatccattccctgcttgtttccaaagtattgtctgagacagagacaccatagggaggaacactgaaacttttggagtggagtgtatctggaatagacaggagatgaaacatattttatcaagtg

SEQ ID NO: 26588 - DNA, 1177 bp, Mus musculus
ctgcatgtcctggtcctaagtacctcctgtgaggatgcctggtccctgtgtccctggaagcctcaagaaagaaggctccatccattcttctctttcaccctgtccccagctagcatgatgctcagaggccagcaggagaaggtggctttcaaacaggctgaggtggggaagcccagggccagcctgggccacagttgccatctgtctattgcaggaggctgctggcctgcagagtcacacaagagcagatctgcccatgtgtgtgagctccagaatgctgcacgtgctctagtgtgtgcctcttgcttattgtggggccattcctcctcctcaacccactgctatcacgggggcagaagtgtctctcccagccctcaccccaagccttgtgcacagccatgcatgtgcaccagggtactaggtcatggtcttcctgactgtgtgtgtgtgtgtgtgtgtgcatgcgcgtgcatgcgcgcatacacctgtgaatgctatcgaggaacttgtggatcagcagggttagaccaccctgggaccccgaatgaggaagtgattatatgttggggccatgggacatggtgaagaaggatctatgggcctagggaaggctctacattatcctgaggacattaggagccataattgtcagcagagggtgagggaattctcgcatacaggtaagctccaactgacaggttgggttgtatcctccacagtgaagagtgaggatgaagatggagacatgaagccggccaaggggcagggcagccagagtaaaggcagtggagatgacgggaaagacccgagaaggcccaaacggccccgaaccatcctcaccacacagcagcgaagagctttcaaggcatcctttgaggtctcctccaagccctgtcggaaggtgaggggttctgggtggggcagtctggggccaacgccccccttttgcttattgtgggtctgttcctcccccatgacccactgctatcaccaggggcaggaatgttcctcccacccctcaacccagctgccaccttccagctgccatctacacagacctgacttgtctccctctctccgggtcaggtccgagagacattggcagcagagacaggcctcagcgtgcgtgtggtccaggtctggtttcagaaccaaagagcaaaggtgagaggtcacg

SEQ ID NO: 26589 - DNA, 2895 bp, Mus musculus
cagcggggccttctccaggatcctgtggtctgactctgcctctttccttctcttgcagtacgagtacagcttccgcaccgagcagagcgcagcagctcgactcccacccagccctacccggtgccagcagatcccccaatcctgaggagcccacagcctcctgggggagaagacatctcctacccggtgcccagactactgatggggtggctggggtgagagtcactccctccctcacctgcccgttctgcttgccctgctcactggccacgagactctgggcagctgcttggtcatgtgtggtcatcagctcgcccgctgagacttccctgcctccctgggaccgttgttcataattgtgactaatgtatgtgctgttagtgaccagaggctcctgtgtgatgaccacttaccccgccaagaaagaaaactccttccttacctggactcacccatgaggggcccaggcacacactccagccgcccagtgacacccactggctcccctcaactgaccgtcacctaccacagaaatcccacaaagccactagctccctcctgggacattccagggttgattgcttcacttaggaccctgcaagatccactgatggcctctgacccagctacctgggaacaagcgccactcgccagcaggctccagtggcccacacatgcatttcatgacggcactaagcagcaggactaagatgcacttgagacaactgtggactcttccccctttccacacactggacgtccagagagcatagatgggaccccgctttctatggaggtgactgggtgcctacctggatggaaacttggctgctagggtactatgcccagtcacaggtgccaattcccacaaagggctcatctgtggagtgtccgacgacagacgacagctccataggcctctgcctggtgacctgacctggtggcagctggctctgagaagaacagtacagaggcaccaactcgtcacagccagacccaccccaccatctagaaggcaccttccaccagggagctgctgttttgaaaagcccttctgtcccaggcctcagaatttgggccaggacatttcacaggtgtcaacctgaggtgccaagttgaaccctccatgtgtcgccatgagaacagtagtcactgctgtcccagctctcagcctcaccaccatgcgctgctttgccaccattggcttttagggctggaatgacactggtctccagagcatctgtggatgtgaagatctgcccagtggttagaggccatgggcagctacttcaccagctggtacaaacctctccagtcacagctctatagagacagctgggtgtccaaggtgcaaaaggatcaggagcaagaacaagccaacaagatggcgtgagctggggcagggccaaaaatacctcaccagcctacaccagcccctcctccgtcccagaccctcaggcccagtcagccagtctttctgcttgatggtacttcatttctatgtgtcaggaagggtcaccttgcttcctcccctcagatgtgagcacaccctatggggtacccatcaaccccttgcctctgggccccacatcctccgggtagcagaggtccatagagtcaacatagacatctctagcaaaacctagtgccacgctggtgctcaaaggagctaataaactgacctaagactgctccaccagctggggtcccaaggatctgtgtctgcggctgcaggtgtgacatcaagtggcttgtgtggcctgaggcccaagagaggggttgaccaccgttgtctgagttaaccgggaaggttgggcacaaagttctggactctcctaacctcttcattgaagtctgtacactttggccactctttctgttcctcggttatgaaatcacttctgccacagggagccaggtggccctcctcttccttggaggagaatgtggcttctctgaagctctcgaaggtcctggcctggaagtgcaaaaccgaagactgtgggcctgttagtgatccagaggccaagtgaggggattcctggagaaagatctagtgctttgcagcccatgcgtgcactcccacaggactcagcccctggggggagggcaaagcgcccactcggagctggagcagtctccggatggacggacggacggatggttgctgcacacttagctgaagaagaaccctgactgagaatgttgtagcactgacagcttctagcttttgaggcgttgaggacgacttggtgtctgtggtaggttccaggttgcacccaacccctggtttcttgtcttctggtgatggtaatgatcgtgtgtgcttacccatgcccgtcttatgtggacccagtagacccagacctgacggtagagctgtggctcacagcagcactgagtggcctttgggtaccatgtggcaggcacactgtcagatgagcacaaggagacgtgaagagccaaacctctcccatgggtctccccctcccctaccagcatgtcccaaactgctactgtccctgcaagcacacacatctctcttgaaatgactaaccagagcacagttccctatccccaccgtcccctctgaaaacttggttccttcctgagggccttggaaatggcacatgggtaacaagtggggagggggttgggggtggggggagggttgttccaggctcacttgcaaatttatcgtaagaccaaatctaagaattcctgtcagcctatctctgccacatggagagccccgctctcctcgggggaaacatgagagagaaccatgactcttcttcctggtggtcagcagcatatggccacctgtggccaaggtcatgctgaagcccctcggtcagaaggacgtccagcaggggactggggtcctgagcgcac

SEQ ID NO: 26590 - DNA, 1178 bp, Mus musculus
acacccaccgtgcccctgcaagggcaggctgagagacccacacccaccgtgcccctgcaggacaggctgagagaccccacaccccaccgtgcccatgcgtttcacagagctttggcctaactttccagaccgagaaacagcctttctgcttccattttcagacttcaaagatcactctggaaataaagtttcgttgctttttttttttttttcccagtgagattccaaaggttttacacacatatgagggcagagtttgcctggaggctgcctcccatgaagccaatgccagcccatgctcaggctgtgccaggcgcccactagcgtggcggtcctcagcacctcttgctaattttcgggtgctaattttcattcagctaggaattaatgcagcaagagggcctttttttcttttttttcctggaaggaaccgttcctgtcttggcactgttcacagctattcggccatcccggtgaatctatctaaagagtgggtgccacagtggcccagagaacagaagggtttctagtcttgaccacaggagacatccactaagagtaagggcaagggctggagagatggctcgggagttaccaatgcttgctgatcttgggagttctggggttcagttcctaacacccggtcagatgactcagaacccaccagtcactccagtgcaagagtaagggaaaccttggggtggggtatgggccttgtttcaaccccacacagcatcctgaatcccaaatactgcttgtagttgactacaaagtgtaaaaggtcatctcaaacagcaagtattttgtaggatatgtctctaaaatgtccccagattgccatattaaaaaaaaaaaaaaaaaaaaacctctgtagtccacatgtccctcacaaaactcagcaatgcaggaacaagtgagacattggtgaacttgagaatgaatgattcagtaagtaaaagatgacgtcatttatcaagttatttaaataaattttcgctgaaatgaattcctcgagaggtgacatcattgttaataattttaacggtaagatttctttacataaaaacgaattgactttttttaacaagctgacagtatacttggctggggcttttactaacttagcccccccaccctccacttcctgtctagagtgttcaaagtgtaggctgggtgga

SEQ ID NO: 26591 - DNA, 1141 bp, Mus musculus
tgccccctgtgcttcccttccttcttagttagtgccggtgatgatcctaagcctctgtgctatttactagagggaaagaaaggagggagggaaggaggggagaaggagagcgagagagagagggagaacaagcctttggtccagcctgtgtttggatggaattatttgtcacatgtcacagagaatgagactcttcacactcagatttgtcttagcatcatctctgggatggtgaatgatgccaaactttcctccaaggtgagatcctttgttggcgagtgctttcttttacagcatgagcaatctcttgattcactggcaaggcgacatccataatcttgaatgagggagtggagcttacctcgctggccctgtgcatcactctggtgacacatagaggcatcctgaattgctcactcggtagaggcagtgaacacactgggcttttacatgccttgccctgtgtattgacttcagatacatccagtgccagcagaactctgtccttagagaagatctttgtcttgaacgttgcctggtccccaactcttgctatttctgccaacggtcctgtcacctctgtagactcagggcaggtggcttctgtggccactgagcttcctggttacatacgtttcctggacagcttgggcattgtgcttgactgcccaggtctaaggaaggagttctacctttagctaacgggtcttgttcagggttattcaggactgcaaagatagttcagagtttatgtgaggacctgagaccaatccccagcacccacagacaaaactgggagcgggggctctcattaataatcccggtgctggggagacaaagacagaggactctatggtgctcggtggccagaacctagcttagtggagagctccaggccaggaagagactgtatcaaaaaactgaggatagccttcctgtgtgatgacacctgaggctgacctctgacctccacacacatgtacacacacacacagagtagttgttttcacagccaaagttcaggattcatttaggataacaaaacaaaggcatctcatttcccagtgtgccgagcacccagccaggaccaggcatacaggaggtgctcaatatttatggtcttgttccagagaagaactgg

SEQ ID NO: 26592 - DNA, 1182 bp, Mus musculus
gagaccagaggctttcctatcacttggcctggcagaaagtttccaggtacccttcttgcttctgacttccagatgctctatctggggccaggcacactgagtgtcagtagaaaagtgcctttgtatttattctcatttttaattaatcttaaaattcttgcttggtcctttgcccctctcacagccagagctgtgaatcattgatgtgagactcagaagaggagaacaggacagtgtattccatttccccttaccaatttcctgcttgtttccactgagggaccaatgtacagaccatcacagttcagcagtagagcaggctgtccttagtggcccgttcagcagcctggatctgttgtgagctctgttgcatgaggggtcacgtgccctgtaacttttgtgcttcccactgagtaaccgtgggtcttctgcaagtaattgtatccatttctaaaagatgaaaaccgtttctgaatttaggtgtcaatttctatattaattacactgctctgggttgcgctgtgtgaactcactagctgattgccatggtaccccaatctgtgatatcaggatgtgtgtgatgtgcatattttaatttgagaaatagtttaacatttctagatattcatttaaatgtggttatgcaggttaaacataacgtatgattgctgcttctttcattgcttccaattaaaccttgcttgttagtttaacctctaggtaatcccatcaaacaattgatgtcaaggaaacactgcccacagtagctgcagatgagtggccattaattttaattgccttgatattaaagattaagaagtattgggactggcagaatggaaacgatctgatgtcaagcaaacccacttgctaaagcttccccaggctgctggtgatattaaaattttactgtgagaattaaataaacctttattagtgatgactgttgtttgattggtccaggggtgtgcataaacagaggattcttacatatccagagatgaggccttccatggtagagattcctcaattatgaaactgttaataaagctgtaatctgattttctaggctaggtttcattaatgtattatagcttctctgattgtcaaggtaatattaactacaaagtactgaatccaacagagaattgttgagaaggagagaattctaagacagggcct

SEQ ID NO: 26593 - DNA, 1236 bp, Mus musculus
tcccatttgcataaaccagtaaagatcctgggctacatgaatatatatttactactggccagagtaaccaagtcttgactaaagatatagtattctgggctagagatatgaccccatgtttaaggacacttctcccagaggacctgagttcaattttcaacactcctactgagtgtctcacaagcacctgtaactccagcttgagttgatccaacaccctcttcggtcctcttggatacctgcacacacgtggcatacacttatatagatggacacatacacataaataatataaaaagaatggtaaccttaaataaaagtgcattctaaataaaatttatgcataaattcattagtcattcttaaaataattaagatgttaatgtaacatttctactgtcattcactttcatacagtaattgttttttgttttttaaagaaatattcaacccactacaaaatacataatctcacagatgcagcctttaaacacagggtgtttatgtgtagacataagaactgatctgaatgtcagatcaactataaataagtgatgggacagacagagggtcctgttaagacgtttcttctgtggcactgtggtccctcatccagaaaaagcagaaaaggctcttggggaggtgtcattatatcttaggggtcattctctcagttggggagatctgttcttaccaacaaggacattgtctcaccaccattctgcagtttcttcagaatgatcacacctgagaagacagcaaatagtccccagaaattcttacagtctcctttgccataaaattctatatgagtttctggaaagttggtgttacaatttaaattagttttagaaagtaaagtaaacaagtttaagggccttttgtactttttaagatccatttcagaatcattgggctacttaaagatcatagttcatagttacaatatccaaagagtccacaccacattctgaacttgacaagaagcttgtaacacatctggttcagcctgttttacaggtagagaagttcttcagaaggctgaccttattcaaggccatgtgccaaaagctctatgtgtggtcatcagataggagctgggttgtaggccctgcttggccctgtgctctagatggccaggattcaagccatagtgggtgattctatgactatctgtcatatggttattttatattgaatgttgaagttgttgcaagtatataatttttagtgaat

SEQ ID NO: 26594 - DNA, 1132 bp, Mus musculus
aatgtatatagaagcttttagctgagtttgttggctgggctcagcacgtgcggggctcagttctcatactgcttgtgttacagcccctttgcatgcttcaaagttactgagggtagctgggctgcagcttggtatgagagcagatgcttagcccatttaggacctcaagttcagtcaccagcaccaaaggacctgaagcaggaggattgagagtgccaggccagcttaagacacataggcacaccttgtctctgactgaataaatgaatgaatgaaacaggaaacaaaaattcccaaatcaaaacaatacacaatgacaaaacaaatcagatgtgtgcactacctaactaataaaaatgtattgaagactacaaaagttatttgtctatacctaaaatatagacaggaagttgtgtttattaaatcattaaaaacagtagatctgttagcataaatgcttttgtaaaaaacaaaaacaaaaacctagattttctttaaaatgttcattggaagagtagctctctgtgttacgccccagctctgaggcataacaccaccaccccaccaccacccccgcatgctaggctcacgggtgtgtgcatccatgcctggtgtgtgcgtgctgagctgccctgctgtgcccagggcctcgcacatgctaggcagacgatctgccacctgagctgcggcccagccctgttgtgcgctcttccacgttcttgtctggttaataggatatcttagatcttcatatctgtttctgtactcggtttgttgcactacattgtttgggttgtagtgtaggaagacaatttgtcctaacacagatactttgttgaaacagaggagagagttgctgtaccctttcagataattgttggtattaattttcatttatttcaaaattcaagtggtaagtttcctaaaggttaattgcaatgtgggaacagagctctttattatactgtgcacttgtaagagaatgagtgtaaaggcaaaagatgttttactgttactatgaaaacagcacaggaccgtaggaccctgaagggagcttggaggtagatgtacccacccctggcccaggctttacaggagactgaagttgctttaacttgcactagactaggcc

SEQ ID NO: 26595 - DNA, 1854 bp, Mus musculus
attatcttgctcaaaaacaaagaaaactgaacaggcgaacaagcttcagcttccagaaggagaagaaatcagggcagcagtgacactggcctctagtctggtgccacagcccaggtggcctgcaaggccaggtggaccggagtccaccagcatcctgtagtgccgagacccgcaggcacaggctgctgggctctaggggaaggtttagaggtaggggtgcgattggactgaaacttggcaatggttctaagtagcaatgcccaggagccaggccacctcctggaggggctgagtgctgctcagccgtgtgtcctgcctggcagtcccagcaagactgtacatagccatgccagacatctccttgcaacttgatcaaatttcttaaagcaaacaaagaacaaaagtgtacatttctctttctttccttttaataaacaggtatactctttatcgtggttggtatgatggaccattctttggggtagaggattgactatattatcttccttaaaatctgttcccatattgaacaggcagattacaaaagctgtggttggagctctcagaagcaatgtttagggcttagccagtagtttaactgtgccatttgtttaaataagtgatttgctttgagaatagcatcttactaaagttaggaattgaggacctagcatgtgcccagcgtaagtgcatgcgtgggtgcgtgcgtgcgtgcgtgcgtgcgtgcgtagccttctaaggccttctcaacatgtcagcgcctgtgatctgagagacaggtgctggtaatatagtgtgacagtgtctccaagtggtgctgagttcccagccagggtcttctctcatctcctcatagcaagtatgatatggtcagcctgcctctctgacctatctccaatcctcttaccggtgcctgctgtggagccagacgctgctgctgctgctgctgctgctgctgctgctgctgctgctgctgctgctgctgctgctgctgctgctgctgctgctatactgaatcagggagaaggagagcaagccctgggcagaaaaggcaaggtacccagcaccctgacaccacaccacacctctgtctacaccagatgcctctgcagacctcaccatggtcccgcctgtggcagcatccttgggccagggccacagccgatatcttatacgacctgtgtttaggacattttttaaatcattgtgtctaagcatctcagagtcaagtgtgcttctttgcaaaggggtcgactgaatgaatgcctctctcattctgatctgttcagccaacaggagcacccttttctaatgtcttccattcctatctccccccaaaagaaatattatttgtagcttgctctgtatttgaatttttagcaattttatatttagatatctttgaaattgtaaatgactaatttggtcattaaatcttgtcacatattcaatattaaaatactaaaataaaagtcataaataccctcttttgtatattgctttgaattcctaaatccttgcacacacggtgctgagatggtgatgtcacagcaagtccccgggggtgacaccctggcatttgataatgcagcacacactgctgatatggtgatgtcatagcagatccctggggtgacaccctggcacttgaaaatgcccagccatgctaagctgtacacaagccacgtctagtcgtcctttactcccgggacgctgggatctctggctctgctctccacagttgctggcacatggctctcagctggttaggttctcaggggtttgagttgcctggtgtcacagtccacggctgtgataggtgggcggcggtggccctcactccttgggcagtgg

SEQ ID NO: 26596 - DNA, 1218 bp, Mus musculus
tctaggaacatgtagcagcttctttgaaagctgaacattgttttgtctaatgctctacagcttccagacgtttccacatggctcttcctaagcagattaacaagctacacgcaggtcctcgttcctttcggcctttctgagttgcatattttatttcctgaccccaagtagagagtagtactgcaaaagggaccatgtttttcaggtgttttaaatttttaaaaaccagaacagaaatcttttaggaaacgtctagatcttggttcatgaattccctgttcgtccttctcatttttagaaagaacagtgtgccccttccaagttgctgtgtgagcgttcggtcgtgaggcacctgcacggagggtctcaggagatgcgcaatacgggctccctagatacactctcctaaggaagagctaagaaggaaatgtaaatctaatatatatttatatttgatgtactatgggcatcttcagactctaataaacaacaaggacagttgctgagagtaggctgtgacattccctcttgtgaaatggtttccttgacaaaatttaagctgagcttaaaagcaaaagcagaaatatttattagtctggagtagagtttatcgctctgcatgtgtggagtttgatggggaagtcatgaaggcgtgtaccaccatggacatgtgttgagcctgcgcattggggcagactccaccatgtggacaagcagtacgtggcatggcaggtgtgctcatgcgtccttcctttgcacctgcgcactgagtggaagccaggaagggctccttaccgagcctcagctatcatctgtctctgatgatggttcacattgaatgcacagaccaggaattcagtgaatgtcattttttaaaactaatttgtatcgtctgctctactgatccaggtcttactagtgttaaactattttgatcagccacactattcttatggaaaaaaatctattttggcaggttcctgtgcctttattgccctcttctgaaaaaaaaaaaaaaaaaagtgtctctgtagtttggtttgcgttgtacatcagtaattaatcaggaatgggctttggtgcctgagaagctggccaaggaggcacaccaaagcttcaagcacaagtcttgtacatacgccatcaccgaggggtttcaccttgtatgtttcctaaacctgtctagcttttttgacaaatgctgcaatcccatacttc

SEQ ID NO: 26597 - DNA, 1196 bp, Mus musculus
attccttactctccagtgtacacagcttgcacagcagaggctgccacccttcacctgtccaatgcacagaaattcctgtggtccaatttttatatgtttttctaagtcatctaaggatactttgatttctttttaaaataaattgtatatgtatttgtgtctctgccatttgtgtttggttgcccacagagactagaaaggggtggtagagaccctagagctggaattcagacagttgtgagctccctggcatgggtgctggtatgagctcaggtcctctggaaaagcagctcatgctcttaattaagctctgagccctctctccagttcccgggacgttatttctggctgtttattttataactagagcggcagtactgcttggttctaatggtttgtggtgcagaagaattgacttcccaattacggagaggttatgaatcctaacagaattcttgtttttttgtttgtttttagacaatgaaattgtatgcttcttaaaagttcaaatagctgaagcaattaatttacaagataagagcttaatggctcaacttcaagaaacaatgcgttgtgtgtgccgctttgacaataggacttgtaggaagttgctggcatccattgctgaagactacaggtactattcccgacctgcctggtttgtaagctgactgtagaacaacaatgttttgtttgtttgttttggttgggttttattgaggtaatgaatctagttataaagcacatggtggtgttttcttggatagagatttttaaaaacacagtttagaattgttaactgacagttcttgttagttaagaagtgtagtttacttcaacttttcatcaagggagataaagaatgggttgggaaatggctcaatgagtaaaacacaagcatgaggacccaagtttgcttgtccagcaccaggcaaaagcgggcatggtggggtgtgtctgtgactctgtgactccatccgggagaagcagatgcagaggatactgggggcttgctgatgagccaaaaccgctggctccaagttccatgagagagcctgtcgaaaaagaaaaagggagacggggctgctggggagaggtcactgggtaacacatgtcatggaagctggacagtctcaggtagaaccctagaattcaccaaacgaaggagagagctgagtttgcaaaaattgttctgt

SEQ ID NO: 26598 - DNA, 1172 bp, Mus musculus
ctacacagagaaccctgtttcaaaaagggatggagggagggaggaaggaaggaaggaaataaataatgataacaacaacatagcaagtgtttctgagtctgtgaagtaattgtttgaaagtgagttttgtgtgtatgataggtcagtatctttcaccatatcatcccaggatgagagtagcagcccagctcagactacacatttgaatttctagtcaacattctttcatttatccctggatggccaggccagtgagatagcttagtgaataaaggtgcttacagccaggcctgatgacttgagttcaaccttcaggagagaactacacacatatggccgtaataaatgtaaatttttccctgggaataacttctccattttaagagatatctgaaagtttgtttgattgcttattataataatctttttgacataaaaattgtttttcttttaattgtatgttcacgtgggtatgtgcactcgtaatgcaggtacccatgaactcccgaagaggttattgaatctcctggggctggagtctggcattacaggcagttgtgagccacctaatgtgggtgctgggaactgaaccccgtcctctgaggaccaacagacactcattactgttgagctatctctcctccactaatttgttatttttattttctgttttgagtgtttgtgttcatgtatatcatatatgtgcatatcatgtgagtgcctgcagaggccagaagagaacatcagatcccctgggactggagttacagtcatttgtgagctgcaatgtgggtcctttgaactgaacttggtcttctataagagcaccaagtactcttaaccactgagccatctctccagtctcttaaaagagaattaattttatggcacatacatgtattattatatagtgagatccccatctcaaaaagttagtagatggggctggtgagatggctcagtggttaagagcgccgactgctcttctgaaggtcccgagttcaaatcccagcaaccacatggtggctcacaaccatccgtaacgaaatctgatgccctcttctggagtgtcttcagacagctacagtgtacttatgtataataataaataaatcttaaaaaaaatgtaggtaaagtattaagtaaagaaatgattttcctgtcttcctttt

SEQ ID NO: 26599 - DNA, 1166 bp, Mus musculus
cccactccagtccccgggggcctggcgtgaggggaggacctgaacggttaccggcggaaacggtctcggggtgagaggtcacccgaaggacaggcagctgctgaaccaataggaccagcgctcagggcggatgctgcctctcattggtggccgttaagaatgaccagtagccaatgagtcagcccggggggcgtagcaatgacgtgagttgcggaggaggccgcttcgaatcggcagcagccagcttggtggcatggaccaatcagcggcctccaacgagtagcgacttcaccaatcggaggcctccacgacggggctgtggggagggtatataaggcgagtcggcgacggcgcgctcgatactggccgagacaacactgacctggacacttgggcttctgcgtgtgtgtgaggtaagcgccgcggcctgctgctaggcctgctccgagtctgcttcgtgtctcctcctgaccccgaggcccctgtcgccctcagaccagaaccgtcgtcgcgtttcggggccacagcctgttgctggactcctaagactcctgcctgactgctgagcgactggtcctcagcgccggcatgatgaagttcactgtggtggcggcggcgttgctgctgctgggcgcggtgcgggccgaggaggaggacaagaaggaggatgtgggcacggtggtcggcatcgacttggggaccacctattcctggtaagtggtatccgtcgaaggaggagggggtggggaggagtggggcgtggcctccggggccagcgtgagaaagtgaggtgctgattccttttctgtggggtttccccgtcagcgtcggtgtgttcaagaacggccgcgtggagatcatagccaacgatcagggcaaccgcatcacgccgtcgtatgtggccttcactcctgaaggggagcgtctgattggcgatgcggccaagaaccaactcacgtccaaccccgagaacacggtcttcgatgccaagcgcctcatcggacgcacttggaatgacccttcggtgcagcaggacatcaagttcttgccattcaaggtcggacccgttttttttttctcatgctaatggggcggctggggtgataggagtatttaggggttgccacttggccaaaaacactgttcaaaggacttaaaagaatgtg

SEQ ID NO: 26600 - DNA, 1277 bp, Mus musculus
gccgagccatctcaccagccccagaaacctttcaatcttaacttttagtgatttagtgttttgtgggaggtcaaggtatatgctagtcagcctttatgagttaccactgcttaattctaatgacaaaagcgtatgatatagcagtaaactgacttagaaactgttgtggcttgactagttgataagagtgacagaagtgagaacaccatgtacttcaatcatctttaagtatgattgcacggttgtccttctaggttacccatgcagttgttactgtaccagcttacttcaatgatgcccagcgacaagcaaccaaagatgctggcactattgctggactgaatgtcatgaggatcatcaatgagccgtaagtatgggactcagagctctaccatattcccaagtgggggggaaatatgaacccctgaccaagctttcttccctcctcttcatcctcacagtacagcagctgctattgcatatggcctggataagagagagggagagaagaacatccttgtgtttgacctgggtggcggcaccttcgatgtgtctcttctcaccattgacaatggtgtctttgaagtggtggccactaatggagatactcacctgggtggggaagactttgatcagcgggtcatggaacacttcatcaagttgtacaaaaagaaaactggtaaagatgttaggaaagacaacagagctgtgcagaaactccggcgtgaggtagaaaaggctaagagagccttgtcttctcagcatcaagcaaggattgaaattgagtccttcttcgaaggagaagacttctcagagacccttactcgggccaaatttgaagagctgaacatggtatgctccttgacagtgctaatggaatccgcttagactgtagaatttgggataactaaataaggtctgggtggtcagcaccatagtaaccatgccttgcttttcttttttgctaggacctgttccgctctaccatgaagcctgtccagaaagtgttggaagactctgatctgaagaaatctgatattgatgaaattgttctggttggtggatctactcgaattccaaagattcagcaactggtgaaagagttcttcaatggcaaggagccatcccgtggcataaaccccgatgaggctgtagcctatggtgccgctgtccaggctggtgtcctctctggtgatcaggatacaggtaggttgttatcactgtgtctttatctgtttaagtagctcgatgggaggactgttgctttaggaaactgt

SEQ ID NO: 26601 - DNA, 1904 bp, Mus musculus
tgcaggtgatctggtactgcttgatgtttgtccccttacacttggtattgaaactgtgggaggagtcatgacaaaactgattccaaggaacactgtggtacccaccaagaagtctcagatcttctccacggcttccgataatcagccaactgtaacaatcaaggtctatgaaggtaattaaacgttcacaaatattgtatgttttgaaaggatgtgatctgggtttcacaatattattaaacaatattattaaataagttaaactattatcctcccagggaaagaagtatgttttgtaactcaaatgaagaggttcttagttgaaccagtgttgaatttttttcatgttaactagcttttgtaatacaaggtcagaggggcttacaatgctttgaagagttgaaattaagagcagtagcacccagtgagttaatgtagggatcccagtgccctggctttgtcaatagttttttctgtgttcttactctaggtgaacgacccctaacaaaagacaatcatcttctgggtacatttgatctgactggaattcctcctgctccccgtggagttccccagattgaagtcacttttgagatagatgttaatggtattctccgagtgacagctgaagacaaaggtacaggaaacaaaaacaaaatcacaattaccaatgaccaaaaccgcctgacacctgaagaaattgaaaggatggttaatgatgctgagaagtttgctgaggaagacaaaaagctcaaagagcgcattgacaccaggaatgaattggaaagctatgcttattctctcaagaaccagattggagataaagaaaagctgggaggtaaactttcttctgaagataaagaaaccatggaaaaagctgtagaggaaaagattgaatggctggaaagccaccaggatgcggacattgaagactttaaagccaaaaagaaggaactagaagaaattgttcagccaattatcagcaaactctatggaagtggaggccctcccccaactggtgaagaggatacatcagaaaaagatgagttgtaggtgcactgatctgctagagctgtaatattgtaaatactggactcaggaactttcgttgggagaaaattgagagaacttaagtctcgaatgtaattggaatcttcacctcagagtggagttgaaaatgctatagcccaagtggctgtttactgcttttcattagcagttgctcacatgtcttggggtcagggagaggaggaattggctattttaaaaattgagaaaaaggtgggtcagggtgtgtgttcaccttggatatggtctatttaacaattgggtcatgcacatgtggtgtaggaacttttttctaccataagtgacaccaataaatgtttgttatttacactggtctaatttttgtgaaaagtttgtaattatatccatcttttattttagataactaaaatttaagactggattctcaggtgtgtctttcttcggtgggcagggaagtggggcttgtgatgctgtggggtggtaccacttcttggagatttatttagctttataacaatgtagagatgtttgctgtttactcccctaggcgagggttatttcaggatgcctaagtccaattcttttgaacatggttgaaatcatacttcccctttgtaaaattgctttctgggcttttagttttttcaagataaggtctttagctttgtctgtcctcgaactcaacactgtagaccaggctggccttgaactcagatccacctgtctctcgatcccaggtactgggattaaagtgtataccaccatggccctttctgacttttgttacaagtagtgctgtggtactgcctggaatctcttaataaattgatcatgttccaggctgtgtttagtcc

SEQ ID NO: 26602 - DNA, 1222 bp, Mus musculus
tgggattcgagcttaacccagcccctacccaactcccttaccatgttttgtccttgcttcctgcagtatactttgttatttgtcctgtcttcctcctacgactagacatagacctcgcgcagttagggatttgttcagctgtgtcagaatcgtgtttgggaggtgccaggtgtcaatgggctgtttgaatatcgtcacatgtggatttggagccttagccctttctctcctgtgaaatattaccctaacttggttaaaaaaaaaaagtagatgaggaaaataaacattgtgcaaatctagaggtccaccttgctcaggatcataaggtgtaagcgcagacggtggtacagcacatgttcggcccttttccacagtcggggccattctttcccaggtacttggagggcagagacggaagtagagccgcttccgcccgacgctgggcgccggaatggcgcgcggagatgacgcagcagcaccggaagccgctcccctgtgaggctgcggacccagagcagcggccgtaggtccaggtctgtatttgcgattggccgggccgggctggacaggaatccccagcgcccgcggcgttactgacccgccgccccggcctgttttctccctttccccgcaggcgccatggctgtggagcggacccggccgctgcgacgctctggcggcccgagcgcgcctagtcggtgtgagcccggcgcgaggtcccgggccccggggcgctcgctcaggtcagtgccgcgcggaacacggctccaggagcaggggaccaagggagtcacgaacgggctgagagactcggagttaattttagacaggaaaattagagctaagagttcctgccttctggtgcttcggtttttcctagccgcgaaacgagttaacattgatgccccaaggctagcactttaattaattaaagatgatgaaatgtggacaggtggtttataaaatgcagaacgtagtagtatgtgtaggaaggcaccatgcttgtgtgtatgccttgaaaacaggtgtgtatttgagatgatgcttctttttaaaaggggagaaatgacagtattagtactacattataacagtaactggcatttattgtaggcttatagtgtgccagatactgtacagaacgctgtttaaccctaacaatcttgtaggtaaaacagtaccaggcgacagtttacaagtgaggaaatttggcttgaaacac

SEQ ID NO: 26603 - DNA, 1550 bp, Mus musculus
ttttttggtttttgtttttttgttagtttgaaaagttaataaaaacaaaagacactaagagtcccttaatgaggtggaatctgttgtactgggacaactgcactgtggactgatgttatgaaaacatgggcactctacagcattagatggttttctttaaaaattcagtgagagccaggtgtggtggtgcatgcttttaatcccagcacttgggaggcaggagcagtcaaatatctgcattcaaggccagcctggtctacagtgattctgggacagccagaagtacacagagaaaccatctctcaaaaaatcaacagttgagtgagaaataaatcagaataccaatataccagtatgctgccgtgcaccgagtccagatctgtgcattctgtgcggtgagatgaggaggattcaccccgcccatttcactccaggtcgggttgattagtcttcctcacacactcgagtagctgagggtaatgccccttgaggtggtctgctgaagtttacagtgattgcacctggtgcaatcactccctgtcattggtatccattggtgtgcctatgttctctctcttcctccctccttccctgtctctctctcctccgtttccttctctccctacctggctatagaccaagctgacctgtaacacacagatagttctctgcctctcccctcaagctccgttgacaccttggggaatttcgttcttggaaccacacagatgggtctttgaatctccttagctgtccgctgcaggcagcacagtgcttatctgtctcctcctgctgcctacagttactgataattcctgtggaaacatggagcccccaacttgtgtttcttatccttctcctaacgtctatttttgtaaatcttttaggatttgtgaagttttttggaaacctggccgtcatggatagtcctcagcagatctgtgagcgctaccctgtttttctggagaaggtgtttgaaatggcggatagtcaagaccccaccatgattggtgtcgctgtcgacacagttggaatcctgggatccagtgttgaaggaaaacaagttttacagaagacaggttggtgtgacttgacttggcttttgtaagacatattttgggccaggatttcatgttcaggttcatctgctggtgggataactgttctagaaactacttttgcaggcgacagtcttcttatccctaacatgaacttgcctcccagagtcttgtgattagtactgaaagctgtggcttttgctccttactatatgtaggctttcatccaacaagaaccatgtggtttgctgctaacattttccttaattttatggcattgctcatgttgtgttcgagtttctacactgacggaagctgtatgaatttcatttacataacttctctggtcacgttcctcatttatcaaaatagcacagcagcagcttcttcagggttttgagtatttcagaagcacagagagagtcagaaggaacactttgtgtcgagacccttccgagcctgtgcaggttggaacctttgactgcactcctc

SEQ ID NO: 26604 - DNA, 1151 bp, Mus musculus
cactggcggcggcatgttcctctggaggctgcctgcagccctggcctgcgggccctctatctttaaagtctgcatcaccttcccatccctgcagatgcttgtttccttctcacaaggcccctgtggttattctatgtgcacccaggtagttgagggcactctccccgcctcaggagccttcgtgtctacagggtctttgactcccatgattgttcctgccaggtccatgcgtgatgtataaagcatttgaggttgagaggaagaaaatgccaccaggctatgaagcagggcataggagaacagctttgccatatgatttatgttcaggtagcttctttgccttgagccttgatatattgcctatcaataaatcaatgggactgtcaggatgccactggcttgccaagattatagatgcaaactgtccactttaggagtgtgaggatggggagttcacactggtcatcacacttcagaggacactgatacagagacaaggaagaaatgcaggagatctacacacacagggaccctgggaacagaagactgactggccatccttaaatgaagcctgctgcagcccagtacaaataaaaaagaagtcggtgctgtggccagaacccaatatatgagtgtttgtgggggtcacttgatagtgccacatatgattcatagacataaccccatgtggcaggagcccactgtatatatacacactggaagttcgactcgactgcttaaacccctgtcatttggggctcaagaaaaagccatggcattatcgtgagccacaaatcaatctgcttgactgaacctcagaggggagaaagtgagagaaacagtttcctgtttgggggtggggtgggaggtgtgtgtgtgtgggtctcagtaaactgaatcaaatgttattttctagctcctggtgtgtgtgtgtgtgtgtgtgtgtgtgtgtgtgtgtgtgtgtgtgtgtgctgtatgtgtgcacccaggtgcacatggggagcagaagaggacatcagatacctgtcgagacagggtctttcactgaacctagagctaggctggtagaccaactccagcgatcctgtctccaccttccacagtgctggtgttataggtatgcatggctaagcccaggtgctggggatttg

SEQ ID NO: 26605 - DNA, 1199 bp, Mus musculus
cctacctgagaaaccttttaaaagtataattaaatgctatttctttcaaattaaaaagactttagttatttactataaaactcccaacctaaaatttttgtaaattttaaaaactataagtaaaatctcttagagtccttatacataaatataatgcctatttatactttgaaattatctttggatgttccctgtaaatatgctgtcagtgtaaccagtgttctgaaaaccttttttaaaaaagacatattttaatgctatgcataaaacactgaaatttctatattgtgcccttgaaaaatggcttatcctccctgatcggctctgtgttctcatctcatctcggatcaccctaaggttaaacaagaaccatctatatgaaagttctaaagggcctaactcagagcagatgaaattgtcacactttattttcaatactggtttttaaaatgttgctaagagttattattttcaatagtgttaaaattttgggttgtattgatgatttttttccctgaaattcagtcccacatgaaagcccagaagaggggcaaagaacagcagcttgacattatgaacagacagtacacacagctcgaaagccgcctggacgagatactttgtagaattgccaaagagactgaagagatcaaggaccttgaacagcagcttacagatggtgagaactcaagtgtgatttagggtaaatagcttcagggcacacagaagatgctcacacggacaatccaagacttggctggatacagttcagctctttttactagtgttcgatggggaattttggctgaacatacccaaaaacatttagtgaaatttaaagtattttgtattattatggtttgttacgttgatgaccagtgaatcaggcttcagtagggaagaaatcaagctgatcaggaaaagcttggtcagtgattgccttctgtggcatacagtcctttcaggagcccgttgacgttaggaaactcattgtgagttatagaaggtgtatagaaagaaggcaaatttaaatagcattttcagagtagaggaagagggaagtaaatcaggtgtgtgacggagcctgagctccaggtaaggaaaggttccatccgttgatcgtcaccttcagtttgtctctgccttgataaatagttgttgagagaggctttttaaagttttcataaaagtatcctgta

SEQ ID NO: 26606 - DNA, 1194 bp, Mus musculus
gagaaggctgtctcagggtactagggagtcagtctacagatgagacctctaaatgccataggcccttaaaaatgggtgtgcccttgtaggtgctgcactggatgtgcaggagagtgaccctgaggtcgttagggacgttcaggggagtagcattcatcacttaggatatataaacgtttttctttatactgtggggatgttttagcaattctttgtatttgaaggaggcatcatatgagtttcattctgtagccaagatatgtttatgcatttgttagtaatgaattcatttgctggcagataacacatcctttccattttccctctacacaggatgacaacagcctgttaaagaagcagctgaaagagtttcagaatcaccttaaccatgtggttgatggtctgattcacccagaggaagtagcagctcgtgtagacgagctaaggaaaaggttgaaactaggagctggggaaatgaggtaaggggaaacaggaccccgagttagcattaactttccctcttcagagctgtggctgggaccagccatgagcctgtcctgctcgggctctgtaatactgactatgtttctgaaaggctgtgatgcaagattgcttaattctaataatggtgttaaagtatctaagagtctcttgaaagtacatggtgtgtgatcagaaagaagggccacattatagactttgggcagagaaccagtacaaagcaggatagtgtcaagcttatggacactcatccttagcctgtgtctgcagaatggcccagtggttcactacaatggtttccactgataccagtcccttcacacagtgctccctcctcttaatgttagcatgagcatgtttgcgtcaaacttataccttcttgttttttttccatagaatccatagtccttcagatgtcttagggaaaagtcttgctgacctacagaaacagttcagtgaaatccttgcacgatcccagtgggaaaaagaggaagcccaagttagagagaggaagctccatgaagaaatggctctccagcaagagaaactggcgaatggtcaagaggagttcaggcaggcctgcgaaagagcacttgaagccagagtaagaaagggcagagactgcgcggagggaggccttcagcaaatgtttacagcgtgtaaattagcacacccgttattattttccctcac

SEQ ID NO: 26607 - DNA, 1201 bp, Mus musculus
atgtgaggaagacccagacctggccaccccaggaggaggcaggagagccaaagcaggaaggaaggcaacagccctgggaaggatggccaaggacgcagggaggtagggcgaatgtatctttatggtgaagtttgaccctgagactggccaatgtgtctcttcgtgcccttgaaccgtgcacaggaaagcaggacattacagtgggatgttagagtctctgaaggacaagttatttgggagtagtgacctcagctattgggaaacacagtgtcagcagccgaaggttgaatgcatgagctaagctagagttggatttactttggagtcagtttgctctcccttggcgaaactttcttgagcctgtggagtaggccgcagacttgtgcgagccagtactagagggaaacagcagagtagggaacattccactcactaacaggcagcctgcactaaggagcacagggctctgcccacagctggcccagggccacggccaaccctactaagtgtgcacactcacattccagaacagcagctttcagaacgggagcagcagctaatggccaagtcaggtgagctgctggccctgcagaaagaggctgacgatatgagggccgacttcagcctcctgaggaaccagttcttaacagaaaggaagaaggcagagaagcaggtggccgggctaaaggaagcactgaagatccagcgcagtcagctggagaaaaacctcctggtgagtgtttgctgccctgggagtgtagggaaatcaatacgtttacccgacttgacacatgcatttttcttatacacagcttcattatgaagaaaataaatcatccatcaacccaggccctaccccagtggttattattggtgtattttgtcataattgattgttgaagcacacagtgagtcttggctgccagcagccatcctgtggacagcacagcacagtagggagctctgccctctgctcagcccactgcaggctctaggcattgggttggtaggcacctttgcagagcctcaggcagcctgtttgtggcaatctgccctttttgttcagcattaatttttatcaagcgttaaaaccaggaagcctggtctaccatgcttttacccatgacctaaggggtggggtggtgatgacatcagtcagagcagtgtgcacagtgtttccaggagtggctgtttccagcgc

SEQ ID NO: 26608 - DNA, 2833 bp, Mus musculus
cagttgactaaaggtttagcaggtcagtgtaaatgccttacattttctagaaagctgtgctttgtaaataaagttgttgattgtctcttaggggagagaatgtagaagatgcttttcttgaggctgccaagaaaatctatcagaacattcaggatggaagcctggatctgaatgctgccgagtctggtgtacaacacaaaccctcagccccgcagggaggacggctaaccagtgaaccccaaccccagagagaaggctgtggctgctagtgacctctttgctctggcccctcatttgacctttcacctctgtctgttggaagcagtactttttactgcctccttgtcttctgtacatcttactgggtttaattaaaaaaagaaaaaagaaaaaacaactcttgtaaaaacagtttaacaatactaaactgctaaacatctagatgtaatcaggttatcaaaggcaagtagagtaataaatctctcctgcatggtaaatctagactttccccctttgattgtccttgtgataggtttgtcaccaatatatgatttaaactgagcactgctgctggacctgatttttaccttcccttttggcaaggctttgtctcgctgtacggtttaaatttgatcttttcagccttcctcccatctttaaactgttgagtatgtctgttgtagccagtaagttcattgctgtgaaatgactttggatggtagagaaaaggggtctgcaactgcttttgtttttgttggataaattccctgttgtaggggtggcatttttcttgatgaggtttgcttctgtcttagccttgcacagggaaaaatacccatttatcttttcttgtgcttaattaatagctttatcttttttttttaatttttacactattttatccttttctctttaacagaaagtaaatatgtataaaatttgaaggaacctaactaacaataccttctgtgtatattattttaatgaagaaaataaattgattactggcattggaacagtataaaataccagtttgtacagtgtgacctatatgtgaccatgttactcttccatttcacacacggaaataagacacaacagcagctcacaagtaatactggctccactccttggtgctggcagtgtttggggacagacataatgctggaaagagctcctggcatcagcggaaacactagcggattctactccatctttgcactgtggcatacctgctgattttcttaactgttcttgtgtaatcaacgcgctcacctgcttttctttttgtaaacattttgtgttataggctgcattcttgccttactgtataggaaaaggaagaaggctgggtttaatattgcacattttaagcttttatacctttatcttggaatggtcaacttctggaccagatagccagaaccacaggtctgctgttaagggattttaaattgtgcgtttttaacactacagtgagataatttagtattatcctttgtgttcatagtatgaggggctatcttatgtcatgttggcataaattattttgtaaaagggaaggtgtttctaaatgtgtatgctgacatcatgtaagttgctactttgcactgggtggtctggccacggaaagaacgccttgcaagagaaacagatctctaggcagcatctgcttcactcagttcttcccttctcttggttggtttctagctgagtttaaagtggctgggaattgagaggtcattggaagtgcacgtaggtaagccccagcacattatataaaatgctctctgctcattgctgtgttaaaatacacattttaaatccctctttaccagacactaatgtaaaagtacatcttctggattataaacatgtggtagttccagagttttgtatagtcaatgttaaataaaagccaaaactggaatgtgcagaaaataggattcggttttcttgtggattcacctttttgtccttgtttaacttaaaggaatcttggagtagactgatctattctgttaaagatgtagagtgatccatttgcttacactgttgcatcacaggggattcgcccagggaccatgacctgctggtgtgtgtatatatttacaaaacaaaacaaatcacccatcgggacataaggtagcaatcacagagtgaagaccttcggcttgtttaggtgcaataccccatttcccaaagtgacagtgggtcctaattgtttttgtgacagaaggatttattcagactgctgtactcttcatttgatgtaacaaaatgctattatctaaatatttgtaaataaagtacctgtatctagattaaattgaacatagttgcattatttttgatctgtaagacttttcagatgaatatttgaactatcagtttttactacagcattgcacttagtgtatggtgaggtctgagtagcagtaaagctaccaattgagctggagtttcatccatgtatgttgcatctttgaggccagcacattgctagctaatagtgttctcccttttctgtatatggggccaaattctatttgtttgtgtaaccagcgtgtaataaatttgggagcttaaagataagcagattgtcatagtgcagcatctgtgagccagtggatctgggcagagtggatttctgttcatttttaacccacaaaagcttgtcattgtgcagatgcctcctctggctttctcactctgcttttgctgtggaggaacccctctggtggtaactagtactccaacacaatgtggagttgatttttggtgttttgttttgtttttgaagtaataacgtgttcaatgaaatgatggctgg

SEQ ID NO: 26609 - DNA, 1169 bp, Mus musculus
acatcacggggcagggcccaagagagggcgccccaaagtcgggtgtctgaggcgcgggtgagtgcccggggtccccggggctccccgagtaattgtctattgtaagttcttgcagatacagcgctaggaaaaggggagtaattcaggtgtagaatggaaaaactgttttgttgctttgtaagtatgtcttgctgcttcggggctcctgggggcggggttcgggggccggggccaaagctctttccttcctgcaggctaacctcaccttggccggatctttccccactactgatttggatcccatctcctttatcatgtctaactactgcccttcttgctggtctttctcagagtcctctgcgtttgctgtttgctgtttgtctgtcccctcccgttcggtttcccctttgaaagcctctggacaggactgttattttattctcttctctctaccctgattgtggtctcctcccctgcccgacccctcccacttgtctgccctttctgttctctactctccactacctgagtttttctccccaatcgcttctgacttctgcctgctttttgttccaaccagaccttcctctgtctgaggtgacctgctgacatccctccttgggcgcaaacctaaccgtctgtcccattggcacctacagagcatgtctggcagcctttcccaccctcaaaccttctcctaacaggttccccctgcagacttcaggctccattccttccccctttcccaagatgtggaaatttggtgggtgggatgctgggggcggggcaggagggaggaggcagacagctcaggaggccacttgggcccactaagccagtccttagtgggctgtgatgatccttccccttccaaggagcaaaaccaaccacgggacctaggatcgggccccttgccctttggtcctgtttccccatttgcagagtaggggtggataatgcgtcctaagccacaaaggttctggaagagagcatgcagagtcactggggactgagagatttgccactgctatctgggagtgtctatccataggggcagagagtgcctttggagtccagggctatccctctatgttgtctcccaaatgggggcccctgaaagacagcctgcctctttgtgccttagctatctccccaaaagggagggagct

SEQ ID NO: 26610 - DNA, 1145 bp, Mus musculus
gccaacagagaggcccacgctgacccttccgaggccgaaggtcactcctgccatagtccttttgaaaatagtaggtgcacttttaaaaaaaccttcttgggcctcccctccctgacttgatgacccctctgtgtgtggcctttaaagcagctaattcctgtcacagaagtgctctttctcacttgtgcctattctcatggatcaggtttttacatcatcttgatttttaaaaataacttggagttctatcaataaatttttatgtccatttgattagcttaagtactgaagtacctttaaattttttaaagaaagcatcatactttgctctgtacatactattaactgttgtatactgtggtatgttttaattactaaccctacctaagtagcataaggaatccctaacacaagagcttgtgattgacctgtgcagacgcccctgctgagccctccgtgcacagggagaatgcttatgtttgattcattttgtggggttttctttctcatataaaaccagtagaggatcacagttccttattgtgacatccttcccttggcctggaaagcttggtggtggcttttgcaacagcttgaggggggggggggattcttgactcagctggaggagcctggaagaatggttccctgtcacagtagtactgttgacacctgccctgagctgttcactgccaggcccacgtggagcccatgacagacactctgtccctaagccttgagcccagcagggttttctagaggtgtatagagcacttccacctggactcaagttgcatttacattttgagtttaaaaagatgtttttttttaatctgtttatagaagtagctcaccttccactgaggaccaggaaaccctgtgtcctggtaaaacaccttggagacaggaaacaatgcccctggttttctaaatttcctgtccagacaccaactggcctttgcttctgtgccttgtgaattagtaatccagtaggctaaaactcagtcacagggaggggaggagaagagcaagcctagaggaaggggtgctggtgggagggtttccacgcattccccccttcagctgtgtacaataaagtgcgtgccctgtgacccgactctgtgagtcttgtttctgtctgcatg

SEQ ID NO: 26611 - DNA, 1192 bp, Mus musculus
ccagcactcgggaggcagaggcaggcagatttctgagttcgaggccagcctggtctacagagtgagttccaggacagccagggctacacagagaaaccctgtctcgaaaaaccacaaaaaaaaaaaaaaaaaaaaaaaggggggccttgcggagcgtgtggtccgctggcctgtttgctactagggcaggttggtgattctccagggcagccatggcagaaccacagccggcgtccagtggcctcactgatgagaccgctttcagctgctgctccgatccagaccccagcaccaaggattttctactgcagcaaacgatgctaagaattaaggatcctaagaagtccctggatttttatacgagggttcttggactgaccctcctgcagaagcttgacttccctgctatgaagttctcgctctacttcttagcttacgaggataagaacgatatccccaaggacaagtccgagaagacagcatggacgttttccagaaaagccacccttgagctcacgcacaactggggcactgaagatgacgagactcagagttaccacaacggcaactcggaccctcgtggatttggtcacattgggattgccgttcctgatgtctacagtgcctgtaagagatttgaagaactaggtgtcaagtttgtgaagaagcctgatgacgggaaaatgaaaggactggcgttcattcaagaccctgacggctactggattgagattctgaatcctaacaaaatagcaacgattatttagtttcgggagaatgtgcctttgaggtatgggggacagcgggaacaaaacggcgtggaaaagaaacagcgtgattcaagatgctgcggcgaccagaagcgttggggactgatgggtctctctgctccagttcaaatcctcctgaaacccttttcattgtcctgattcagtgggtttttaaaaatctcccctctgttttgccaacctaattttcaagtagcaatttatcttatgaccttgacaaagttgtgtgactttacatttaagataataattagaacagctccctttagagatcacagttgctactgcctgtctcttaaagactgctcaagtctgtttctgattcatcatttagaattttgtttcaaatgtttctttttggggtctgttaccttctggggtttcagttcctcagaaataacttt

SEQ ID NO: 26612 - DNA, 1162 bp, Mus musculus
aggccccactaggctattgtttctgtcctgggcataaaggaggcagagagtgccaataggtactttggtggcacatgttcagagtccaggaaaaatggcagggtgaccacttagagggacataggacttggggttggtgattgaactgagttacaaacacagacagctttcttcaggatgactaacagcaggaattgaatggaaagtgtgttcattttgttttgcccaaattgtattcatgctgttagctttgtgtgttgagccctgtggagagggtgtgactgtatcagggaaggagagtacctcagcggactgaggaccagcaccctattatatcagaagacaatctctcatcatcgggtcctacctacaacctgctctgaacctccgagttcctcagcccatcgtgttccagtgtgggggcctgtatggagcaggtgactgaagacaaagccccctgtcacatgacctcatttcccctgctctagtactatgcaagtgtgacagccagccagccagatgtactggacaacataggaactgactttatggcaatgggagccgcagtcactacaacggagctgctgaaggttctgttccccgctctgagagcctgcaggagcccctgtataggtggttctcaacctgtgggtcgcgacccctttgggggaagtgttaaatgaccttttcacaggtgtcccctaagacggttaaaaaacatagatatttccactctgactggtaacagtagcagaattacagttatgaaatagcaagggaaataattctggggttcgtgtcatccataccatgaggagctacattaggtcacatcattagggaagttgagaagcatagctctacttgggtatttaagcaaattattgcaaagggggttgtcgctctgtgtttctgtgtatgcatatatttatattttgcttgtcttccagtttaggtcatctgtttcttcctttaagcagtttatttaaaaggccattgcaccatcttggtgaacagcatgaggggtttcaataaaaaataggatcttacctttgtccacagggctctacctcttacttttcaattgtgaacaaaaaaggtcgcacacccagaggcaacaaaacccacagaattcctgaaccaatgggagatgccaatggaa

SEQ ID NO: 26613 - DNA, 1135 bp, Mus musculus
gagggggaaactgaggctcgtggagtaagtcatcactcaagctcagactgatgaatgggacccaggtgtgtctggccccagggcttgagtgtggcttcctaggactgggagtgtgactgtcgtgtgtcctgccagttcctctatttgtggctccagcgtgcacaccgtcataccttcgtgctactataatccgtggcttggtaattgccagctgggattggtggttttcctgctgtattttcactgtttccccaggcagaagccacctgagggtggaaatcagtgccagcctgtgagcctgcagctcccaggaatgcactcaggctgctgcgctcaggtggttggcagggtgcagggcacattcctgagccatttgtctacctaccctctggccactctgtgccgtgtcactaagtgttgccatttcacatactgaggaaggcagggttcagggtcgttatctctgtcacatagcccttgacttatcaggtactgatagggcggttggccaggtcagggtcttgcccttaggcactttggtcctttggctctgtgtagccattaaagacagggctgtgagtggagactctcttggcctggggctggatgaactgaagtgtttggatacaagatctggattcaaatcctagcacttctgagctatgatgtgacctggttagccacccagccttttagaatctctatcagtaaagcgtgaaacaacaacctggccctgcagcaggtacttagctgatgggatgcactctgaccaaccacatccatccattggatccacagtcccaactgggtttctctttccgactctggattagtactagggcacagaagatacggcatttggggtatcgggaggagagccacctcaccccattcctgaacacttattttctccggccgtggcatcctcagctccagcttgcagctgctccctgtaggccctgagggagcctgggaacatggttttgcctgggggaggcaggtgagataccacaggctgtaatgaacctgccactgttgctgccattgcaaacctgggtgacaggatgtcaccatctttcacagaaggtgccctgtgggagattgtgtgtcagagtagatggtctcaaggactagc

SEQ ID NO: 26614 - DNA, 1304 bp, Mus musculus
gggtcagagacctcaggaaggaaggaggtggggctgagggcctgccactgcctcttcctgccccactcctgtccacacccctgctcccatgcatttcagcaggggtggcctcttgggcagggcctggcctggcctggcctggcctgggtcttgcccttccactgcccagggagccctgttttcctcctcacccacactctcgcccatgcctcgtaaagtgacctctgtctgagcgcctcctagcaatatggggaggtccccaggcctggacaggagagcgcagggccagatgcaatggccccctctggtggggttgttagctctcaggccgagagccttatttacctagtgcaaaaactgtaaaagtgtacagactctccacagatttttatcttaattgcaagtctgcaatattttttttgtaaattttttttttgtaaatgttcttggtgtttgactgtaatggaactatttcacccaagggatgtacatagtcctttagtcctggtgctgcgagggctggccaggacactgctctcacggttgatattagagcctggagaacggtgctgggcaggacaaagagctttgcagtctaggtgtctgtctgtctgtttcctgcccggggcattgattcgttggctttcaagcatgctgtttgggtggaaggttgatgggggcaaatgccccagtggggccagtaaagcatcctcctgcccacagcaacggcttggggcgtctgagctctgcttacagcaagggctggagttgccagaggccctgctctgggaagaccctggccactgacacccaagatctgatggagagagcggccccacccttgccaacacagacacctgacctttttgttcaacttgtgtgttagggtgaaggaaactgccaaacttcctctgagtgaagacctctgactgcccaggagtaggggtggggaccagggccagagctcaacgtgtaccccagcacctgcccgagggacactcctccctcatactcataggtctgggagccagactgtccagggaaccagcccctcttttctatatactcggccacaaggctacccgatcccccactgtgcccagctcccccttttgtaagtatgtgaaaaggaaaaatgcaaaggttggatcggccggagcccttccctccagtcgagacttttaaccctgtaataatgtacagagaagttgttggtgttcgaagactccgtgtggctgtgcaatttctgtacatttgcaattagaaatattaaagatttatttagctattttaagcctgacttg

SEQ ID NO: 26615 - DNA, 1915 bp, Mus musculus
tctctcctttccccagcatttgtcttcttagtaacttaatgggtatgaagtgcataaaaataagactacagacttttctcatgttaaagttctccattttttaaaagtccagttcagtagtgtgttgatgtatggtagtctgacaggctgggttttaacaaacctgctaatgttctctgttacctttctcggttggtcaggaatctgaaagttccctagtggagaaaacagcaattgcaaagaaaaagcatactagatcagaaagatgcaccctaaacaggactgtcagacagcccatgcccagatgccagcagtaaataccccatcctgccttttaaagaagttgccagtggcagagctggtcatcggtgtccacctgcagtctgtactagagcagaaagatagaaacattagaagagaaacagagtagccagaatgagtgagactaaagatgagttctcccagatatcagagtgctctgtccctttctggtaattgaaacattgttgctttggcatagacttagactgtagagcagggagctgggccctggactctgcagttccttgtggtccagctacctacaactgctctgtgatgcttctcaaagtgctggacggtgagcaagggagtctgacatggtcacagtgctgaggtagcatcactatgggcagattctaggaccttattcttagtagtaatttgccaggttatgaactcctccagccttcctgactctgtgattccctagcctcctggagtttcaggtggccttgtgtgattcatttcattcctggagaggagcgttagcaacatgacacttgttttaagcaaaactctgtaggctctctgtcttcatctctaagaggaaagggggatgtttctggaagacacatgggagagctgtgatagttaagcactcagttgtaaagaatcctaacaacccacgtctcactgtctgaggagagcctctgcgtgtggccttagtgtgtgactgcctctcaccttgctttcccaggtgaaagtcagctcagctgtgcttaaagctgccgcccatcactatggggctcagtgcgataaaaccaataaggagtttatgctgtgccgctgggaagagaaggacccaaggcgctgcctgaaggagggcaagctggtcaacggctgtgcgctgaacttcttcaggtaagagtcagtcgcctgaaggcagtgcttgcatgagttaacatcaaggtatcctgaaatattctaaatgcatattctaaaatgaggaagtgacttccggctaattaagtagaattataagtgtgcaggttttgaaatcagatagaccaagttcagtaacctccacgaatgtcagttttcagctgcggatggtgtctgtcctctgcagtattgcagtagatattttggaaaggtgtgtacagctgtctcagcccagagcttgttgacagacagtggacggtcgtgacgattaagaaagcattgagtctggttttcagttgggccactgtgctcactgcttaagtataagcccaggtgtgtaattagctgcccagtgttgatgggacatggggtaattgtaacaggtcttgtgatcctggtgctcaggtggcggagacaagaggctcagcaagggcagccatggctaggcacagggagtttgaagccagtttgggctccatgagatgctgtctcaaaaagtgtttggtttgattcagccagcctagaactcactgtgcaggcctggaaccacagctctgcttcagctcacaagtgccggacctacagtgtgcaccaccccatcagcctcagaaaaatggttttagacctctgttataatcaaaagggcagaactcaactcagcgttaactgaagtccagaattagtgatggtgtcaggtagggctggattcaag

SEQ ID NO: 26616 - DNA, 2140 bp, Mus musculus
tctgtgtctcaggactgactatgtaagggtgtatgacatatgcacaactctgcctgggcttatattataaaaacataactgattttcaggcttcgttttcatgtttataattttatgtcgtgttgtcctaaaacacatcagcataagaaggggagagatgcaagtgttttctgggtgtctgtatctctgcccactctgaccctctgctgtgctttttccagtgtcactgcaaagataaaagccattgaagcaaagctgaaaatgatggcagaaaatcctgatgcagagtacccagcagcgcctgtttattcctactttaaaccacctgataaaaaaaggactactccttactctagaacagcctggaagtctcgaagatgatggtcgtgaattaccagagcagcagaagcaaatggtctccacgtctgaagtccttcgcctctgtactgtgtagatgtgaatggtactaccaacagagcacagtctcttgttagggccggtgacatagcgtgtttgggtgttcatatggatgtgtcttccctgaactatgtgtgaattgagcatcatccagaataaataggaatgtgtccagactgtgatgtgaacactgagatgcgctagttggctgctttgtttggatttgtaactccagaaacacaatgtgccagagagaaaaacaagcatacaacgttgttatttaaatcaggaaactaaatgtattaacatccaccaaaaacttttagcatttttatgtgtacacttctcttcaacataaacaaaaaataagggtgagggtggaaagtgagagacgtttacagtcatttttagaactgtttgggaatgtactgtagaaatccttcagttgaattcaaaagagaattcttggcaaaaagcagctgatcccttgagtgaatgttgtagcagtctgtttaagaattatgcttattatttccaaatctcagttaggaaaatgtggtatacgtcttaaaattgtttatgtcgtcaaagtgtagagacacatttaacattttataccacaacagatactctatttggaaatccagcttttattctttggcaatcatggttttgaatctgaatgaccttgccttctataataccaaatgttattactaacccgggttttaatacacttactgcatgagattgttttatagcatggggttgttgcagttagaactgtatcatgatcaatctaaatagaaaagcagaatttctttgaaaacctaaagtttgctgtattggttactgtcaagcattactttgtcacagttgtatggggctgtaagaagcagctgagtgaccttgttgcagctgagagagaaagtgcagtgagcagcaggagtcagcagccggtgctcaggcatcaagaccgtaacaaccacactcgttctgtccttttggaagaccgcacggcctaaaactgaacgttaccctgaaagcatgcttctctccagatatctctgtctccttggagatatgaacatggtagtatagagacacacatagacagacagccttgggaatgtgtttcttcagctcagtgctgattgaattggtgccgggcctgacagactgttcattagcaacaccgttcttcactgagcaggtcactgtcgctcaccacaggtgccacccatgatgacttgggttgtagagacacttgacttaacttctggggtttcagaatccacagaactgtttcagaggaattcttactgcttttcccaagtcggttttttagctatctttagatactgaatatgtcccagatttatcagttgtgtgtatctgtgatgtgggaaactctccttccacttgggagctcattcagggaagtgggaacaccggctcccatttgtctggtgacttattagaatatagaattcaccatttcatccttaagttctcaaagggttgtggtggagtagaatttgatgccaatagccttctatttttaataggaacctagagaatacttaggattatctagagttgtttctttagaatctagaactatttatttgtatttaaacaatgtctatgatttgtaccaattcttacccctctatgtgaataaacgcaagacgacagtatctatgtggtcttattgtctttc

SEQ ID NO: 26617 - DNA, 1196 bp, Mus musculus
tttgaatttaaacatgtggaaacttctaaattactgcgagacctagactataagcgtagaccattacctttaaatttcaccaatactttcatcagggaagtcaaaaagttagtatcttagatgttgattggcattctgtacttagtgccagctttcttattcagatattaaaagtgctctataaaataagaaagttacgtttgcattgtatgtgagcgcgagagagaacattagtagaaatgctcataatgctttctaagcagagggaagccatgaatgtatgtaaatcagggttaagaaagaaggctccatgtaaacagattcaaaagggccgtttggcttaaggcaaggatgagtactaagtggtgacaaaggcagctggataggtagaatactgtcaggtgaagacaggctctttaaattgtattcagacaagtggaagctcatgtagaacgtccagaggattttaacaagaacctgataccaaggcagtagtaatgttttagtgagggattcaagactgagagtgcaggttagttggcagatactcacctgttgccactgccacaccggtaggacagtgaacttggagattggtgggtgagtctgagatgtgagaaacaggagtagagaagagtggagaggcaagatgattctgaagggtggtggtgctatttttgttttctaacactagggctcaggctcggcctcagtcccagagaggtcttgcctggggaatgtaaacaactcaagagcctactaaccatagaatagtgatgatgaagtcattgtacagtaaaagccaagaggtggagagccaccaggtgcaagtgtccttttggtgctgactttcggaggattagctgggtaaaccaggactccctggaaatagatgcataagcctgtgtcagcaatgtgtttaccttttctctcagcccatttcacattcttccttcatagtccgtggtttgcatgaaatgatgtttactgtttgcttgcttaagtctgaaacaataaagcatttactaaggtgtatagaacaggacaaaaagattctcctcatagtaatttctataggctataaaggaaatgttctctaaaaacactatatagtatagtaaatttaaaaaaaaaaatcctgaaggtcatctcgttggctctctgttgcctctctggtgactgtaaccacaaaacaa

SEQ ID NO: 26618 - DNA, 1138 bp, Mus musculus
ggctgcacagaaaaacactatcttgaaaaaaaccaaaccaaactaaactaaacaaaacaaaaaaacaaacaacaacaacaaaaaaggagtagtcttacctaccttgcaggagtgttgttaagaatctgtaacaatatcaacatacatttcttagtgcagagagtggataacctcagttagtgtgaactttgtcactctcagtttttcccagtaacctttgcatgtttcagaaacatttgtccctaccccagtcatcaaacttcaattgttcttacagatcagccaaatggcagacgacacggtggcagagctggaccagcatctggcagcaaagaccaaagaactccttggatgaaagtcagcagtcacagccggacaccgagtcctgtgtctgctcatgccgtgggtggcaagctcgtgtctacactgccctgaccatgcacccgaggctgatactgctgcgcctccatcgtctgctcagtctcctgttgggatgctcagatttatggaatctcttccttgttcccgtgcacaggcttgttctgctctgaatctccccttgtgaatgtctctgttggcagaggacctttactctggcagtgaccttgactgtggtgtcaccacagcactagggccgctgtcaggcttagcagctcctctcatcaacacaggagcctcctttcaaactgtgaatcataccctgcccttgtgttaaactcatttggattaatgtgggccttcagtctgactgctgatgatcaagcctaaataaattggaaaataacaaccacagaagaaagatagagtggtttggatggaagaaccccagaacttgtttataaagcaaccaagggcagtttttgcctctgggttgtcctcccacatgctgttcatgtgggccaagcttccgctcctaactagccctgtttactgtgccatcagttgcccgctctgggcagtctctctgcctccagagctaggccccggttttggctgggctcctcttatttcatcctctgtttttcttttctgttagtctatatcttgagaaaaattaccagagagaatgacacagagtaccgcttgaagttgtccatgtatttatgttgtaaaaattggtagctgctcaccaaatgct

SEQ ID NO: 26619 - DNA, 1512 bp, Mus musculus
ctctccttatatctattcaatatagtactcaaagtaaacaatagagtgctctagaacaataagagaacaaaagaagattaagtgggtacaaattggcaaagcagaaataaaggtctcactattagctatactatatactatatgatagtattcataagaaaccctcaaaactaccagagaacttcaccagcagataaacaacttcagcaaagtggccagatacaaaattaactcaaatgaatcaatagccttcctttatacaaaggataaacaggctgagaaagaaattagggaaacaactcccttcacaatagccacaaatataaaatatcatggggtaactctaaccaaacaagtggatgatccatatgaaaataacttcaagtttctcaagaaagaaatagggtctttccggacctggccgagcagaaggcgccatcatgggtgttgacattcgccacaacaaggaccgaaaggttcggcgcaaggagcccaagagccaggacatctacctgcggctgcttgtcaagttgtacaggtttctggccagacggaccaactccaccttcaatcaggttgtgctgaagaggttgttcatgagccgaaccaaccggccacctctgtccctgtcccgcatgatccgaaagatgaagcttcctggccgcgagaacaagactgcagttgttgtggggacggtcacagatgatgtgcggattctggaagttcccaagctgaaggtgtgtgcactgcgggtgagcagccgggccgggagtcgcatcctcaaggctgggggtaagatcctcacctttgaccagctggccctggagtctcccaagggccggggcactgtgctcctgtctggtcctcggaagggccgagaggtgtaccgacattttggcaaggccccaggaaccccacacagccataccaaaccctatgtccgttccaagggccggaagtttgagcgcgccagaggccgaagggccagcagaggctacaaaaactaaccctggatcttaactgttaataaaaaaaagcattggaaaaaaaaagaaaagaaatagaaaaagatctcagacaatggagagatcacccatgctcatggattggcagaattaacatagtaaaactgtccatccttccaaaggcaatctatagattcaatgaaatcttcatcaaaatcccaacacaactcttcaaagacatgggaaaaagcaattctcaaattcatctggtaaggcaaaaatccaagaatagtgaaacaattcttaacaacaaaagaacagctgggagaattaccatccctgatctcaagctatgctacagaacagtagtgataaaaactgcatggtattggtacaaagacagacatattgatcagtggaatagaaatgaagacccagaaatgaaaccatacacttacagacacttaatcctagacaaaaaagccaaaaacatacaatggaaaaaagaaaacatctgtaataactggttctggtctaactagctgtc

SEQ ID NO: 26620 - DNA, 1539 bp, Mus musculus
ccacagagtaccccgccgtcaaattctgtcgggtgaggagctcagttattggggccagtagtcgttttacccggaatgcccttcctgctctgctcatctacaaggcgggtgaattgattggcaattttgttcgagtcactgaccagctgggggaagatttctttgctgtagaccttgaagctttcctgcaggaatttggattgctcccagaaaaggaagtcttggtgctgacatctgtgcgaaactctgccacctgtcacagtgaagacagcgatctggaaatagattgaactgataatctagttccgtagctatctcattgtttgggctggaggacacatgtctgtatttatttctgtccttcctgtgtcttctggctttacagctgttctttgtagtctcatttagtatgtgaaaagtcaagaaattcttagattaaatcagaatgctgactcactttgtagctagcagtaaagtgacttcaaattatataagcaggaaactaggttcttgagctgtttacttctctagcgtgacatctctgatactgtttccagtcaatattgacatggcacccttgcaggcaatgtcttgaaaattgtcttctgatgacctcagaattctaccagttctgagagtagaattccctagtgagtgtgttctgtgcaatgtaaacagtgcatttccataatcacttgattgcaaatcatgtttacttgcaatcagatgcatagctgtactttttttctctagatctgtctctaccagggtccatacaaggttgggaatgtagctcggtggtgaactcttactatgcacatggccccaagatacctgattcctagcactgtcaagactaaaggttccagatggtgcctggtgctgtagttagcagtggcctctgctgtggcggtcagtggtccagtccagcataatgaacaggaaaggatggtttttgctgactgctgtcatgttgggaggcaagcatcttattgactgacattggtgtgtgtggagcttgaaaacctcagtgggaggatctttctgtactcctgctcatcagtatctcttcctgttattaacaaggcgacttcttgtttaacctcagctttttttaaatgcttttttgcctattaggaaaaaaaaatcatatttagtagaggaaaattggccaaaataaagatgtaaaaatggtttaaaaatgtaattctgccacctaaatactatatgttttggtatagttcatatataggttttttttttttaatgtattcattggcttttgtttgtctttaaatgacactgggataattctgagcatagtgtctgatattatggtcagctactaacatcagatgtttttcatgttattaaatactcttctgtaacattttaatagctgttgatatttccactgatagatatactgtaatatgcttggtggttggtttttagaaagatggcaaacttttttattatgaaccttttattatgaaatgtgtccctcatagaacatacaataaaaattaagctaaaaag

SEQ ID NO: 26621 - DNA, 1145 bp, Mus musculus
tttacactagctatttctttgtatccctttgctggcaagggagtacaaggagtcaaaccacagatcagaacaccccacatttgagtggagacttatttttactctaaggggagttattcccccaagtctgaaactggcaattatttttttttctcttacataaaaatttaaaaatatcccccaaaccagtggaaaacagacactggctgcacttagtactgccaagagccaaggtcatttgcacatattccatcaacctgtcaaaaattaggcctcactttataacccaaggcatggaagtgcatgcattctcttagctgggcaagcaattatactgtagttgtgatacaacacatgtggcttttatttgtactgcacatacccactgtacagccacttgggagtatcgtggttagcttgcagcaactgccgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagcttagtgtgaatatttttacgtctgtattagacattttctttgcaaatctattgttcgattgaaatgtaaatgaaattaaagatggtgtacacccatcatgtaaaacgcaggcaccatctctaagatggatttaatgctcatttttaaggcatatactcagcttctatttaaaactataaaataattctgtacaatgaaatggggaatatatatgggaataaattctattccatttatttcaatttgaatttccaaattgtaatgtttccctttgtgctataggaataggattaaatgggggaaggctaggacttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaagttgtt

SEQ ID NO: 26622 - DNA, 3674 bp, Mus musculus
tttatttattagcttttatgtgtatgggtgttttgactgcatatatgtctatgtgtgtgcaagctttgtgcccaaagaggcccggaaggacattgcttcctctgagattggagttacagactgctgtgtggttttggctgttgaacccccaggtcctctggagtagcagttgtgctttaacttctgagccttctctttagcccctacttaatacattttttaataaagaagataggcttttctgtgggcttagagtttgaagtagctttcagagagcaaatgtgataactcttaaattgtacataagttaatttgctttcactgtcattttctctcagggaggagcaaaaaccaattctgccggtaacatcttgctttagccagccacgtccaatgtctattagcagtgcaagctgcctccccatcaccacatctgtcagtgttggcaacctcattctgaaaactcacgttatgtctgaagataaaaacgactttttaaaacctattgcaaatgggaagatggttaacagctgaaaggaggctcagctttcaaatctgtgaccacaccatggaagcatttacactagctttttatatatataatatatattatataatgtatattttttttaaaaaaaaagatattactgggggcatccatttcctgtggactctttgatacttcaagccctcttgcattagcattatgaaaaaaaagaaaatttactttactagggtaatgttcactttccagaaattattggaatttggacaacatttaacttaagcttcaagcagctttttatgagtttgtagcaatccggtgcagtaactgagccatttcctattttaaatggcttctacagtaaattaacaactcagttattaaactagcaggatcctacaatgatacatctagtgaaagtagagttaattaacttatttctattttatgtttcactgagagaaatttccatctcattccagctgctttatttatctttttcattggactttgcatggatttttctttctttctttttttgttttgttttgttttgtttttccttttcttttctgtcttttttttttttttttgagagtggagttagatgttcttaccatagagttttacagggttataatagctttctttactgcattatatgtagaagtgtagtgcagtgcttttatctgtagcatttaattttttaattttccatttttcaagaatagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcaattttttaaaatgcagatttaagcctgtacattattgaatctgatgacttggcaaaagaatcaggtgctttcagctttcttgagaaaaccctgtatgtagcgtttgcactgactaacaagatggtattgctgggtctttaatttaaagaaattaatttgggtgttcattgcattatttagttagatattgtttattgttacttcatgttgggtttaattttcttgttttctgactgttaggttgataagactttgaaccatgtagtagtagaacattggctaacattacccatacttaaaaacatgaataatttctgccctgccataatgtgactgaaattttcacttggcatctgaaagtatgcagtatgttcaaccagctctgccccagatttgtgggtagtagtttattgaagcttaaatttcagtcaatatttaaaaacaaaagcagggcatgcctttctggtagtaatctaatagtttatctttttgtttttcttccatttctttaagattagtttgacttttattattttttaattaacttctgtgaagttgtttactctgaaaattgtactggaatattttaagccaagctgatctttcaccaggtgtactgtatgtaagggcttctcctgctagcaagatgcttaaacaggatcatgttattggtcgtctgagctatttagttattttacaaaaaccacagcattgtatcagagaagattttgataaaagttttgtgcacatttccaggggtgggagggttaacatttccctgaaatttcttgattggaatgagtaaatactggtgtttgatacctgtcttaatgaacatgctcataaggtgactgatacgttgtaaataatacctgagaaacaaaggggtagttttgatattctggtgtcagtatggaagatcttacacatttatttaatactcaagtgtatgaagatgtttgtttataacataacagcacagtagccttgacttagttttatttggttagtactgtacctttttgccatggccagtgctccccatccctacaaagacattttatttattttactctgtaacctgaaatgaagaggaacaagagttttaaaccatgttacattaacttatttctgacattataaattagcctaggatattacaggaacatgattgttatataatttatatcagaacctttctataaatatgagcttattacatttgaaatgtttccaatgtatttttcttttccttctcttctcttctcttctcttctctcttctctcttctctcttctctcttctctcttcttttcttttcttttcttttcttttcttttcttttcttttcttttcttttcttttctttctgtttgtaattccaaaaaggttatgtaaaccagtctgtctatttcatggatatttaatagtgagatcttccatgttgaaggtaatgtatttttttttaagattttaaaattgctattttgttacaaaatagagacctattaacagttgagagctccttatgtgccctcagggaaagaaccctctgtgcagcagagctacacgaacatcttcagcactttctgagggtgattatatactacataaattgatcttgtgtatttaaccttatctttttaattttaaagttgaaattttgaaacgtggttgtgctcttctggaggggttgggatgcttaggtgtttgcctacttgttcagtaaactgcatttcatcagtgtatgtgtacacctgccaaccttattggtgtgtctcaaacatttataggaaaatagtgcttgtcttgcagcagatgatcccataaaacaataacttctaattcttaaatgtttactctttctcactaacaacacaggaattgtttctgtgttcacattattctgtattgcattttttatgtggtgacagcttactgtatgttttagtgggtataatttgaaataaggctattggatctctgccacttaagaagaaagaacagttcatctgacctttcttcaaaatgatacctgctgatgtcacagaggaaaatagtacaaacagacctagaatgtgtttttttttaattggggcaatcatcactttgaccctttatcaagatgacatgatgaacacatttggaatcagaggctacaaaacaatagaagagaaactttgtaatgtcggtatctaaaatgcttgtaaagcctatgggtctaatcaggaatcagtagtatgaagtctgaaaaaaagcagggaaatggtgta

SEQ ID NO: 26623 - DNA, 1202 bp, Mus musculus
gttctaagaatgttgaatgttcttattagtataattgtatcttgacagtaatacagtttgtataccaagataaagatcaatgctgattatattttcccacattcagggctgccttaaatttaaaccattttaaaatgttggtttttactaaggtattacattgaatattcttcttttcaattttcaaggatactacccaccacctccaacggtaccagctggtgtgactccctgtgttcctcgctttgtgaggtccagtaatgttccagagtcctccctcccacctgcttccatgccatatgctgatcattacagtacattctcccctcgagatcgaatgaattcttctccttaccaacctcctcctccgcagcagtatggaccagttcctccagtaccctctggaatgtatgctccggtgtatgacagcaggcgcatctggcgcccagctatgtaccaacgagatgacattattagaagcaattctttacctccaatggatgtgatgcactcatctgtctatcagacatctttacgggaaagatacaactcattagatggatattattcagtggcttgtcagccaccgaatgacccaaggacaactgtgcctttaccaagggtgagtaatgttgaaaatagaaatgttgctgtcatgccgggcagtggtagcgcacacctttaattccagcacttggaaggcagaggcagggtatttctgagttcgaggccagcctggtctacaaagtgagttccaggacagccagggctacacagagaaaccctgtctcgaaaaaccaaggggaaaaaaaatgttgctatcatgtgttagttgagatccttgtgtcttgaatcaaaccagacagactcttactgtgtgatttagagaagttacttgccctttgcatggcacagggttttttgttttttcatgtttgatggaaataagaatagtacttattaataaggctgttgtgagaattaaattcaaaaacaataaagctcctagaacaagacttgatacataccagtgttcaatgttatgttcaattaggaactgatatagaaattttaaaacaaggcctcttttcagtagcttcacatttacacacacacacaacttctaacctagaaaaatgagttctcacatttgacttgacatcagctgagtatgttacccttttttattgaatatatggaga

SEQ ID NO: 26624 - DNA, 1379 bp, Mus musculus
tttatatgaaatccaagatcaaacagttttgtatattataatttatataaatgtaatatcagaaaaatctgtgatctttataaacataaacttatttaggaatataaaatttctacattttgataaagtttaagtatgagtttgagttttttttaattataatctgcttgtataatttaataacaataaagaatgctttcatctcttgaatcctatcctgtttattctgtgttacttttaggatttggtgcttttttttttttgtatcacataaaataaaatttcaaaccccactcttttcagaaagcttcaagtgcatgtgtacttggcttgctatattagttatgtgcctgcatttgtatgtgacatgtatatgtaacatgtagagtttttgatatttagctgaagaaagttctcagagctgtttcctttttaaaacacattttcatattaaaattgagagcagtattacaaacatgctgattatttttaaacaggtaccgattaaggaacaaaaagatgagcgcgactgtaagaacatttcctcttctgaataaagttggtgtaaacagcactgtcacaaccacagccggaaatgtcatttctgtcataggaagtactgaaacaactgggaaaattgttgcaagtacaaatggaatttcaaatacagaaagcagtgtttctcagctaatcccacgaggcactgacagtgcagtaaggactttggagactgtgaagaaagtcgggaaggttggcactaatgctcagaatgctgggccctctgcagagtccgtgtctgaaaagtaggtatggggtgaaaatgatggagttccttatcccttttagaaatgaccttcttttttcattctgagataccgtagtaaattgaaatttttatgcaattattcatgtaatagaagaaaacactaaataccacaaaatttgagttctaatcctcacaaggcagccaactagttctataaacttgaaagctcctactcttgagttttgttttttcaaatatattaagtttggatcagaattaggctttccataagttattttctagcgtttcagtattaattccatagagacgttaaaaaggaactaagtagaaacctaaacaggtgagaagtttgaatgtctagccccattttagtcagcttctatggctttctctgtcgtggtgtgtgtgtgtgtgtgtgtgtgtgtgtgtgtgtgtgtgtgtgtgtctatggggctctttgggctcaaattgtggctcggtttttttctactatttgatattgaccagtctacctgcctccaagtattaaaaaattacttcatatattgattgtgaaacttaaacgagttaatatcgtactaaattttgaaca

SEQ ID NO: 26625 - DNA, 1100 bp, Mus musculus
tttgattttcctctttttcctaaagaaattctatttttagagatgtagctcacatagtcgtgagccaagagaaaacattttctgaaaattttccttctatttacttgtcgtatttatttggctttgtttatgttgctgtagaccctataactacacccttactataattttttgtttctaaatctttctttcctgccaaatgctgatgaactcaatgaagaaaaggattgcgtacataattatatactttctgttttgttctgaaaaggagtttctattggcattttgtactttttgtggtgtctggtatataaccccttcagcccaatccccacacccacagtaaatgaactggataagagaaaaaggcagaccaattctaatgagtttgattttttttttccttcccatttttaggttactaaaagggatgaagactcttccctgatgcagctaaaggaggaatttcggagttacgaggcactacgcagagaacatgatgcccagattgttcatattgccatggaagcaggactccgtatttcacctgagcagtggtcttcactgctgtatggggacttggctcataaatcacacatgcagtctatcattgataaggtttgtaaggttagattttgtacccttcctgtctcagaaaatactgtagcatagatccttccttctctgttaataacctaatatgcctgcctgagtagaaaatacacgtatctaacctagtgaacttgatgacttagaacattgtccacgctggtctttgtggagtattagctacttatgtgctcactgagagctgtaggtcagtgccattgtctcatgacagtgtgactactgtacttcacatcactccccttgatgaaattaaatgtaaaatgtggaacactctctactgaatatattttgcctttgtagcattgtaaagttgaaaacttttatcaacattctcaccccagagagctaatatagctgataaataatgtttttaagtgtctagtgatgaatttcatagggcagattctgaggtgaaaatttagttcatcattgattgtcctattatgaaatctgaagacacttgaaaacta

SEQ ID NO: 26626 - DNA, 1100 bp, Mus musculus; identical to SEQ ID NO: 26625

SEQ ID NO: 26627 - DNA, 1195 bp, Mus musculus
aaccttgacctgacaaagatccacctacctctgcctcccaagtgctggggttaaaggcatgtgtgccaccatgaacacattgttggtgttcttaagtagagagtgggaggtaggggctgtgagatgtaaagatgctgccaagctagatgatctgtgtgtcctcagaccccacgttagaaggagagaactaactagcatgcacacatggcacacatgggcccacatacatacacataaacccacacacaaaataaaaacattaagcaataaaaaatagaatgtattagtcactaagaaaaatacaccaaagttttgattactattgcatgaacaagcagtagagtttagttgaaaggaatagtattaataaattgtctctgggtaaatgtgcaaaatgtaattcaacttacagttttgttatttattgtttgttatagagacatctaaatcctatatttagaaatgttttagattctggagtggtggtagttgattttaacagttaagtgaatgactaataaatatattgttaatgcttgcttttgtccatttgcagcttaaaaaacactacacatcaaaataatgatctgctagactgctaacccgagcatcagcttccacaatgcctgtgcaggcagctcaatggacagagtttctgtcctgtccaatctgctataatgaatttgatgagaatgtgcacaaacccatcagtttaggttgttcacacacagtttgcaagacctgcttgaataaacttcaccgaaaagcgtgtccttttgaccagactgccataaacacagacattgatgtgctccctgtcaactttgcacttcttcagttagttggagcccaggtaagtgtccagtatttttactggtttattatatcagttgtcaaaattagttctttagctggtacagagcatgttgaaaggtagtcgaaacctaaaaggtgtatttactttttgtgatgtgttcctacaaagatttttctcactgctataaattcttaagcaaaataatgaatcccattacagttatatatttctttgttctggcttcaataccaaagccagaatttagatatctaagtcctttggtagttgagaaactgtgtgactatatcagtatttatttgttaagtcatgaaaagaagtaaaatcagaggtttagttagaaaaaaaactatctaaagc

SEQ ID NO: 26628 - DNA, 1234 bp, Mus musculus
ataaaaatgcagcacatgtagtgttgccccccacccaatctgtatcatttatttttgttcttacatgttattcattctgaacttctaataattccaaagttggtggtgtgattaagtttatgagattctacattgtctcaaacattatgtattagtcctctgttcaggagtaattgcagattctgatttgtagtttttagataagtgatttattgttgacctatatagaattttaaggaagtaagatggcaagaaaatagatttgaaagcatagtgttgcacatcgctattaatattgaaagcagataggactagcagttttttttttttttaatttaaccagtgttcttgatttataaccagaacaccaaggtactgtcttaaaactaaaggagcacaattcaaattcacatggggccagcaaaatgtctttagaaatacattacttaaatgtccaaaagaatatgtgattagacccttttcctgattatatatattgtagcctccctcagccttgaagcaggctgatccagactttgaccttgctgccactaagaaggagaggctagagccttctgaccttgatggctctatttgctcttctccaagactgcttcctgctgaaaggtctttgagaccgtccgacctgtagatcacctactggctggctccaggcaccaagaatgggctggcagggaatgggcctaccctctttataagcatggactctcagtaaacttcagaggctttgaacagaaaggtttgtcttggcctagttcttttcttgcctctggtctctttcagccccagcacgcctttcaggggaacccagttctcgttcagcaggcggctacaatatataacatggttggattaagaactctggccaatgcaagtattttcttaaattgacaattttcttagattggcaagttacttttcttaaatagtccactttcatcaaagacattgttacactgtttacttagggtttcttttggtgtttgttttggtttacatgcactaaaattgacctctgtggaattacatttctacgaatttagtacatatctaattgtctgcaattgggacacagaatagttccaccagcttccaaaattcccttatgctgctcttttgtagtccaccctttctaactctaaattctactaagagttcttcattaatataatttgttctaatctgaggtgataataaaactggaatcttatgt

SEQ ID NO: 26629 - DNA, 1099 bp, Mus musculus
ttaaacatgtactccagcactgagctactcccacagcctcaagaagtattagtaaccaactggaatttccaggtactgtgttatattctgaggataggaaggtaagattgatatatatggtccctgtccttatagggcaagcgattttagtgagatgatgtctcaaatttatatcctaacaagaataaaattgcctcgttttctttaatcacttaaagcagtggttttctacctgtggaatcaagtgattttttttttcacagaggttgcctaagaccatagaaattgtttttgtttatattacaatttaattacattataattcaaaacagcagaaatgcagttatgaaataatgaaaatatttttatggttgggctcaccacagcatgaggaactgtattaaaggatctcacaatattaggaaggttgagaaccctgacttaaagtccactttcttaggggtttctgttagtaaaatttttggttctgtttgtaagtgtaaaccatttgcataatttgtgatctcttccatttcttggctggagaggtcttatttttgtgtgagatatttaattttggtggaacttggtttctttgcttacgtgtttctcagattttaaagcaaagagaagaggcatatattttattgtggaagaaggcttttcacactagtaattatatgaggcagaggtgagccttagttactcagcatttggtttaatttggctttttgtttttgtttttgtttttttgaggcaggatcttactatgtggccctggctgcctctgcctctgctgggatcacaggtataggccacgatgccagcctcagtgtttgtgttgtatggattcctaggaaaacctcaaaagaaagaggaccctctttactgtagtttgttttttttaaaattactgttatttatttattatttaatatgaaaacaatctccaaactgaagtggctctgaggtaaatcaggtgtgattttgcattagtttagaagatgtgtaagtgaaaggtgactaatgtcactatttctaaaatattgtcctaaacaacttagaacattttatttcagctcatgaatggctgttctaa

SEQ ID NO: 26630 - DNA, 1139 bp, Mus musculus
gctttctctgtcttgaatttatctcttatatattaatgtgaaatacagtttgctataccatcctagtattttaaattttagtattaataatgctagggaaccgtagttattacactttcacaataaccaagtgttttaacttcatttatgtgtaaagcaatacaaattaaagtccagaatactgttgagttcatctttgcttctgtaagccaagacctgagttgcaatatgtgccaaaggcagccctataagtaggtggtgttattgtaagaggagtgttttaattatatggaatctgaaatatcttgacctacatagcacagaatatccttatcagaatgaatgaaaagcttttttttttaaagaatagagcataactaaatatatggcagacattttatatgaatctttatggtttttgtttttcaggcattaaaaaaatatttaaccattcatgagttgagcctcattcttgagttatggatgacaaggcctctgttggaaaaatcagtgtctcatcagactcagtgtctactcttaatagtgaagattttgtcttggtttccaggcaaggagatgagacaccatctacaaataatgggagtgatgatgagaagacgggactcaaggtaaagtttgacagccaaagtgtgccttgctaaaccctgtgcacaacttggagctaataaataaaagagtaagctacggagaacacaggattgatagatatacttttcaatggtgttgagttttgcatatacttaatgagttactcttattttaaggatttttattttgattagcttcttaaattttttaaagctcctaccaaaactcttatggtataaactttttaaactttaggattgctcccttttcccagtactcaggaggcagaagcaggcagatctcttgtttgaggacagcctggtctacaaagtgatttctatggtagtcaaggctgttacacagagaaaccctgtttggggagggggggggggaagagagagagaaggagagggtaggagaaggggagagagagagagagagagagagagagagagagagagagagagagagagagcgggaacatgtggaagcatgagttcgagcattcaggggagggggagtggtaacaa

SEQ ID NO: 26631 - DNA, 1226 bp, Mus musculus
gtactgatcttgtctttatttagttagtaggctataagaattatatatttgctgccccagcagtggcagcttaatcccagtagttggaaagcagaggccagcctggtctacagcttaatttccaggattgccaggactgcacagagaaactgtcacaaaaacaaaaacccaaaaccaaacaaaaagaaccagatttgctgatatttatacctttctacatgtgtgtcccaaacataaaactgtctagatttagtatcatagaattatgtgatacaacctcaacatccacatatgaattatgtatcacaattcaacatcaacatggctagtatactagaagtagcttatataatcatctctctggacaaataccctaatgtaaacataacaaataataatatatagtatatatataacataataaaaataataaaaataaattaagtcctgttataaatacaagttgctcattattaatctcttgcctttttgtctggatagacttttagatcctcaaacaaacactgaaatagcaaactaccctatctacaaaatcctcttctgtgtcagaggacatgatgggactcctgagagtgactgttttgcattcactgaaagtcactacaacgcagagctcttcaggatacatgtctttcgctgtgaaatacaagaagctgtaagtgttttgttttgttttgagacgtgattccctgtatacctctggatgtcctgtcactgatttcatagaccaggcaggcctcagaagagagaaatgcaaatgagatttcaccactatctctgttgctacaagtgccacagacgggcagatggttcagtgagtaagatgcttgctgcacaaacatgaggacctgaaaaccatccccagcacccacactaacaagctagtcatggtacatgtcagtaaccccagcataggcagatcctggggcttgctggccagccattgtagcctaaacagagggttctaggttcagtaagagacgctgcctcaaaaaatagaaaataggtgaagacacccaattgcaacttctggcctccatgtacatacacaccagtgagcacacttgtgcacttgcacatacagtgctgcagtaggtgtggtctgttggttgaatagattcacaaccttatccaaacagtgagacatttgcaagttgttttgttattagtaggtcctaaacttgttagagccacatgtggttatt

SEQ ID NO: 26632 - DNA, 1234 bp, Mus musculus
aaggacagccaaagcaaaatggagaaaccctatctgggggttgggggagtggatctaaggttactatgctataggtaggtaacctttgggtcatcctttctatccgacagaaattatttgcatatctcctagacacaaacctgcaggccacttggtaactgcacagagccagagtccttaactaataataagcagctgggttagagacaaatatatttgtctagcaaccctaaaaacagttgctaaactaaatagatatcctgtggtctgacttggcaaggttttgttgtacttattcttttggttgtgcttggcctctactggcagagacgcttaatgcagcagggattcctggccttcagtctaagactcctattttaaatagcactttgaaaggacacattgctataatcttggccttaatcctaaggttggagtaatgattttaatgaaaagccaggtagaggctaggatggtagaatctactctggtgttcctgtaccctgtagatgtccttgtcctccaccgtccatctactatgctttgcacctttctgtgctttcagcatcctttgttgtgctttttacagccttcatctcccccatgatccttatttcaagttaactttctcttcttcaactggcaataataggaatattaaggtgctcaaaatatgtattatgttgatagaatatctaatttttttaaactttttttaagatttatttatttactttatatatgtgagtaccctgtagctgtcttcagacataccaaaagagggcaatgggtccccattacagatggttgtgagccaccatgtggttgctgggagttgaactcaggacctctggaagagcagtcagtgctcttaactactgagccctctctccagcccgtgtctaattattttttaattaggcccatataaattgtttatgatgcttgcctaaaagtaaaaaccagagtgtaggttggaagttgcttggcacaaattgttaggaattttattgatgtcttgcctgctgttcatctccacctactgtcctcctacccagctaagaaaaacgtttgtctactgtttgaactaagcaaaagaaggaaagggatttcttcgtgctaaacttttagaatttatcaatggttttgatatgtggttttaagtaggaaacctgaaaagacaccttaaatttgttggaaagacacaggacagttgactttcacattgactttt

SEQ ID NO: 26633 - DNA, 1143 bp, Mus musculus
tcatatttacttagcttggtgatatacactgtagtatcagcacttgggaggccaaaaggcaagagaatcattagtttcaggcttgcctgggctacatatgagcaccaagcaaacctgatccacatagcaactctaactcacaaaaccaaaataaacaaaatggtgacaattctgagaacatgcagtatctcccattatcagattatggaattatatcccataataagtatgttgtgttgtatacctttgtacctttctggtttcaaaacaccttcatatatactttgacttttttgtatctgtgcatttcctgtttatgggttcaatcaattgtgaattgaagatatttggagaaaaatacacatgtgcattttttttcttcattgtcaatattccctaaatattttatctgggtatttattaccaaccagtctagaggttgtctctgtgaggtagtatgcacacaggttctacacaaatacttcatgacataatataaggaactgcgcatgctctgatttcagtatctaagggcttcgtagacccagctgtctgtgaacccttaggggtgactgtatcttaacatttttgagttgttgaacctcattggcccttaccatctacgctatagaaagagtgttactgtccagtttaaagacagactgaaacagaagctctttagactttgacctggtcaaggacagaatttcattttcttgatttccactctactgtcttcaccctttgacacatttattgtgatcagaaattctctaaaaagaactaaaatatggagaagcctcataatcttataatttcacatggctttatcatttttacaggttttttatggtcaaaaaataaatgatcccaatgtactaatgttcttataagtttgtattttcaaagagaaaatacattcaagatgctttaattaggaattcaaggtagagacagtgtcagaacaaagattgtatttaggctcatataaagtacagtgcagagtttcatgttgccctgtgctaagttctgtgtcactgtagagcagacactggactgactagaggatgcagctagggtttggaatggccttcttgtctcttaaaggaatgataaaataattcctattagcataagaaaagt

SEQ ID NO: 26634 - DNA, 1183 bp, Mus musculus
ttatgctcaggctgcctggtgccatcacgtagcaattactcctcacaagaaatctaaagagatgaagcgctgttttcctcctaactcatttcacatgacagctttttagtgacaggccaccctgtagtctttactgatgggcttatctacccttattcctgtttctggaaaggatacttagttgtagaaactgccagactggggcagagcatcctcagcctgtctagggtccttgctctatatcccaggaattgggagtagcactgggctcatgaagcacaccaaggctcaaaacaagtactttgttcaggtccaggaggtgaaaacctatgttttgcaaagatacaggtggcatttttctccaggctttagcttactcggttctgatgttggccaagttagtgcttagaagtctgtttaaaatacccatttgtatttactgttttcccaagtacacagtgtaaatagtataatttgcagtgcaaagtctttggcaataattttatgatgtatatactatgttaaacattggaaaccacaagcaccatggactgccccatgtcttctgggcctgtggtgacatgtagactttggactttccaagtatcagcgtgcttgaagcagcagcctgcatgtgtggactatcatcagtgcctcgcccagagatgcctggccttcatccaaagggaccctgctgctccgagcccagcgagcagcacccacactgcggctcctttgtgttgaatatgttggactctgccatagactccttgtttggctgctgcactttgtaatgccttgacatgttgcatttcttttccatttggatgaataaaaataaacgctgtgtcaaataggaatggcctggactgttctgtacaggactcactttactgaaaagttacagtgctagctgcagagatgcttcagcagttaaaagggctcactgttcttttagagggcctgagttcagtctcatcacttacccagtagatccaatgctctcttctggcctctacacatacatacttacccaagcacatacagacataccaataaaattgaatcaaatgcaagcttcactccctttcctcaaactcatttcatctcagaggtttttcacttcatacagagggagtaggtgcatgcatcctgacatggtcagtgatttggagcctgtgta

SEQ ID NO: 26635 - DNA, 2998 bp, Mus musculus
tgtggtgagaaaattgtgaaagaacatccagacagccaagaaccttgttgtgactgatgagaaaggggctgttgccatgcccagataaggatgaagggatttgcttgagttgtagtagagatggggtagcagtctcttcataagcagatctgatagatctctctcctatcggagagagtggtgctgcctctgaccaggaaggcaatggtagtgtttatagccactggggtggagcaagggctcaaaatggactgggtagtttgatgccagccagttgatatctttactctttttttttttttttttttttttttaaataaggctaattctgcccatcacaacatgataggtattgaatattcctttatactggggtctgtctttttgctttcatatagattttttttttttttaattttaaagatttagcctgtaaaagggctagtgccttttgggaatcagcatctgtagagtatagtctttagccattggaaaggtacattttctttacagagtttcttacagaggaaaaaggtatgtggttactgaaagatttactctgggctttagctgtgagttaatatccatctagccatgtctcctgggtgttatggacaggaaaccaggtgggaatcacaaggaggtgtatttttttcagtgctgggaatgagagagtgtcacgcttcaaaactagggccttgtacatagtaggctgttacttcaccagtgaatgaatcaggatagatttctgcactattgaatttatgtacctctgctggggactagactgctattatttggaggccttaggtcagatctttggaaaggttaaaggtatttgggacaccaagtctgtcagtttttgagcagtgagaactccagggacatacagatatcaccttctcattggttacagtgaaaatcttttggcagccctcctcctatcctatgccgatagccttttcctttccagaatccttccataatttactcaccacactggagaatggtaaacagctggatggatggatgggagtgagcatgtagggcacatagttgctgtcacattctaaactctgccactgtagcatgaaagcacctcagaatggtataggcattggtgagtgtggctgtgttcaatcacatattacttacataccaaagtgagtagggctcaggaaggtccatgatgagctccaaatggagggaagacatttgagtggggaaagcccaagggaggcagcagctatgttgttagacctagagggactatgtggttcctcccagaaagaacagctctagatggtagagaggttgtgtcccagctacaagtttttgttttcagaggcacttgggctagattggggctgcttgggtgacaggctgaggggcacagattattctctaggtggtgggtaacgtgaccacagacacattacattcaataatgtcgttctgattatggtagaccaatgcctggaactacaaattacacttttctgcttagtatggactagatgtgtaagggctgaggtgctcttagaattctgatgaaaagtgcagttggaatgttggaaggttttcttgccaggatgacttagtgatgaatgagtgctgttacatgacaatttcactaacagtgtttcattgccttgctctttttttgtatccaggccaatttgggttttgggccttggtgtgcaaaggaaaaattgtgaatgtacccctgtgtccccccccccccccccacaccctttagaaccaaatcacagagcaagaaagctgtatgtaatgcaaactcacttaaagccaggccttgcagctttctactgaaagttgagtgctgccctggtgcatcctggaccttgagggcaccctgctctcctctaggtaatttcctcagggcagtttttagccaggttgagaagcatctttcatttagaaagttccaacaacaactgcttgctttcagtgagcttttgtgatctgcagccatccttcaaggtgatgtgcctaggagacatgttggccttgcttagcttcctctagtgcaatggttctcaaccttcctaatactgctgtctctttaatgcagttcctcacattgaggtgacccccagccaggagatcatttttgttactacttcataattataattttgctactgttaagaatcatgccagagcgggctcgacccacaggttgagaatcaatgttcttatacagatatgctgccttggattttgctgcctcgtaagatatgggatagctctgatgctgatagtagtattcttcaaaattttctagagaagtttctgagttcatggaagggaatatgatttgagtatggaatagatggaaactggctcagtcttggcagtgtgcagtctgtccttagctgatagcaggaatatattttctttctctctggcttttcaagacagggtttctctgtgtatctctggctgtcctggaactcgatctatatagacctggctgctctcaaactcatagagatctgcctgcccctgcctcccatgtgctgggattacagggtgtgcaccaccacattcggctcaggaatattctcttatttggtagccaagttctgaaaagtgctctagcttatagggtggttcctgtcacttggcatggtcagtcaatgatagaactttgcctgttgactgtgtcatagccttcagttaatgccatgatgatgatcaaaattaaaaaataagtgaaaaactacgtcccttagctatttatgctgtagtaggagccagaaaaaatgtttttgtaccttgtcaatcggtcaaggaaatgaatcaagagtaaggataggagtctttagaaagactgccttcgtttcttcctgtaatttagaaagttgcatttctagtttctggcttcttgcctttggctgagtggttgatatgctctacccttccttgctgagcatacctttccactctggccaaggaacttggttcttgttga

SEQ ID NO: 26636 - DNA, 11239 bp, Mus musculus
tcctcttcacacatcagctttaccatttttattttgatgacaattataggtccttaagacattgctatactgaagtgtagaatttgaatagtttggcaaggttcaaatgtgttcaagaagttttgtttgggcaaaatgcagagcccagatttaagtcctttgcctggttgtatccctcgcccactcatgtgacccaggcttctccatattctgaactataggaatcacagatgtgggagttcaggattagtatttgtttttatctatatttccttctgaattcagactggctctttttgttttgaccattggcatttgccctttctccagcttcttaatgtcctgaacacctcatcctgacaaattggggccagctgattaacctaggcgtagcacacttgacttacttgctatacctgagtctgtgtgccagtcacaaaataacaagatgaattctactaaagcattgctagagactttctttaaaaaatttgggttttagactcttcagttacatccatgttttcctcaagtctttttaatttttcttttctggtccttccttaacattctttcaccctgtggcttctgagcctcagaaggcgcctctcttccatgtgccatatactgacttccaaagctggtgtaatttgatgccccatttttcacataaaagattgggtttttaaatgttactgtgatgcaaatctactaaaacaatgctttattttggctgtaaggtaaatatgtcttttggcctttgtaaagctgttgcatgtggggttatctccctctgatcatctggtgctcttgaatacctgctgttgctgctttgtgatttctcctagggtaaacatcagcataaaggcaggggcagatttcaaatcctccttagtatgcaggagtttgtgaggccacaagaacgtattaattacaaattaagtaaacaattaatctttccagatttgccatgccaaattaatggtagccactgagatgacaaatacctggtggtgccttgattgaagctgtctttctgggagttgaggcccacacagaaaaccttatatcttgacatattttttcctttaaaatgtcatgtgccatatgtatttcttgagtcactttaggacaaaaatgttaatcactaccattgctttacatctttagaattcatgcctgctcactcagatgtcattctgagtgtcattctataatacaggctttttattttagagcagaaaacattatgtatcaagatagaagagcaattgatttgtgagagatttgtgggcctcttccaaaatggtatgaagtggactgactaatctggaaatggttaatgataattactgtaagaatttttaacctgaaatttttattggagtcctctccgtttcttttctctgtaggtttgcccaagagaatggttctgttacccgttatgaaattcccaacatatcctgttccccactactcattcttttagtaaatgacagaagctcattcctattgaacaacaatacagtacaatgcagaatgttagagaaaaagcctttttatcctgctttctttgaacacatacttacttgatcaaaattatttgtaaagaacatctttcctactttttgattttaacaaatgcaaattcagttctctaaaacttgaaaacaaacaaaagaaaccagttctgtgaaacggtacctcattcctggaaataatttataccagccccttcgttgtagggaagtctagcagctcaaagttgacgttttaagagagtatcagattatgtaaagttaaatttgtgaaggatgtatagagtctcaacactgattacaaataaactgctttgttgtaacacagagtactgcctggttcctgatgcagtcactgattggtagctgagtgatatgtgcttactccagggcacttgaatttgggctgtagttattttttttttaaatacagtagaaacttttcatttaaactttaactttgtaaataacgaagtgtgtaattaaagccaataaaatatgggtttgaatattgttttatcttattatttttgatatgttttggtatcaaatttcaaggaattgaaaactagtaataacttggccctagaaacccatttatttgtaagcaagctgctaaaacaaagcaaagatgatttctcaatctattcattttgtaagctctttgtactccatttgtacaagagcatccccatgataaggttacattctgttattccagcattgcttattaaaatgatggcaccatccaaagatggggaaggaggattgtgattattttagtttacgaatttccaagttaaaaaaataaattaatcaatcaccctcttttgttcttgtggccttcttcactctgtaagactctgtgttcactccttgactttttccatgtagatagatgattagcaggtttttttttttttttggaattccttgaagagtctcctttcctcttctttgatatcagaatctaaagcagcaacaggatccccataaaaactcgctctctgattgtcccagttcttgttgagtgctgctgtgaaaagtgacagatttcagccatgggtcagcatttacttttaagacacctgattatactggtagaaactgggagccagtaacattgtgctggtctgtgaagggtgcagacccaagtccttccttgcattctcaccatgtttggaaagctgatgatgttactagaaggtaatggtttcattaaggtactcacccccattcaggcacaagtgtagtcctctgcagacacaagtcactattcttaaaaatgatttaggaagtaactacttttctgttaaattccttttcaaaacttcaagcagtgcccatcacttgaaagtggtcttactaaacttaatgtaccaggctcctttggaagggaatgcgagatgagcctgcgggcacaaatactgctcagatgtgtatcacacagtcatttgttcctttccttgacctttgttttctaatagtggtgggtgatactttaataaaaccttgtcacttgctgaaaatagctttaacttgtcattctcatcatgtgtgttagtggcaagacataatggagcagggcccttttcagctgggaattttcatgttcattggtttgttttgctgacctatggatgaaacagagccatcactgagaagaaaaagcatggctgctagtatctagtttttaattaattaaatatttacaatggttctgtttttgaaatactattaattggcagttgcagttgtattgttatttgaaattgaccatcaaatttggactctaggctggaatctgccttgagatttctctttagaaaagacttttgcagtctctgactctgcctcataactcaccccctctctgatggaggaggaagctgtgctgttctccaacatgatggccgtcatttcaaatggttcctaccaagtcttccctctttcttcttaattttgttgtttgttggaagttactaaccatgttgtaaacctgcccagttgctgcaaacttttacatttctctgctttacttaaaacaatggagctgttgaccctatgttagaagtggtaaccatgcaagttcaattgtttaaattctgtaatgaattaagtgtcctcccaccttttgcccgtcccacccttcattttgtaatgaaaattccacttacagttgaaagagcagagaaatataaatgaagctcttagcttcgtccaattgtatgagattaacataaagttctgcttctctgctcttttctccactgtaggtggttttttcattgacagcccctattgccagcctctgagcgtcgcaccatttattattcacttgggccctcaagatttcttctctgacttctagaaccatcaggttgtctggcttgaatggcaattttatatcttggtcttaagagcaatgtgacccctaaggctttccagctttcagatccactctaaccctttttgaaatcaatgactaagaattttaaaaaagagcaatactttgtccaaagccacgatgtctgttttaaagctctccttttggacatgtagcaatatctagatgtaaacccttcagtgtgtagctcttgtcagggagtttacagaccaatgtagaatttagaatctatgtgagcagtgctatatcctctgacactttttaatcgtttttagtacataacttgagcttttacttttctgactttgccagctagcagtattataattaatccgagacaggtgtcctccttaagccatatcttttggtgggggccgacgcttcaccagaggtgtggctggcaacctgtgccccttaaggctgcaggagcgccacatctcttgtgcctcataatggctccatagatttccaacatacctcatgctgatgaggtttggtgcatagtatggcaaagtaaggggttgggttaagtagctcctgagattgtttgtaatccctcaaactgttaccctctgggaatgaaatacttaatggttttgcttggattagcattttcttttttcttcttcttctcctttttttttcttttttttttaaatgggtgaatgtttgaaaatcatgaatcagtcaccgtaattaattgaagagctgggaataccttgttaatgtatttttaaaactggtgttggaccctctgtgtatttcaggttaatacttttaagcagttttcagcacgtttatctcactttattctcgttctcctcggacctccgtagccatatcacttgtataaaataggctgagatatagtgactgtaagctgtgatctcagtattcaaaggtaagctcttttattttctgattaaagaaaacaataaccaattaacacaacctgcatatatgacaatcatatgatgtatttgatctcttaggtcttatgtcactgcattaactttaaatttttatggtctaaatgtaaaatagtaatttccagcatttgttttaatactcttgtaaacgctttatattcaagagaaacattacacattcactgagtccagtgtatgtgggtagaattgtaggatttaatgtatatgtaatttatacataacagaggcacctgcttgaatataacaattcagttgtaggaacactatctaaggagagtcaaaatgacagggcactgtcttgttcaaggagctaggatatcagaatcagtaatgctggtgacatgctgtagaattcatgtgcatttgctgcacaggctgagggatacaagtgccaatctcaagaagatcacctcctctgacctgtgttgcatgctccaatacagcaacagcaagaagccatttaaaaaagcaatagagaatcaaagacaaaactataaactgtgggaaatatatgtaattggctgagttaagctaattatttgcagaatcaacttcagcaagttactgagtctgcagaaaccaaatctgcttaaggaatcggataatctgtctgtccgtctgactgtctgtctcaagttaggaagctagaatattatttctcactgtattcagtcatgaacagagttcatttataggatatcagtattaggccaaaccttaatccacaaatacaccttattatgttagctgttaagtgctaaagctgtatgtgtgtgtgtgtatgtataaatgaattttatgctttacatttctttctatagcagtttctgttcatctctagcattaaggctgctgaaactttgttctcacacagaacctgcagttcatgaggtcggcttctgttaaaggctgtacaaagcagagcagagaagtgcagtgcactgtaatcctgttcctgctgatgccaggtcctttttctgggaccagggaacagaggctatgatcagtgcaagtatcttaagttttctgatggaattcctgatggaattggccttgttgtaaataaataccctactttggaagatagtgtattaacagtggcaaaagttattaattcatttagtagtgtaattataaaatactgaatatttgtaggtttttcaacaccacaaaattggtgttacttgaggatttcctcaagtagcatattttctctggcattcgtgatggactgaacttcgctctggttatgctactcatgttctgtccaagtgggtgttgagaagatgagaagctcagcaccactgcagccctgcttttggcatctctatgtatagtcctgcaaagaactcaatgggaaatgtaaaccctgactacattctttcaatggcaggtgaatgttactgttataagaaatcacttgctgtaattgtcctggtttttatttttcactaatgataggcgtcgagaagaagagtcagtactaagtttttcttcccaagctgtttggagcctgtaaccagggacattgtaaacagagtgacatgtgaaagcagcctactctgaatggtctgcctttcatttccactctttgaatgccccctcaagtcacctagagatagaaagatgccatgttatttagctttgttctctgcaacatctggtatcatacagctaggcatcatgattccttagtgtgactaggaggcttgtggaaggaaatgggtggagtgtcaatgagaacagcaggcccaagtacctgctgtcatgatgaacttcagcacgggtgtgtgtttctgtaccacctaacttacagagcacagtacagctgatttaagatgagttcccccttttacaaaatagtattttgcaaaaagacttttttaagtaaagaattcatgttgggttaattatataaataagtatccttttccacataccactatttcagttaggagctaacagcttccattaatgtttgaagtttttaaaaatagaattataatataaatttgtcttatgtaagatttacagcacagctagagatacagaatagaaaacatatgagaatctgggccaaagcatttctctcactccagctcatttctgtggaactcggatatctcatgactttatatattcaaagcttttaatggtacctgttacacagcaagtactctgtgaatgctgactctgctgttctgatcgaggtgggggaaggatgtgagggaagtgagactatgctggttaagcaacaggtgcatggcctgcttagggcagagttgtgcttactcctttgctcacagacttggcagaacagatttgcccatatttgtgctgcagcagttaaatcagccaacttgcagcccagggtttgtaaatacttgtttaggatttatgggtgcttagaatttcacaagggctgaccttagaccatctacctgccaattcaagtttcctacccatactttagtaataaaaaaatctacaacagccagaatcaagttttcaaggcttgtgtgtttgttggtaaagaacaagttattataggaagcatgcttaggatgctgttgactcattttctttgaggagttcttgtaccttgtgttatgctggggcattcgatttcttgtaccttatttcatgctgggacattcggtggaacacatgtacactcatcagcatatgatgccttccttctatctgatactcttagggcattactattctatttctatctctatctgtttatctacctatttggatacaattgggaagtttctttttattacaaggacaagtgtgttgatggtgaagttactgctgctcaactgagtaaagggcttgtatctaccatggaagtgctggctcacacatgcttgcaaagacttgatcacagaagagggtggacaggttgagtcccaggctggtaggaggtgagttatgtggaaacatagattgaattccaagatgctgtagttttagaaaaaactctggacaaggattaactttaaggaggccagctgaaactgttggtaggttcttcatctcacttatccaacatttgaagcaaggttcttaatgtaggtatgcatgcatacacatcaaaaaacaacccctgccaataataacaacaatcttaaaaaaaaacaaaaaacaaacaaacaaacaaaaaaaaacaacaaactacaacaaaaaaagccctgaccagttatcagaggaggatcatggcctttcttcttagaactttaccatttgtgtaagtggctttgttgcctcacaaaggggtgtcgtaaagattgcccccattgcagtgaagaggaatggttcacatcttctctttgctgctgcatggccatcagtggcacatcgcctcagcacagttgcaattgggatgttgctggccctcttcttcattcgatattctccttcctagtttcctttatacaacaactaactattccaagtagttcagttagtggcagtctttgtgtaggacttaggcttggccaacattttgacatcataacatattgtcatctacagtgttcatgtgacaactgtataaaataacactgaaattgacaggaactattttggggtcaggaagagctattttggagtgtgagtagcagatttaagaagccagattgggaatgaggaaggaacattgctagaattggtattgtgggcatatgtggcactggggcagtcttaattctcaggcagccctcctggaggtgctgttatttctgatctagacatgaatctaatattcagggttaactgctagagacaggaatgaatcccatctgttttttgtaccaaagctcctctctgctcagcaggctacaaattagaaggcagcagcgaaagctggcctgatttctaggcctcctgtattaaacatatttctgagcagaacagaatacagggatttttgcttcttgggagtggggtggggtcactgatgataaaaggatatctaacaaacagagaatgaagagaaagtggactgttgaacagaggaagcttttgtgtcgaaagcttgttttgtttggatgaagtatcaagagactgggatacctattttctaataagttcttcttcctgggaatttattctctgcttgagaaaggtaatgatggagtttgagggatttgctcctgggatctggtataaagaggtagacctggtcaggtgtagttaaggtaggtagcccatcaaaagacccatgctgagcacttgacagtttggaatgtgagtctttcctccatcttgggcctaaggttcagtgaacattacttgagagctgcaggctctgtggatatatttgcttctcaccatgttgtttacaggccacttcccaatttcataaccaattgcttaggggcaggaagatgtggggatcccaccttgccagagctcttaccatctttgccaactgacactttttctgcaaagcatgctgtgctccattgggaaataggaagaaagaatcttattctaaccaagttctagagcatcaaagtgtgaaggaatgagaggtctggatggcacgcagagcactgcagagccctctcactttctgtggtccatttctagctctaaagaaatagtgatgcaaggaatattgtttttcatggaactaaaaccccagaggtctttgcaaaccaccctgcttgtttgtggcaaaacactgtggcttctaattagtgagtattgaaccacacagaggaaattacatctctgtgctgctcttagggttaacagaaactctactaggaattggctttgaatcctgtaactgaaggacttagaagtttgctcttactaggaaagggccttaagtaaagtgactttactcaattacatagtgcttggtggcagagtcctcatgctcttgaatatgttctgcttacctggtcctgtgcattcctcactaccctgcttccttctcaaaggccatttaactcttcttctagactttgagactatacagtgtgtgccttacaaaatggaataaacagaaaccaatgcagctcttcttttccctttcctgtcctagctcatgctctccctggttcctgtggaaatggcacagtggaatatttatagtcttgtgctgttaccaaaactgtatataatgaagtgcaacttagtggatgctgcttgagagatcctgggcttttagaaatgtggtctttggggggaagttggctagtctgcatgtgcttatttaaccaaaggatcatcctcacagtggtactttctggagcagtctcacacagggatctgctttttttttttttttttcgagacaggggttctctgtgtagccctggctgtcctggaactcactttgtagaccaggctgcccttgaactcagaaattcgcctgcctttgcctcccgagtgctgggattaaaggcgggcaccaccacgcccagctagggctctgctttgtaggatctgtcatacgtactttagtctacattaagaaaaatcatggatatcctcctttgagatgttaaaacaaaagtatggagaatgtcacttgaggaacttagaaaggcttacatcacttggaaacaagatcaaaggaccaggatgtcaaggctagtgaaggggtggccttaggcaaacctgaataagtcttaccggttattttaaaggattttatttacttgtatgtggttccagaagggtgaagacaactatgagtagacaagtgggcattttgatgtgaaggtgccacatgagggcaggtgaggtgctttggaagaacagaaggtaagaagtgtactgtgggatgtgatagcatatgctgaagctatgagctgcctttggtggtgcatgaggaagactgagttcatgccagccttagctatgcaatgagaagctgtcaaaagccacaggatgtccattgtgatcacctgtgacaggactgggagacagtgctgggagtagcttctctttctttttctttttccttttccttttccttttcctttttttttttttttttttttttttttgagacagggtttctctgtgtagccctggctgtcctggaactcagaaatccacctgcctctgcctcccgagtgctgggattaaaggtgggagccaccactgcctggcttcattctactttgtaaccctctatttggctctgctcagtgttgggaatgtcacaagtttttcagcttaggaggatggccatgtatgtgtaaggtgcaggaaagggagagagtgcatggcaagaggtgtgagcagaatcagagctgtagtggaattgctaaagccagctgttctgctcttccgctcatagagatgctagt

SEQ ID NO: 26637 - DNA, 1105 bp, Mus musculus
tgttattattctagtgactaggttgtctagaagcaaatttatattttagctacacacatatatttaacacatctaattttactattgtataagagttacgacttttttagaccctgctcagttatccaatttttttctattaaaaaaagtttttattgctattgttcccagatgtccttctttgtagcttgccaaaagaaacagtgcttgtatttattttgttaatctatgatggtgtacatgttcattaataagatctgagattgattatgagaagcagtagtcactgattactttgctgaatgaattcctttacttttgcacagaatctgatgactattgatgttaaataatgttttcttaattttaaaaagaagcaacaaaattattataaaattttctgtcttataagtacactcaaatgctgctttctttttgttgttattgataattttttaagaacaccctttcaaactgtttgttttcctttatcccatttactattagaaaatgttatgatgaaagaccctccggacttattggacaggcaaaaatgcctgaatgccttggcttctcttcgacatgccaaatggttccaggttggcgctctattatttctttactgtttctgtatagccatgtgtagattatatgtggaccacttttcacttagtgtgatgtgtgtgctatatgaaatgggaagtttgtagctcattgagttattgtcagggtgaatcggttcctttggatacagtgcctagaatagctttcagtgtgtgtgtgtgtgtgtgtgtctctgtgtgtgtgtgtgtctgtgtgtgtgtgtgtgtgtgtgtgtgtgtgtgtctgtgtgtgtctggcattgtacaccacaggtcaacttcaaatgtcatttctcaggagttatacatgttgccatttttgggatagggtctctcatggggttctgcaactcaacacacaggctagtctgactggtcagcaagcccatggatcctcctatttctgcttcttcagtactgatagtctaagtggcttttaaaacacaggttctgaaggttggactcaagcctgcatacttgcataggaaacactttatacactt

SEQ ID NO: 26638 - DNA, 1138 bp, Mus musculus
ggagctgcaggcacaggcagcgatgccctgctcgctctcctggatccacttaacacagcctggtcaggcagcaccatcccatcacatcctgctacccccagtgcagccaccccattcatccctcagctcagcttccccccaacagtgacacccaccccttttgtacagacaccactcaatccctttgtcccatctgtgccagtagtaccaccctccatgcccctgagctctacaccagccaggccttttgggacccctccagcatccctagggccagcatatgcacctagcattctattgtctagttctggcttctatgcccctcacaggtctcagcccaacctctctgctctctccatgcccaacctctttggccagatcccaatgggtgcccacactagtcccctgcagccacttggccccccagccgttgccccctccaggatccgaacattgcctctggcccgctcaagtgccagggctgctgaggccaagcaggggttggccctgaggcctggtgaatccccactgttgcctcccagaccgccccagagcctacagccaaccccgcagccctctgttcctacacaggccagagacccctttgaggatttgctgcgaaaaaccaagcaagatgtgagcccaagcccagccccggccctggccccagcctccacctccgtggagcagctccgcagacagtgggagacctttgagtgagcaggcctgtgccactgtctaatactgtgcctccccaacgtcccatttctagccaggcttcatggggcaaagggactctgccccctcctccacagcccatctctgaggcctggccctgggaatggccatcccagaagagctgcctgccgccacccttggcaccctgtgtgggttttgcactatatgtcaactggaccagctgtatcctatcctcccatagcccaagaggagtcaagaagctcaaggctgctttcaagcccagctctcctcctttgctgggccccaccccacagggcagatgtcagtaacaacctgtgtaagcacagctttgggggacatgggtgtttggggggctgaaatgaggcccactcctaggctggcatttctccctggtggtcatctccaaacctctctagca

SEQ ID NO: 26639 - DNA, 1174 bp, Mus musculus
attggagcccacactgctgagtggcagcagtgcatttgtctcaagtgtgctttgtggcccctgtaccaaagcctcagaaggtgaaaacggattggaagccattgccagaagcattttgtgaggaccgtgacccaagtctgcatctcagaacacttcctcttgtgtcgctgtacagaagacaagctaccctagcactatggacgtgcttcacatccgtcagtgtcagatgtcaaaggagccaagccctttacctcctgtatagcccagcactaccccaatgctagagttggtcatttggacagaggcctggtgcacaggtggacttccccatgctcaaggtggcatcccagtctgccacctttgaggtgccaaggcttcacttcctgacagtatccagagaagccacagtcacatcctaaatagggggacacatgacctaccattcctcctcacctcttcaacaatggccagtcagcccccaacaccctgacggttacatcacatcacagactttctccctgtgcccgagcccagagtgtgagcctacactgataaatttcctctggatacacacttgaaggcatttgtttgtagaagcatacatgtagacagacacacaaacacacacactcacacttatgcgcacacgcacatggacatgcatatacacatacctgtgctccaagcttctccagggagaagttatatacctcaaccttgactttgactgccaagccagtgcttatccagacttctgctcaaaggtgtctcccgaatggagggatgtaggaattggtgaaggcagatgcctgccactcatagtccactaaccctggagatcaaccaggtgccagtaaacaaccacaaacacctaatgaacatttactgtgtgccaggtgtgcgtggaatgtaactgtgaggctgctagcacctcgcctcctctgaccctgcaagagctggaagctgccaccagcccagcagcaagtctctaggatgccagctgggcctgggccccagggggcaggggcagctgtcttggtgctaccccctggcaggctgccaattcccactgcctgagcagccagaagtccaaacacctcacagaaggtcacaaacccaattagcagagtgagaggcccctgacctgactcactgccctccccagtggattctg

SEQ ID NO: 26640 - DNA, 1179 bp, Mus musculus
tggctcatcagataagagcactggctgctcttcagaagactctggttctatttccagcatctacatggtggctcactactgtctataactccaggtccagaaaatctgacatccacttctagactctgtgggtacagacatccatgcaagaaaaaaacacccacacatatacatacatacatacatacatacatacatacatacatacaatagaaaaattgaggtaaattttaaaaagtgactttacacaatgaaaattatcatcgagggcatacagggtctggaggggagagaagctggcattttttggcccagcaaatagctgtccatctgctctctgtcagaatatgttaggagtgcatctggattgctgccccagagcctcagctccgggcgggtcatgtggtcgtctccacgacaactccaggagtgctggaaactgctgtacttggagccagatgctgctctgcacatgtggtctaattagccggggttccctgcctcctctgcctctcacccctccctgcatacactaccttttcttttccctgcctccctcctttcctagccttccttgcatcctctggctggctgtgtactctgtttgccttctcttccagcatccctgttatcctatgcaggaagctagtgatactccagacacctctgcccctgagaaagacacctctggagtgggaactgacaggtgactaggcaaggcaatgactagccccaaatgctcttgcagtggaaagcttgggtgctcaagacctacagaaggttcagcaaagaccatgacaagtgtcccatcccaagtctgctagatttttgagttaggttttataagacatgaaaaattccccaggagaagatgtggcacgtgaaaaagcagaggtcaatggaaccttctggagaactggttactggaaccaaggtatttggagaatgagaagctgaggtggggtatcaggcttctctccacctctgaactttacttggttctacaggcactaggagccagtaaatgggggtgacatggcagctgttgtgggtgagccaagccccttcagaaatgtgctgcaaagcctccgtaggactctttcattgctggatgggaaatgcttgggaaagaatagtcagaatgtgctgagaagtgaatttttgtgtcttctgcagagc

SEQ ID NO: 26641 - DNA, 1128 bp, Mus musculus
ttattttagagtgtgtcccttttactattgaaaaagttcactataaagcattctgctgtggtgcactggcagcagcctcctacatctcacttttacctcatcatccctttaaagaatattattagtacaaatgtgtgcatgtgcacaatgggaggggcacatggcacagtatgtgtgtggaggtcagaaaacaagtttattgctctctcttttcatctttcagtgggttccagagagtgaactcagactaccaggcttacgcagcacgtgccttcacccactgagtcatttcaccatctcctactccctctcttggttgacttatttttttcttgtgtttcatttagattagtgttgttttgtaccatgacacacactccacataccattgtaaagggtttggcatttgtaatagttactttttgttgctgtgattaaaacatcataaacaaaagcaagttatggacaatagagttcatatgggcttacatttccagagggaatgcccatgatggtgagcaaggcatggcagtgggtggctgtagcaagaagctgagatcataaagcagaaagagcaaactggaagtggggcaggatgtgacagatccagcctgcccccagtgatggactcccataagggctccacagcatccccaaacagcaccactaacctgcggtcaaatgaaccctatgcaggacatttttaaaatttaaaccaccatagtatgcacagcatgggctatgtcatcaatgattttccacatagaatcacatacaatgtgctcctcagcacaaaccctgttgttatatggaatatgcctatattgaacttaaacccatacatctcaaacttactgaccatgaactcttctgaagcagaggacctgttagagatgggggagaatcccataaacattttagagctatcttcctggcctgtgggaaacactgggactagataggagtagcagaagggttgtggcagtatcagaaagccagacatctaagtgcacttgcagttgtccaagatctaacccttgggaacctgctctgaagagaatctgtaccttctctgtgctgttgttaaggggaatttccacaggtcccaaagatcaagatagtgaaagt

SEQ ID NO: 26642 - DNA, 1200 bp, Mus musculus
atgtcctctaccatcatcatgagatatgcttttaaatccaggtctagcttttcaggtgtgttggggtgctctggactgggcaaagtgggagtgcttggttctgatgatggtgagtggtcttggtttctgttagtaagattcttaagtttacctttcgtcatctggtaatttctggagtgagttgttatagttgtccctgtttagagattgttcctctggtgattctgttaccctctatcagcagacctggtagacaagctctctcctctgagtttcagtggtcagagcagtctctgcaggtaagctctcctcttacagggaaggtgcacagttatctggagtttggacctcctcctggcctaagatgaaggcccaaaagaggacctttcacagaagctgtgtttctttggcctgtcacagaaggtgttagtttcagtagtccacactctcacctgtgcagactactttctgcggagtcccggaaccaagatatctcccgtggattctgaggctaaagcctcctgtgccgggtggacacctgtcttctggccgggaaggtggccagatgtctggagcctgaaaatggcgctgcctcagaagctctgtggctctcgcctgtcccagaaactgttagcttctgtagtccacactcacacctgtgcagactactttctgtggagtcccagcaactttgaccatcttactgttaattttttttatcttttctgtgagactataattcccagatttaaaaaacattttctttttcctcctctccctcctgtacacaccagcaaccatccaagttcacaaccctcccagttcacaaccctccctgctcacaaccttcccaacacagccctccctgctcacagccctccctgctcacagccttcccagctcacagccctcccaactcacaaccctcccaatgcagccctcccagcttacagtcctcccagttcacaaccctccctgctcacaactctcccagctcaccctcctgagaagctggtgctacacaatctgcatcaccacaccagctccttcaccattctcacaccacagtcctagctcctgtcttgtgaatctcttgttgagctctggctgacatgtgccttgtcacattttaaagtaggtactgaacatctcgcccaaagtaatatgctcatcagcagagcttgacagagtacagaggtg

SEQ ID NO: 26643 - DNA, 1179 bp, Mus musculus
atttcttgtccctgcttcattttactcactgtcagctgggcatactgtgttctgtgttccatctatctagattctcttctgggtaactaactgtatgactctctcctccacctggctctgctcaaatatgaactggttaggaaagccttccagaccactctacttagaatcaaccctagtctcccttgtctggtttattttttaatatgccattttcccagtgttgttacctataattcctgtcatcatttcatttgctcccctttacataggaaatttgatgtcagtattagcatcaacgaaccatagctcaacaattattttcttagtctttcaaggtctttatggaggaaaaattatgtgcaattaagtatcttttaccccaacctactatttttattgattctttgggaatttcatatcatctaccccatttcactcacttcccaggaaaaagaaaacacacacacacacacacacacacacacacacacacacacacacaaatcaaccaaacaaaaataaaacaagcccaatttgtattgcctttatactcactggagcatggtcaaactctcagtgactttcctcttcaatagatctgagtccttccctcccacactaatgccagaagccaaaagttttggagagctaactttaacatctatcacactttttgagttgtcttcaatggcttcctgtttaggctattacttgttgtggggtgaggttgaggggggagtagggatcatcacagaagccttccatgtccctctttctcatctgtgtacctgcagtcatcaatatcactgcaaaagtagcttccttgcactttatagttagtgggatcatggatcatggacttccacatggtttctggtgacagcacaaaccagaacatggcctctggcttcagtaggcccatagatccagacaagacccttggaggcagcttagaccatggatatcaacatggcctcaggtgacagcctaggctactcatataaatatggccctcagtgcagcaaagctagagaacatcacaaagcttcagtcagtggcacagactgagtatgtccacatggatcttgggctacagcatggactacagataccaacatgttctcctgtagctttacgaaccacagtggtcctttataaggaggtctaatcctctgt

SEQ ID NO: 26644 - DNA, 1359 bp, Mus musculus
gaaactccagaagctttgctcgcacactgttcttgacaagttcggggtctggatcttcctagtgacttgtcaaagtttgttggcctttgtgtccttgcctgcaaatgggacattataataaggtgtctgtcttccaggtggctgacaggatttaaaacaaaagttgttagccatggcagcctaagcttgctatcccagcacttgagaggtagaggcaggaggatcaagaatccaaggttgccctgagcaatacaggaagtttgagacaggaacggactacataagaccctgtctcaaaaacaaaacaaacaaaacccaaaccaatagagatgcaaatcagctagcagtggcaggtgatccaaaaatacagcctgcctgtcaccccttcagaaaactcaagtcatggactatgcgagtcaagaattaaaatacaactgtattatgtgcaggaaaagcagaaatatgttcatttactttttgttcctaataggattaactgtgaagactaacttataaatgtgaatttaaggaaatctaagtgctggaggaaacagtctgaattttgttcttctattccagtgggtctcactttgtatatcaagaccccctttacaaacctgtctccaaagatatttatattacgattcataaccgtagcaaaattacagttatgaggtagcaaagaaaataattttatagctgggagtcaccacaacataaggaactgtattgaagggtcccagcattgggaaggttgagaaccgctggtctatgcagtattcaaggagcacccacttggtgacaggccagtgctcctgtcttgtcaggtgatgtttaccagggctctgcacaaataagctctctggctagccaccaccctcttgagcagggcctgtactccagatacagcctctgcccggatcaagtgctccatattttagacaaattgggaagagagacggctgagcagctcaggggtggccctgactgcgtgtccgtgttttatcttggactgcagtccacacccagcacacagcagcagcataacttcttgaggtgcctttagaagcaacctgtcaggcccaaaccgtccaagtaacaccagaatattcttaagttccccaaataattctgacactcatcagccaagctgctgccctcaataaatccactgtaccctttcaagcagtttgcacaagggaatctgtcctccagtgtcctgcccagaatactgactctgagaaaggatcagagtcgctgtctcctgcccagcactaactcctgaaagttttcctgggtctttgtaagaactgtttctgttcttagaggctctgttctatctgcccttggtacaagcag

SEQ ID NO: 26645 - DNA, 1132 bp, Mus musculus
tctagagatgaggggcagaaggcgaattacatcactcatatttaatgcccaggatgtgagttttacggaagtggaagcctcaagtcacatgaccaagtagcttctagctctactgagaatggtgggatgtggaaggaaaattgaaaaacagtgctttttctattatctcttaagtattgtctcatgcacatgcgagtgcatgcatgcacacacacacacatgcacgcacgcacgcacacacccctttcaagtgtaccatttggaagtaaagggaggttgactccttgaagccccagaggtggagttctcagagtctagtcaagcctgttgctgtctggccaaaatgtctctgtcctgacctccgttgggcacttgagcagaagtctaattgcttttatttttctcattaggcttggccggtacagatgtgagaaaggcactaccgctgtcctcaccgagaaagttacccctctggagattgaggtgctagaagagactgttcagacaatggatacttcgtgaatggtgctgtgggtggttggataactctagatgactcggggtgcataccacccctaccccaaccccattctaccccaaccagaaaacatgcctttggcaattgctcaattaaaataaataaataaaaagacaaaaaacttagtgagtggttgtaatgttggaactgtgcgtttgggctcctactgacccgactttcctttctatgttccagatctttctggcgtgttagtggtgtggtcctctgaaactgattagttctttgtggcaaaaacaaaaaacaaaaacaaaaaaacagattgggtttttggttctaaagaatatgacctaggcctatatttgtttactttatcttcacttgggggtaaccccaggcacctgtcctaacagagtgaatcagtgcaaagcagtggcaaggaagtctcaggctgagtggatggcttccctacataaacaagaccctagttccccctccccaggacagatatcttcagtttgaattctcagcctaaacatgctcaggtctagagaaagatagatggaaactgggtatttgtgtggctgtatgagactggtgagctgcactctagccattctcgtgacaactaaagga

SEQ ID NO: 26646 - DNA, 3330 bp, Mus musculus
gtagtgcctccatttgtcagtttttctctttagtgaaatgatacaggtaccagcaaagtgacaatatgtcctttgatgtccaaagttcagaacattatttcttctcattcttattccccagccacttgagagagaaaaagttccagatagaatgtttttcacgtttgtgggaagatatatgtattgatgtgtctgtttctgagctcacaatattttcatgtttgcctgaatttttatatttaaccaaccagatcatgttatttggctctgggtcagattctcagctgctttcctcaagctagaaatcagagacacagttcagagacagcacctctgtgcacacagcagccttctttgcttagacttccatttatcaaattggtacttttttaaattgcttttcaaattagcattttacctgttgtgttgaatgtcaaagctctgatgagacaagaacatatctttccaataatgtagtattaaacagagcaagttgttaatttgtagagtgggggaaaggttctgcaagttgccattgtacaaatccatttttacaaatgtttgcagcagattccacagaacaaagagcccattcattgccaagagccctgcagaatctctgagccaagtggctgtgtgttccgagctggagcctgacctgtggaccgcctttaatgtcttctgcacccagtccttttatgacatgggcttcttttaaacagggtaaagtaaatgggctgctttgcaaactcaggtattatgaggagaaggtaggagtgtagctagcagcgtggagacattaggtcagccactagatgtatttgtgattttggtttgaaggacacagagaaaggttggaggaggaggtttggtatgcttgttttttgccttttttcctataatgtttgattaacaggcagccttttagctagtggaagaaggaaaaacttgtgcatgctatatctcattcccccctctctctctcctgtcctctctgatccagaccaccaaaaatactcactttgagtgagaatttttcaaccataaaaacatatagcccccaaagccatgtggagaaggagagcccacctccttgcactgtgctgaaacatagaggtttccccctgccttttcttatgtatgctttcttgacccaaggcagaagtgtggagtcttagagctttgtaattcctgttctctggctccctttaaaggccatttttgtcctttgcaaggtttggtagtctcacccttagttcgatgaaattccctacaactcctctcaaagcactctacctgggtccggacacccagtccccagggccaacctacaagtgaaggagacaggtctctagggtagagggaagcaggcaggaacctccctgtcctgatcttagaacagtggaagtgaagaacaccccacactctctagctttagaatactggggttttggttttggttttttaaattgcagttgttttaagaaattcaacctttcagaccagcccttccactaaactttgattctttttctttactgcttttttaaacctaaaaaaaaaaaaaaaagaaaaaaaaaggaaagaaagcaagcgcactcagtgactcccccaccttggtctgtgggaatgcccgcccgcactctgccgtccatcctcctcccttctcctcatgcagtgtctgtgaagtagttttatctgtttcttaggatgaaaaacggcaatcatcccaccaggtgctggaaactggtcagccttgaagcaggcacttctgggaccacagctcagggatgtgtatttaattacagggtccccagaaagcctctcttggctgccacaagtagcatctttcctggacttggagtcagaccctgacaacttcctctgagtgagcagccccaggccactgaactgaacgcaagcttgcctatgggtctgggcttcctcaagacttttgaccgtcttacacgtgagcttctctagtgctcatgagaagcctagaccctttgcccagggtcttatctggcagtcctaagtacacccagctcgcttgggtatcagctgtaggctcaaatggaagctgtgggaaaggctaaggcctgctccaaacccaagaaaaatgtgctactggtggaagctagtcttctaacctggaagccagccaaagggttctcttgctctttgctgacctttttcttagccgaaatataataggtgataatgttttttactcaaatttccatgggggaaaaaagactacctcttgagtgacatcctggtcgattcctctctgaggagtcctgtgggaaaagaatactgtagctcccgtgctgtttacatgtttctgtcgggaatgaaaccctggactgttgtgtttttgtctgtgttgccatcccaggcctgtgataggagcttgtggctgtattgtaatgtctgggcagtgtctggggagtccttttcacctgcccaaatagggacaagccatcgctagaagaggcctccacccccttcctatgctccatagcttggatttcagggactctgatggcaagtgcatcatgaacctacctcaggctacctcccagtcctcccacagtcctatgtaggaatcgaatgaatggatgtctctgagcccttgttcccaaagggccggccaagggctgcctgccagcctggctccatcaaccctgcatgaccaaatgatagttggcgggctctgcaggctgctcaggccctctgctacctcccacacttgcctgctggcaaggggtgggccctgttctgtgaattgactacctgtggaaatgtgaccaattagtatgaaatgcatgtttagcaagtattaggtactgtatttgaaccaataaatgtgaatcctctgcacatgccatctgtctgtgaagcttatcttgggctgggggagggatggcctggtgtcctgaggcatggactcctgctcatagtcaacaccactcccatctctgttactgagggcttgtaggaaatggtctgctcctgaacctcgggagccagtgcatgcctgcagccggctgagcactgtgctaatttttcataaacccagaccaccatgagttttgaggactattgactctttgtaaacaaagaaaccaaggatgagaatgatgaaaaggcttgcacaagtttctcagccagaaaaaggcacaaccagggggttctagatgggagatacacagaccttagaagtgctgtgaggagagtattgggacttgggattggtacaggtagtgaggaggggcttcccagatgagaaagtctccaagctgagaactatccatgagggtagagtca

SEQ ID NO: 26647 - DNA, 1727 bp, Mus musculus
acccttgtggccgtctcagtacttctgatacacttgccctcatcctggaccaaggtgatcagcagcctgagtggagacaaagcaggctttccttccctcctggccgctgctaactgtctcttccctttacctaggcaagatggtgaatgtgcccctggagcagctgcccctcctctttaaggtggtgctgcactcctgcaagacaagtacggtgaaggagtgacctgtgccctgcacctccttgggccacccacagtgccttgggtaggcagcacaggctccagaggaaagagccagagaccaagatggagactgtggagcagctacctccatcacaagaagaatttgtttgtttgtctgtttttaacctcatttttctatatatttatttcacgacagagttgaatgtatggccttcaacatgatgcacatgcttttgtgtgaatgcagcagatgcatttccttgcagtttacagaatgtgaagatgtttaatgttaccgtgttgtcattgtttagagataggtttttttgtattttgagggagagggtaggatggactagatgagtatttccataatgttgacaaagacaactacctcaatggaaacaggtgtatgaccatccctaccttttccacattttctcagcagatacacacttgtctgttagagagcaaactgccttttttatagccacagacttctaagtaaaagaagcaaacaaaggagcgaagtggtatagggagatttactaatggccagtgggacatctgagaggcaatttgattttgatcatctcatcccacaagcctgaagggcagaaactctgccttaccttctgctgcacccctcccccacacgctgttgtctgttgatgctgctgtcaagttttcatccaggtagagtcctaacaataagccagtatgtaggacttgcctcccagcgcccttgtagctcatagctgcctagtttgctgttctagatctaccaaggcctaccttcttcagaccccatccctacctcttatgaatttgacttcctgtcagtcctttagaaagggacaggaaaatgccatgttctgaattctgatgccatttctgatttgttttttacattgtttccctcaaaaggtagaggggcaaagaccaggctgctgaaagaataaagacttctttggaagtcgctgttctcacccaaccttatcctctgaaccaaatccaaaatccaaaactgccacttttaaacagtagaaaggaccagaaactttgctgcaaatttttgttgtaagttctcccattagtcccaaaatgagatttgtttgccagggtctagaacagaaagtcaagacccagagaagcccagctcttccttcaagtattatcagggatctaacctaccaaggtttggagggatggagccagaaagacctagaaaggaaaggggcattaaactacctcatgtttctaagggctaggctgctgctctgcagctgcagcctgggcccctgtgctttactgcctaccccatctagttctaggaagagtttttaccctccagactttggccagaccaactaggtttgtcttagagctgtttcagctgcttttccctttctttgtaccaggctctcctaccactagtaccccagacacatgctccactggctggtatctcgtgctgggtctgcctcacccacagtatcttttttagcctgttttgtcaggaac

SEQ ID NO: 26648 - DNA, 1135 bp, Mus musculus
ggtcaccattacagtcactaagcagtaactgaagcaaatgctggccaggtccatggccctccctctgtagctacttctagtccccatgttccttgcacattttgcagcagatgagaaggtataggcagctcagctctggcaatgtggggtgctagcctcagctcccctgtcctcctgtactagaagccctcgccttggccatccactaggttactgctccttccttagcccttctcaaagccttgggcctggggtattttctgggccttcaacgctattctgttcacactcagggattgctaggagtaaggcctttgtcctcagagtgggtggccccaagatggaacaggctctgtctcctttgttgatcttaatctgatcatttggtgggctgattcagcagcctgagaatctgagggagacaggacaggagttcagaagagacttctcagcttccaggataaaacccggaggcagaggcaggggagggtagactgggctctcggcaccaggattttctttgagatgggattgtggacacacaagtgaacatatataagctaccttaaaataggattggcagctcgatgatctggtaccgcttgtgaccttcagacccagatagccctaagaacatgacctttcaagccagccttatggcagctttggacattctttttaaagctggagagaagttcttttgcccatctctttgttttaccaaagaaaatacaggtcccagcagttctagggtatgggcggagccatatggggtggggtacagctgatctcctttggtaaagccctatactgagacagttctgcctgcaaaagcaactgatccccagtacccttgaaggtgtctactgctgacccctaccctgctcctggaccctggagacttccttgtgccctgaaatgaaatcccactaaggccgctatgccgtgctgggaagggagatgcaggttccgtgcagacttcctttcttccaggcattgttgggtgatgttttacttaaggaataactcactcctgaaataaagagggacagtgacagccagcccagccaggtctgactcacagtggtagccacatccagcttcccccacccagctgaccaccacgggctcctct

SEQ ID NO: 26649 - DNA, 1379 bp, Mus musculus
gtcccaagctagttctattacttcaagagctggaagcttttgggaaccttgactctaggacagggctctctctagaacttgatctctttcagcaagcctgtgacatagtgggattgaggtctgggaatatgtgtcctcatctctaggtgagtaaagctccccgctggccagtcaggtaccatttgacatgtttccttttcctgtctccacaggccttagctgtaggaggactaggctccattataagagttcttacagcaagaaagactgtttaaaaaaaaatcctgttaccttgagaagaattttggatgcccaggctggtgaagaagggactgacaatggaccatcttcctagaactcccaactaaatacttcaggacacatcttctggaatgtattttacttttgaggtggagggagaaattgtcttattgattcctaaattctttgcaggatcagaatgtctgcctttgtctacagagttaacacagaaccaacacttgactatcaggctgactggccagattatgtcaggtgtacctgtgagcactgtctgtttgaaatggggagggactgtttgggcaggtgcagatccacaggctgtggtgaaaaggagagcttgggttctgaagcggaaaaacctgagagtttgtacagacatcctgtcttctcagagaagacaggctctcttgggttcattgtaaagtgcctgctgcatcaataaagctcttggcttattagtctattcatcgcggtgtgttctctgtatgttaagtgggaaaagaaagggttagtaatgaatgatgatagttgggtttggaaagctgatgtagaaggagtacaggtgtccctgtcctgccatccctgggggagggggaaagcaagcagggcgacgacacagctgtgccatatttcaactacagaggtgctggatgctaccgagagaccttttgctgagtgtttatttttcttactcttttgatttgtatgtaattttggagcttatttaataaagtgccaaacctttaatgattgaggcttcaaaagtcatccatttgtgtgattacaggtgtagtcttgggcaagttctggtcactgtctcctaatgtagggtctgttttaaaccccagtaatagcagtcagctcttagtcataagcaagtgctcctgagtacataattgcagcttaaatggtggcagaggcccccagtcatattcctgcagctctgtggccaaaacaccactggccctgcccttcctagatcctctgtagaaccgctgatgcttgagaggtaagattagcccatggatcattaaatcacatatttattcacctttaatctgaggaacttgctttcttttgaaagacaaaaaaatctg

SEQ ID NO: 26650 - DNA, 1171 bp, Mus musculus
tggtacctgctctctaaagcagtagtttctccagctttgctctgaattctctcatattaccactgagcaaatgccagtcacacttctacttaagaataacctgctgaattcaatggaagcaggctgtccctctcctaccctcgttatttctgatgacactacattgatatatagcactcaggcagcccagctgacttccacacttgatagcacacatgcctccgttttagctgatagaaacttacattcatttttacacttgatctggataagccacatcagatcccaagggaagccatttgattgagtttgatgaaagtgtttcactagcgagtaagccaataattggagcttttaaagttaccatgtatctaggtaaatttatgttcttcagcttaaaggcaacatatgcatgtacatgcatataatgtgtcatacagaaatcgaagttttgtagcatttgccttctaagtctaaatcaggatggcattgctttggctgtggctcttcttacaggagtttccctttagggtgccacttcccatttagtggggacatgaaactagagccccactgttatgtgattttacagaggaagatgtagcttctccaagtaggattccttcccttcctcctgtcccaggtaagaaaccccagaggactgaacagtccacagccctccagaagcagctgcagttccagctttggaagccctttctacaccttaggtttctcaggcctttgagctggtatgtccgtctgtctatctgtctctctcacactcgagcacacagacacccctgcctgcaggttgtgttgtggctgtggggcccactcgtttagaatggctttcctgctgcatgttgagctcctccagcactaggagagtgcagtagctattccaagtggcttcatgcactttacttccataaactttataagagacagtgtgtagccctttatagatgagcactggactgtgatcttactaccaatgtaaatagggatagtattatctaaaaactgctgtagcagaattatttgtggtgcaatactttttgattaaagctcttcaagatgcaactacagtgagttttacttgataaagctcaaggtatgtttattttgatgtgtcaaatgtaatccttcggggttttgttttggttgttgg

SEQ ID NO: 26651 - DNA, 1143 bp, Mus musculus
agacagagagtgtagtgattgttgggtgtggatgatttcacctcttgattttgagcatatcaagaacagttctttgcaggaaatccaccagtattcctgccttctctatataatggcattgcctctttgtggctgatttgacctctagtggtgcaagatcagcttccctggtgctgggattacagggatgtatcatcatgcccagcttattcgttttttaatcagtaaaaatgaaaattgttacctactcttattataattaaatccttccttgttctccccctcgatttctttccctctcccctctgcccctccctccctttctttctgttgctcactcttccccctccctccctccctccctccctactctctctctcctctgacccctaaggtctcaatatatatatatatgtatatgtatatatatatatatatatatatatggtcgctcattatgtaaccatttatcagttatcagccatttatcagttgagagcaacaccacttgttgtcttggtgacttttcaattgctgtgataaacaccaaggaaacttataaaagaaagtattaaattaagcttaaagtttcagagggttagagttcagcgttcatgatggacagtgaaggcatggcagaaagaacagctgagagatcacatatccttaaaattaaacaaacaaacaaacaaacagacaagccaggaggcagagaatggtggttgctggagctggaacatgcatggcctctttgttcaattgcatcttcaccctttctgttttcaatggtttccttcactgcctaagcttggctgtcttagaacttgctctgtagacaggctgcccttgaactcaaatatctgcctgcctctgtctcctgagtgctgggattaaaggtaggtaccaaaacacctagacacacgctgtgcccttcatttctcataaaattgaagtttaactgggtggtcctgccctgaggacaccattcccattatttcatttaacaccaggctttcctttcatctgcttagctccattccacttcctggtacccctttctcctcaattcttactttttacttgctcagcttgctccttttcattatagatcttcttaagagtgaacataataacaacataaca

SEQ ID NO: 26652 - DNA, 2608 bp, Mus musculus
tttttctttcttactttttcttttctttctttttttttttttctttttcattttctttgttgagtttttgaccctttggttgagttaaatttcaattgaaattcaatatttttttaaaaaaatcactaaattgtgcctaaagaacataactgccatattaatgtttttatttctatagtattagaaaaacatttaatacttgtagcattgatgtgttgatttgataccagttgagtagaatgtgctcagtccagtttacactctgtcatgagtatcatcaagtaaacacatgtacttttcaatagcaagcattctctcactgtaacccttgaccttaacttttacaaagtattcagtttttaactgcaattttaaaggctgaacaatcagaacccttgtgtttgtgaagtataatctgaagcagattatttaaagtttaagaagaaacagactgttctcttgtgaaggtctgtcataccatatttcagctttgtgtttgtaacttgactatctaaagggttgtgatgatcagttcttgatatataattgtccattaataaggacaagtatatcattatctcttatgactgtactcatagatgattttgggatataccatcttatgaaattgttggtatccctttataatttcttgtcatcctaggaaatccatgtgaagtcgattgataaagcactttagcatctgttcaggtagttttcaaagcaacttttccccttcaggataagaacttccaggttatctaaaaatgcaataaagatcttaatagtctaagcttcttggcaaataatctttcatcagggtttcttttactcaatgagcacaatattattttgattttatttgtccccaaccacccacctccttgtacagtttttaattgtgtagctctgtgaaaaaagtggctgagacatttgatacacacacttgaactaatagtggatcggtagctttgtgctactgtcctaaccccagtgtaattcaggtggaaaggtatttttatctcacaggaatatgtagctatgtattttactaattgtgaaacactggaattaatgatgcagacaacttggtgtggtttttgaacagctctgcagtattttcttgatcatgttaccatgaattgtatttaagtgcttgccctcctgcttttaagttgtaccagttaaaccagtaactctcaatcccctttccacttcacactccttagcttagttgatgtagttgttttcattctccttgtaatgtgacttattttcaagtcatggtgtactgcatttgtttgtcactagctgggcatgtgccaataatattctgtccattccttaactgccatctctgttttgcctgactattcttccactgataatggctttggggcatggaaaaagtagtttttgctattagacttgtgaaggaaagagagagtgaatgaatgtattggactttgtaagcctgaaaaagaatatttggatccctctactaaacaagggctatgtattatacagagtaatcttgtgggagatacttgcaagccagagatctgtaggcgagggaatctgctactccctgtatctaggccgaatgtaaaatcccttatgttgtatcaatggagctaagaactatttttatttgcctgtgatattcttggtttctaataaagtgttctaggctccagtgagaactgtctactttgaattgccatctcctccctttcttcattggctgatagactcttggctagctttccataggtcaatgcttctccctgaagaatctcatttctttaaatgtgttcactcgtgcgtgatcctaaaaagccttgactacatctaatatacagcctgtaccagctcctgttctatctggatatctagaactgttggaagattttgacatcttaaatgctgagttttgcttttgaaataaggttcaaaatgttcgttgcatttaagatctgtgtgtgtttgctctgtaaccccagctccgggtgttggaaaatgcctgtactgtgaaagcctgccattgtcagaagtagaatcacttttgtcagattccagaaaattatgtacagagttaaagagatttaactacaagatttatctacaagaatccaaatctttcaatgtcactgttttctaaatgctaatgtttgtaaagcaccttcagttctttgaatgaaaggtgctgcattccctcggtgtcaattaataaaaagattataggaagtttgtgaaaaataattttatctcatgcagtatacagaattccctgagaagaaggtagcatttcatgtaatttatgtgttcaaagaaatgctagctttttcacttggttgcctgactggtaaatagaactaaccttttttctcctgcatttgcctatgggctaagtgttccagtttcttaaaagaagtatttactgttcaagcccagatcctgtgctcagtaccatgcttcatgaagtcgtcacaactattttaattgtatatttagagttgtggtaatgaaatgaaagtaagttaatcaaaaccaataagaaacatttgaaaagtccctagaacaatgcaagtttccttcattgcatgaa

SEQ ID NO: 26653 - DNA, 1220 bp, Mus musculus
tgtttcaaaacatttcttaagtgataacttgttttattacagaaaggattatgggtattttccaaagatgtgttcaatcgagtagtaaaaagaataaataaggaaaaacaagtcagaaaataagttaagttggaaccagcagtgaaaacatggaataaatgctgcaatggccgggactctttctaaaaattagacacttaggcattctagaagctgactggctaatattagaccatgagttttttgttttttttttaagacaatgtaagccaggggctactcaaggaaagcactgtccctgatagagggaacagaggcattccttcttaggtcttccctacaggtttggtcaatctcttgtgtgtcatgtttatcgtccacacagtaatacactccatggaggctttattcagtagtgagaacatgttactacagattggttgaatgacattaaagtataattcagaagaaaagaacaggtggaaaaggaaaattacttttaaaattactttaaagcaagtccttggaagccatgtgtggtaacacacacccagcactcaggagtcagaggctggcagatccctgagttcgaggccagcctggtctacagagagaattctggtctacagagtgagttctgaaaccctgtgttaaacaactgtcatcagaagaaaatgagaaggagaaagaggagtaggaaaggaaggaaagagggagaagtagtagtggtggttgttgttgttgccaccattcttggtgttcatgtaattttatcagttattaaagtggaagaaaatttgcatactaataaaatactaataaaatgaatgtacttgtttataagtctagagagaatattggatattgtaagacatcttcagctttttcagagttgatggatattttgatgttataatgataagaacaccactatataaatacatagaattacagaactttttgagaaactgttagaaattctggttctgtcttaattccaaaccaaagttaacttatttaagaaatgaaactaaagccagacatggtgttgtatgcttttctgcagtgtgcttatactgactgccttgcccaaatgtttccttatggagactgtttttattacccttcattttccctgaaaagcttgaggctaactgtaagctaactgtaagcctaggatacttgttaattcagcagtgcggccaagatctgaccacagt

SEQ ID NO: 26654 - DNA, 1180 bp, Mus musculus
tgtgcaggaatagaaaccctgactaagacaaagggagaagaaagtgggtcaaagcccaaatggttatatttagatgatacctcagataataaccattgctttgcatacagttttatttaccagtgccatgccaatagcagataagttcttacacgaaacatctagtcttttagatatctgaaagtgcttgatacagttaaaggtacaggtagtagaataatattttgtgtatatagttttttaaactggaaaaatgctgtgtgtagaaatagaattgttagcccatctctgagaacagtgtacaggctgtgcttgttcagtggatcaaggaggtgggagggaaggaactgcaaaaaaattccatttgtatgctagacatttctagcttacccatccccctgtgtgttgtgcgcatctcatgtaactttgctatgctgtatatattgtacatactggacaaatgagtcctatgatatctagtctctaggtatgaaagaggttgcccatgtatgacaaaagtagttagtaaactcacacattctgtttactctgttagttcatagcaaggttgtcttctgaagagttgtgaaagtatatcatccaagtgattgtcacaggacacaagatgggctgaaggggaagaaagggcagagaccagaatgtcctcaccagaagacacattgaaatctaactagttacatgcgtgtggtttcagcactactacgtatataggggacaaattcatgtcctcatctgaaacatcttagtccttctaggtgtttagaagtgcacaaagtatgttaaaagtagacatagtaaataatacatgttgtagattctgtttaaactcatggtgaagtgctgtcttttggaactagaaagagaaaccgcttctgagcaatgcagccttgcttgcgtaggtctaggagggaggaagaaagaaaatgaatgaagagcctaatgctgatgcaagtttggtaatgcaaggttatccattgttccttttatctgtgcatcttactttgcaatgtataggaaacataggtccaaatttgcagcacccagtcttcctagactgtaaagaggtgccagcgtgtgacaaagtagagttagtgaaaagacatatttataaattatgttaaaatttgtaggaaaaaaacttaaaaccacttaggaagtg

SEQ ID NO: 26655 - DNA, 1129 bp, Mus musculus
tggataacctcttggcctttgtgtgtgacatccggccggaaatccatgaaaactaccgcataaacggataggaggtggaagtgcctgctctgtgggttggcatgagatctgcccccatagaataggaaaccttcacagagctggagttctgttctggaaggcattaaattatttctctatgctgttgtaggacccttcactttttgagagtatcaaatctagctttttgtacagacttcttatgtacctgaagtttcatcttcttatcttgtgtgtctttaaggagtgtatgtcacctgttttcctgtgtcttcatgcaagtaatcgatatcaatgttgacttttttttttttttaattagcctagtaggaaaaattctttgaaggaagaaggggagtaaactgttcccttctcctttcttacaggtcaggggcgttatctatgaaaaagtagaagtagctattagtaactcctgtgaagaagcagccagccttagagtactctagcctggataatttaggacagtcaatacgatatgcttgttccggctgctgttagtgtaacctaacccaaatcactagatgctaggacttaacttgttacatgtttttggtgtgcttataatcatttaaaagtaaaaatttgtcttgcttttcaaaaaaaaaaatgggtgtagagctaaacaaagaatactcaactagggaatacctaatggctgggaagcacctaaagaaacgttcaaaatccttaatcatcagggaaatgcaaatcgaaacagccctgagatttcccctatatcagtcatgatggctaagatcaaaaactcacgtgacagcagatgctggcaaggatatggagaaagaggagcactcctccattgctgaagggattgcaagctgctacaagcactctggaaatgggtttggcagttcctcagaaagttggacatagttctaccagaggacccagctatactactcccaggcatatacccagaagatgcaccaacatgtaataaggactccattgtgttcatagcaggcttatttataatagccagcagctggaaagaacccagatgtcccttaacagaggaatggatagagaaaatatggtacatatatacaat

SEQ ID NO: 26656 - DNA, 2179 bp, Mus musculus
tcctaaacctgataaacagcttcagtgcagtagctggatataaaattaactcaaacaaatcagtggcccttctcaacacaaaggataaacaggatgagaaagaaattagggaaacaacacccttcacaatagtcacaaacaatataaaataccttgacgtgactctaactaaggaagtgaaagatctgtatgacaagaacttcaagtctcttaagaaagaaattgaagctttttcgcaacgggtttgcggtcagaacgcaggtgttgtgaaaaccaccgctaattcaaagcaaaaatgggaaaggaaaagactcacatcaacatcatcgtaatcggacacgtagccagctgatctacaaatgtggtggaatcgacaagcgaaccatcgaaaagtttgagaaggaggctgctgagatgggaaagggctccttcaagtacgccggggtcttagacaaactgaaagctgagcgtgagcgtggtatcactattgacatctccctgtggaaatttgagaccagcaaatactatgtgaccatcattgatgccccaggacacagagacttcatcaaaaacatgattacaggcacatcccaggctgactgtgctgtcctgattgttgctgctggtgttggtgaatttgaagctggtatctccaagaaccggcagacccgcgagcatgctcttctggcttacaccctgggtgtgaaacagctgattgttggtgtcaacaaaatggattccaccgagccaccatacagtcagaagagatacgaggaaatcgttaaggaagtcagcacctacattaagaaaattggctacaaccctgacacagtagcatttgtgccaatttctggttggaatggtgacaacatgctggagccaagtgctaatatgccttggttcaagggatggaaagtcacccgcaaagatggcagtgccagtggcaccacgctgctggaagcgttggattgtatcctaccaccaactcgtccaactgacaagcctctgcgactgcccctccaggatgtctataaaattggaggcattggcactgtccctgtgggccgagtggagactagtgttctcaaacctggcatggtggttacctttgctccagtcaatgtaacaactgaagtcaagtctgttgaaattcaccatgaagctttgagtgaagctcttcctggggacaatgtgggcttcaatgtaacgaacgtgttggtctaagatgttagacgaggcaatgttgctggtgacagcaaaaacgacccaccaatggaagcagctggcttcactgctcaggtgattatcctgaaccatccaggccaaatcagtgctggctatgctcctgttctggactgtcacacagcgcacatagcatgcaagtttgctgagcttaaagaaaagatcgatcgtcgttctggtaagaagctggaagatgggccccaaattcctgaagtctggcgatgctgccattgttgatatggtccctggcaagcccatgtgtgttgagagcttctctgactatcctccacttggtcgttttgctgttcgtgacatgaggcagacagttgctgtgggtgtcatcaaagctgtggacaagaaggctgctggagctggcaaagtcaccaagtctgcccagaaagctcagaaggctaaatgaatattacccctaacacctgccaccccagtcttaatcagtggtggaagaacggtctcagaactgtttgtctcaattggccatttaagtttaatagtaaaagactggttaatgataacaatgcatcgtaaaaccttcagaaggaaagaatgttttgtggaccatttttgtgtgtgtgtgtgtgtgtgtgtgtgtgtgtgtgtgtgtgtgtggcagttttaagttattagttttcaaaatcagtactttttaatggaaacaacttgaccaaaaatctgtcacagaattttgagaccattaaaacaagtttaatgagaaaaaaaaaaaaaaaagaaagaaattgaagaagatcgcagaagatggaaagatctcccatgctcatggattgccaggattaatatagtaaaaatggctattttgccaaaagcaatctacagattcaatgtaatcctcatcaaaattccaactcaactcttcactgagttagaaagggcaatttgcaaattcatctggaataacaaa

SEQ ID NO: 26657 - DNA, 1197 bp, Mus musculus
aggagaactgtattaataggcaataggagccattaatctactttatctttaaacgtcttgttgctctaacatgactgttttaactgtgactttgttaggtggggtgcaataacatgagagatagttaccaatttccacagaaaactgagcatattttatttatctgcagtgaccaaagtgtcagttctaagtaacatgttttattttaatattataaactatttaaaatgtgtttaatcatgcttggttctgttcagtgtatgaaacattaaatatgtacattttataattgaatatagacatgcagtttgaatatacttgttaaatgagtaaaattatatcaattttagtttttcttctttctaactgcttaaaatatattcatcccataggtttggaattatggttaaaatggccagctttaacttaatatctgccatttatctagataaatgccaagcacctccaacatatatcacattttatgccttttaaaaataatgtgtagcctagacaagcttggactcctgttcctcatgccctcatgtcatcagcatgtgcaccaatacagccagcttcttttatactggttgttgttgttgttgttgttgttgttcttgttcttgttcttattgttgttcttgttgttcttgttcttttgtagttgagaactgtctgcctgctgtgagagggttcacttaatttctacctttgagaatattagaattctaagtgacacggggaaattattttcagcttacaaaaacttcaaaagcctaaactggtgacatgagagcaagtgtgacccaccgtactgggtgttttatagaatgcagcagttgccattgcttttgatttctctcacatttaggttctgcacataatctttgagagatagttgtggtgcacagctctcttcctcatagttttgactagtgtcttagagtaaaagtatagtttaataattattgaatacatataaatgagtaaatgaaggaataaaagtgtaaaggcaccctttatccattgttggtgcacaactatttactgccttcaaaccagctatctaaactagtatattttatgggtcatcgtaacaaagccttgctttagcaaactaaaatcctcacttgtcttattaaaactttccaacccaagaattgatatgtgtctatgtcttctctagcatcagctcaa

SEQ ID NO: 26658 - DNA, 1193 bp, Mus musculus
aaagaaaatttcggaaataacagagaataagcagtatcaaaatttccttaatccaacaaaacacacactagagttacactctgcatcttctagcaagcattctgatgacatggggatttcatgtgaaggagtcgagtgacgcaagggtgtgtaagaggaagtggtaatttttagtactgataataaagtattttgtatgcgaatcgagaggattgcctatatcgtgtacaatatttggaagatattaattaaaaaggagccaggaaaagatcccttttttttcaaaaactaaataaatttgggttacagggagattgatgaatgtagaagctaaactagaatggtaattgagtatttcagaaaaatgtacatatatatatatatatatatatatatatatatatatatatatatatatattcaatttatatatacatgtatattcaacatgcacttatatgtgaattgtttcagaaatggtctcatgaggtctaagctggcctagaattactatgcagattgtttatgaaattttggggggctggtggtggcacacgccggtaggatttgctgaaggaggcagaggcaggaggatcacgagttcgaggccagcctgggctacacattttgggctggtgagatggctcagtgggtaagagcacccgactgctcttccgaaggtctggagttcaaatcccagcaaccacatggtggctctcaaccatctgtaatgagatctgactccctcctctggagtgtctgaagacagctacagtgtacttacatataataaataaatctttaaaaaaaagaaaaaagaaattctgatcctccttgtcgtacccgtttgttttaaatacattacattttgaagtcagaagcagtaataatagataaaaagcatagagagaagtttaagaaattgactaaacaatatttgcaaagtagataaaagaagtacccagcaatccaatattgaagtggagcatataggaattgcagaaaagagtagagggagaccatgagttttacttatgtcaagtttcaggggtctgaggaattagtcttcaaggaatgttcaaaaagaaatgggaaaaaagaggggggggggatgaaactaattcttggaagttggaagcctatgaatttgagacattaaaagaaaagctaaagtggctatttccctcaatgaa

SEQ ID NO: 26659 - DNA, 2309 bp, Mus musculus
caagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggatcaacattatgaactaaccagtaccccggagctcttgactctagctgcatatgtatcaaaagatggcctagtcggccatcactggaaagagaggcccattggacacgcaaactttatatgccccagaacaggggaacgcaagggccaaaaagggggagtgggcgggtaggggagtgggggtgggtgggtatgggggacttttggtatagcattggaaatgtaaatgagctaaatacctaataaaaaaaattaaaaaaaaattaaagataaaaaaaaaaaagtatgtagccaccctgggcgtggaggtacacccgctcctcttccatactaacagaggacccatcaagttcaacgtgtgggacacagccggccaggagaagttcgggggcctgcgcgatggctactacatccaagcccagtgtgccattataatgtttgatgtaacctcaagagttacttacaagaatgtacctaactggcatagagatctggtacaagtgtgtgaaaacatccccattgtattgtgtggcaacaaagtggatattaaagacaggaaagtgaaggcaaaatctattgtcttccaccggaagaagaatcttcagtactatgacatttctgccaaaagtaactacaactttgaaaagcctttcctctggcttgccagaaagctcattggagatcctaacttggagtttgttgccatgcctgctcttgccccacctgaggtggtcatggacccagctttggcagcacagtacgagcatgatttagaggttgctcagacgactgctctcccagatgaggatgatgacctgtgagaaagtgaagctggagccctgcgtcagaagtctagttttataggcaactgtcctgtgatgtcagcggtgcagcgcgtgtgccaccttatttagctaagcagatcgtgtacttcattgggatgctgaaggagatgaatgggcttcgagtgaatgtggcagttaaacataccttcattttttggacttgcatatttagctgtttgaacagagttgtttcctttctgaatttcaaagataagactgctgcagtcccatcgcaatatccagtggggaaatcttgtttgttactgtcattcccattcttttcgtttagaatcagaataaagttgtatttcaaataatctaaacaagtgaatcatcccttgcttattaaagccactaacacgagggagcttgtgccatattatagtttaaaatgcttctgctattacctgaggtctattcagtttatgttctccttgtgcctaccttcataaacatttagattgtctgtgactcagctaggatgatatctgccctacctgcatttagccaggtagtttaacctacgagaagactttgtgtaaaactaaagatttaagtatgtacgcatcagatgtttaaggattgcagttgacaatttctgtaacctaggccttcagaagttagaactgcagttgacagacagaagcttgatggttttctgagatggactacatttcttcatttccatgtctaatgttggttctctaagatgtcctctgctttcaaatattggctcctatattgagtggtagtctcaggaggtagaggcaggaggatctcttgagtttgcccccaaccttagtctacagagcaagttccaggactgagagacccgtctcaaaaaattcatggtaggctgttacaatattacagcagctgatcttttttttctcccatagggtttatataggttgtgcaggagaggaaatgctagggctactgccgctgaggagtagggtgggcttctctgatgtgatagtgttagttgagacttaggtgtgtgatcccggcacaactgtgttgctcagatgtatttacagcaagccattctgtgtgctctgctggtccagtctaacaaagttcctagaagggtggataccttcacatagttgttggtgtttgttttgtttttttttttctccccaaagaaggtagatgacttaaatacagtggggaaggtggaaggaactcatactgtgcactagcttcagcagactgattgcaagactcaaatttgatgtatgtgctatgctatgatcaggtgaagaccctctcccctgactgggatgaaa

SEQ ID NO: 26660 - DNA, 1124 bp, Mus musculus
tcccttggtaccctccacccaccatgactactatagtctttcctccttttcgtcctcagggttccccaatctccaagaagacagatcaggtggagatttccaatttagaccctctctccacataatgtctggctatgggtctctggaccgaagcctctctgatgactggacaagtcaccattctatgtgtatagcagaatatcaataggaatcaattcaatgtttttttttttttaaatttttatgttttgcaagctgtgtttgtctgatctatccaatctgctggttcctatccttccaggcagtataaggcatggactccctctataggcatggacttcaagttaaacagaagattatttggccactcctacaaattctgtaccacaattgcctcttctgatcttgttggcaggacagactttaggtctattgttttgtgtctgagttggtgtccaggttttttttctcctcatcctgcagagtaacttttaccacaaaatagagtggaacagaagggtgaaggctacattcaagtaccagctgggcctttctatgttcaatgatctgtgtggatgtgcaaagagtggtggtatatctgagtcttaaggtcaatttatgtccaatgctctgaagaactggtatgtagggaaaccctgctaattaaggttaccatgatcggatagttcttcagagctccacataaaatggaagattctctttagtagcagagattcattttctctaaccttgtttggggatcctgactctctatgcccttacatgggaaaggttgaatagtccttgtcagacctacaaacttccttttctccccataagcaccaccctctacccccagctcctgccccaggaagtacctgggattcctggaatgtctttccacacaaatgaggcattcaaggaaagtaaaattctaaccaatgattttcatttattcatttaccctgaaaactcttccaactctctaaagtccatatatatcaatggttcacaccaaataaagtgtgaacatataagcccaccgtgaataaacttatacatataagctaagataatataagaccgctgtttcactaaagatgggtggagaagcccttcatcta

SEQ ID NO: 26661 - DNA, 1099 bp, Mus musculus
aattaatgtactaaaattgtccatcttgctgaaagcaatctacagattctatgcaattcccagcaaaattacaactcaattctccatagagttagaaaaggcaatttgcaaattcatttggaataacaaaaaacctaggatagtgaaaactattctcaacaataaaagaccttctgggggaatcatcatccctgacctcaagctgtactgcagagcaatagtgataaaaactgtatggtatttgtacagagacaagcaggaagatcaatggaatagaattgaagaccaggaaatgaacccacacacctatgctcacttgatctttgacaaaggagctaaaaccaaccagtggaaaaaggacaatattttcagcaaacgataccagttcaacatgtggatcatttagaagaatgcaaattgatccaaatttatcaaatctcaagtccaggtggatcatggactgccacataaaaccggatacactgaaactaatagaaaagaaagtgggaaagagccttgaatacatgaacagtgtgggggggggggattcctgaactgaataccagtggattttgctttaagatcgagaatccacaaatgggaccttacaaaattgcaaagctcctgtaaggcaaaggacactgtcaataggacaaaatggcaaccaacacattgggaaaagactttaccaattgtacatatgatagagtgctaatatccaatatatacaaagaactcaagaaattatactccatacaatcaaataaccctattaagagctaaacaaagaattttcaactgaggaaacctgaatagttgagaagcacctacagaaatgttcaacattcttagtcatcagggaaatgcaaatcaaaacaaccctgagattccacctcacaccaggcaaaatggctaagataaaattttaggtgacagcaaatgctgttgagaatgtggagaaagaagaacattcctctattgttagtggaatttcaagctggtgcaaccactctggaaatcagtctgctggttcctcaaaaaaaaaatggacatattattatctgaggacccagctataccattcctgggcatatatcca

SEQ ID NO: 26662 - DNA, 1114 bp, Mus musculus
acaaaatccacataaagatggaaggagagaactgaccacctcagcatagccctctgacctccacacatgcacacacacacacaccatacacatatgtacaaatgcacactagaagaacttaaaaacttttaaaagaactagatttttatcacaactttatttactgtataaaataaacaatagataagaacacacatgtggcttcctgtcctggccgccatcggagagcctcagccatggccctgtgctacctcatggccgtgggactcagcaagggccacaaggtgacgaagaacgtcagcaagtgagacacagctggcattgcaggcgcctcactaagcacaccaagttcatacgggacatgatccaggaagtgtgcagctttgcactctatgagcggcgcaccttggagttgctcaaagtgtccaaggacaagagcacaatcaagttcatcaagaagagggtgggcatgcacatccatgccaagagaaagcaggagaagctgagcaacgtgctggcagccatgaggaaggcggtggccaagaaggattgatgaacactcccccaataaaagatcattcctacaaaaatgaagcagcagcagcacacatgtgggtaaagaataatttgattaataattgtatatgtaataaatatgaaaattactgttttgacatagtactgaatacctggaaaactcatacactgctggatataaagtgactatgaaactatatatatatgtgtgtgtgtgtttgtgtgtgtgtgtgtgtgtgtgtgtgtgtgtgtgtgtgtacatacatgtgtatatatgatccagttattaaataaacataaaaacgcatgacaaatattaatggcagttaccttcagaagctatgatcagacaatttgtcactcttcgtactttgcaatattttaatcaaaatcaaaataataaacatcattttcaaaagatccatgaaacacagaccagcagaacactttcttctttctaagaactctactctgtccttcaggtagcacatcattattcataataatgcttattgagcaggaataatctcttttcagcataaaacattttgtattcaagcaaaaataattgtaatac

SEQ ID NO: 26663 - DNA, 1099 bp, Mus musculus
tatgcaatgacattaagaggtaaccagtgctggtctaaggaacacaacccagcttcctccccaaattacttttacagctaattttagatagttcatgccttatccttacgaagaaagtggaattgatggcatgtaggtaccagagtgctttaaaaaacattattacattagaatataattggatctttcctaaagcttgcacgggcccaagtaaaaaattaattccctgaattttaaattaccaacaaatagccagtattatgttatatacatttttgttgagtcactttaacatccatacattaactttataaacttctacgttactatcaggagctcactgtgaatgcattatcttcagatggttaagacatcagacactacattttacatataatgtgcactaatctctggggagaataattacaaacaatacataggtcaacagactttaagtggggaggataatagcattcttgtttgtatgccacacaccatagagaactgtgcgttgtctctgtacccaaggtctcactgtattcgtaaggttgccaagttcagtgttcattgttttgatttctacatatttggcccctcaaactcttgatataggtttgcttgcacttgtaagctaatcaaggaaaaccataagaaaatatgcatataaggaaattattcctctccataagcaaactactactggttttaaacattcaacctcctttaaaagctgataaatgagggataatacgactgttcggcttaagaaagcactacagataaattttaccaagactggttcatgatataagatgctttgtctttatgctaaaatttttttttaaggaaatcttgggtattgtatgtaaatctagcttatcaattttaaaacttgtattctcttaagaactacattaacagaaagccttttttataagcagtaacgttaagaatgttccagtgactacctgcccttatacctagtcttgttaaaactttcttttgcagggcattttagtgtttggtttacagtaagtgcagaatgggcagataaaaagattgagttagggacattgaaaaagaaagatcaaagaatgaa

SEQ ID NO: 26664 - DNA, 2988 bp, Mus musculus
ttaataagatacgctactacattgctttgtttataaatagtttatgggaaatttgcacttagtatgttttgaataatgaccacgcatggacacagtttcattaatttaaattgcaccacacaagtagcagttcataagaataaaatgtgcttattttacgcatggtccataaaatgatttgatactcttttaaagtgtatgtggtccattagaaaggttaattccaacaaagcatttagtttacagatcataatcctaagcagtcaggagagaaatacgaacagaaattacatgaggaatattccggctagattaggcgcctgtggatattggagttgggttgattttcctgaattggttcctataggatcctccaattttggatcttctacagatcccccagtgttctagtttagtaaactggcccatttgggctgaagaacttgtgtggaaagagtccaaacaactcatcattttcttctctgcatatctcaccacaattgtaggatttttttttccatgtacattctttgtatatgttcagaagggatcaaaattgccatctaacaggtaccttaaaggattcctgggcatctacttccacaactaatacgtattccacagtgttggctgttggcttcaaaaaaaggaattctcttaacatgctatgttggtcagcgtccacctcctaagctcataggcaaaactcacaggttaaaatggaatttaatctcagagatcctttgttcaagaatatttgattgcatatttagttgtagtaagattttataaaatacataatcctttgtatgtgcagtttgtaaagtatctgcagaattaaatgctcttatttacagatcagaaaactaacaccagtgtcaggatcacagtatgggaatgactgatgtgaccttgaatgcagcttggtttgactgacattaaagccagtgttaaaaactaaagcttagcaacaaatgttttactatttttacaggatactgtaaggaataatttgacttttaagaaatcttaaatataaattttctgtgcattaatgtagtacctcatagttaaaactttcttcattcacagcctttccctttcacagtaaaacatgcttagctttctgtgtctttcttttagtcatgataaaaatgaagctgtaatatcaaggtcatacaagtataaacatatatgtccaatttttaaactacttccaccttacaagttgttcaaaatacattattagataattctaaagtgagaaaaattagattctaaaacacaaatcacaagaacgtttgatattgaagtgtctggctttaacatgtgattccacaagagtagaagcaagaaaggtatatacttttaggagcctaaaaaacatttccaaactagcccaagctatctcaactacaggagcggagggggacgaatgattgtgaacacaaagtctgacttgaagattctctgcaatgaagagaattcattcattcactctgctcaagactccactgggccaagagatggaagaacaaacaaaaaggactttccatgtagccttcctccatgtggcctagtgaaacatggatcttgtttaaaaggcatctgattttatgcagacacgtgtctgaaaaattaaaatccattgtccaaacttccatacattaggtaacgtcttataatgtaaggacatggtatccactgccctaaagatttagacatccatcacagactctgcagtggtgtttctactccagtgaggtactttctaccatggtgtgccttttgctgtgagtgacttaacagtgcaggttcttgttgccttcactgttaaccctgagagcacataatctgatgcatgtgtgactaagaataagcctatggtcatgggcaagaagggccaacatagacacttgggtagaaatacagtctgatcaagcaacggtgtaaggaaaagtccctaattcacaacctccttgatcttatgacccttgaaaacctcaagaccgaagcctgaccataagttggaaagctctcattaccctctttaacaacataaattcatagctaaagaaaaactgcatgtgcaaataataccatattcattttttatttaacatggggatggaatggggatagcatacattttatttgtacaatatttaacaatcacttattcaaggtgggattttatggggatttttttcatttttagctttctgttaaatacttgcagaaaaaaaaaatagcaagtacaatatgacagtagtacaacaacctgtgcccaaaacactgacaagaaatacagagtaaagctaaaataattgtttaccaatattttgagaggtaacaaatagggagatacgggttgagactgcataaaaaacgtactgctggttgaatatctgaggtaaatgatgtttaatcaagatgctacttgtatctttgtccataaattgtaaataattttatgcacattataccaaatcttcctaaaaagtaatttttcaaaaaagtaaaaaagagaaactggaaaatatctgatgaagcatttttttttaaaaaacagtaatcattctattccactaaactaccatctatctggtgaggagtttggttttgttttgttttgttttgtttttcccaaccatttgaattttacttaaatgtgacttaattattaaggataagaaaaagggtcagaagcgatgttttcataattgtgtgtgatacataattctgtctttaagtccaaaggtgtttgttttttgtttttcctggttatatttttagaatattaccatgaaagatagtgcaagttcatgggaccaataattgtgaggcacagtctctgttctggaattcacaaggtacctgtaataaacatccaaacaagagtcacaaatcacatgctaaaactcctagcatctaaaatacatacaagatctgtgcagggcatagatagacttcaaataaattcaaaca

SEQ ID NO: 26665 - DNA, 1227 bp, Mus musculus
ctttgttaaattcactcttttcatctctattccttaccttccattaaatcccatttctctagaattgtctctctatccattggcattttcttaatgtaccttgtaaagttttaaaaattactttgtattatatcgttgattatctcttccctcttgaagcttcttcgcttgtgtgatgattaatcttcatgtcattgtgactagtttagatggccatggaaacacatttctgcatgcatgtatttccagaaaaaaattaactacagagagaagacctatcctaaatgtgggtgtcaccattccaatgtgctagagttccatactgaatggaaaggaaaacatgagctaagaactagcattcatttttgcctccttcctgacagtgcatatacactggcacatgctgccttaagctcctgtaatggtaccttcccctccatgctggattgtacccttcaaaagtaggaccaaaataaacactcccttaagctgctttattgtgaggaatgtttaatgtatacagcttgttttctagattgttgtggtatcttgtacattcttacaggctttagtgtgtcatttttcactgctcctttttctgtctaccactctataacttcttgaccacagcttactctgcacagatactctgcccacccccatagttcatcattctcagttgttgtttccttttcaatgaaggcttcatcaggcaagtcttctgtgaatgtctgaattctctccacagttgtaatggcctctagttgggctttcttttttcttccttttcaatccctttgcagatagctgtgcttaaggtatatgatgacaccgttttgttgtcactgtgacatgatcttgtttcagctcatgttcttatagctcttcataatttccccactatattcttgtaactccactgttttctcaaatattagaactcttattctctgttgtgatttgtgctacattcttttcatccatctcactagttttgactatatagtttccccattatagattgggaatttgggatcaagctatgttttcgttgattttgttgtttttgttttttagtgtctctctgaagattcaactgtgcttgaagtcctacagaaacatttcagtgtcaacaaaaacttgcagtcattacacatgctattggtttgtacttttacctaatctatgaaaataacttatacatattatggatgatttttttatgta

SEQ ID NO: 26666 - DNA, 1194 bp, Mus musculus
tacaatcataataaagagttttatcaatctgtaccatggaaagaactaatagcataatggctccagtaactttataagtaagataatggaaaaattttcagtgtataaggatagaaaaaaaattttaaaaagcttcactctctcatacagaacagtgtgccacttaaaccataaagccagtcttctctttacatagcaaaatatcattacagaattcttcatattcaacttcctgttacatgcatggaattacatgcagtgttttgctaaatgaagttaagttggaggctacaatagtatgtacaaagatatttcttctaacagtttttatacatatgttttgttggtagaataccacaaaacaacaggatattgaagagcatcttcactagttaaaagattttaaatttaaccagtaagagttgatttttcttttgtttggcttttttgcttctgttgctttctttaatgaaaaagaataatttttttttgttgttcattaatctttatgttccttcttagtaaatgcattttcatacaatatactcaggttgactgtcatcaaatgggcactattccattctttgaaaacatttaatgctaaggaactctgtttctgttggagctcagaatagataattacaaatgctatctgacatatgagaaaactttttttttaagtccacatatttttattagatattttcttcatttacatttccagtgctatcccaaaagtctcccataccctccccaacatatgagaaaactttttaaacttgttagagaataagtctgtggtccaaaattctttcttttttttttttttttagaaaacctaaaaataagttaaaagtaagaattctaattcttttatcagttttatttgagatataagtatattacataataatttaatgtttaaataactataagtcttcaaagagaaaaaggtgacatatttatagattaacacacatctatattttctaacgtaagttggcatacaggaaataaaaattgctaatgatgtcaaagcagctacaaagcttgtacttcattcaaagttgggtatgacaaattttgatgtagcataattggcttgtaaagctttgtcttagagaaattttcattaaattccatagcattaaacaaattattagaatatattattacctacaaggaataaaatga

SEQ ID NO: 26667 - DNA, 1142 bp, Mus musculus
attcaatctgtgaattttattgtatactttaatatatatgaatgtgatcgaaaatctggttttgtttttatcttttattgaaagtagatttattttttcttcatgtagtatattctaattatgctttctgctctctctactctttcagtttatccctaattcccctccctggatccctttcagtcactcaatagaagacaaacaggcttctaaaggatagtaataaaataacattatgataaaacaaaaactgatgcattagaattggacaaaaaaaaaaaaaaaaaaaacagaagaaagagcctaagagaaggcacaggaaaactcacccacttatttgcatgctcaggaattccataaaagcactaaacagaagccataatctataaacaaaggacctgctgcagacccatgtcggccttgtgcttgctgacttgtctttgagttcctatgcactttgatcatactgacttagaaggcttgtattcttggcatcctcttgtctctctggcttggaccctttctctgcacccctttcacaggcttctcgagtcctgagaggagagatttgatggcgatacttcatttagagctgatcattcaaaagtctgtcactgtaatgtcaggctgtgcttctctgtatgtgttcccttcagctgcaggaggagagtgggccttaagtcaaatcagatattggttgtttactccccacaagcttttggtcagcatttcactagcatatcttgctggcaggacaccattgttaaaccaagagtttgtggctggtttggtatttacatctctcttggtagcatgcaaagtaccttcctatgaccaagatgctggagtgtagcaaggaaggctccaggtaccagctggacttctttaatttcagtgagtttttcaggtgttgttttcatcaataggaccttactggtcagtttgtggatagcaacttgaagtcttggcaacaggttggattgtttgggggctcacttgggacccttttggccaacaactcaattatctataagcagtcccggtattggcagctttatttggtgacaagagttggtcagctggactctgtgtcccccattatttggcaattttatttaactcatcttcatatgtgtatatat

SEQ ID NO: 26668 - DNA, 1455 bp, Mus musculus
atcgtggaagcattaaagaaaatgctcaaaatgtaacatgatttcagacttgtaggaaccgacaaggaggaaataaaagagggcagggacactagcattcatatttaaaatgagcaggatttaaaaactaaaccatcagaggttggggttagctcagtggaagagcccttgtccagtgtacacaagaccttgaggtcaatcccagcaccacgaaataaataaaaaccagatcactagtcatgatgagaaaactgctgacacctttgctagtatgttaccgtgtagatgtgtaggctgcatataccactgtgtgggaaatgttaccatccacatgtctgttaaaggtaaagtcaagggtttcctgctgttcccaccttacactgccatctttcaccgtttgtgttttgtgttgtttggatgtcagtattctatgaagaactgcacaatgatctcctgtgtttaaaaaaaaaaaaaagaatgcaggcttgaaatgatttgaagtaactagtgccttgttaatattcttagtttgaggaccctcgtgaaactttatgtgtttaaaggtgcataatgggcttccaacttctcgctgactcatgctgttttagctaatactgtacaaataaaagttttaatatatgcacttagaaattaaaacaacagtaagtccgtaagtgttttaagatgtactatatttattgagcatgccttcagtcatttgagtaaagcattgttagcctcacttattactcagtttttataccccttatcatggtttgcttcatgtcaggtctacgttcatatgtgcaaatgtatgtgtttcaataatgatgtatttttatgtttatattatgggaaagacatttatttatattcttgtttcttctgattgtcaagtttagacctattttatatagccttggtcatttattttcttgtttcatttatccatataaacatataacctagattgataatggggtatcaaggcacatgggctgaaagtttattaaaataaggaaagctttagcatatgaatacccaaaagaataataacaaatgttgagcagtgtggcgcatatggctgagcacgtgtaggctgacattttacacttagtaaaaatctaggtcacttaaaactttgaaaatgttagatctaataaacttaaatactaattgttgtacagagatcagctgattatgaatatgggttgatttactgatgaattcttttggtaaggtaaattctaaaaaagattcttaccccataattttttatgttatgaagtgaattatgtcaactgaatgtactatcataattgcctggcataaatacctgtttacactgctatttgttctttcattaatactcattgaacagtgatgttgggcatttagaatgaagcaacagaggacagtccaactttctttgtaagagtagagaaatgcaacttt

SEQ ID NO: 26669 - DNA, 1120 bp, Mus musculus
atttctgctggtgttggagtttgagactgtgggataaattgggagcaggaaggttggaggagaagggctttgtgatacattgggggtggggttagagagtaaagggagaccatacagattgtctgctgcagagctgggcatgagtgttgtcacgttgaatctggaggaacaaaaggcccaattattttatcatttcttttcatcttttcatcttttcttttctctctctttctttctttcttcctttctttctttgttttttatgatattaagatcctattttatgtttaatcagtggtttttgcctacatgtgtgtatttgtaccacatgagtatcatctggtgcctatggaggtctaaacaagacattgtattccctggaactggagttataactggttttaagcaaccacatgggtgttgcaaattcaacctgggtcctctgcaagtgcagcaaatgcccttaaccactcagccatctctccagcaccaagttttgctggatcaagtagattttctttagtttggtaactagttggtctgaatacaactttttcaaatgtcttccatttttgactttatctctgccccatcatttcctctatacgccacccacataaccttcctgctaacttttctatccttagtattctctcttctgtttccatattcttagctctaccttcaccctctcttatacacgcctctccccatggcttctttctagcttcctggcttctgcagtactccaagttaaacatgcaaatttagagattggaaaactaagatccacaagtgaagaacacatgacatttgttttcctggactcactcggcataattttttcaagctctatctatttactttcaggtttcttttgtttatttttatttgtgactaaataaaaattccattgtgcatgtgtacctcattttcaatatccattccttagttgatggacatgtatgctggtctgatttcctagttatttgtgagtagagactgaaaatggattgaatttgcatttcctttttctaatgatgttgaacaattgttaacatatttattaaccatccatatttgttttgaaaagtctttattccgatatattagtccattt

SEQ ID NO: 26670 - DNA, 1162 bp, Mus musculus
tacaagatgtgtgatgtaatggctgcttactttggcaaaatcagcgaggagaacatcaagaacaattttgtgctcatatacgagctgctggatgagattctggactttggctacccacggaactcagagataggtgcactgaaaaccttcatcacccagcagggtatcaagagtcagcatcagacgaaggaagaacagtcccagatcaccagccaggtgaccgggcagattggctggcggcaagaaggcatcaagtatcgccggaatgaactcttcctagatgttctggagagtgtgaacctgcttatgtccccacaggggcaggtgctgagtgcccatgtgtcaggccgggtggtgatgaagagttacctgagtggcatgcctgagtgcaagtttggaatgaatgacaagattgtcatagaaaagcagggcaaaggcacagctgatgaaacaagcaagagtggtaagcagtcgatcgccattgatgactgcaccttccaccagtgtgtgcgactcagcaagtttgactctgagcggagcatcagcttcatccctcccgatggagagtttgaactcatgagataccgtactaccaaggacatcatccttcctttccgggtgatcccattggtgcgggaggtggggcgcaccaaactggaggtcaaggtggtcatcaagtccaacttcaagccctcacttctggcccagaagattgaggtgaggatcccgactccattgaacacaagcggggtacaggtgatctgcatgaaggggaaggccaagtacaaggccagcgagaacgccattgtatggaagatcaagcgcatggcaggcatgaaggaatcccagatcagcgcagagattgagctcctgcccaccaacgataagaagaaatgggctcggccccccatttccatgaactttgaggtgccattcgcgccttctggcctcaaggtgcgctacttgaaggtattcgaaccgaagctgaactacagcgaccatgatgtcatcaaatgggtgcgatacattggccgcagtggcatttatgaaacccgctgctagctgcctagttgcagctggcccacctccctacccacccttcccacaggtccaagtacccctagtgaccactcaccagtgtcgttcctccgtcctgctctgc

SEQ ID NO: 26671 - DNA, 1130 bp, Mus musculus
tgagtgattacatatataggggatatttggtatatatgatttttccaattcttttctcattttagtatcagagaaatactgttccatagaatgaatcggggacagtcccttctcttcataattttgcaaagtttggatagagttgctgttgttttgagttagctatttatttgaagacatcctccagtaaagcctttgcccatgagttttctttttgtgggttttaaaagtatagttcaaacatgccagtgctcgcaaggctactcaggttatctgtgcctttctgagtaagctttagcagtttgtttctttcaagaaatctgtccctgaactaacacagagatccacagcttggcagtgtgcagagtgaaagacttaggagcactcagtcctaaatgagaggtcttcatcacaccccttccctcagggctctgggggctctgtgaagaataggtgggtagattataagagccagagggtatgtatgacaccgagagaactcgtccagacactgtaggatggatgcacatatgaactcattcagactgtgggagaatgcacagggcatgcacaggctcatgacagaccaggtcccatctcagagaggagaagtggacatgggctcctagccctaacctataaactatctccagttgactcttacaaggggaaaaattagttttgaccagtggactttcactgggtatattaatcacacttaagagtagacctcacatttaacagtagatggccagcacaagacaaacaatgctatttttgtggtttttttgtgtttcttagttgttgtaatgtgtatttctagtgggtcccccccccccaattttaatcatgtttgtctgcctgttttctaaagagagagggggaagggggtgaagttatgtaggtggggagaatctggaaggagctgggggagaggaaattgatcagaatgtattatataatctgaggtgggaggaaccagaagtggggagaagaaatgtgtccccgttagctgattgcccagtttcttggcagtaaattgattggaatgtttgctgatactgatagtttgtatctaattttttctgtgacctgtattatcagttttgtgaatttttaaaaaattatct

SEQ ID NO: 26672 - DNA, 1202 bp, Mus musculus
cattgtgggagtggcatgacctggcttgctgtctaaaaggtaaagctgctctaaggggactaagtacaggacatttcagaggctgttgatgaaaggtgaccagaacctacatgttttataggaactttttgtttaatatttattaaatatttcctgccatggttgttatatgattgttgtactcatctttattttaattattcaatttcaagtgtagaagatacttaaaatttataacacagacttatttcctgtgacttgaatattttcttcttaatgtggtagtggtgatgaatacctcaatttatttagcacccaaggtctatactgactataaacatgtatatatggtctttaagaattctacttttaaaaattgttataaagttatgatgctgattataagctgcaggaattaagggagacggatggtaatgctttcttggctatgcagaaaaaacctgtggtttagcgaaggagaactattccaaatcgatttttgcatttatcagttaacaaagtaacgtttaaatagaattatgcacggagttaatattactaacacaacttacattacctactttacattttccaggaacatcacctacagcgagctatttcagcgcagcaagtatttagagaaaaaaaagagagcatggtcattccagttcctgaggcagagagcaacgtcaactattacaatcgcttgtacaaaggggagttcaaacagcccaagcagttcattcatattcagcgtaagtttgctaatggattgttttctctttgtaattttaaattatcagccactgaaaatattctgtattgtctgagattttaagcttttagttcatattctttggtgaatagaatgttaaacatgagatatttaaatctgtttgtattttcatttgagcttggagatcactttgagttttaataatatttggacttgtaatatttatataatataagatttttttagaacacagtttattataccgctaaaaagaggatggtttgccatactcaaataaaatttatttttaatgttcacaagtagggctatatctttagaaaaattcaaaacatcttgcacttaagtttaataaaattctaattgtaattttttttactgctcttttactatagaattcctcccaatgttggtacataagtggtcaccacctccagttttagcagta

SEQ ID NO: 26673 - DNA, 1445 bp, Mus musculus
tatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaataattctttaatgggatcatgagcatgaaatgggatcctgcatcacttgttttaactatttattttgccatgtttacattttgtatcttgtaaaaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatacgacttcaaggcaaaatagtattttctattactgtgcaggggaagggatggatcgatacatgcaaatttaatgtagtaactcacttttccatatattttgaatgtatatttctatttataataccagtttataaaaaataattacacagaaaaagtggactaggaaattatgcatctagcacatttaaactgtgcagatatgaaaatttttcatggattacattttatctgaagactgcatattttaactggctttaaaactgtaacacaccacataaaagatatttaccaggtatgtattgcatcatatcattgcaataattattggaagtctatatatcgagccatcccaggttttgggaggggggagggttgtggcgagattgtcttttcaattttggagagttttcctgtggctacaaggcaagtaacgggttggaaaccgtctgactgtaagtgttggacaccttcatagcgtagtgtttagtgacttttttatacggttcttgtaaattagatacgtgtagtggtgtttcagaatgtttgtttatgcactagttcagacaactttccctgttacttgttcttgataagtgaaaactgcagggaaataaaaaatacatatcaaaacacggccatgctgcatatgtgtttatttcaccatgtgcacacagcgcaagtgagggaggacaggagggacaggccagcccgcacagcacttgtcgcccaggccttcaggcatggaggagaaggtcgaaggctcgcctctgggctccattgggtttcagataatccaatataaactacctttgctatgaaagttcttaaaatattttacagaatgtaagtaatttgcagtatagcagtcattgaaatctcataaatgagcctcattttataaatatatagagtatagtgtagaattatattgcaagggggttttggaagtcctgggaaatgtaaatatttttaatgaatacaattaaaaaccatttcaaactgaacataattttataccttttttatatctg

SEQ ID NO: 26674 - DNA, 1150 bp, Mus musculus
ccaatctctaactcctgcaggttaaactaaagcgtgcctgttcacctcccaccttcttctttcccacagtttcactgcttctctgtgtggattcacacaggaggggagatggcctccccactccaaccaggacagacccccctccccacagccaggacagtactctgctggcaacagatgggagctccccgggaagccaacagcatgtgtgtgtgtgtgtgtgtgtgtgtgtgtgtgtgtgtgtgtatgtgtgtgtgtgtgcgtgtgtgtgtgtgcgtgtgtgcgtgcgtgtgctttctgttttgtaagttttgtttaacaagccctgggttgagccaggacttatgcccatttctagccttccctaccaatcgttctagaaacttctgtttgttgtgcaggaacaaacaaaacatgactcacacactcaacttggagttttacagattaaacgacattgtttgaaaaaggcagagccccgtttgctcctctcccgtgcttcccagcacttcctgactgttctgtgtctttcgctcataggggaagttacatgatcctcagcttatgggtatcattccaaggattgcacatgatatttttgatcacatctattccatggacgagaacctggagtttcatatcaaggtaagtgcttttattaagaacaagacaggccactaggccccaagtcatattacacagtctttctcctcctatataaataaatgtacaggatggttcttttcatcaagtgtcattctgtgggaaatagacactatttattaatttcagtcaataccaaacatttgggatgcttgcagtaggaacataaaaacatagaagccccctttaggatggaatcgttatacccattgcctggattctccccttttctcaatgcatttctgaggatagtccaggaatatgtatgtgtgggggtcaggacaccgttccccatgtgagttccctggaacataatctcttatgttaccaatagggaagctgccagagaaaagcattgtatggacaaataaacttggaaaatacttttttgaccagggctaaacttaccacaagttcaaatgctgtcatgaatagtgtggttctcagaaggaatgcaccctggataatgacacattcatgtcacctt

SEQ ID NO: 26675 - DNA, 1192 bp, Mus musculus
actgacttttggaagagactaccgtgactgggtcaggacaaaatacttagatgcaggatggaggaagctctgttatccatcatgttagccgagtctcaactgagaagcagtgagggcgagcaggagacatcaggctgagcacacgcacggtggagtatgtgccagtcccgcagtggcaacactgttgtgaagaatagcagcattcgtacatattgaagtcgtattttaatactgaactacaaaaacgtatccttgagattaggttttcccttcagttttaccttttaatgcagattctgaaagaaataaaataagaggctcgagttgtacttgtattggacagctctactcaaaatgtctagactgaaacagacgtctgaggagtgaatctgctgaccactaatgcctgtgttctctctttcatttctcaacagatatgactccacgtagcatgaaaaggactgtagtagtcaccagttcctttctgtcccctcctatacagtttccgtttctttttacacttgcttgcccagccgtctgtagtacaccagattcaggtgtttgcgctgtgtagaatttgtgtgcacagatacgtgcttggatccttctcctaagaagttggaaggagggggttacgcaatacccacttcctgctcagacctcgccacttctcagcctccggggttgtgtggtctctggaggcccctgcagtgcactggccccttggaatggaacgccctgctgtgccatcctagagggacaatcaagtgcagtggaaccagtgaccacgctctgcctcgacttctggtttcctgtaaaataaacacattactttatatttttagggaacaaaaaaaaagtgctgctatagggttcaaaattttcattctgaacacttttccaaaaccaaccccagagagcattttaaatatcctggtcatatctttggatctgtaaaatagaccttttagtatggcacctgttaaaatgcaaagcagattccttcaaggcagaaaaacagtttgacaatagcagtgtagaatttgctcattcagacacatctatgaaaatgcgaagagtcacagaattcacctccaagctgctcgctggtgaacctgcagtgactagtcctggccagcccagttgtttgaacatcattcctatacaagagttgaaaatgctgcagaattgg

SEQ ID NO: 26676 - DNA, 1126 bp, Mus musculus
agatccagcgtcagtacagtagttggaaaagaattccctcaggggaaagtcattggtgagatttatgccttgtctgtttttattgtaacctatcattgcaaactgctgatttgaattctttctttggcaccagataggctttttcttctttgaggcacagttaggggggaaaaatcagtataactggattggggtttgtttgtttgtttgtttgttttggggttttttatttgttttttgtatatttaattattactttattcagatccatgaatcgaaaggtgactacgttcagttgggcatactaaaaggatcagttgccaagtagtcaagcgtttcaagagaaactggcaggcttcagtgagtcgctactatgtgctgctatttgttttcatgaatttgtggtttagatagtaacatccccattcatctcagagaaatgacccatcctgtcatcttatgtgcccaagaagtgtgagctcacaccttcttctgaagctggtacccctggagtaaggggagactctaggctttctcaaggctgtgagggtggggtagaaaaagttaatgtgtgtgcttatgcacatgcgtgtgtgaaatgttgatggctgtgtatattacctccaggattctgttgtatagtcctttcctaacactgatttgacttaatttatttgttagatgttgccctttataacagtgttttgtttttaattaggtgtgaaaagaagacaacttctattgaagtatttattttacaaagatgattttgtgtttacctgtgttcactttgtttcatgttgttgccactgttggctgctattggagtctgatggaggggtcctttgcagggcaagtctgcaaaccccgtcagtaccaactgatgccaggttagaagcttgctgtctatgtttgcttctgactcggaaactgaaacgttggcctttaagagggctaccaatgggatgcgtcttgtctagaggacctgctattgtcttttagacttgtgtttagaaactgggtacgggtcagtaataccccattcttggctttcattagcagccattataaaatggatgattttagattctttctaaagcacttttccccctaggttcccattttc

SEQ ID NO: 26677 - DNA, 1745 bp, Mus musculus
ttaattcctttatcagaacagtgtgctctcgggccgcttttttaaaaggccatgtttataaagttttcattgtttgacaggctgttacattctatattctagctgtaaaaatcccacttctgaacagccaagtggatggctccatttcgtcacatgtttcacattgctggaatgtatgccagtgtatgttctctgaataatttactatctcatgcctacttcttgaaagtttactctgagatgccgtaggagtgcagccagatggtttagacaaataacctctgcctgccagccgttggggtgatgattagaatgttattgaagatagtggttatggttggggcttataatgccgactgcatttgatcagtccttagagaatcctgaatgtaggtctcatctcttcaaatgctgagcagtttgctttagtgggcatcaggtaaaacagtcagaggtgttagccttttaaaagacggagaatcacatggtgaagaattcatagaagtgttgtaataaatgaagggctaaaaatgtttgactagaatgtagatccagtgacaccttgaagcctccaagtccatatagagatgtgagcttgagggaatggggtttgtgtcagcttctctttcctagaatagctaaaggatcgtaaagcttcagtcaccccttcctttgtagggcaggcgccacggggactctgggtagaagacattgggggacacttgtcattagcagaagtttgtcattgggcaggttttacttcattgtcccatgctggctatcttgagcaagctaaagaaccatcactgtttaaaactgcttcctaacagggttttgagttttaaacaactgttgagtaaggaccagataactgccaaaggaaacactggtctgtgaagtctgcttatttactgagaactgtgtatcaacttttaaacacttcccatgtgtgcagataaaaggggaatagggctttctgtagaattctatctgtctagtttgtaaagtgtcatgtgtactgcagatgtctgttctctgggctttatgttctgtacagtagatttcattaagaaaaattgtggacaaacttgtttctgtggtttgatgggggagaatggcgatgtgtatttaaatagctatcctgtgagatagaaatgtccccaaagatctggaagtaaccctccctggccctcggaaaactctggctatctcctaggttctaaaatgaagatgtatggatactctggcagactgcatgttgtataatttgaaaatactcaaaactggacaataaaactgagttaaactttgactggtctggtgtccttatttgagccccagcagggtatcttgacaagaagtcaggaagtgtgtgttggaatgaagcatgttttgaaagaagtcactccaacatgaaccacctaagtcaaagctttgttcttttttgttgctggctttttgttgttgaggtttttttatttcccctctaggtatgtgcttaatttttttttttttttcatgcctggcagtggtggtgcacacctttaatcccagtccagcactctggagtcagaggcaggttgatctctgagtttgaggtcagcttgaactacagtgagttctaggaaagccaaggctacacagagaaaccctgcctttaaaaaaccaaaccaaaccaaccaaccaaccaaacaaacaaacaaaaaattgctttcacagtgaaactaaaattatagtaattctat

SEQ ID NO: 26678 - DNA, 1181 bp, Mus musculus
acatcacccatctctagccccgggctggaggcgatacacaccccccgaggtgctccgggggcgggggcgggggcgggggcgggcagcaggccatcgagcagcccggcgcgccaccgcccgttggattggctcgagcctctcccgccaggcctgcccggctcccgcgcgccgctgggcccgccccccgccgccatcttggtcgtggaggagcgggctgcacgcgtgagtaaataagcgcgagccgggagcggacggcgggccccggggcggcgagctgcggagcggacttcccgcgtggggggtgaggagcgggaggctcggctcggcccggccggcgccgcctctgccccctcgcggccgtgctgcctgggaagcggcggcgggagccgggcaggcgggaggccggcctgcgagcgcgcggcccggcgtgcaggtgagggcgccgcgcgggccgtgccaccggttactgggtgtcttccggcctcgctgcagggtggcggccgacatgacggccccaggtcgcagccccctggagccgcttctggagacttgggaagacccctcggtgcctccgggagagcagacggacgcctacctaactctgaccaggtgaggcgggccggggggacgagcccggggcgggagccggggcagccgtggggacccggcggacgcgggtagttcggggtgcaccgggccattgcctgccgagtgacgttgcggggcgcagcggcggcgtccgagggcttcttcggggacgagcggttctgtatttttttgtctggcccgcagacgggaaagcctttaaagaaaagtttggagtcgagaggcgtttggagagcagggctttgccctgcgaacctcggacgccgtgggaaagttggcgatccggagttagtgggtttagttagggtctttggctcaggctcgctccagtgctcatcccccgaccccggcctcgaacttgtggttctgccggagtggttgagattacaggtgcgcgagtcagcaaaccggccccagaattggcttaaaaaaaaaaaaaaaaaaagcagagccaggaaccccgttttgacttatttgaaaggctttagaaaaatttctgaattttgttaaactttcgtattttctgagttagaaaacatgattagggaaagggattcccactttcttttctcatg

SEQ ID NO: 26679 - DNA, 1307 bp, Mus musculus
tatatgatattaataagtgttattttggaagtggtagtaaagtatagtagtgctactaagtactgttaactagtactattgttctgtagtttgcaattgtaaaagaaacctacaagatcactattagaggaactgaggggtaggtagtaaggggatatcataaagttgttactctttccttccctcagtagagttgcagttttttcttttttgtataaaagtctccataatatcctaagatgacaatagttaattgagtatgattaaaaaaagggtttgcagtttgcaactgtttccccttcggtcaggattgtttactttttgcaagaagtgatattgatcagcatctctgtaggttttgtgatcatctgcacgttctgaacagctccatctacctttgttacttttattttacttttgtagttgacattttaaagattttaactatactacataaatgaaattaaaatgcttgtttttcagaggcaaatattcaagaactgcttttaaccttgaatggtatcattaagagttcagacaaaaatgtgtgtaccagggcactgtgggtaatatccaaacagacgtttcctgctgaacttgttagcaaaatggtgagtctagttttgggacatctgaattatatgcccaaaagacagttgtggctcacctgattggtatgcgtttttgtcatttaggtatccagtattattgattcattggaagtgatactaagtaaaggagagatacattctgctgttgttgattttgaagcattaaatgttattataaggtatgcagttggttcttgtatacattagaataatcaagctttggaactttggggttcatgtatttaatgatgagatagatgttaagcaacagggctggcatttgcttctaagcctgacaacctgagttgaattcctaaagtccgtatgaataggaaagacacttcctgctagttctctgacctaaacaccatgagtgtgtagatagtcacactggtatgcatgcatacacacacaaatgtttaaaacagtaatatttaaaaaaccagaagtgagggctcagcagttaagaactttgaacctgagttcaattcccagcaaccacatggtggctcacaaccatctataatgagatctgatgccctcttctggtgtgtctgaagacagctacagtgtactcatataaataaataaaaaaaaaaacaacagatgtgattatcctttagaccaagttaagcaagagaaaggtaacaagatggaacactatctgagttggttctaaaaactgtaggttaagac

SEQ ID NO: 26680 - DNA, 1202 bp, Mus musculus
tgacctgacttgatgggcatctggatggtcagttgagcgttaaacttactggtagagctaagtgctttctttttcatgtatgaaaaggtcttagacttggagagtggatgttttgccttttaaagtatttgataaatgttttacttttgttcccagaaattaatctcagaactccaaaaactatttaagaataaaaatgagacttatgtgttaaaactatggcctttgtttgtcaaacttcttggaaaggtaagtgaattactaccttaccttgttgaattatcttggaaaggagagtgaattagttggtattttcataatttgaacatgccagaatatttactttttagtgtgtcctgcgtaaggttctgtggaacttaccactcagcacatagctcaagcacagccctgcaatttgcatcaatcctcctgtatctgcctaccaaattctgggatcgtagatgtgaaccactaggcctagtttatgcatgcttacatgctcatatgtacatgcatgtggaggccacctcaggtgttgctcattaggtgccatctgccctttcatttctttactacatttatttgtatgactatgtgtgagatgtgatatccatcaggactccttggtgtgggggtggggttcactcttccactgtggggttccctgcagttgacccaggttgaggatccaccagtgtctgtgctgggagtaaagcatctgccactgtctgcccagcttagacctttgaggtagagtccttacagtcctgtgttcactgagtaggcagccgttactgccattttagcactgcgatcacaagtgcttgcctctatttctgcccttaaaaatatatgagtgtgtttatttttaaaaacttatctgcttattcacttgcacataggtatgtagatgtgtgtacagaggtcatggcaactttgtgaagttttttcaaataccactagagatcaaactcaggttttcaggctttttttgggtgtgtgtgtgtgtgttgttttttgttatttatttatttaattaattttgtacagagtttctctgtaacagccctggctatactggaactccctctgtagatcaggcctgtctttgcctctgcctcctgagttctgggattaaagtggtacacagtaactgctcagccatgttttaggctttttgtatggctaagcaaaaccttttg

SEQ ID NO: 26681 - DNA, 1146 bp, Mus musculus
cactgatttctgaagtgatcacactgtttttatttgattacattaaattagtctgtattagaaatcagttgatttcttatcagttacattataaaatttctgttttaagttgtcattctcacaaaatttatctcatagttattgagtagaattatattttttctactagagttatagaaaataaattccaatgtgacaactcatgaattttctttcttttttattttccatacaaatccttctgtttatttttatatcttttcctgtgtgtgggggtggggtggggtgggggggtggggagatttgtagtatatgcgagtatgggcttcacagaaaggtccatgtctggtgccttcctctattacagtggttttcaacctgtgggttctgataccattccattggcaaacctctgtctccaaaaatatttacattacattccataacagcaaaatgacagctatgctgaagtaacaaagatgattttatggttgggggtatgaagagtcagaacattaggaaggttgtgagccatgactttgtttcttttcttttttttttttaagatttgtttatgtattatgggtgtactgtaactatcttcagacatactagaagagggcaccaaacccattcattgtagatggctgtgaaccaccatgtggttgatggtaattgaactcaggacctcaggaagagcagtcagtgctcctaactgctaagccatctctccatgactatttcttactgccaattttttttgagacaggatttcagtaactcttgattccactgattggctagtctaggcaccaggaaccccaccctcatagtcttgtttttcccccagcattgggattctataacatgctcagcctcttctgcccccctttatttgtttgtttctttgttttgctctttggttgatgctgaggatacagatttaggtcttcatgcttgtatagtaagtagtctgttctaaattctttcttcgtttgcactagggtatacaaccaagtgcctttacttgttaagaatgcaccttagcaagccgggcgtggtggcgcacacctttaatcccagcacttgggaggcagaggcgcagaggggcagagaggcagaggcaggtagatttctgagttcaag

SEQ ID NO: 26682 - DNA, 1161 bp, Mus musculus
gataaatagtccagtctagaaaagaggcactagagtttttctgaacttttttctcattatttgcagggattaaggaactgtgtatgagctaggaatatacatttctaatgaaaacatttatttcttactttggtcatgtattttcgtaattataaacacgttattgaaattctgaggtatagaagaaattgagatgtattttataattttttaagaaattcttatttattttgatttcttaattgagatctgccagctcctttctattgaatttggattttatttatactctattgatatttattccttaatgctgtatcatttgaaggtttatatgaagtttcagttagcagcaagaacatgtatatttgatatatttagcatttaaatgcaaagcataaaagtaatagtgacatatcaaagtacttaagtttttaatcaacccaattatgtcttagcaccgcagagatcttcagattggtccagaaagaagaaggagcctctagggaaattggcttctttatttaagctaattgtgaaagtcatcgatactttccacactctaagcctcaaggaaacattctctgatacactgcttgctattggtaactctatcattagcatgctttccaatgtatttggacatatttccttgccctctatgatccgagaaatatttgcaacttttacaagacctctggctttactgtatgaaaactcaaagtaagtattttcagctcattaatgttgaattaactacatcgattttttttatgtgttttatatgtgtatatgtccataaatatattcacgtatatgcatatacatgtaggagtcacagactgctatcttttattaactttgtaccttgcttcttcctttttgtttttttgtttttgtttgtttttcaaaacagggtttttctctgtagctctaactgtccaggctggcctcaaactcaggcctctgaatctgcctttgcctcctgagtgccagcattgaaaagatgggtgccgccaccaaccggctctaccttgcttttttgagatacaggcttcttgctaacttggagctccccagttccagctccaggctctagaagcaggggctgcagatccacgctcatgcccccatgttcttatgaccagcagtgaactgtac

SEQ ID NO: 26683 - DNA, 1116 bp, Mus musculus
aaagcaagttgcaagtgttgctatccacagaaacctccctagccccatttccaccccccacccccaccccagacacagtttctctgtgtagccctggctgtcctaatggatataaaagaatggggtataggtgcattcttaagtggctgtgtttttttaaaattcatgttttctcagatctcacccctttttatgtgtagataattattaattactgttgcaattaataagaaaccctttttcctgttaacaagaaagctgtgaatcaaattacagcactagtacttaatgtaagtttacctgatagtttgttcatgtgtaaacaggagtgcatatttatgatgaccatggtgttgtaaagatggttcagatttcaatgaaaatagtaacctagtctacagatttgttatttacagtacccggatgttttccccactctttcctagttagaaaagctattgggagaaattgttgcatgcctacagttcagctatcttggagcctatgacagtgaacttcttgaacatctttctccactcctgtgcgtaatatttcttcacaagaataaacagattcggaaacagagtgctctgttgtggaatgccacatttgctaaagcgacagctctggtttatcctgaggaattaaagtaagttagcatcacaacttcctgcaactgcttgttctatttgttcatgtaaatttgaatttgggtacaaataaaatgcacagagaatttaattctatcattagagtatgtggaagccattaaacttgggttaattgctgttagacttactgattttagggaaatagtatatgccatagaaaatccttgaaaataaacaagggcacaaaatcgaaggttattaataaagccagacatgggtaggaatatttaacttttggttttgtttctgtcttgtattttctttatcctctcctctcctctcctctcccctcccctcccctcccctcccctcccctcccctcccctcccctccttatgtagtggggactactggaactccttatgtagtggggactagccttcaactcacagagattcacttgtctctgtctcctgagagctgggatcaatggcatgtgccacaa

SEQ ID NO: 26684 - DNA, 1099 bp, Mus musculus
cttcagggtctttacaatcattcttctattagattgtgtaaattagaaggttgtaaattataaatacagatctttatttcattaattgtttaaatgtgtacgagtctcctaactctgaaccatacactagcagaattgtacataagtatgcatttaaaatacattgtaaataagattttgcactgggaagctttaaagcagtgtctgaggtagcccaggatgtctttgcgctggtatggagctaaagttccccttagctaacgtgacctcccacgtcttccatcatttttggcctcagtgaggctttaactgcatcatcagtttaaagtatggtaaccgttctttactggtacttttggaagattcacagttagtacctgtaccagagtttattcttaagtttcccaagaaaattttaattatcacagcattatatttaaattttccaagtaagtggtgttacttatgtaatctatgtgcttttatttaggaagagcaaatggaaagtactattttcatccatcaagatgccccggagaactgtggaatagatgaacattctgagaatgcttctttaccaaattgtggtggctctgttgctgaaaccaatccagaaacattgatcactggttttgatgctagaaaagaagtattaatttcatcaaagatattgtctgctgaaagttcatctagtacagaaacttcggtggtcagcagtagttcagtttctaatgccactttttctggaactcctccacagcctacaagtcggagacaaacctttattactttggagaaatttgatggctcagaaactagaccttttagtccatcccccttgaataacatatcttccactgttacagtgagaaataaccaggataacacaactaacactgacatgccaccaaaagcaaggaaaagagaagtgacgaactcaaaatctgattcagaaaatttagcgaatgcaggtaagaaatcaagtcggagatggagtaaagctgagcagtcagttactaaaaagtctaagccatcactgacatctgaacaggaagagcactcatccgaaaataactctcctgatctgctcagcccaaca

SEQ ID NO: 26685 - DNA, 6242 bp, Mus musculus
aaaatcttgtggcacaaattagtgctcttgctcttcaactggactcagaagatctctacagttacactggaagccagctatttgaaatgcatgaaaaacttggtaccatggcaaactctataataagaaatctacagtcacgttggagatcaccagcccatgaaaattcttagtattttaagagaaatgtaaagttttttcaccatcagattttattttttggcttttagaaatattcacaccatttaaagaggacactttgtaaaattgataaaataatcaaatcctgaaaggtaatgaattactaggtcatttttataagttcattagatcttccctactgtattttcttggccagtacacatagttttttaagaagtttaaatgttactgaaacttgaaagcaaaagagatatacataccttttttttttcatgctttaattcatgcatattttggtatagctcatgtaaaagattttaattaagatagaagaaaagttttatttacactttattgagttgacagagatgtttatactctttcaaaatatttatatttgttgtgcctggtggaacacctgtactgagatgcaaaagaatgagaacatttcctgaagattacagctgtagaaaatctttgaaatatcaagtttcaacttgtgtgttaaaataataatgcttaattcactaagattctgttcattttgcattgacaaatacttgtgcagcagcctttgtgaaaatgtgttcttatgaaggtatagtgttcaaccttaaatgcatgactctgtatattatgtatagaagacaatgttttttaatttataaagttcagccttcattaatcgcatgggtttttctgcagctttttgtgaatactattgttttgtgtaatagaaacatttgtatatatttaatatcaaaatatccatgtggatagtaaaagtacttcattggacctactgtggatatttgtaggagtctttatctacaaataaagcaacagatagttttgtatttagttaaaacatgagtttattttctcaaatgtccagaataattaaaattattggaaccagcaaatgttacataccactgccttttttcttatggtttggaagaggatcccagccactagaaaatgtgcctccctcatatttcttcttaatggagagttaccctggatattttcattgcaagtgtactataaactgtctgtagagataattggtttttcacatattttgaagactaaacgtggaagaaattggaaactgccatttttttatatgtacgtttttgttgagttaaaaaattaggatatataattaaaccatttgtaaatttcaccaagtagttagtgcctgccttcacatatttgtttcatgggttttgtttgttttgtttttcgttcttgagatacagtctctgtacgtagcccaggctagctttacttccgtgatcctcctgcctctgctgtcagagatctggagttgccgttgtttgccactatgcttggctatgtctccccaagggtatattttgcttgttttctgagtaaaattagtgagtgagcttagtttcaaacttaacctctgcttagaaagacactgccattttaaaataaataaagccggtgccattttttagtttaaggtctccctttttccagcagagacccccccccccgcccttcgtaaataaagttggtgtcactttgcataagcataaatcattacagatattttggaaataagtgtgttcacctacaaagagggccataaagaatctgggattgttgcaccaaggacctaggagaccgtaacaaacaagaaaaagcctagtgtttaaaacaattgataatggtggtttgcattgtcaggccactgtatttaagtactgaggtgtgcgtgaacacctcagaatatagtgaatgggagtgattagcaaggagaatgtggatggatggatggctcattgcacaaactgcattcttttaactctggtttactcacttgtaggcatagcaaagttcttagggagttcaaagttcagcaggaagggtggcaaataaatgatttgcttaaattcctgaatttaataacagcatatatctgagtgaagccatagctcagtgagatggtgttttaccatcagtttattgaatctttgttatttttaaggttgagtcgccttcttttcagtattcttggctttgcttttttttcttctgtctgttaattcctaaaataacaaagaacattaatatttctgagttgacaccaaagaattgttttactattacatggaaccccttcagttcttttctaatggttactttttgttgttgttgttttgttttttctttcttttttttttttgttttttgtttgtttgtttttgtttgtttgtttgttttttgtttgtttgttttttgagatagggtttctctgtgtatccctggctctcctggaactcactttgtagaccaggctggcctggaactcaaaaatccgcctgcctctgcctcccaagtactaggattttaggcgtgcaccactacgcccggcttctaatggttaattttttaaaaacgttgaaatattggctttcagctgtgatgccctattatatatatttaagcaataaatctagggctggctagatggccccgtggatgcagtgctttcctcccatcctggttatgtctttgagtgccattcttgatacatgcacatggtggaacgatagtggtcctttgacctctgtatgtacttggtgcacatgtatatgcacacacaaatatgtaatttaaatttttaagatttttattttctgtgcatgattattttgcatgtatggatatgtaccatgtacaagcctggtgcctgtgacagtcagaagaagccacctaatccctagaaaccagagttatagataagcatgagctaccttgtaggttctgggaatcaaacttgggttttctgaaagaacagcaagtgttgttaattgctgagcaatcttaatccttttttaaaagactctgtaaagtgtataattttttatgtctttgaatatagttgattttcatgttcaaactgagttcattagtaaagatgccatctgtttcagcaagttaaactactactgagtactgcagggtcttaacgctgcatttcaaatagtggtgatggatctaattaatagggctaatacagtttgtaaatagaatttaaatctaaagattaaaagcatggttgttgaatgacgttcttggactcttagtacaacttaaaggtagccagaaactcccatatttaagggtcactagaatgtcaataatttaaaatcttaattgaaggctgaggcatatgacatctttgtgctgaggtcaacctggtctacagaaaagaacctgtttaaaacccaattaatctggggggaaaatagggtcttagaaacacatttaagttaatgttctattccgcaaataatagctgaagagttttatttggtctaagatacacatattaaaatgataaagtattgtttctgaagtcagtggaaatatttaacatgcttccagacttgactgattaagagtcaggtttcatttgattatttgtagttgatttcataggtagtttgtcaggtccacgggctgtagaacaattgtgggcattgttgtggtgacatttgactggggcagaagcctgtttttattaccaaaactctagctcaggctggcctgcaactcagtctcaaaccctcttgtttcagcctcccaaatgttttttcaacatttcataggtatcttaattttgtggtgtctgataacttagttctggttatgtttttgttgtccctggctttatatattgctctttggtagtatccattaaagtccatgtcctttaagtttaagatctgtaattccttttaacagtgctcttactagctatggaacttcactgaggtcttagaatagatgatgttataattttgtcacaacatttcttcctgaggataaaaacctttcttcaatgaaaagaaatgacctgacctaagatgctaaaaagaacaacctctgtcatgtagcttttatgcttcagttatagcagagtggatgttgtctttgttaatttgtaattgggtagagaactaactttttaacattaaacacatatgcttattagtgcacagggaagtgatagagtgagggggaatcaggtgggctgaatttgattttgaggcaatctcacattacccccagctgtcatcaaacttaggacaaattaggctggctgacctcttgcagagatctgtttgcctccaacttccctatgtaggcattaacagtgtgtactaccatatgacactcccttagccaaaaatttgatgataaaaccttttggtggaagaacaagcaatcctgtagttagaaaatagtggttggcttggaatgcttctctgtcatgtataacactaccttttcccaattaatatgattagtttaaaatatatagtcaggtgtgtggtaagcaacttatctaattctagccttgtggggtagagagcaagagttcaaggctgggaaaactattttgtacatagtttaataagaaatgtctaaagcattttagtttttatagaataagacttttcaaaaaaactggaattgagtatagaaaccaaagtatagtaggagaacttagtcactacagcacaatgcaaacgatgccttaccttttgtgtttttgtgtttgtgtgtttgttttgcctgtgtgcaccatgtgcatgatgtgcccacagacgtcagaaaaagggcatatcttctggaatcttctggaacttaacagttccagaaggttgtggtggtaggaattgaacctgggtcctctagaagggcagccagtgctcttagttactccggccccactttctcttattttaaaccattgggaagaattttttataagtattttgaagcaaaggaagaaatagttctatattcttagtatccagaattagttgtattgtggcagtcaggctgtgtttggctgctttcctaatttggtgacagttaagtaatctgaaattagcctaccgtcctcaagtatttatttgtctcttaatttaaaagtttgtcagtccttttaacaggataattttattcatgtttggtatgtggtcaatttagttactgctagactggtctgaacgcctttcctattagccataaaagtttgcctttataagatagtcatggttgtgattgctttactggtgttctaatacacatatagtatgaaacaactacttatttttggtgagttagttgctttcagtccattttaaacactgttctgctaatagccttaacaaaatatgaactagtcatttgttaatattttgctgcccttggtgaaagtttagtttatactgaaagtatatttgatgagattctctaattttaagttacaatttaacagaaatatctgttaattatattaataacactagtacctgagaaataagggcaccattctaaggggttgtattattaacagtcttgggaacaagcagcttccttagtatgtcgggcacatgattgttgagaacgtttgcttcagagtaaaatttctcatgtgtaattgggagttggctgtagtcatttgccatttgagactgattatttttaaatgtacttttatttaaaataaaagtataacttatttctggtgtttatttttgttccttgattttgaaatctgttttgtattaattgagacttgaggggactaaggatgacatgattgagtgccagtatttacaagcatcatggataccaacaaatagtaaccctcttaccccgcatttacctgggtggctctggaaagtttctggtgtgttgtattttgttttgttggtttctaaattcatagttattaaatacgagagaaagtgttatacggcatttatttatgtgctagtttttgtgggcacaaactagggtcatttgaaactatggtcatttggaaagtggtaacctttattgtctgtagacaagtctctgggggcattttcttggttaatgattgaggtgggagaggccagcctactgtggatggtgccacccttggacaggtagtcccagattgtatgaaagacaggctgatcaaatcaaagtagagtttctccatggtccctgctccattcctgtctcccaagttctgctct

SEQ ID NO: 26686 - DNA, 1151 bp, Mus musculus
acaagccgtatgcgcaagtgcaagagtgaactcttgcactttgcacttgagtcactgcccatcttcggcgtagtaatggggtgatgggcgagcaacgaatcaggagttgtcatgccacatcaggtgctgaaacatcacgctgcgggctctataagcagcgccattttcctgattcagcgtcttcctcctgataagtaagcaataaaagctttgccgcagaagattcccgttgtcctgagtgtgttcttgccggtggggacaaaagctcgggataggaaacgttgtattcaaattatcactgcatgtaatttgactgttacaataaacgtctaccccacccctcaaaaaaagccagggggtatggcagatacctttaatcccagcactcaggaggcagaggcagaaggatctcttaaacttgaggacaactagagctgcacagagaaaagcctgtattaagtaaaagaatctgactagtatagaaattgctaacagaagcttgggatattgctgtgacagacctggacatgtttggaagtattgaatgggaaagcctttgagtattgagcattctgtgggtacttggaagataggaatggtcatagtaatttttttttggtgaggtttcagaaggaagtttgagtccctcaaataatattcatttgagtggtgttttatattaaaaatctggcttctgatcatctaagattgaagaatctgtaatgctttagagctccagagaccaggaccactgaagtgaaactttggttttactggtaattgatgttggttagtggggttgagaactctaaagaaaaaggccagcattattgaggtgaaatctggtaagtattccttgtgttcagcaaccagaagttgtcctgaaggcaccaaggagtcatttcaagctgtcagttaagtctcccacatagtactagtcttggcttcatggaagcaacaagattgaagctactgagagagacatttctatactggagagtccaggactgtggcaggtgtgaagtggagccagcctgagactacaaagggagcttcttgtattgcaagtggcagagctgaagaggatcttcctaaggaagccctttggagccagaacatggtgagttctagaaaatagacaagaactattt

SEQ ID NO: 26687 - DNA, 1095 bp, Mus musculus
ggcatgcgtagttgcctttaaagacagctcagacttttatattgaagtgttgactgtaaagttatactttttttttctcttaaattattgatttggatgttgatgttgagatttgggtacagggaaatgttatggttaaacagagatgattttttttatgtcagattgacaaggggtcagttgggctggttagtttttcttgttacaaatgagctatttggaaagagcaaacctcaactaaaaatgcctctgtcagattggcctataagacaaatttgatttattttctttttaaaagaaatacttgtttttttccccaaagattcattgtatgtatgtgagtacactgtcaatctcttcagacacaccagaagagggcatcagatcccattatgaatggttgtgaaccaccatgtggttgctgggagtttaacttgggacctctggaagagcagtcactgctctaaaccactgagatgtctctccagcccaagttactttcttgattgatgattggtatgggacggaccagcccagatgctcccggggtgtataataggccaaacaagccatgggagtcaaaccaaataaggctcattccaccatagcctttgacttaattcttgcttcttcctgccttgggttcttgccttggcttcaagttgccgaggcacgccaatgatcacagtagaaagcaaattgtaatagcacccagcaactctacttggagtctgtttcaaagatgtcagcttgggttgaagacaaagttctgggcctctttccaggtttcctggccacatgggagaagagcagagcttgggaggaggggtggggagaggcttacagaagcatcactccagtctttgtatttagcatctcctcctgtgtgcctttttgcccacatttactttgcttgaaaggacagcagacctatttatttggctaatctcatctaaacaagaatggggcagggtggggcatgatacaatccaaaacatgcttaggcatgagtgttaatttttccctctttgttacagttagaaggtaaagcaaataactggtcttgaggcctctgcagcttgatagtcatgtttg

SEQ ID NO: 26688 - DNA, 1193 bp, Mus musculus
gggtttttggttttttttttgtttttttttgggtttttttggtgacattttctcttaagaaagtgctttagcaccgctggctggcatctttaatgcaggtggtaaacctaattccataagcatggcctgcccgagccagaaggaagaagagcttgctccctggcctgaggaagtgcctcgtaggtagtcatggaagtcacaggtaagtgcaggagcttgaagacaggcaagaggtctctaaggtgttcctttcctttgtctgagtgtatagtattaagatgcctagaagagagatggttttgttccactcttacaggcactttatatttcttgctgtaactacagcaatcacatacagtacagacaacctcaaaaatctgtttatattagtgtaaatagaaaaatggtagaccgctgtctagttttctccgcaggcatttttgggagtgtatctatagcctgttctactttgttaatgggggataacagcacatcctagatcatgtgtgaactttggggtttttaattgcccttggtatcctgatattctcattttcaaggtgaggtaaagacagggtttccttacttaacggatttgagcgcttctgttctccaaacacaatggaatttcttgttcaagagcagcttccagagttgagccagccctcgctgccttgggtgcttgcttaccaccagtcaaggttgctctgaactttcccataaccattatcccccaagaccaccaggctctgagtgacctctctaattctgtcttcccacccaccagtgacttgactgctctgcacctttgcatcttcagagctgctgcgtctatcaggagagcaggatcagattatggtatccagataccagtagaagaattggatgttatactatacttagcaccttaattctacttaacatttacttcttaagctgacaactagattcagaaatacaagaaaaatagactatgtcaggtcctcaagttatgagttaggaccaacgactattaacttgcattcacattatcctcacagaaccaagagtggcaatgctttggagaatagcagtccagcctagttaacatggggaaagatgacaacattgtatgtagtgttgaacctgaagacatcctacaatgatttcccacactctatttttccttatgtttgcttaaatagcaaaaatca

SEQ ID NO: 26689 - DNA, 2144 bp, Mus musculus
tattttctcatgatgaatcctctcaggacatggcagagcttggcgagtacaaagggagaggaagacatttgaactttagaactttgtttcagcgtgactctcccaccctgccccaagttgaatgttcccttcacattgaatcaaatacaaatcagcacagatactgtttccagtttttaaaaatgtaatattatggaaagtattttgcttcaagttgaatatgtattgtgtatatacctcaagttcaggttaatggctttgatttgtgctctaaagcaaagcaaataacacaggttaatggtaacttgttgttctcctgatctaactgagtaccacctttggtgttaagtgtcattgtttagtttaccctctgttctctatgttgtcctaacaagccaaccccaaccaacaattgttaagctgctccttaaaaatgaaacaggagaaagcctggcattgtatacctgtttttgttgctcagtaattcaggtggaaatatataacgcaagtgggtagagcgtctgccagactcctggcctggtgtgcctgggtagaattacacgataagcaatggtcagactttccttctgtggatccttatgccaattcagctactaatcggtcattcataaatggtgattaaaatgatcaggtaatttttaattgaaaatcatggtgtgaaatatatctacccaaagaggtaacatcctataaatagtagtaattaatttagctgcaacctttttaggtattaaattacatgacaaacagttaaaatgaatttaagaataaacataaggcatcgttttcaatgaacagtaataatttcccaatttacagattagtgtctacaaaggttttcttacatcttcttccattgcataatatgccttgtgtaatagttaagaaatcattttttctgaatgacttaaaaaatttgattgaaaatttggcaaattacattatttgtactagaatttgacctaaaacactttttatgtttgttaaaaatatttgctttttaaaatttagttaaaaattgaagtatttctgtcatagacaaaattactctgttttaacatattcctggtggactatatcaaccttttgtgccctgaaaacttgaaggttaacccaaactgtcaagatttaggatagtcaagaaaaggtttaactagttttagtatcagactttaaaatttcttaaagattttggtaagaaatagaagtccacatacaagcattgaggaaactgaaaaatctttgtaagacccttaatggctaaagccattggctgtaatgagtgttactgtgtgaggctttgtgtatgagatctgtgctgtaaggctcccagtgttccttcagcattaatgctttcccacctgctccaagagaactagccctcaaccagtgctgcggcctgttcatatgctctcatactttttcaaatcatgatgagaatttttctcctatatactaaatcctcttaaagactcaactctttgtagttttgtcaaagacaaatactctgtaaagtcccccacctaccccagatctacagctttttagcttttaatttgaatcatctgcatagttgcttggatcattgttacatcagttcagcgcatagtagcaattctggtgtggccaaggtgttggctgaagtttattcttcattggatgtttaaagcatttactccattgttaaggttggcatcatatagtcagttactgacatggcataagacagcatgaaactttaccacatttataaatatgagggattttttcttttgttggtttttaacccttttagactaagcctcaaaaatattatcatacctgtgtacttgtacattaaaaacaaaattattgctgagtaagaagatatttaatatatgaaactctcataactgtcattaacagtattaattaggtctaaataccgtggagcagccctgatatcatgctgacagcttacgtgtcagagggcagaactcagccagtcctgtggtttcaggtgttaatatgtaaacaagcatctcatttaacttcactgtgctcagctttgaaaagaacaaagatttatacctctgtacatgtggatagatagaagtgtcctgttttgatactaattttgaaag

SEQ ID NO: 26690 - DNA, 1183 bp, Mus musculus
aatctaggggattctaatctgaaatattaaaagtttcccctctcagtcaaaaagaaccatgaataaataaagcacaaaaccccaccttaccctgaaggccataaaaggtttttttttccagtccagttggcttgaagttgaccttttggtcaaaggcagcttggatgttctaagttagtcgggctgaactttctgggcccttactgagtagccttacgacactacatgatatgaggtaggagtgtggaattttctctttaaagaacccgttgtttcctcttaagatgtgatttttgaggagcactgaagaccttgaaacattttttgtctgcacttcccccaccccttgaatttcccacaccctgttattttaaaaggcgagcatcttttagtgcaagcctttagcttgccagcatatttcctgttggctccttaaattacagttgtgtttgcagtactgtcaggtttgctctcagtgtaatgctgagtagtaattagcagatacttgtctacagaagcaagaacaatttggaaggtacaaaaatggtttctgtcattaccagtgaaaaccatgtaaatgcaaatattgtggagcagttagccagtcctctgacagacgagggccagggactgccccaggagatgttagccttccccagaaagggcatcctctcatactcgtgtccctggtatttagaattgttttctagtgtcttttggtggatgtctaatgaaggtgctgtcctttggatttcctgcctgctacatatgcagacactgcacttccttcttagggattctcagtgaatctgagccaggagacactccccataacctgatgtgataggaaccatcatgggtatcagtgtgaggtgggcgttcctttcttacagaaagctgtcatcgtgtgccattgggaagggattgtgtgtcccctagaagtagttgtgagcctttgcaggagcagcaggcagcggtgtggtggccacaggctgacaggacagcagtcagctgcttgtctgaagctcctgtcttacgttaggtcttagtacagttccacatactgtaagagttggtggcaaacccaagggaattttctcttacagctttgcacactactttattatatcagctttttacacaacataaactagaaaacatagatgcacaggactcggatcca

SEQ ID NO: 26691 - DNA, 1156 bp, Mus musculus
acccaccctacagtcactctacagtcagacggtggatgctcagggtggaggctgtggaaagagtttaccactttaactgttctggcagctgtgttttctaggcacaattctgcttgttgttaagtctgtgtgatttgtaaactcatgatcatttcaggtttgtcagtgttctagactgatgaagatgacaggctagggagtggagtactggctagtgtgagttactgtcctgcatgaaggctgaggcttggaatagtgtagtttgtctctttgaagctgcatgtgggcctgggcattccaggtagaaattatattattgctgtaagtagccctgattcttcccctgttgatttttaaaagttttcttcaaaaaaaaaaaaaaaaaaaaaaaaaaaccactaatatattttgaggaccatacagaaagtttatacagatttttgattctgaagttgaaagtaaaaattgtgtatatttaaaattatccttacaatcttctaagttgaccattaatgtacagtatatatgtatgtatgtatgtgtgtgtatatatattcctcattgaaataattccagaatgtaattttgtgcatgttaaagttgaacctttgagattggctaaaggagaggctttaagagaaagtatatgtatgtatgtatgtatgtatgtatgcatgcatacatgtatgtatgtatgccagagaagccctgacactcagctgtagagcctgggcctcacctgtgactgaggaatatgggtggaaaatttggacacacttttacatagaaagctctgctctcaaggtacggtgttgccttctaatcacaaagattatacggaacaacaatgtaacaatgcttaacaggaaatcagactccctatgatggttcagcatcttttcagcctctgtttatcttgttgtatgtcctgaagcgatggtaactatatgtcctctataaataattaaagataaaataagaaccggatgaatgggccacagcccactgttcaaatagtaagaggctggaaaacttgtgctcaaatcagctttctttccagcaacagttgtcctccgaggcattctgcaggctctctcagacaactgtctcagaaccttgtttttgtccctggttaaatggctgtgtttgttcgctt

SEQ ID NO: 26692 - DNA, 1177 bp, Mus musculus
attgacatttcttttttttcctttttaaaaaattctctcagccgggcatggtgcctcacgcctttaatcccagcactcgggaggcagaggcaggcggatttctgagttcgaggccagcctggtctacaaagtgagttccaggccagccaggtctacaaagtgagttccaggacagccagggctatacagagaaaccctgtctcaaaaaaccaaaaccaaaacaaaacaaaacaaaacaaaacaaaaacaaaaaccattctctcatatattccacctggaccacagtttcacctccccccttcttcctcccctctccctcacatccaacccacttcatctctcctcagaaaagatcacgccttccaggggcatcaagcaaaatggcataataggctacagtgagaccgggtacataccatcacatcaaggctggacaaggctaacccattaggaggaaaagggcccacaaatagggaaaagagtcaggggcagctcccgttctctctgttgggattcccaccagaacagcaagctgctcatctataacatacatgcagaggatctacaccagacctctacagtctccctgatctctgtgatctcccatgagtccccatctgttgattctgtgggattgtattctcacggtgtccctgacccttctgattcctcagatccttcctcctcctctgcagggctccccaaaccctaatgcttggctgtgggactctgtatcttctcccatcaattgctggatgaagtctctctagtctctttgaggatgcttctcctaggctccgttctcagcactctctgcagggaggacagactattggtaggaggttttgtggatgggttggtgtcctgatcccttcacttgaggccttgcctggttacagaagatggctggttcaggctacatgttggccattactaggggtctgtgctaaggttacctttgtagattccatggagtttccattgcactaggttttcaccttagccctgaaatgcaccccctcaactccaggcgtttctctctgtattttctcccccactgcatcaattcaccctcaaaaatctattctatttttccttcccaggaagatgcttgtgtccttttgtatgctatctctgttaattaacctctctgggtctgtggattatagcatgatag

SEQ ID NO: 26693 - DNA, 1189 bp, Mus musculus
gtttgttatagattaaaaggtctgggttaacacagagaagtgtggtcttcactcctcttcaaggaaacttctctaacagatggagaacattacagagtcaatcaatatgtggagcccagttccagtggagacatgtatagaacactcctataccaaggctcagaaaatgggtgtgtggggtgtgtgtgtgtgtgtgtgtgtgcagaaggagtctaagagccagaagatcaagaagtttgctgtaaggttatatcttctagtaacatcataagctatatccataaaggaccactcaacatgtgagctaagcaaggatgacgccagtgagcatgccaaactgggcggggaagaacatacggattcgtggtccagggccaaaacataccacaagtaacgttatacagacttggctggttatatttggaatatatgcaaatacacagatctgtatagtaacacttatggaaaaaagagactatgattttgaaggagagtggaaagggggtatatgggaaggtgtggaaggaggaaagggaaaagtgttgtaattaaattatattcttaaaagaattgaagaaaaaaggtgtgttgaaccctaaaatcctgagctctgcagtctgtgttgttggacgtgcagatattctgctctaacaacccacactgtgcctgagagtggtttatcttgttcttgctggatgagctgcccctcctagacacgtttgtaatgagaggtactagcccatgctcttgctttgtagtagggctttgatagatgtttgttaagtttaattgcttgagggcttcggaggtagtgaggtagggttgtattgagcctcctttggtgtagtggagagctactgtttgcttccagaatacaaagtttttatttcttctagaaaatttcatggaagtataaaagagatttatgaaacacacctatgggaggaagattgtgacttacaaaaggcaacctgagttttctctttttatcacattcagtagctgaaacttgggctttaaactccgtggggttactttaacattgtttaatggaagccatcaagtggagacatggttaacagagcagtatgccacataactaaaactgttccattgctctgggaaggagtgtggtgtaactcaggaaggacatggggttcagtctcagtttcccctccccccaggcccc

SEQ ID NO: 26694 - DNA, 1153 bp, Mus musculus
aatgcatcacatatggttggaaaaggacttgctaacacactaggagaaaacgctcagtgaaaaaaactgatgggtaggaatgaattagtataagcctaacatatctgcttgttaaagcaaaatgaagacagctgtgagagctctttctatcttccagcatagcagcccagtaattggtaagccagcaaggaagatgcaaacaatatacagtgacccaatgtaagctgtttgttgctaatgattcttttgccagacccagtgtttgtaatcctcacattctcgaaactaacactgagaccgcagaaattgttatgcgtttcctttggctgcaaacacctctcgtgttatggtgaaggatgcggtggaggaaaagcaggttgtgtttgtctacgtctgtgtctggaagttagtgtctcggttttgagtagcattccttttttgttttagttttgactttgaaagtgtggaaagtaccatggagagtacggtggacaaatcaaagccctggagcaggtccatcgaggacctgcacagagggagcaacctgccctcacctgtgggcaacagtgtgtcccgctctggaagacattctgcacttcggtaagtgccttaatcagatgctttggagtggcaggatcatctgtcctcttctcatcctgagtggacatccgtgtgtctttccaacatggccctttcttctccggttgttgaatctaaccgacagtttcgtaggtgttcatggcctgctcccttggttctattctctcactttatgtaacccttcttagaaacgccatcttgtgattcagcatagaaggtaagaagtgtgtgccaattaacacagtgaagtagtctctggcaggtaagttcccatggatgtggacaaagtgacccccaaaaccgctttcagggctgaggctacgcattacaatatgagcttttaaggagcccctgtcgctcctcatctgtttgtgctgccctctctttccacaggtagctcaggtgtgtgctgtgtagggcgtggttatgcttgttcgtcacagtgttaagaagacatatttttataatgaagggctactagtcatgttcctttggtcaggtatgcttcatgtcaacctgacatcttctactaatgattgcatcttacagctcc

SEQ ID NO: 26695 - DNA, 1151 bp, Mus musculus
ttcattatttgccattttgattgtccattgtggcccaccctgatttcctggtaatctgtaaataacggatgtgtgtgctatgggtatcctttgctgagaggtcttctaagaaattttgtgttcgagccatattcaccaactcctaacaagggactggaaacgggagatggaagctggcatacaattacatccttctttagtctcagcaaagtacaagcaggatgcaactgcagtgccactccaagtcattcgattttatcctatttcatgttgtttctgtgcaaggctgccatgcacaaaggcattcacttgtatgacttcaagatggcataaaacattgaagacttatttgcagaactgtgttaagctagaggcagcttttaataacgcaaaggtttcttaattagcactaaaattaatgtctcagtattctgatttttgaggaccattatgggtgaatccttaaaatagaaattggtgccttgttagtcagggagatttttaccacaagctctatcagtaagcattcaaaaattacatgtattaatgtaatgttgggaacctggccttattctcttctgacaatcgaagggtccttttttttttttcttccctttgtaaattatactgatacagttgacattaagttatcagggctgaattgctttatgcatttcttacttatgggaaattcccattaaattaacattgagattaagtttaaattatccgcgatagggttaaatggttgactaagtcactcacctttacttcctcactgacaaggcatttccatctttcccaaagtcaaagactggactgaagctaaatttgtacttttcataatatatattctgcttctggcttaccttgttggtacatcagtatattaattgtaaaaattattgtatagtatttaaccaccaaatctgtgttcatgtgaaccccttggtgaaggcccccttttcatggatgtgtagttatatgatctttaaaatgtacagatattttgctataagattggtgcagttttttatggtttttacacttctctttaattcctacctaagcctttaggtactactgtaaatattgttttaaaatgcatcagcctatgctacacaatctgaatgttactttaacttatagtt

SEQ ID NO: 26696 - DNA, 1246 bp, Mus musculus
tttgtgtgactgaattccacatctactttagaatctttttacagtgtcagttttcaggattaactttaattgtaattgtgttgaatgtctttgcagggtaactgggatacttctggcagtgaactgagtgaaggggaattggaaaagcgcagaagaacccttttggagcaactggatgatgatcaataaattataccaaatatatgtttatagtatgatttaaagtctaattcagaccagggattattttaagtccaatttacataacactgggttttaattgtgtcacaggaaaaagtgcatttatgtattgttattgtggactttataaaagcaaaggaattgaaaataacttgattctgtatcaagaatcatattttcctatggtaataactgtctttctgtgaccctttcacagggcactacaggatggattaaaagtggcaatttcatgatagctgcagacgtctctactttgttctaagtcatgaggtgatttgatttcctttatagaagttggattttgaagatacaatgaaaatttttgataatgtagtacaaaaaaagcaccagcaacctatgagaagactgcttttttgtgcactactgaactggttaaagccaatgtgatcttctgtggtgagctcttaagaaacaggtgtttttgatggagccttggtagacctttaacagcagtggtgctaacgagcactgctgtaaaaaagccaccattattttttatgaaacatctgaacattttaaaaaggcttatgagggcattattttgagcatctattttgaggtgatgttttaaaatagctaacatcaagtcaaattgtaaattagttgaaatatattgccttaaggacctactaaagaatgtgccaccaaacttttgagtaatagttgaaatatccttgtcaggggtgggaaatcaatgttgacttaaacattttcttttaatttttaatccaacctttctcttacactttttttttaattccactgaggaggttgtaaattaccttccttactgagaagtattgacttcatggtacacattctaaagcatttctgatttcaatatttttgtacatttttatctattattaaacttctcttgtagtgtgcactagtctttatttctacataagctgctcagctctaaggaaattgtatgatcattttcaagataataaatccctgaaattttgtttcatcgtacccatggtagctacagtacttt

SEQ ID NO: 26697 - DNA, 1101 bp, Mus musculus
tagtatttactagttttattttagatcttactcgttttctcataccaaattacatgttctttttttcccttttcttaatttgtgctctttccctttttcactaggaaactgactggacattctttccacatgggctacagcatggcaattttgaatggtattgtcgctgctctcactgtggcatggtgcctcatgtaaacctacactagagcaacgttgttggtgaaagtcatgatggtttttgaagtagcagaaacgaaattgctgactcagaagactttgaaatgtgatcagatacttactatcatcattatggaagaccttatagagggcacttcttcaatgtataagatgtttacttcatctttttacttttgtttatgtagtttatcagttacagaaaatatttgaattgaaatcaaacttggaaacttgaatacatgacattgcctacctttctatgtatattccattttttactaacagatactgatatttgtggttgaggtagaaatatttatatactatattaggaaaacagtactgaggccaagtgtgttagcaagaccttcaagcccagcattttggagacagaagcaggttctgtgggtttgaggctagcctgtagctgcacaatgagatcatttcataaaaaagaaaacaattcctattctttgacattttgtagaagctacataaatcagagtttttgataatcagtagaatgcatatgtgcatttatatttttgtggagtgtacctgggtgtcttatagatttttataatactgcatttgtgttttaaatgattacatttatacctatatggctgtaaattttatttcttagctggtgtagacctgtcctttagtattttgtctcttcaaaaagaattaaagtacattgacttgagtttaagattaagtaaatatattttttaacaaaaacatactacaaattcagggtaaactatttgttgttataatgttaagaaatttgagacttttagccatttctattttctacaattgaaagtatttattttgatgtatatattagggtagcaaacttgtactatttcatttttagtaaatgaaaaccta

SEQ ID NO: 26698 - DNA, 4182 bp, Mus musculus
gtatttaaatttgtttagaaagattcccagggatttagatttagaggccttgaattgtcaagtacaataacaccgaaaaatgataattaaatataggaggtcatggtttagcttggctctatccctgagattcctgtttagaatgtaaaaatagaattaaagatccaatatttgatgtaaactttttttttttttaaagtgacccaaaatgtataatgtgggcgaaggagttcattagatttgcttttagggtagcctgatctactgagtagatgcagttgttgtcagcagtgtgaaacatgtctcccttcatctcttcttgaactgttcaagaagtcaagtgtttgctctggagctgatggaagagctctggggctaggaggagcgggtgaaaggagcgggcctggctgctgagtgtgttccttcttttctctttaagctgatgagcgcagttcagaaaggaagggtctctggaagccgacttgccatcctgatgaaaactgccgaggagaacttggaccgcagagttccaatccccgtggaccgtagttgtggaggattgtgagtctgaccagtaaatccgccaccagcaagcataggacagccagcgctatgtacaaccagagatgacttaaactctaaaatagtggatctcgtagctgccttttttaaaacaaacaaacaaggaaaaaaaaaaaaacaaaatcaaagaaaggaaagggataagcaaataaacaacactggaaaacattccaaaacttaagatgttggtgtgtttgccaacttactttgccaatactttatttatatttgccactcagtctggcttctacaaagcgcttttcttattttttagtgcgcactgatgtactgttttgtatccattttgtaccctgtcagacttgacactctgcctgctcattcattcattcaaactagttttagaggcagaccccgtatagattggaatgatgctagaaagactttgtgagcacccaagagctcaggagctcgagcctggagagagcattctttctttttttttctagaaaatcatttgatctcttgacctgttaatattttgggagacttctcagccccgtcttgctacccacccccttccgattaaaactgcacacttttctgtctggagcaactctggctaatctggagagggaagacaaagtttagatctggttgagatttggttacatttctaaaagagaacctccaaaagcttccagatttgcaggcgtaagataaagacagccctgacatttgccgggaggtacggtgatcgctgcttctcagcagttcattttttttcccccaggcactgctggcttcctttgactattatagttgccagaaaaatccttgctttttttactttacaaccagcatttgagtggcaagttggatataatgggatgagaccaaatctctccattcctcctgggagcaatgatgggacacaatttccagtcccacaagttctgaatcttgtagcgtgtagcactgtcaggcctgttcttgtcggggtgggcagtagtgacggtatttgcaaagagataataaaaaagaactgggcagacttccgttaactttaattatgaaattgaaataaggcatgccactttaatattggaggctggtctgtttgccaaaggcccttctctttgtgtactcactggaaaaactctctttctaacaaaaaaaaatacaataaaataaaaatccaagatagacatcagacatatacgtaggaatacacacaaatcaaaccccaaagtcggtgtcctttgaactcagcaaataatgcacagactggagatgcccgccaggtggaatgttttttgttatattctgttggcattataactagtaatcttaatacttaattaattggcttcccttttctgaaactaccagtgatgagatccctgtgcatcataggaggtggaccccttcgttcccacttctctcccggcagcctttcttgcacaggctgtgtctcagctttgtgaactgatccataaagcacccttgtgctgctattctgcctgtgcaaacattgtgtctctctgcctcattcattatgggttatgagtccacatatcataatatgagctgggaggtctcagcccccgtcccactccacccccacccctgaaatatgcagacttcaggaatagacagctcaactcattattaaatgaagtatcgatacttccacttctatttccgggaagcctgacaccggacaagtgatgtcacagcagatgtcactgtgaaatctttttttctttcaaagtgtcaattttttacactggtttttaatctttatattttttaaaatagatggaagcatgtggctttgagatttagtgggtttttttccctatcatgacaataaagttcactttatacctcgtgacagtcaagtcggcagaaaaagctgtcctttaagacatcccagcagatatatcacaacattctacatcactactcctttcccctctctctttctctctctctctctctttctagttagatcaagataacggtggcttgtgtcatcccgattctcttacagtagggaccgggctcagaatgtgacttgcttaggccgatgtgggcttggcaagcacgtctcgtttgtatatgttttgctgtgaatgaagttcctttaaggacaaagggaagtgcactgtgcttcatttgagcatatctgccttggcttagcatctgcttattctaagacacgctccttcacccgtcccagagactcacgttggacatgaaatacttttatcacgttcctgtgagtaaagcaacccgggattttcctgagttcccaattaaacctgtacaggttttcacattttaaatccaatttaagcaaagagggaaaggacacaggggaaagaagcccctttaaaactcattcagagaataaaccatgtttgctttttcatataaacctggtatttgttgattttgtttgggtgtgggagtgggtgcgcagagctcaccttttatcatcgagtgatttatttcctttgacgggattcaggtgaaggaagcccatctgtgccggagagctctatatgccttgaactagcctagcctctgtcccagttgtgatgacagcgataacgctggattactggtttagctacagttgtctgcctctgagtcctcatgctgcatattcctgctttccagtctgttcctactgagtgtgatgtcacatctctgctctcaaatgcatgcttcctaatctgcttcaggttatgcctcgagtttggtctatttcagaatgtggacaacaaaaatgttcattctggttttaactcagtacaaatagaggttgtcattgatttctctttccctcttttccttatttgtaaaaagtctttttgcatatgaatgtaatcacaccaacgtcaccaatgctgtgaacttgcactgcctagggagcggaaaaaagccctactgtgtttaaaaagaacatccgctgttaacccagccctggagcggacacacttgctgcatgttctcttacttcctcagttttaggtgttgtgttgggttatcgttctagactggactgttaaatgccgtctgtgaggctggactgtcacttttataactgtcttcgtattttatcaccattatttattacttttgatatacagaatgagccgcatgcatttatagagccataagaagatgtatttaatgtgccttgtttttaactgagtaagagctgaaagcatgaatcaataaaactgattaaagcgctccatttgttggcattttgatgttactcgcggtccgacaaataactttaattactgctgaagtttttagaagtttgaaaatatttccagaaactatattttacctgacgcacattcattcttttacattagaattttaccacaagtgaattatctgtattgacagatgttattttatgaggccaccaaaattatttgtattaatttgttacttcagcttttagggtatggtttctgttttatgtgaccctagtctacatttatcccattacaactcaataagatttcttccttccttccttccttccttccttccttccttccttccttccttcctttctttctttctttctttctttctttctttctttctttc

SEQ ID NO: 26699 - DNA, 1202 bp, Mus musculus
ctggaagctgcatcgttccccgaatcaaatcatacttgcgcgacttacagtgggttaagtgtgtaatggcattctgttcgaaattcatgagaggaaatgacaactgaagaactatttttttctctcagtttttgtttgggtttcttgctccttatttctctccctgttctagtgttcttcttgctggccttccctctttgttcctccataagctagatttaacttaagaggaatcttatggaagcgtcctgctgttgcagaagaattcttttttcttcttactggattactgaaagaaagtctgtttacacatttggaaggcattcagtactttttgaatgggtcaaatttaaattcaaggaccatggctaagtagctcttattgatctgttgagtgattttatgaaatggtgttgtcttagccaaaaggaaagcatttgttaccctccccctccctccctcactatctcctcccttactttttctttggatgcagggactcatttcgtaggtcacattagcctggaactcacagagatctgactctccctacctgcaggtactaggattaaaggcgtggactgtttgtcacttttttttaacctgggccacctgaagctagctctctctcatgtctgtccatgaggtagttgagtggacctcacataatgaagctttgcattgatttagagaacactaattcttattctgtcagcttaggcagacactaagaacccagagtgatttccatagcagaattccttgaactaacttgatgaacttcatatatctagaaaatatagctctaaaactaccccgtgaaaagagaagaaaatgatgcttaaatttttgttcatttttcaagagccattttgaaaagcctgagaaaccctggaatcccagatctgaagtcttctagaaagaagatatgaaatctaacatctgtgattggtttttcccaaggactgagatttgtagtgtaattataatctttgtgactaacagggccagagattaagaggttctggggaggcaggagagatgactcagtggttgaaagcactcgctgctcctcccaagaggtcctgagctcaattcccagcaacctcatggtggctcacatccatctacaatgagatctggtgccctcttctggcctgcaggcatacatgcaggcggaacgctgtacacataacaaataa

SEQ ID NO: 26700 - DNA, 1190 bp, Mus musculus
ttgttgttttctttggcttatgctttttaaaaatatagacattttagagagtcatattctaatcaccatttccccatgtaacaaagaaagctgctagtagcacggggtttgatataaacttggttagagtgggttcatatgttcaaagtgttaattttggtgatcgggtcacgtagccaccttggggaacactgatgtggatgccgtccttctgtgtccttggacactagaaactgacatcacataggaggagtaaggaccagcttatatggtatggtgttaattttatattaataagtgatttctgcttataacaaggaaactggtactgatttttcaattctattgaaaagaaactcagatcttgaaaaaaaaaaaaaaacccaaatatctttaggttgaagttaaagaaaatatgtttcagaagcatagacttgactggaacacacaaacctagacagaattttgcatactgaatctgatgcaccttgcttttatttgtgtgtgtgtgtgtgtgtgtgtgtgtgtgtgtgtgtgtgtgaaacagcagacattcagctttgatctttgacttttttttttaactgtaaaactcttgaagctttgtggtctgaaagaactctccctgggaagatgccgcacatagcacatctacctgcaccagatagggatcccacaacagatcaaaataaggataccatcaaagttcagcctgctgaactgatggcttttattggtgttacatataggagcatgggtaagaggttactaaatgactcaaagacagctgtgttaccaaggctcaccccagcatgggtgacagctcacagagctcagaatctggagcatactgtacagcctaaaggaacctctacaggttggagagtgtcctttccaagtgactttagtctaaacctcttctaggcagctcagctggcgtttgttttccagccagctggtctggtctcagagtcttctttgcagctccacttgtctggagtctttttttgtagtccagcttccttccgcctgaggggcactctcagcttttattgcttattctgtcagagggcgtctagtgagtctggtcagtttcagggacttcctgaagctctgttgagttctttactttcctacttaaggggcttacctgtgtactggaatgtttcagtcctagaggaaactgttac

SEQ ID NO: 26701 - DNA, 1128 bp, Mus musculus
tcttgacctttaataatgagtgctctactttcattttaaatcattttgtgctagtttgctcgtgctaattatttttgatgagtgatgttcataattagatggtagctattaatctggaacttttacacatgatattgcttcataacatattttaaaaatagtaccactctagcatatagccaccgatgtattcatgtttcttcttttggtggctttgttattttcataatatcctctttagtaaaaagaaaaaaatattatactatctcccttcacaataagggatattaattttccttgttatattttgtggggaaagctgataggaattttacattacaaatattttgttgtgagaagcagattattgtgtatgcaagctctatatatctaatttacattctgaattttaattgggtggcatgttttggcttttatgctataaaatatagcctaagaaatgttaatatggcaacttgcttggaaaatgaatctccttggtacttattgtaaacttgattttaattgacagttccgtgcaggattggactgtagaacaaaatgcatgagcatgtggatgtaccacttaaatattttagaagcaaacattaaggttggaggaaaagatatctcatggcttgtcattaggaaaattgcctgcttttgagtttttcttgtgtttgttgttgttttcttgctattgtgtgtttgttcatcgaatggaaaaagttaaaatgaaaagataagtaagatattttaaatgtatagtcaagataccaataatttgtttgttcttaatttaagtaatactaaatgaatgtaatatttgcctactcaaaggagaaaatgggtctctttttttcgtccttcatagaaggaagggggaaaaaaaacaattttggttttactctaaaaattattttcttttgtatctttctcaaaacgcatatctgtcaaataattttctattgtttttatatgtgcaacctacatgtcatttccattgtcagtgaataaaatgttgctgaaacccatcaagaataatggatgtcccctaactcatttgtcattcagtattactttttacatttagtggagaaatgtttttcttaacttctcctagagagc

SEQ ID NO: 26702 - DNA, 1145 bp, Mus musculus
tatattgttttccagagtgattagagctgcttgtaccttagcaaagtaatttagttgtaattattttgtttcaggcattcctaagaaaaaccatttaaaacaaaggcttttcaaacaatttaagagataaatctgtgtcttaacttgtagaatgtctgaatttatgaatcaaaccttcagggattaggggttgcataaagcagaaacagattgtaaacaaattagatgactcatcaaaacttgaagacattcgtattacacagttatttcttatataatcatactttaataacgatacttcggatatacatatagtttttataagtaggatagaatatctagtattgaaatattttggctttggagagataagttttccttggataatgatgtaatagtttaagtcactttaatgtttaagctagtaagttgaaaatgttttattagaatattaattatacataatgggttttattacagtattttcagacatgtatgcaatatattgttgcatgtagttttctgctactgccttagctctagggggggatcctgctaccaacctctccccagctccccttgaatcctcaggtaaaggacatagactcagtttgttcttttacaacttgccttcttggcacaattactggtcagtacggtctcccgcttggaaaagcatgcccttaccagtttattgtctctgtctctccacctgccctaaactttagtggctagtcccacctagcctagcctctgccaaacatccatgaccacaggcctgtagtggtggccaccaaccccagcttcctcccccactcaagacctcacatgattgctacgttcttcttccaccaaagcatggcagaaaaaattgctctctccttccttgtgtctcctttttcctcctgggactcagaagtcacacctgtaccttccacccagcagttggccccatctttctttactgacaaatcaagaaccagttggggaacgaggtcttaatatcagaattgcccccttcagtatattccaattttattctaccccaacccaccccacctcaccacacacgttccttccttcccttctatacccattttccagcttaaggcatggcctcatccattgggtttcacatgcgcaaa

SEQ ID NO: 26703 - DNA, 1187 bp, Mus musculus
tcagctaaatcacacttgtgtacctgtacattgcatctactgcattcttaagtagaaaggcagaaaattaaagtctggaggaagaacactgaagtggaaaaccacccatattgagaatcccttttgttcccctgaccctttctctgtgtctgtgtactatgatttccttaagatcacaagcatttcagcctctgcaaacattgattggaaaaattactttcaaatagataacattaagatttttgtaacttctcatgcctgcctttgctgaacttttcctcctatcagaaatatggccttcctcctttctgatgctgtgtctcttccacgtagggagtttgcctggcgtgaccctgagctgccagaagtcattcacatgctgcagcaccagttcccatcggtccaggcaaatgccgcagcctacctgcagcatctgtgctttggtgacaacaaagtgaagatggaggtatgctccccaaagccctcatgacctaggcacactgtgccttccacttagcagctggcttgctttctattttaaaatgcctggggagggagtggagactggaaagatggctcggcaggtaagagcattggttgcttatccagaggacccaggtttgatttggaacacctacatggcagctcacaggcatctgttataccagttagcaaggattcagtgccctcttctggtctttgtgggaactgcacacacatgttgcacatacacacacacaggcaaaacatccatacatgtaaaatgtacaaataaaaataattgggctgcaaactctgtagccagtctcacatcacccagaggaagctccattcccaagcactctaacacacccaggatcataggattagaggtgccctgagcagacactgggcactaactctgcagccagtcccacaacaccaagaagaagctccacttccagactctctaacacgcctaggaccacaggagcccaggagcttggtcacaccaggatctcagggtccagaggcagcttgactctcaggatctctgacacacccaggatctcaggatcccaggatcccagaatcacaggatcacagaatcacaggatcacagagacagctgaactctgagaagttctgacacaaccaaggtcacaggaaggacagtcagatataacaagggcaggtagcactagaga

SEQ ID NO: 26704 - DNA, 1102 bp, Mus musculus
tataggaaaacacactgtgctgttggtgactataggaaaatacactgtgctgttggtgacaataggaaaacacactgtgctgttggtgactataggaaaacacactgtgctgttggtgactataggaaaacacactgtgctgttggtgactataggaaaatacactgtgctgttggtgactataggaaaatacactgtgctgttggtgactataggaaaatacactgtgctgttggtgactataggaaaatacactatacaacactcgggcaatggctgaagccggccttcctgctaacagagtgaaaatatgccaggaaaggaaattttgtctaactcatacattctaaaggcagatcgggttgctgtaagttagggctcatgtgttggttcctgtcttaaagatgcaggatctctgataaatcttgcttgaactttctctttcaggggttctttggaatctatcttcgtgtgatgctgtaaagatgacaatcattcgagacgcgctctcaaccttaaccaacactgtgatagttccacattctggttggaataactcttcctttgatgatgatcataaaattaaatttcagacctcactggttcttcggaacacaacaggttgcctgaggtaagtgcttccctcccagttaattacgtgattaaagaatgtgtgtcataagtcagtggactgtggaaggagctgtctggctagcatccccccaaaggtggaggctctccttcatagcttagggttatagactttgttactgtgtgaggagacactgtgagcacagactggtggccccaaggcaactgtcttgcatgtttgtatataactgttgtaaattattcagaaaggcccagttggctgagggcactgtggcagttccaacagtttctcctgtagtggtgttttgtttatttatttgtttgtttgtttgtttgtttgtttttctgattatcacatacttactgcaggtctgatgtagccttgtttttgtttcaactccggttatggtccttgaagttcaggatgtgaagggtcctgtgatttcaacagctgttgcttttgaggtctataaataagtcagcccaatgc

SEQ ID NO: 26705 - DNA, 1135 bp, Mus musculus
accgtgactttagacatcggagttggaatgacagttgtgcccccccccagccccaattaaagatttaaagtatggaaaaacagatgcaaaagacaaaatgtcaacagaaagattagggcattcctcagagaagggagacaggaaatagaggggcagcagaggtaagacctggcgatagggctgcttccgggaagggagaaggaagtactgggatggaggatgggaagtcgtgggaggcctcagcatctccagtgccgtgtggcactgaacaggcctggtggatcttagtgtaaagccagtccacgcttcacagctgcaccctggccctcaagactggagagcagttctcctccccttagacgtcacattctaagtcagcagtatttccttcacgttctccatttacttcctgttggtgtgtgcagtgccgagtcgtctcatgtgatgtttttaattacacactgtgttgggtttcagacagtggagaactgtgtgtgtaccctgaggaacctgtcataccggctggagctggaagtccctcaggcccggctgctcggactgaacgagctagatgacttactaggaaaagagtctcccagcaaagactcggaaccaagctgctggggaaagaagaagaaaaagaaaaagagaacgccacaagaggaccaagttagcatttccttttctctaccgttttacttgttagagagtgaaaagctgtaatttggcagaaaagattatcgctatttagctaaaacccagtccagcaaaatgcatgagtagcagccagagggcttacccgtttcctttcccctcagcctgtgccatctgtctttcagtgggatggagtcgggcctatccctggactgtccaagtcccccaagggagtcgagatgctgtggcatccatcagtggtaaagccgtacctgactctgttagcagaaagttccaaccctgccaccttggaaggctctgccggatccctgcagaacctctctgctggcaactggaaggtgagatgtttcctcctatacacatttctgtctgtctttgtggtcgggtcagccacagtgggaaaaggacacacttgtttatagagtttgtccataaaagggagttatgcggtctggggagg

SEQ ID NO: 26706 - DNA, 1102 bp, Mus musculus
accactgttccgcgctcccagccacctctgctctacccaagctttgcctatgataaagacacagtcaccgctgcacatagaccctgctctgatgggagccctggctagcgcggcctaagaaaatatttactttggccttaatttctgttgtttgtagtacatttatcccacattgtcacttggtaattggaattgaaaaagctagagataacctgtttggagaggagtaggggaagttgggtgtttataaagaattgcttcccttgctgagcctgcctcagccggcacctcactgagcctcctcgagataataaacctgcagtttcagtagaagatttttttccttgtatcttttaaggaaacaatagttaactgctgataacagatcagccaacagaaccttcagctttgttcaagtacgggactgttcataggtgactcgacagactagacccagaaagacttaatgaaaagtatttttgacaaccttggttagtccagattcaaagataagttttgtgaaaagctttgagtggcaattgcattttgatacactggaattaagaagagcatttctgccctaagccttcattacagacatgactgcagagtacggaccgcagccagtccactcctctgagcacttctatacactgatttatatttctttcagcaagtgacagtagtgttttataaaggagtcatgaagttttgttttgtaaaagccttcctattataaggattttcaacaacagtgataaaaagctgatgcctgtgaaacgatgaccctagtcgtgtgcacccggcaggtaaatacgccatgcgagacctggtgaacaggcttccaggtggcaacggccccagcatcctgtccgatgaaaccgtggcagccatctgctgtgctctgcacgaggtcaccagcaaaaacatggagaatgccaaagctctggccgactcgggaggtatagagaagctggtgaacataaccaaaggcagaggagacaggcaagtgtgagggcctggggcctggggtgagagaaggagccatgccggaagcggggatttatttctgtttctcacatgttgtctacaccagctaaga

SEQ ID NO: 26707 - DNA, 1746 bp, Mus musculus
attacggtcatctgaaatatctaaaaccagatcccctgccctcaaatacgtctaggatatgcttaacttccctgagcaaaagctgcctctgccaactctgctgaggacctaaactctcctgaggccccgggacagacttgagcaaacaaagccagcttgcctgtaaacataactgaaagtccacccctgcagtgagcaaacatttgtgcacctgaaacagcttcctcccccctttagcccacaaagtgctttaaattgtgaggcaggaagcccacatcagtgttgttgaaatgtgtgtttttaaattgctctcactcatttgcctttccatcctgccaacagcatcagcagctgtactatcaagatgactccaccaggaagaccttggatgcatacagactgtacctgcagtctcctcgaagctatgaagacccttattgtgatgaccgagttcacttcccagcttctactgattactcaacgcagtacggactgaaatcaaccacgaattatgtagacttttattccactaaacgaccttcttatagagccgaacagtaccctgggtccccggactcctgggtgtagcatcaagacggctgcctgctgaggggcgctttccttctgactctgtttggattgaggggaagtccgtcttgctgatgatggtgaccgtgaaagtgaaatggaagggatgagtgaagaggttttggtttgtttgtttgttttttctttttttgaggaattttcagggaagtgaggaaacccttgggagaggactttgtacgcgctgtgtaggtgttagatctaattacttgtagagtctagtggtgaaggtgtgggtgacgtgctgggaggcttgagacgtgggtgagatgagatgggtatgtgtaggtcaaatcaaatgacagatgatttttttaatgtgaataaagttatgttcagatagtttgtacagaaaaaataataataaaatggatgcccttcatgttttattgctattactaaatgtcaagattgtatgctattatgtcttgtaaaaattccttctgttggtgtaaatatggaaatgccacattggttaagtgccatcaattgtaatgcagtgtgtcatttgaaaagagatttgaagaactgacagcttaaagcccaagcgggaaacccgcccgggaactgttcgcagttgacaacaaactctgacgccctctgttttcagtgagtagtgaactccggaagcacaaaggccagcgtgacagcagcgccatgctcatccccctcacaggacacttcactgccattttctatgcacatggaagaataataaatgtggaaatttcatcctggagaatgtgttcttgcagttcttctgggtgcgatcatggaaacagatttagtaagtcccttgtgaggtgggccacactggaccaggaagccagagtggctcttctacataccttagcatgtgtagttcttggttgcttttttattatcatcatttcatttggtacatgggacaattttagcaggttttgccttgtctcagtcatctcttttcacctaagggaaatcacatctggcatgctggccgtatcgtattggcaagggccacttacttttagaactcggtaattacatatgaacagttgggcattcgcttgcttggcatcagtgctataaagcaaaactgattctaaataattattgtgcggaatacattctggattgcaggcagccttgggggatccc

SEQ ID NO: 26708 - DNA, 1184 bp, Mus musculus
caaagtggtacattatgccacatacagttttaacacatgaaagacatcatgcaaatgaagatgcatatattacatttgtgcagtttagagtcagtatatgctcatgtgacacactttgtcttgtgtcccatgtcagacatgccttccctgtgtttattctttggctctgttttaatgactggttaccaaatccattgcatatgtgttaccattaccaaatgattgatttttggcctttgacatctttggacagacagatatcagaggcctttgattcagatgggcacacatattattaagtcactgtggccttacacaacttctggctccttgtagctccaaaacctccatcatcaagaagctgcctcttggctgttagcaccaacctgagagaaatgtggaaagaacccagattggccaaagaagagttccaggtgacggaccccattaaacccacaagatgggtctgtgggccacagtgtcccacagaggaggctattgtggatggaagagacagggagtaagaaaacacaaagagctggccagcatagcaaagatctctaggagtggtattggctggccttaaaagcatacctaatggcatagggtgtgaacattcctaatgtcttcatgccatatatatatgctcctgtagtctgggaagcctagacgtagccacattctacagggatttagtcactgtgtgtatagccatttgtgtaaggggtggggtattgaattacatctaaaaatttggagctggtcatgactcccatgtagtctgttaggatcctctcttactgccagactttgctctaaattactcgagattcacaacatcaattattaatgtttattgagtacttgctgatgtggaactagatgtgtgaattttaaattatccatggaaataaaagaagagtagctcttctctcattgacctaaacaagcaacgacagttatacacagagccacctcctgggtcctggcttcccttgctttttgtgacatagaccaaccacagtttatttcattggaatgaaactggcctcatttggatggcaccgccgtacaaagctcaaaacattacttcctacccttcctaccacgattctggcatttatttatttgtttatttgagttggggggtggtcatggggaaggggaggttttctctgtgtagc

SEQ ID NO: 26709 - DNA, 1149 bp, Mus musculus
aagggttggtgatggcagagtggaggcatggtagctggagaagaatgctaagagcttccatctgcaaactgaaagctcaagccagagacagccactggaaagggttttggggcctaaagtttagactcaacctcctgtagatgttgcttctatttcctcagatgatgggatgagatgagctgggctgagcccagagcacttatttctcttaactatctctaggcctagtcctgcaaagcttctagcctccatacaatccaatctttcaagctgtacagatggttgtgagccttcatgtagttgttgggaattgaaatttaggacctctgctcactctggtcaaccctgctagctctgttcggccttactcgctcagtccctgcttgctccggcccaatttatttattattatacataagtacactgtagctgccttccgacacaccagaagaaggtgtcagatctcattacagttggttgtgaggcatcatgtggttgctgggatttgaactcaggacctttaggaagagcagtcagtgcttttacctgctgagccagttctccagccccaggccgattgattcaatctggcttttctctgtttctgactgaattgctctgcttggcctcatactaacttaggctatatgttctactcttctggctcattctcattctctggcttgttctatcttcacctgtgtcgagtttgctctttttctgcaatctgtctctgtaaaactgtcttggtaaaactgccacacacaccccacatactacactatcccccctcctccccactcttaagtagcttccctttcctgtgcagttctccgaagagttgggtatatcctatctctgagtcattctgtcaactctttctctgattcatcactttgtctgcccctcgattagatgccactttcaaacatggctgctttcttctacaaagtaaccttactttcattgttagggattaaaggtgtgcactaagggtgtgtctatactccagccagatcatactgtaatccagggtgtgtctgcatcccagctggatcacatagacctagaaggttttaggatataatcccttgccagagcagccatgttgctggattaaaatcctctgtaaccttcagtgatatactt

SEQ ID NO: 26710 - DNA, 1150 bp, Mus musculus
gtgtcagcagtggcgggtcaaacacaatgcatttggtttgaaaatgtcatcatcaggtgaggttaaaaggacccccacatagcacctttgacctcagagagatgctgtcagcaaagagaaagtctacccatccaagcctccaagcttatatcatgcatgttggtgtgaagatgctgacgaagggggaggagagttcatattttcaaggtaataaggaaatcggggagtgagccacagttagccagaaagcaaattctctagagaacacatgatggtccttatgaaaaacttattcttcactgcacactgttacatgatgtcccgcatgcctacgtttactaatgtaatagatagttcataaatagggaggctaaggaactactgtaagggctggggtattgtagtggtagagggcttgctaaacatgctcaaggtcccgggtttgattcccagatccacagagggaaatccattctgaaatacagaaagatggcccagttcttaagctggagagcttaaccctgtttctctgtccctaaagttagtgattgggtgcttgggtttggttcccagcataagctgttgagcctctttctgatttgtgtcttgaaatacatacacacacatgtatgtgtatatatatgtgtgtgtgtgtgtgtgtgtgtatcaggaaaaagctacatgaacattgaccacaaacagacttctgcctcgtatttcctaaataatacagcatgccctccaatttacatagcatttccattgtattaggtattgcctaacatctggctgtgatttacagtaaacaagaggatgtatgtgggctttatgcaaatattgcgcgctttcccaaaagggacttgatcatcccaagatctgatggggatattggaaccaatctcccaccaataccaagggcaggtattctctgtacatggttgattcttggaagagtacgtcagttaaaagtccttataacaacgtctttaccagagtaagcatgttagaaatatttgcccttatcattgatggcatgttcgataccgtcctgcgttctttgcttttctgtctcttgacactcttccttcaaactttggtaactagcggcactttggacacattgttagctcacttgcctgcgtggtcaacc

SEQ ID NO: 26711 - DNA, 1215 bp, Mus musculus
gcatgcatatgccacagcttgtccatttgccagttggaagtcacttgggtagtttccagtttggggtgacgataaatgaaattgctttaactgtgagcacactgtcttttgtataagcacaagtgtcctttcccttggggagggacttaggggacttaggagtggaattggcaggatcatatagtatgtacgatataatttgtatgaaagcatcaactattttcgaaagcagttaaacgttttgtagtctcgccagcagaacgggagctaggtggttccgcatcgtctgcagctgcgccttttgtgtggtcgaaggtgttcgctgttctgtaaggtctgcgcactgtctgagaggggcttaggtaatctttgatggtctctgtatccagctcagctgagagggctttgttaactgtaattgatgccaccatctttacactggattttctgtagcccagacaaaccttgagcccactgtgtagccagggatgaccttgaacgctccagcctcctgcatctaccatcaaagtgctaggagtacagacttgggccactgcatctcactttatgtggtgatggggattgaattcaggatgttgtgaacactagccaggcactttgccaattgagatacttccccagctctcacactgttaaaaaaaaaaaaacccaaaaccctataattcatcttcattctaacctaattatacctgtaagtctttccacttaacactccttcatagatacgtctctgtaagagtgattggagtctgcatctctcaggccctcttctccctgatgtcagtgcccagaggttgggtggatttgacacagatgagacacagatgattctgagggtgaagaataatatgtgtgtttctttggtgtggccatttctctgtggtgtgggataggaaggctcctatacatgctgagaggtggtggggtacctgtgcacacatgcacatcaaaggtaaagccaagggcgatgggctactcctaccttacactggggactgagagtgaggctcaggagtgttctgctctgacccgttcctggatgctggggaggaagaatgaagcaggaactcagcaccttcccacggggaggggtccttaggtgggtgagacacctgctcttcatctgcctcttcatgtctcttagctgacataagggcagagggtttaaactaggtgtgctgtagccattgtact

SEQ ID NO: 26712 - DNA, 1100 bp, Mus musculus
tccaggaagactggagggctctgtgccatggccctgccccccaactctgaatctctcccagatgatgtgtcagctccgtgcaccacacacacacacccacacccacccccatcccgtttttcctctggaccacagggtctgccgcctgcctccccccaggccgtgcagttgcaggtggtgaatgccaatcttagctctttgtctgtttctcttcctttgccttcctggggtgctgatatttgtcccccttccctcgctcatttagagatggggagcaaatataagctttgatgggaacaccttcatggaaacatttctctcgcaagaatggctcctgctaagctgtggggccctcaggccatcccttgctgccgcctggtgagatgtgctaacattggcttccatgaccagttgcttagaacatttaagtcatgttcttatcttctgttgattctctctgcctcctcccgacttatgaaatgaaagtggttctggaagtggccctaagtctgttcgtttctgtgactttgtgtctctaggaaggtgatcagatgtggtaatttaattgtactttcttttcattttagaatcgtaagtcccactctttcgattttatacttctgctgccctgctgccacctgtatcgccatctcccctcccaaattagaatgctttgaaattgatttggtaataactatttagaacgtttcaaatctgggttaatagtcattttgctacattgcctgcaatttaaaaatcatccttaattatagaagccttctaaaatctcttgggtaaaggaggggagtttctctttacatttatgatctggtaacacagtaaacatggggaaaaagccttggtggtcccagccggcagcatctgcaccgactgcagccactgcgggtgtttgggttttaaaggctgttctattggaacaggcaagcatgtgtgggtacctgctgtgtgctaggacacacttgttcagtattgagacaataaaaagtaaggcacagtatctgttttcaaaattgtctccttatgggactatgaaatcatttgtcctgacactggcttaagtggacctctcccatggaagg

SEQ ID NO: 26713 - DNA, 1207 bp, Mus musculus
cttttctgcggtagctcttgtgttaccagtgtcttttcccagcaagtgtttggtgggattgggtatttaaagattcagaggaatttaatgagatatgagcaattcatcttagtggttaaagggaatattcattatctccaaattacatagattcactgttaaatctcagatatcttgacagctttttcattatcttcctatcagtttttttcctttcccatagaagtgatttagcagtttatttcccctgataagcaacattcttttaatttaccaaaatacattgtatgaaatatactttgataaaaatctctgtagaccagaaaactttccattggtgctggggaggggtgtgtgtgtgtgtgtgtgtgtgtgtgtgtgtgtaactctcagcagtcccagctgtgcctagactccttcaaagtattttcaaagtatttcgatctctcatttcagccacaatcacaagttcatcggaaaatgatgaccggagtggctccagtctggaatggaacagagacggaagcctaaggttaggggttcagaagggagtgcttcatgaccgaagggcagataactgttccccagtggcagaagaggagactactgggtccgcggagagcgtgctgcccaaggcggaaccctcagccggagatggtccggtgccctatcctcagagctctggctcgctcataatgccacggcccaactcagttgcaggtaagaccatgcctctccccaagcctcaggtcccggttccgtttacttaatccagacccaagccaggagtgcgatcttctcccataggcctcagtgcactcactgtacgctcccacggtctgttagtggtccttttactctgtattgctttggtaatgttggctctttgtagccgaggcggggagaagttccctgaggctgcccttcctgtttctcttaagcatgtgtgaattacggcttcttaatatctcttgacatagcggccgttatttaaggtgaagttgatgacgagatcaaaggatttctgattcaactgtaaaactttgttttgtgtagtggaagcccgtcacagctgggaggtcaaatatttctgtaaaattcagctgtcattgggaaagcgtgtgtggtagtgggagcgagagcaagctgcggcagctagacacacacacacacacacgcgcacacacacacacacacacacacacac

SEQ ID NO: 26714 - DNA, 1098 bp, Mus musculus
ttccacctcttgggtggatctgatgccattgacatattaaaactgtaggataaaactataattagtagctagaaatcagccataaacagaagtactaaacagcattgaacactgttgtcagcttatatctggcgatttaaaggctgccaagaagacatcaactgatgccgttctcttaggagattatttggcttgctctgtgtaaaagcacacgtacttagagaaggaaaaaaaaatccactggtaaaagttaactcctgacataatatctggaaaattctggaaaagatggggagggagggtgtttaagttacagatccctaagtcaaacctgtccttacatgtgtgtaaaaatcgcaacctgagtgatttctagctggatataaatgtgacttttatctgcaaaatacaagcgcagccaagtatcttgttggttcctcgagaggatcaaacacctacttccatgatatggtgaattgaagagtatttttatagccccctttttggaactatacttaggtttcaccgtgttgctgataagacgagaacaggctagctagaatttggattggtgtccaggtcagagttgtgcaaaagtaccaagagaagcactcttagtgacggccacaaattagctctaactggttccgaaagtgttctggacagtgacggtccccaaaacaagcctctaatgtcctctagggaaagtgttcagacaggacccttgaggtctgggtggcagttttgatttccttacacagcccgttgtttcatagtcatgtgtcatatatatatataaatagctagcccattttattcagacttgtaaataactcaaaggaagttaatctaaagacaaataacagaaccccgccatctctctgcatgttctctgtacgctccatcatgctggttgccgcactgaacgatgcgttatcacggcttgtaacagtatacccgcaatggcactttatctcctgtgtatggacacctctgaggtgctacttaaatccgagtgacatatttttcacctgtaaagataaggtacagggatgaaccttggcttaaggtatttttatatgaaaatggtgttattgg

SEQ ID NO: 26715 - DNA, 1206 bp, Mus musculus
gcggtatttttaaggcttttaggcagttggccagcccatctttaacttatctggcagataaattgcacacacttcacatgtttaaaaatgttggttattataaaattgtttcaacctagtttttcagagtatatcatttaaaataagctgtcattggcagcgctgatgggatttaatgggttataagaaaaaaattattgtaggagcatgtttgtgttgaacatagggctacatacccagcttttactgaatttttaaaaattttctcaaaaaactatattttattattatctgcttatctgaatggatatcaaagctgcatgaagagttttatgcttttatttttgtgttactcacattattaagtgtattaatgaaatagtattgacttaaactgtaggcataatcagcttgctaatttctctcaccttgttaattacaggctttgaattaaaatataaaagcacactaagtgggcactgcgcccctgttctggcctgtgctttttcacatgatggaaagatgcttgcatcggggtaagctatctataattaacgccttagtgctcctagagaccttctctgttgtcggtgccatagtgtgtatgcggaggtcagagcacaacttgtagggatttttcctctccttccgctctatgagttctaggccggggctcagatcatcaagcgtggtggcaatcaccttttcctgctgagccattccacaagcccactgtttcttatcctttcctatacttcatatttgggtcttctaaatgctacccattgagaggtatagtgctactttagcatggttagcttgtatccactcccccaaacaataatggtagaaattcattttgatttttttttttaacttaatggtttttcaagatagggtttctgtgtgtagccctggctgacctggaactcattctgtagaccaggctggcctcaaactcagatccaccagcctctgcctggtgagagctgggatcaaaggtgtgcaccaccaccagcagccagcttgttgtgatgtattttagcaacacattttctccctgtgcttcttgtaagatgaccacaggtaaatcacacctatttccaaggtaaaccagccttgcttgcagcagacgggctggggcatatttaaatggtctgttgctgtagagaaagttacctttcggtctcattgcttgggatatga

SEQ ID NO: 26716 - DNA, 1265 bp, Mus musculus
ttatatgggccctaaacatttatgtaaagtaatcttcatatttattgcatagaataagaagaatcttgagaactgttttcctggaatgcatatttttttaaccattacactgtattatttggcttaaagttgtgtgtcagtatccgtttcccattaatgcatttcacttgtgtcatcagctctgtttttgaatttgcagtactctactttgagtttgtactctactcaggagtacttcagaagtaaattttttcttataatagttaaactgtttgttataagatagatagcatttcatttcaaaccctagtctttcagtttggcaggagtcaataaatgtgcattcaataatgcttaaattatttcataattggttaccttcccttctttcaaaaatagatgttcaagaaagagttccttcttcatattcacagggagcaagaccaaaagagaatgcagtgagcactttacagttgaattcatcatccaccaatcaccaattgccttctgaccatcagacagtaccaagttctagggactccagtagaagttctttcagatcacatttttctccaagacaatcagaatcttttcgcaacagttcacatcctgcattttcatatttttcaagtagaaatgaaactccaactataagcaattcagaaaggggttcatctcagagaccatatcgagaatcttctgacaatgaaggtaggcgtacaactaggagattgctgtcacggatagcttctagcatgtcatctacttttttctcacgaagatctagtcaagattccttgaatacaagatctttgagttctgaaaattatatttctccgagaaccctgacttcacagtctcggaataatggaacctcctcgtcctctgacgtcagtgagggcagggcagctgaagcatctcagggatttagatttcttaggcgaagatgggggttgtcgtcgctcagccaaaatcatagctctgaaccagaggcagaaaattttaaccaagaatcagaaggtagaaattcaggaccatggttgtcttcttcacttagaaatagatgcacacctttgttctcgagaaggaggcgagagggaagggatgagtcttcaagaatgtctacgtcagatgtaccacctagatctcatattttcagaagagattcaaatgaagtagttcatcttgaagcacagggtgactcccttggggctgctgccaaccgaccacaagcatctggagcgtcaagcagtgctgctgcaggt

SEQ ID NO: 26717 - DNA, 1123 bp, Mus musculus
ataaaatgtccttttgaaataaaatgccaatggcacctaattagtttttcctctttaaatgccttaagttacagccacattttgataatcatttacttccagtgtttaaaatttttttaaaagaatgggaagtttgaagagcattattgtattaggtttccaaatttaatttgaattctaaatccacttagcaataaaacctaatttttaaggaaaaaaagtatgtaaaagatgtagtaatgatggataacttttgtattgatttgcaaaaaatgcagattatatttgataggccatggtatgtaggtattcctttcaggaatattacagctgtaaattatatcagaattgccagtcaaatgatacttggttaaaaattactgaaaatctcaagttaacagaatatttttttaaaacccacattcaaagtttaaaacactggttttcaatgtgtttttagtattgtcacttctttatagagaaatataatataaataacctatttggatcctggtcatttttaggtgttccttgataattctgagcatttatttgatgattgttaatatttttcactacctttgcaaaacagataaattacttattcaacattaatgagtttgcactatggtcttgagctgtgtaaacttgcgtaatgatttccactgtcagcacccttaggatatatattacaatttcgggtggtttcagattagtccaatgttgtggcaacaactcactttcaaaacctaaatagaaaccatgtacgttgtcaaatgtgaatggacagtttgcctacatttagtttgttggtgttaatgtaaaacctggcttgaaataaagtgatactgattgatttattttagtttgaactttttccttttaaactggtcctcaatgagaaactaggaaagaatttaattaaaatttcaacttttatttcatacaatggttctattttctcaagtttattgtatgtctgagtgttttgtctgcatatatgactctgagccatgcccatgctgtgtcttcggaggctaaagaaggctttggatctcagggaactgtagtaagagttgtttgggagctgacatgttaaaagtagtttgtaatggagcccaga

SEQ ID NO: 26718 - DNA, 1312 bp, Mus musculus
caactataaataagatcaatgatgcttcaaaatagccttttaaggcactggggaaaaaatacaaaataaggcatattttttatacagaaaacagagccccttggaagatgtttcttatactatttcaaagatatgtatactggtattaattaattgttacatttctgtttttcattgcttatattcagtgagttggtttttgtctttaacttaaagttaatgtttcctaaagttgggaacgttgctgttaagttgcctgggcgtgctgtatcagcatgtctgcgtttgatgattttcttttttacaaggacccaattacagctgagacttcagcttttacagttcctgtctttcacataggagatcagctttctgttggtggtggctggggtttttggttttgttttgttgtttttgtttttgttttgttttgttttttgaaacatggtttctttgtgcatcatagccctggctgtcctggactgactttgtagaccaggctagccactaattcagagatcccccgcctctgccttgggagtgctgggatcaaagactgtgctggcaccaccccagcaagcaggcagggtatcaccttttgatgaatgtattatgttgttgcctttttacttgagcgaaacataaaagtgatctttgaataatgttgtttgctacttctgtatttgtaaacaatcaccgtccctaagacaatgaaactcagaactctgtgattcctgtggaaatatttaaaactgaaatgattagtgacacactattttgttgatgtaatttccatttgaacatctggaatatacttttactagtagtgtcaaaataaatatggtgactgttttattcagtgtttcatatttatactttagagtatttttgtacaagatccagatttattttgcttgaggtgtttatgctatcataaagttgtaaataattttctaagactgttttaatgcaatctacagttttcctaaaatatttttcttgaggcctcttttaactatcactaggagtttcttcaaaaaactaaatcaataccatgtgaccacagttgtgatcatggctgcttccgtggctgatccttgcatgtgaaagcatctctaaattaggtttgattgtatcccatgtgtagtatgaagagaaggtgtccagctattgcgagttaaggtattttaagactttgtgagcactttttaaagaataaatctttgtatgtctaaattattttaatctccttggctcagtgtttctcttttgtgtgtggtgtacgtgcgctctctcaagtgctctctctctc

SEQ ID NO: 26719 - DNA, 1177 bp, Mus musculus
tggtaaaaactatccaaaatgaagagagctgtctcaaagaggaaaactgagcatacttgatatatgtaggcagtgctctgaggaaaacccaatgctttgggtcccaagaccacatgaatttagggccgacacatttaccctatgcgctctaagattaagcaaagtacgtatttatttgaaatcagtgtggctgcagctggattgaaatggggtgggaagccactggagttctgtgagaaccaatgcccaggtgcctcttaggtgtgatcctcacagtctttgtgagtagagactctctttcacagagtagaaactggaggctctggtgtcagggatctgatccagggtatgacagaggcaaagcgtgtgtggacatctggccacccaatgccaaagcccagaatttactgagcatgccgtctttcccatttcaattcagaactcccgagtgactttcttattttcctctcagctttgtttagtcttcattaagaagtcactactatgccattgtacgtttcccagctccatcttggcaactggtgaaaatccattccacttttataggctagagtctcaggctcctttcgatgtaattttgctccttgctggagttcccttggtgcgtgtgtgtgacggctacagaatctcactatttttgcttcccatctgatggctatattttgtgtgtgtgtgtgcgacttccttaatacaaactaaaagtcaaaaagtttttctttctgttctcatcgtggggattgaacccatggccttgcatattcaaggctagtgctttaccattgaactgcgtacccagactactagcaatacttaattaacatttaataggtatgcctttttaaaaggtcagtactaaagcaagcattagtataaaccctgagaaatcccactttggtgttttcaactggacatgaaccagtttgatccaaaatgaacgagcctcctcgccatcacctaagtttctccatttataggatgcttggtttgtgatccaggactaaccataagccactgctctcttctcgcctaggtagcactccccagatgccagactggtataatccaggtaagctgagcatcaaaatgtagccatctcagtttggacctttttggataatgcatgtcatttgctgttaattgctactttcttctcgtg

SEQ ID NO: 26720 - DNA, 1889 bp, Mus musculus
tgtgaagtgtcttatccttttctatgaattccaatttgccttaactcttttgatgctgtagctgtttcagtaaagttagttcaacctaatgatgtagaatgctttgaccaaatgggctggtctagtgcaccttgtaagcagcagcctagggcttttaaaaggtagtcaataaaagttgctgaaattttggcttttttaaatatgtagtaggtgtttttaatgatttttcacatagcgtgtaaggtagtgaagtgcaaggagggaaaactgttttgtgtgaaacacattttctgactggggggacttttaatagggtaaattgtttataaggctgtacactaacagtttcccctaatagtgtgactgatttaggatatctgctgtatgatgcaatgtaaagtcttttttgcctttttttcaggaagaaaaaaaaataaaacttaacgatgttctaggtttagtgtaggtagctgcggggatggggcgggggcggggggcgggggaggggagtcaccgaatgttttgtcctttatactaacatagtgctttagaaagagaaccacgcttgagatctgagaaaccgatggcgggggggaaaatggggttgctgttgaaactagatggtgaaagctaaaagtaaggatttctcttcaaacctaagctgagatatgaccagaaggaaaacgattggctacgagctctctctctctctctccttctccccacccccctctctctcttccccccacccctctctcactctcattctctattaggtaaatttgaaaaactaaacaaacaaacaaacaaatgacttggcacttttaaaggtaacttcaccaaagaccgacgagccagtagccagcagctccacctatctcagcgtcacatcctgtctgtcctttcttttttgccggaccagtttgcggttaggagaatgtgccttttttgtaccttcgcattaggttttataattttaactgatgtatggactcacagagacaaaatttaaaaaatttaaaaattaaaaaaaaaaaaaaaaaaaagcaagcatgaaggaagatttgaatccaggcagtgccgccctctgacgtcatcactacaggtgtttgcgtggaaagaaaaccaactttgaaactatgaaattcctgattcataaatacagttatttctactttagtacatacaagataactcactgttattaacactcttttttattaaggcagttgcatacgttttcaaaagcaatggtgaattaagttgtcttccaaaactgtgtacttgtctggtcagctgtacgtgatcagttatctacctcagaggctatttttcttttgtgctgggacaggttgctggccctccctgtttccaccgaccaaatcctcctagctcaggagctagggctaagcagttacttcttttgagtattttttagttcttaaattttattgcttgtatttgatgatagatgtcagcgacatttcatagtttcaaaaatccttgctgctctgaaagtgtagattctagtgaaaattacatagtcataagagaaatgtggggttttttgtttttgttcttgttcttggttttggttttgtttctgtttttgttttttttaagttgtggtattattggttttatgctccctaaaacttgtgctttgtgaagtccagactgaaggcagcacaccctccgtggatcgagtatgttgatcagcccaagactctcactacttgatatttttttccattagttaagacagaaagttgatagctcagtcagtaggggaggggagatctgctgctaggtatgtctgaactaagtgccatactcgtctgggtcagatttgggaaacaacctctgtacatataaaagaaaaaaaatgt

SEQ ID NO: 26721 - DNA, 1194 bp, Mus musculus
tttttgtttgtttgtttgtttttaatctttttcaagattaggggttgaaaaatgtgacacatattacaaaggcctgaaatgcacattttcagttgcttagaaccaggtacccttgcctattctaacactcctcagtttttgtttttgtttttgtttttggactgcattagcgatccacccaaaatgtagtcctttgttttccctctctacatatagttcataatcttgattttgaaaggtttttttttttttacctattcggatagcttcctcttttccttaaattattgaagattagcacagcaggcagaggaaaaatggcagtatacattctaaagggaatgtggtttgaatgagaatagcctttagtcaccagcttggtgaactgtctaggaacaattctgatgtgtggctgtgttggaagaggtgtgtcagcgaggatgggctttgaggtttcaaaaggcctattctctctccacactatttctctaccttgctgagaatgatgacttaaagttctcaggtactgtctccaaatgccatgatggtcatgaactaacctccgaaactgtaagcaagccccaattaaatgtttccttttctaagtttccttggtcatgatgtctcttcacagcgatagaatagtgactaagaagataaaaacacaaacttcacttgacataactgaacataaatgagttaaaatcacccagtaatatttgtatctttaaaatgttagaggaaaaaagataattaactataatcatacgaatagaggtttcctattagcagaccatttttattttccactgaccttaatataagtatgttttttaaaaaattatatggtatcatgtcaatattttttcaaattcatttcatgtgtgtgcatatatgtgagggagggagcatgaagtaagcatgtgtatgccatggtacacgtgtggaagtcagaagcaactgccttcacaattctattttcaccttctcccttgttaaagtggggtcttgtttctgtggagctgtgtatactccagtctaggtgacccagcttccggtcatttattacatttcaccattggaatgctatttcacctggctttttatgtggattaagcactgagccatcttaccagccccaaaattattcttaccatagaaaatgtagtcataaattaaaataaccattcacta

SEQ ID NO: 26722 - DNA, 1178 bp, Mus musculus
caaaattaatgttagcaaaaggctcagcagctgagcagagcagtgcaaattggtttttgactgagttcctagttctactgctggtttaattgatatttaatcctttcacaacagttgatcctggtgtccattgttaaaaaatgtgctcggtgcctggaaaacccagctcccagagctaaggagttaaagagtagatatttacttgaatgctgaaagggtaaaaactggctctgagaaagtgtggtaacaaggtgaaaaactgaaagccttatctaccactgctaatgtgcgtgtcttaatgatagccctcctttgtcacacttactcatttccatgtttgctggagaatatggtgtccggtttcagagtttctaatggtgctttttcacacctgtgtgctttcatcttttcttaatttataccctgttagtgtgttgtttctctcctctcatcatgcattgctgtgttctgagtctgagtgccctttgtttcaggcccgagatggttgttggttggtatcacagtcaccctggctttggctgttggctttctggtgtggatatcaacactcagcagagctttgaagccttgtcggagagagctgtggcagtggttgtggatcccattcagagtgtaaaaggaaaggtagagtcagttctaacttcattgccgtctactgccattttatacacatgcatgtaataaaaatctttatttgaaagtgttcttaattaaacacacacacacacacatgcacacacatacacacacacagaggaatgctttttattgaaattattcaaggccttaaatgtttgtcatagtattagcaattttaaaaaattacgtaggggttttacttttaatttacaatcatgaatgaatgtttatccttaatgtttaaaattttcataaatttgaatgttaaatcatactgaaagcttcatacattctactaatatctaataaatatatctttaaaatgttatttttaaagggctttgtttttcagacattatgcaggatatattctggatattctaaatattttagacaatgaaaacttgtcccaaagacttggtaatcaaccattcatgtatttggagtgaggacccagaagaatgattaaaaatgctgactgactctgaaaagaggttagcttgcagagcacattgggt

SEQ ID NO: 26723 - DNA, 1158 bp, Mus musculus
ctctcatgacatacacatatcagtatacataccgatatataacaaaatagttctttggctggtcatggtggcacatttaatacacttttacatttttttatttaatcagtacttactgaaaatcttctgtgtgccaaactaaaacgctaaaacgtgagacataaaagtccctattgcccagagagcttactttctgtaaaagaacacaaacagatagcatagtacattgtagctaatgccgtggacaagagtggtgactagggagacaatggctttatatggggccagtaaaaatttgtcttatcaaaaaaataattttttgcaatctcctaaaaatatttataattatatatatatattgagcattataaatatgaatgtttataatgctcaactatatgtgggttattgggctggagagttggctcagtatgtaaaggtctgagttacatctgcagcccatgtaaagagcttggtatgatgtctagtgctgaagaggaaagatagccttgctgaccaatattcataattgccaaggcagaatccacgagtatccagcaacaggtggatgtgtagggtttttctctctgtgtgtgtgtgtgtgtgtgtgtgtgtgtgtgtgtgtgtgtgtgtgttcacaatgcaatactgttttttctttaaaaagaaagaaatccttccattgtaacatgatgatcctggaagacatggttaaatggaataaactagacacataaagacaaatcttcacatgtgaagtccaaattcaggagtaaaaaatataaaatcatggcttttagagtcttgaagctggtgttaggagagactgggaaaaaagaaaagacctgggatatgtttaggaagtggtaaacgtggctagagtgcaaatgaggaggagtagaagatagttacagagttatttctgatcagaggcacgatacacctggatcctgactttaggaacaggagaggagatttgaatgggagttacactgagtggctgtgttgtgtagtgacagtagtaatggaggcattgataggaaaagaggaaaattgaaaagttccttcttactaaactattgatagcaataaccttttcaatgtaggcagaagaggatgaagatattgattattgtttttgtttcctaattgatactc

SEQ ID NO: 26724 - DNA, 1101 bp, Mus musculus
acaagtacatcaggaacatctcaaagcaaggagggatatatggaaatgtttggaggaaggaggggagaggggaaatgtaatggtattataattattgttattatattgtaattatattttaattacattgtaatttcaaaaatctttaaaaactaaaaaagaagggaaagtaattatcaattgcttgaaatttgtttcaatgctttttagtctctttctatacatatatatatatatatatatatacatttgaaaagacattaataatttcacattcatatcttcaaaatatactaataatttctattttaatttttaccaatttatagaattgttgaaatagaatgtgttggaagagtaattagaatctgtcagcaagtatcttttgagtacttactatattgtaaaccatgatagactaaaatgaaagaaaggctttgaagtttgtttgcacgtccaaaggactcctttttcccctgtctctctgtctcttcatttctttgactctatctctgactctgtttctatcccaaacccctctcactctgtgtgtgtgtgggggggggggggtatatgttggacatgtagatagtataaagctgaaaataaatgttgaattctgtagttactttttacctacagaatttactttttagaatcagagccccacccttgtttccttgaaaaacaagaaataataatactttacagtttgctttgagttgagatagctagccttggcattggcggttatagataggcagttgaataatcttttcttgcatctggcttcttaggagtagagcatctgacccacctacatccaaagaattcatagaagcctttcagacatgcacaaaagactgcaggtgctcacaaatcactatgtgctgtgtgggactcccacttcctctgcttagacatcctggtgcacgtaacactgcttagcaattgttccaagcatttctaaatgcacacaaaaagagactggaaatgtcaaagattttttttcaaaatttatttattaagtttaagaaggaaaattaaagctataaataaggctaagaggtttattattattattattatcattattattat

SEQ ID NO: 26725 - DNA, 1079 bp, Mus musculus
tcctccttcttgttccataggcagtgtttttggtgaaattttctatagagatttcagtggttaccgggttctttgcattaagttgtctgatctaagatgtcagagttaatttggtttctgaattttcgtatattttaactgaatatattctagctgaattctgatgcaaatagatataattttagtgtagctggtgaccaaattaaatatttaagaaagaactccatgatttttaaaaatatttttaaaagaaaactccacaaaagtgcaagctctttttataaatacagaaaacttaaaatcagcttttacttcaaaagatcctgaaaaggaaatgatgtctaatcattttgatattgattactatgtaacttgccatcaatctggatacttggttattgtgtaagaatagatcaatgaataatgcatacacattgtcctctgacaatttgttcatgaccacatagtcagtagcctgaaggaatattaagggaaccattgaaggtacagaatctgaagctgtcatagaaaacagaagccacaccatgatgttgtaagtcattgagcagtgtacactcttaatgtataagtgcttttatttatacagtaaacatgtttccatgtcattttgagaattttttaataaacattcaaatagcttgctgtaaagttttgtatcatacaaaatttgttacatatatactgcaatgagatgcctcagttcaaacaacggtgcattaattcagctattatctaaaagattgccaaatggttaaatgccaggtattgcacttctagtgtgagtggcagtttacacactttaaattacatcaagggaaaatcaatactatgagaatcttgatttggtccactttaaatgtatttttaaggactgtgctcattaacctattttaggcatgcattcagaaaaaagaaagttaacaaatatatattcaagttatatatttatttccagaaaaagcatttagcctggaagaaagtagaatttatcaaggtagtttaaactctgtgcaattaaaaaaataagaaaatcaatttgtgatagttctttaattaaa

SEQ ID NO: 26726 - DNA, 1121 bp, Mus musculus
agtttaacttgatgcattgtaaaggaatgtacaaatgtgctttgttactaaaatgataatcaagttaattggaactattttcttctgtgcctgttatttgcagttatttatatatatatatatatatatatatatatatatatatatatatatatatatatatgtatgtgtatatatatatacacatatacatacattgtgtgtgtttaaatctgtaattatacctgctaatactatgactctaagtagctacagtcagtgataatgttgtcatgggtaattctcaacgttgcaagcttttatcatagtagatacattatcaaggattgggaggggaattgaaaaggagattggcagagacattttcctttctgtttggacattggcagatgggatctgagactggcaattgctatagacgttttcctttctgtttgtttctctttgcttatacatacatatccattgttggttcttttgtaatgttaaattgggaagaatgctcaataagattcacaatgttagtctctagttatttaggacatctcactgactactctttcctctgaatcccatgaaagtattccttctttctcttctgctcaaccttactcagtatttagcctttgtttaggtattattttaacataggtattgtatataaaaccacagtactggctttatttatgtaaacttgagtaggctggagtagtcatttaggaagagagtacatcaattgataaaatgcttacattatacatcaaaatgctatgggggcatattcttgatgactgatatggcaggggggaggtctacatcactgtgagcagtggtacttctgggttagcaatcctaggcgctataagaaaattgactgagccaaccacgaggaacagatcagtaagcagcacgactcatggtttctgtttcaattcctgcctccaggtcactgccttgagttcctgcccagacatctttcaatgatagaatgacatgtggaactgtacattgaaataccttgttccccactcttaaagttgattttggtcatggaattttatcacagcaatcagaacacaaacgaagacctccaccgttatagatttctgttgcaactaaca

SEQ ID NO: 26727 - DNA, 1129 bp, Mus musculus
ctttggtttgggggggttggggtttgtgttttgaggttttaggtttggtgtttcacagtttgagtttggggtcttggttttttttggtttttcaagacaggctttctttgtatagccctgactgtcctggaactcactttgtagaataggttggcctgaagctcagagatctactttcgtgtgtctcccaagtgctgagattaaaggaacgcatcaacacacccagcttggttctttcttcacttcaaccatgcagatctcatttgaaaacttttccagagttatctctgacttatctgcatcaggaaagggaaattctggagagccaagttcaagattcactctgttgacacagcacaatgcctcttcctatgctcttcatcacattaatgatcagaaatgacatggaactccccagcccctgcctgcaagagctaagtaggaccttactgtaagttgaagggagctccaccctaactcatggattgtgaagaatggactgctgttgggtctgattgactgttgatggatgatggtgtggtgtatccacaggctattgaatgcaacttacaatgcttaatttaaaaaaaaaatctattctttaagtataaaaaaataaagcaaaagaaattttaacttgtgggactgcaagagtccccatgtgcccagagcctcaggaatgtcatactgagctgacatcagagcctaactaccactttgaaggaagtctacttccaaacaaaggagtgtcttcacttccagagagaggattcttttacaggtatcaataccaagaagactgcaaggatacaaaacctgccagtgaaatattccattttgagcattcacacttacagatttctggacagtaggaaagatcttgttgatccccatgagtatagttaactcttgggaaacaatgcttcttccccaagcctccaaaggaaaggccaagatgtcatggcacggattacagtctctatatcctcctggaaatgcagcctcctgttttcccctgatgagattagctagtggcaagaaagcagattttaaaagaagctcagatataacatttaatgtcaatgtaatgttgttgatattttcatacacttggagctaacctctttta

SEQ ID NO: 26728 - DNA, 1197 bp, Mus musculus
tgggatggatcacaagtttgggtggtcactggactgcctttccctcagtcacttctccatatttgtccctgcagttcttttagacaggaacaattctgggtcagaggttttgactgtctgatggcattcccaccagttcacttgatgccctttctattggagtagactctacaacttccctttccccactgttgtgcatttaatctaagatccctccctttaagtcctgagagtttctcacttcccatgtttctggtactttctagagggtctccccacctcccacccctcaagattgcatatttctattcattctgctggccctcagggtttctctcctgtctccccaccccataccagatcatgttcccccctactcttccttgtcccctcttccacctaggtgcctccctctgcctcccttgattgttttcttctctctcccaagtgggattgaagcatcctcacttgagctcttctgtttggtaaccttcttgagctctttggattgtatgctgggtattctgtactttttggagctgccggtccttggctcggagctcgcggaatcgcggacaggcgtcctcagcgcgaagaggcaggactcggagtcgtcgccttgagccttgcatctgagaagttccaggtactttgtacaactgcatcccagaacctgtgtgttttcagcacctttataagtgacggctgccatcaggaagaaactggtgattgttggtgatggagcttgtggtaagacatgcttgctcatagtcttcagcaaggaccagttcccagaggtctatgtgcccatggtgtttgaaaactatgtggcagataggatatcgaggtggatgggaagcaggtagagttggctttatgggacacagctggacaagaagattatgaccgcctgaggcctctctcctatccagacactgatgttattctgatgtgtttttccaataacagccctgatagtttagaaaacatcccagaaaaatggactccagaagtcaagcatttctgtccaaatgtgcccatcgtcttggttgggagcaagaaggaccttcggcatgatgagcacacaagacggtgttagccaaaatgaagcaggagccggtaaaacctgaagaaggcagagagatggcaaacagaattggcgcttttgggtacatggagtgttcagcaaagaccaaa

SEQ ID NO: 26729 - DNA, 1196 bp, Mus musculus
tgctcttaaccgttgagccatctctccagcccctaaatacctaaataaggtatctctttggtttagattagttttagattccccatcttcactcactgtgaaaagagggactgggactcaagcagggtcatgatccagttaaacaaagaagacaagaccagggatgctatgagatgtgtccaagtgagaaacatttggaggaaacgtgatgatggacagtaagttggcaaaactagagccagggcaggacaccactgaggatggccgccagtatcttaggatcagaaaatagggtgagcttgccaggctaggatggggtgccacacacagccatctgatggggatgatttcaggtcactgtttccaacacttacatgagatgccttaggatcacccacgctggtaaaatgagtctgcaaacctaaagatcaataaagaagagtatccctggaaaaagcgagttcagactcaccatggcaaccacacaccaaaagctggagagatggacgataactcggggaatttaatgtggatgaaggaaggagatggaaaataaagaccaggtcttcagaactggtaaagagagacggtatgcattcaggaaatgccaattctaaaggaattgtgttggactcaaggtaaaatgcatagcagacagaaaatgacaattctcagaactgtggtatatgaggagcagagaagaggagccatgctgagatgagggtgtgaggagagctttgttttctcttccaataagatgagaggccaacatgtggatacacagatacggtcccctggctgcttccagtgacagctccatcagattgcctggtttgtctattctcactaattagcatcatcttcccggcagtactcagcgtcattgttaaatgttactatatgtcttgggtgattgtagactaagaaagaacagaagaggaaaggttgaccatatggttatgtggcaatcctttaaagcaaggggcagcacatctggtgagtggcaggaacagggtccactgtgtgcttttgtgtggccattagacaaaatgaaatggcttcatcttccaaatgatttttagaacaacaaatgaaattttgatgaaattcaaattttatcatgtacacatgaaggttcactagaagctggccaccagcatatttgtacatttgtttacacatagctactttgatat

SEQ ID NO: 26730 - DNA, 1146 bp, Mus musculus
aatggaagtttcttattacatcattttccaagaattacaagcgtgtggcagagtcatttagatgttacagctttgcgcccacagttctgctcatcagatattttctgtagcatggctgtgtgttactaaacagcacagcatcttcctctttcattgctcgtcagaaacgaaaacctagaagctgagtactgcctgggttttctctagtggtcagtagtagcgttagtcttaactgtatgctgtcttgcctgccttggtatttccattctgagcgctaaatcagaagaaggggagttgggagaggaggaacaaacttcagagcctaaaccatataccttttcagttcattgactgtgggtagatttttttttaatgaccttaatagagaagctggaacgtcagtacatgcagatagttcttatgtatgggaaaagaaatcactccaaagatttatgacctgtgggttactgttttcttttcttgcaattagcttttcactagacaggaccactgctttgtatctgacccttcatgcttgcttacatttcaagaaaagacatttctattgttatttgatttcatctttcacaaaagcaaccaaccttataaagagggatgatcgatgttgttctagacagcatttgtccaaggcagctttgctgtgattcctccatctatctcattagcatactggtagtaaagtcagttcaaattataaacttcgccacatgtgcaaggccatctaagcatctttaaggataatgtatattgattagaaaggactataaggtgagaaatggaatagaaatcagccttgcttttgtcaaaactgatttacatggctttcctgatttttagttgtaactttaaaatatgtccatagttaaatgtcttctttcttctttttaactcttttccaatattttttatctggcttagaataaacctaaaagttatttattgagtacttggaagaaaactcaactttaggaagtctctttacaatgtatctagaaaattctatccggactatgactgctcactctcctgtcatgtgccctggggtagattgttatttctgtgtcatagaaatatcaaaaggcaatttgtagcacattttatccaacattgctttgccctctcttc

SEQ ID NO: 26731 - DNA, 1161 bp, Mus musculus
ccagaagccttttctcctcttactgttgtatttctgtttaagactttaattgtacatctgacaatactgcctcttttatgttgtacttagaaattaatatacttataaaattaagatttattagccaaacttgaattctagttttaaaactgactgtgaattttatttttcatatatttatgctttacacaccgtagctccgagggggaaagttttgattacgcgctttctgcaattgatctcttgttatttaaaccaacggtttcaggtcaatctttggagtatttgtagcttctaatttttgaaatgactgaattaagaatttggatgcttgctcttttggttggtttgcctaaaatccagcccacaatccagtcgtctcttgggagagggaggtgccttgcaaactttcatataacgaatgtgcctgaggctgcttaactctggactagtctcagatctcaaacctgcactacacgaggaggcatacttttgcttcatctggacatttagaatactgtaaccttgctgccgttctgttagattgctaactacgtcccccgtctccaatttggctctccttaggcgataggatttgttgtttttaaggcaataaacttgacaacaccagaatccaagttttacttgaaaagctcggcagaatacacagtggtgtgaaaaaaacaacagaaagggtttttttgtgcaatgacaaacggtaaaaatgctgtaaacgttgaagaataaatatttccaacgcaagaacctcctgcttgactgtgtattatgaacccaggaaaccttagaagtttcaaatttggagtcaagaccttcaagaaggtgggctccggggatggtaccattgctctttcctagctaaccctagatacggcagctctttaatgtactttaaaaagcaaatatatattactaaggaaagaagttatttataattgccttgtcataatcgttaaggtgttctagaaccatttgcatacaatttaatgtaattccattccattctgttgtttacacaattactcaaagatgactgcaaaggtaaacggaaaaataaaagtgtattgcacagtgcactcgagtctcctccatttcgttcctcccccagccgtcaccagcatctccactgcgcaattcaaccct

SEQ ID NO: 26732 - DNA, 1214 bp, Mus musculus
atgccacagcagcacagtgaccaaaggcaagatgctaacactaatctctatgttctgttatgcacttctccgctcttcatcaaagttgttgattttccagtgttgtcagttcccctacaggttctcatctgcaattcctttagctgcttggtttcctttcatatggagcagcgcgtctcttgtagttgctgcacttttgaagaatccaggtcggttattccgtagactgtctccataaagacttagctgatatttcttcgtgagtgcactgaccagcgtgttttgacaggcttcttaggagtgaggctgtattctgggtgtattatattacgaggcacaccttgttgcctccctcccatcctgctgaggtttaatggtgactacctgctttaggcggcacctgtcagcttcttcattaaaaacgcaagtacaggaacctacttatcccccaggtcatgacatctttttttttccaaggccgtatatacgctctgcgtcattatggctgcacgttcataggatgtcaggggtaggaattccttgggatttgtagtggacagggtacatttgcatcagactcaggcagcaagtgaggctggtgctattctctctccatctgtgctgggcacagctgtggccagagtgagcagcctgacctctttgtgccagcatctctgactctgtgctgcccggggctgagccatggaagcacaaggatgtctggcctcgtgctttacagcagcagatgctgagtccacaacgatgtcctgggcattatgtgaataacggggtcacccatggctgtggacagctgggtgttctacaagcacataggcacacagctggggtgggtgacagggatggcttctctagcactgcgtccctggatgggatggacagagagctcttggcgaagctcacagaggaggaaggcggtcccagcctttattctttggaactgtgatttcactgctgttgactgttcagcagtctttatattctctttttctgccccataagagccagagctaacctctgctatcttgaggtaacctctacttcccatgcactagtggagagcatgagagtggggagctgcagtgtgcacggtcctcctcaggagcctccacaccacttttagtcgcttgtttccttctttgtttcaaacagaaaggaagggagagcaggcgttgttgttacatcttgccggatgg

SEQ ID NO: 26733 - DNA, 5994 bp, Mus musculus
tgaagaaatccattatttctatgtaggcatgctgtatgtaactgacacagggaacagtatttgcatttgtcttaggatattatttatttttttatttgtttgtaaatctgtggacaaacgaggattccttcactcctttcattctctgggctcgtgattgacagtaaggatgtcctgtctgtgtgtgccccttttccacgttgtggtccagtgtgccgtgagcatcagctttctttaccccttagagcaaggaacatcccatgccagatcctcacacagttcccagtaggttggctttccttctgttctgcacccattttctatttgcccatacagttggtgaccattgccccacgtgagtctaaacagggtgaaccaggtgttttccttgccactcttggtgatcagatgaaagagagtggctatggggggactttagaattttacaggaaaccgccttggtttgtctcttgtgcacagacatgagacttcttttctgtggtaggttgtcgggggttgactatgttggtaacaaagctattttgccctccagtgaagtcagtgttctgagtatgaaacagtatctcttgcataagttcccagatacaagggccccacatactgggttctgggagtctcgtaaggatagccactgccctcaaccaggtcttgccatgacttctaccctattagtccagtcttctgtcctgacgtataaaaaagaggaagccccgaatattctgaggcaggaaaagaaaaagtcttgtgggagttggcaaagacttccttccctgcaaagcactttattgcaaccagctttcaagagaaagccctatctggtattagactttgtattttgctgagtaaaataaatcgaatgagagaaagacaattaaccccttgccttcctcctcaaatgcatcccataatgactttcttgttgctagaaacatccaccccacaggacaagtctgttccatttactgctctgacgacttgtgagggctcctgtgaatttctcttcaagtggagctatttccagaaaaacagtaaaaaattctactggagaatagcagcaacagctgtggggaaaattgccaaagaatacgtcatgagccctcacccacccccaccccctgcagccagtgttacttttgttcggctacagaaaccacacagatgagccgaggactagacccatctcatcctcagtaaaaaggaaactgaatgggattacaagtactcgtgagtcaaacatctcctaaaacaggactccaaaccagtcagcgctgagtaaccaatagcaaaacattacagtgcatgacggtcctgctcagaaccacccccactccatttggttcttttaaattaaatctgcatacccataccttgaagcctgtgagttaattgttaagagaagactcccgaagaactcactgcaatattaaatcctcctccacctaattacaaaacagtattttctggtatggtccagacaataattttcaaagcttggaagcatgtctagttgttaccacagaagacagtgcaagtgactgtgtgatttgagccttgctgatatattagccaaaacagttatatgtctaggagtgaaacttgattgagtgtttgggtttgtgagaccagtgataagacacgggaggtactgttagtaatcagagcatttgctcaaatacaaatggatgaaaaccaagagcagtgttgagacagtgaaagtttgtcatcagctaagctaaggaacctacccatctctagttaatgtctgggctcatcctcccaggtatgagatggttttgacaaccactgtgtacttgtatttgaaccatgtgacactctttagcacagaagaattttaagatcaatctgtaaattcagaagaggtatataaaaatgaagtaagttgatcctgtccatatcaaaggcagctctaactcatcttctccacggaagttactgtggaagactaggggcacgctttctgactgacacctttaggttggctcagtctgcaacgtgtctgttgatttttctgtttcgtattacctttgtgagaaaataattctgcttggctaattgaaatggagtttgtaggctttttctggaatagaatattaatatctctgtctaatgttctcccaaaaatggacggataagactgagaacagacactgtccgcggaatcgtatccacatatggcaggccatagctctcagaaagtctgacttgtaaatccagctttaggttagttctaagtggtgattttggtaattagcatagcttgtggtgatgtctcctccttcctggttgcatccaaactccccagggtaccaaagtgtgtgtagaaaggactctagaaaaagtaactctcatagcttacctagatttagtgggggggaaagtaggaaatcaagtagactttggcctagagtcagtaattgatatagccgtgtctgatttatgtgtgcatatgtatgtttctccaaaaactggtaaaactaaatgattactgattcatcatcgtcctccatattcctttccttagaaaaaaaacgaacgcattcaaccatgtcctaaacagactttccttctctttagttttgctttgcaccagctgagagtagcaaagccctctcagcctctcagtcacagagctccctgagatagactcaggtcctggagcatctgctgccacacataggacacacccacttcactatcgcagactcggccccgtggatgttgagagcagaggagcaactgcaaggatcagtattgtgggtcattcgagtattcattgtaaaagtgcaagtgattgccatttaaccccatggttctaatgtctgctgaactgccagacagagcatatcccaaattatcattagattgtgtcattggcgtccaatgctgatgaacaaggcagcaaaggcacggaccaagaaagaccagtcatctttagtccatatggtaggtgagtctcaaactggtaaactcctgtctgagtcatacacttagcaaaagcactgcgtgctaccatggtcccaaaaggtgatgacatagcctaggtacagaggcggtactgtctgctgtgtgtaagtacacttattgatgttcgcagagtgacaaaaatgtgtccctgctgtgacatgacataggcctatactttttgagcaaatgtattgcctttccttcactttagatagaaaggtctgaatcttccaccttgcatttaaatctcattgttacttgggctaaggaaaaatgagacttcgttgttataaaggacattggagctcccctgagtctgtgttgaccagttcttctgagagaacgaatgggtgcctttcattgcctccaacccagtttacattactaatcattttggggtaaatcaatgtcagagttgcctggatatttgagtattttccttaatttgaagaagaaaaatagtgtgtagaattagcccaaaggtacggatgtgggccatttatcagtatgggagatgatgtcattaacccagagaggccgcaacacctttggaaataagaagttaagtgctggccctttgtgtaatgtttgtggtactaaggctcctacctgcctttcactttccttgtcttcggcttatttctgcttagtcaataagtcgtcatagccctgcaatggttctaacacccaaaggagaaaaacatcaaacaagaccagagtcgccctgaggggatagtgatcacctggctcttgtgtagcaagaaagaaatgtggagggctctaactactgcaggtgccttcaagtatgctgcccctgtcaggaatgatcataaacgttcttaaagtgaaacaagactgtttccttacatgtatgcttcccactatcagcttctcttccagaggtgagattgtgccattctccaaatgctgtgagctaattagcaatagtctaccaatcacattttagttccatgaactgatgggctaaaggagggccctcctttcacctatgtgtacatagcacccacccacccctaggaggcgccaagcagatgtgggggagccctagccaaagctcttgaaactcctgtaaccaccaatactcaaaagcagccacttttcatggagaaaatcatgttgaagaacgtaagtcaccataagtaatgagatacgtagacacccgaataagaaggttcgcctcctgcaggcttttgtgacttgatgcatcccaaagcctttgacaggaagcatcggcaggtgcgtgcattgagactcccaccaatgccaagtgacaggaatgcatcggcaggtgcgtgcattgagactcccaccaatgccaagtgacaggaatgcatcggcaggtgcgtgcattgagactcccaccaatgccaagtgacaggaatgcatgggcaggtgcgtgcattgagactcccaccaatgccaagtgacaggaatgcatgggcaggtgcgtgcattgagactcccaccaatgccgagaagttgcaaaagcctgggccacagggtgagttactgtgtctgcatggaatcgggcactctcggattgctgggaagcgatgaggaggcgctgttagcctggagctggtctcctttagctcattcactcacggccttttaggcttctggaactctggtaaaagaaagccagatgctaacatttttctgctttcagtttactaatgactgttagatcagctcttcccatcccttcttctctgtctggtgccattttcaggaggtgggagagggtgtgcccatgtacacctgtctccttaacacaggtccacgaatacttagcttcctgggttgtgtgtcttctgagaaccatggtacagcgtcagtcaccatagtttctgtgctcagtggaaaattttgatttcattcatatttttattctctttacctatgataaatgtcataaactgtaaaactctccttaatgtgaaactttttttggttttttgttttgtttgtttgggttttttttgttttttgttttttgttttttgttttttgtttttttttagtgttagctgcaaagctacaaagctctggaatggttacattatgattctggaacgttcgctcaaagcttaattagcataagtgtggaccacactccagcttaattcccctgtgcacacagttctcatcactcctgtgcccaagtcccagtcatttcccttcatggcctgtagctgtcagagaaaggaatggtggttaatttggaggtttgtttctcttttccagctttccctggggactagaataagtgacagaacctcatttgttttctaaagatagttcggtgcgtgagcatctgtcagaagtggaatggtgtgccattagccaattagaatcactctgtactgtcactgtgtttttgctgattttttatatgggaatataattactcgttcttgatctttggaagtaattgttattatgaggatcattttactttggaaacactttcataataaagataaacattaagagtacagcatgagtgtcctttattgtaagcatcgaccagctgaattgggaacacatccaacatctctgggtgggactgtgtcagagctcagccatccggttatttcttaatgattctccaaggcgttgtgaccattgagaaatactgttatatcgtcttgtgatatgctaaagtgtctccttgaaatttagggtgcaaagccttcagtgttaaatctcacggtaacaccccattctggaaacagggtttctagagaaagcaacctaaatggatcagaggatactgatttttcccaaatcgtgaaggagctatcaatagctaatctctaaagcacaatgggaaacagcccgtctctgtgcatgcgcctcagaacagcttgcatcagcttgggatccgggctctgcatttctgggccttttttcctttttttttttttttttttttgcatctgtgcttacatcatgtaggatctc

SEQ ID NO: 26734 - DNA, 1164 bp, Mus musculus
atcttctttgtttttcctctagtgtacgacagttcgcctcatcttgagtgcctagcagaatttcaggagaaagtcaggaagaccaacaatttttcagcttttcttgccaatattcggaaggcttttatagctaaggttcataattgatataggtttgttctttgttactgtatatatccagaggaattctcatctcttgtccctgtcatttttctctctttctgtgtggtattaaagaaactagaatatatcatcccaaaccatgcctctttgaggtaacatttgtgagctgaaaacagttaagcagcagcagagttagaaaacctttgccttcccccagtctacctaaacatgggacctagatgatagaggtatctagctctgtacccacaaagaaagatagaagttagtcgcttaccacagcagacgtggcaccagaggaattgacaagccttgcttcattaatttattcctgtaaatatattcttcacaattccccatctgtggaagtcaaaaggcaaatctgtctgtcttatcatgttgtaaaatcctactgttctctgttgaagatgctgtgtaaacctgactaggccactgtttggagttccttctgttggggttctcctgtattgtaggctctgcttgtgttaataaacttgcttgttgtctcccagtctttgtaactctctcttcagtatgactttatgaggattgaggagaattagtttgcgctctcacagtgaggtgctgagtcctacatggcctctgtggaagggaaggcgtggcccatttcctgtccctggagcagaaccagcagggtgtgggcctccacgagtgttgacggttgccaggcttgaggcttgtttgtataatgatgtacatcatttactttatgttcctccttctggaaatattctccttgccaaggttattggggaatgtcctctctgccaatgttaatgactccatgataatcagagacagagtcctggaggtggcgtgtgtctaatgtccttagcaaaatggtaaatgttatgactttcaggacagccctcaaggctgtgggaaagaactctaaaaacgtgagttcaaaaatatataaacaggatttctcaactatgtaaaatataaggatgcaatatgaattatatgagggattcatgg

SEQ ID NO: 26735 - DNA, 1119 bp, Mus musculus
acttttgcgttgctcaggactgttctggaagatgagtgactgtctcatctcaagtgccaataaccttctttctttcccaaagccttgagaagtgtggcttaattcacaatgctccgtagtgcttacagacaggctgattgcagggtgggagttgcttaatgaaaaactaagcagtgtatgcaagaactccccaaagggagaccaaggctggtgactgactagtagttagatggaaaaggagaaaatatgatataaaagacgatggctttgtctcctcatcccattgcttggcaaagaaaggctacatcccattctgctggcatttatcatggggaagcctatctattactcagacaaatatttaggattttgaagttgagctgaccttcagctgaattctgtgaggatgctgggcaaggtccctaggatatctgttaacagatcccttgcagtaggatctgttaacaattgccatacgaacaaatgttctggatctggccggaggcttttggagggttacaaggtaagacctatctctgctgacagcctgctggggaacatctcattagcctactctctggtccctgctctgcatgagagtctgaggagtctccatggccatggttgggcactagtttaggcttatcttcccagagttttaacatagtcccgaacaggtgaccatgaccactctgccacttacttgatgatgtcccctcccccaccccctttttttgcttgagagagaatctcactatgtagcctaggttggccttctgagtgctggactcatagatgtgcgccatcacttccaacactcctcctgttctctgtccaccacactgtcagaggttccccttgatggaggccttatcactctgccctaatgcatgctaggatctgttgagagtcctaactgggcagttatttttctctttgtggctgtggggaggttggttagtgccgtggaggcttctattaagtaagaatatatccggggctggagagatgactcagtggtgaagagcactgactgctcttccaaaggtcctgaattcaattccctgcaaatctgatgtcctcttctgatgtgtctgaagacagctacaatgtactcat

SEQ ID NO: 26736 - DNA, 2201 bp, Mus musculus
gaagaaattcagaaaaagatgataaatataacaaaaacaaagtgaagaaaaggggcaaatccaagagtaggagcaagagcaaggagagatccaagagtaaggagcgagactcgaagcacagcagacacgaagacaagagggtgaggtcaagaagtaaagaaagggatcatgagactactaaagaaaaagaaaaaccactggatcctaaagggaaagatcaggaaaggagtagaagcaaagagaactccaaacaggtagaatcaaaaagtaatgaacatgatcatagcaaaagtaaagaaaaggatagacgtgcacagtccaggagtagagaacgggatctgactaaaagtaaacacagttacaacagtagaacaagggagcggagcagaagtagggacaggagcagaagagtgcggtccagaagccacgacagagatcgcagcagaagcaaggagtaccatagatacagagaacaggagtataggagaagaggaaggtcacgaagccgggatcgaagaacgccaggacgatcgagaagtaaagataggaggagaagaaggagggattcccggagctcagagagagaagaaagtcaaagtagaaacaaagataaatatagaagccaagaaagtaagagttcacacagaaaagaaaattctgagggtgagaaaagaacgtactctaaaagtcgtgatcataatagctcaagtaataacagggaaaaaaaggctgatagagagcaaagtccagtgtcaaaaacaaagcaaagcagtcaggacaatgaagtgaagtcctccacattaaaaaatcaagaggacgaaaagaccagatccccggtggaaaaagaaaaccaaaaatcaaagggtcaagaaaatgaccatgtacatgacaaaaataaaaaatgtgatcatgaatcaagccctggaacagatgaagacaaaagtggatgagtgagttgtgtactcttaattccttcctgtctcaaattttcagtttttaagacttactgttgaacctcccttttttattgttttcattgttttggagttgtttatgtttgtctccccccaccccctttttttttttaaatgtggacttcattgagttgatcttttgataatctgctacctggataatttgtactgctaaagttttaataaacttgaaatgaaaagaaaaacaacactttggtgtaatactgtgtgctatgttaaattcttatgtattcatttttgtgttgcaaccgtcaatagcagcctactttgcttaatcagccatttggaaacaagcttaactgttggttgcagtacattgttgtataggcttgtgtttcttttgatacaaatccctttagaaaccacttgaagttttgtatagctttttgggctttgatttttcatttataattcatgggcttagagcagtttccttaactaacagaagcaggatccttatgtgatcttaaaccttcatttgattttacagttatttgtactttagttactttttttgtgctttataccttatactttacaattccagctgtagcttgtttcttaatattgtccacgttgctctgcgagctataaaaatgaggtgagtgctgttttcagttcatgtgctgattgagcttgagttgctgttatacagcatttgacagaaattagaccttggaagaccagactgtaattttcaattctttgttgcttttggtgtgaagagctgaaattgttgctttttaagaacatgttattacctttttctacaatttaaaaaatgcatttctcattaaaacatactacttgtgtagatccttcttaagctagacagattctaaaaagcgttagtattggaaataagatttccctattttggctattagcctatatcacattgagtggtaattctgcatgatttgggtttgttttttgtttttttttttttaaacttggactaacttctctgattctcatagctgtgaatatgaaatgtcaagaagatgcatctttctatatatgtaccatgataggctgtgtagcatgtttgtgactctggtttctttctattcagatggctttagaccagtttactgttaacattattttaacttggcatgtataacattgccatataaagtagaatagaaagttgcaaaatatgataccgtgcagagttaaacactaaacatatccaaagtccat

SEQ ID NO: 26737 - DNA, 2121 bp, Mus musculus
attactttttttttcttatctagagcttttacttgttagcatatacattataaacaagaactttccagttctttaggaaagtaaacatgggagaaaattggtaatgtctgtaatatcctccaagagagcagctcagagctgagcatttacgggctcccccaactcctgctttgttagtttgttatttttttcaatatgacagataatggggtaaatagttgagaaaagacaatctagatttttttttcagaataaataattaacagcattaattgtaccccaagattcacagttatcaattgcacaaagcccaaattcttgttctagtagatttttagttatttgtacatcatattcccaaaactatttcccatttcaattttcccatcacattggctttctaagaatatctaaatttacagctaatgaatagtttttaataccccttgaaagtactttcacttgtttttattgcttgactccaaagctgaggaaattatttcagtatgtaagactttgatgattattgtatgaattattgttctggataagttgtttaccacagaaattgacactacaaagagatcgttagagaaagtaaagctactgtattgtactgcattgtagctgatacagaatggttacttgctgtaaagacaagactgtctgggaacagctatccaacgtttaaagtgctctttcacttaaaagttatgctaatctgctagctttctttgccccagtgtgatccagctgctcactggctttgcttgcatccagtggtaggtgtcaaaccaagaacctttatgttctggataggcacatgctggggttctggtattttgggtaatagtattaactactgctcctactttattttctagtgactacttagagcagttagtataattgatcctttgttccatgtgttaatagctttcatcatggaaccttttacagcaaatttctgtaaatttcccagaaaggacttagacttaactgattggtataaaaaactaaatgagcatttttcattcttttgtttctatttactgtaattattccctgtagggtttatgcatttacagttgacaaactctctgtgtagtttgagaaactttaattgtaagaatatatttttaaactaattgtttttaaaaataaagtatcccaaggaaactgagtgttgattgccattactgcctgcagtgggcttctcaatgtcttgaagggattcacctgctgtgtgacaaataaacaacaaatcacattcatttaaaaaaaaaaaaaaggccgcacaggccaaagaggaagaagtgttaaggttttactcatttgctctccctgactcacccctagtactggaggatggaagggcattcattggtttgtatttctgtctggttttggttttcttttatagacaattccatgttactaaaagcacattctctgtatttctgccccaccctctttgtgtgtttatagtatttttgaaagattgacacataaattgggtatttctatggaatcttgaggtgtggctgctctctgtggaaggggaaagcataattaggttaatgcacttcttttcctagctccacagtcactgtgatgtatatttttttaatggaatttagaaaacttgttttctcaattgtaaaattagtttaaagatgctgcttctcttatcattagtctagtaaatgttgaactgttttctgcagatggcattttacaaaatttaaacttcaaaactgtattaacttttatagttaaacattgtattaaataaagtatactacaataaacaatttgggattgtgctttttatttgtcttattaaaaattaggtaaccaataaaatttttgttatataatagaaatgtaaattcatttgtattttgagaaaaataggtagttgacaaaaaatggaccaaagtatttactgactgtggtagcttacactttaaatctagtactatggtgacaaaagctagccaggactgagtagtgagagcctaggaatcccagggttggtaaaatgctgccaagcctggtgattggagctgaatccctgggtgggacccgcatgatgcagagagaactggtcctttgagc

SEQ ID NO: 26738 - DNA, 1196 bp, Mus musculus
gagggcgggactcctcctccgaggattgtgggaggctgcggtaacggcgcgtgcgtggaaagcagagccgggccactgcgtccgcggccacgcccacctgtccgcaagggctgccgggaaagcccccatctttaagcgcgtttggctggcccgccggcgctcggaagtccaggcgcttctgtcgttgttcttgaagctgtggtgaccgtgggatccgaatctttgaggtgagcttcttggaaactgaggagaaggtacgaagggctgtgctatgcgcaggcctcaccttcctctccgcgccgccgcgtgggccgcgcggcccgtggccgtgtgctggaccgcggcccgagggggcgcgggcctcggcgaggccacggagcgggccccggccagagatgcgggcgcctggggctttccacgtggcagggatcccggcgggccggtgtgggaggatgcggctctcgcggggcctttaggcagaggctcgccgcatcctcacggcgtcctttcggtttgttccttgcacccctttcctgactggccagaggcggatgtttcggaccatttaagtctttagggtggtcggtgcgggttaaacgcgacagggttctgtggggactgactggaggccgaagaagtgggggccgctattgggttcccagcgtcgctatctttttttttttttttttttccttcaaagaactgccattgccattctgtcttcagtgtgaaacagtccctaaattgggtaggccgcagaagtcttgcaggggctaactaggtcgttattgacctgtgtctctgtagtaatgagaagtgagattgttggtagtgggagacaaaccagcgcctgtaacagtaaattctgaagtgggacgtgtacttcgtagatttcccattacaggaccagtgtatcgccagcagtctccagcattttgagcaatgtctcaagaaatataccaacagtaactcataactatattcagctgctgcagataaactcttcaagagctggtatacttccgtacaatatggtagggtggtttagtaaggcgctgaaagccagtaagacagaagatccggtttgtgatttctagcaaaccagtatcacagtccctctttattctaggattgttgtcagaccgtgaaacaggaaagtggctatagagttaaccagtgtagtagtgttttaggca

SEQ ID NO: 26739 - DNA, 1145 bp, Mus musculus
ctgtctaagtgatattcttgaattagtaccgtcttccttgcttgtattgtttcacaagtgagaggttggttgaaagataaatttagagatcaaaggaaagactacttaaggaaagcttttctccttgaagggaagatgcatttttttttttaaggaagctattaccaatacttgtaatcgttattactaaaacagtgctaacagtgaatttaacaaaattatttgttgtaataggaccaatgaaaagaggaagagatggaagagacagagaagaacccgcatcaaagcataagaaaagagaaaatggtgctagagacaagtagtttatttagtaagcagtgtttttattccttagttagattttaagctgctttttgtcttcagaagcttttaaaaagaaaagcgaattaggtccacttcgatgtccacctgtataaaaggaaaaaatttttgttttacttgtcttctttttgttgttatccaaatgaaagttttttaaaatgtatagttctgtttgtgtttggatgattaaaatatgagaaggaagattcttcctcttaattgcctttgtaatatgagaatgtattagtacagacttgtaaaatatatactgtataaaaatagccaatagttctttcttctttttatttctcttaaaacgtttcacaaagaacttcaactaaaatattgactcttgcgagtataagcccttcttcccacagctaatttgtctaatctctcaggctgactttatatttacccatttaccttggtaagagtggaaatgaccattacaaaagcttttgaatactggatgtacacagactacaattggaaaacttacagatttctttttatgaaagttgtataatgctggtagatcatatcgaagctctgttaaaaaaaaaagccaaacattcatatttaagatattaaatactgatatgcataacatctgatatttctcactttggacatatccttaaatactgatttgtcttaattggatgtggtgtttctgatgttttgatcatttataccaaaatttgaagtcatggagaatatagttagaaggattaacaagtagggaaaaaaataagttctatgaaaataataggatgtgccaggcagtggtggcgcacgcc

SEQ ID NO: 26740 - DNA, 1099 bp, Mus musculus
gtattcttttcatttatttatttatttttgttagcatttttacatacacttttcaatctagctttttaaactaatttttatctaataataaagaaaaagtaatgtgtattatataggttttttttgtttgtttgtttgttttttgttttgttttttgagacagggtttctctgtgtagccctggttgtcctggaactcactttgtagaataggctggccttgaactcagaaatccgactgcctctgtctccaaagtgctgggattaaagacgtgcgccactactgcctgactctgtttggcttttaaagcatttgtgaatagtaatgtatagaaaaacataagatagaaattgatgcctgtaaattatgttttaaaccataatttatgagtctgccatataaacttgattttttttaaaattatttttacagtttaaaacagagtggaaaattccctggcaatccctggcctccgtataagaaaagaacatcactccatcccagctataaaggtcttatgagacttctgcactgtaaaactttacacatcgtgctcttcactctgctttacaaggtaaggcaggcatttgatgagagtgacttggattacaacgtgtttgcatgattttcaaatcaaagagctaaatgactatatgaaggcaccacttataaagcaaagtatgcttataaattttttaatgtgtgaagataaattataattacatgtctttggattccaaattgaaaaattaggaagcagttgtatttctttgtggagaaatgtttgttcttcagcttcagacaaatacttcagactggagtatttgttatggcttctgtaaagtgaggcgtgctgtggctgtaggagctctgtcaagcaagaataaggaagcaagtagccagtcagtcctgctgcttgacagaagtacacgtcgctgtgtgaacttactttatagtggttttctctgccttttacctcttaggaatttgccaaagaaggatttgaatgtgggatctttagacacttgaaacatcctttattctcctgttacctagaatctgtttcagtttgggagtgttctctcacaaaaccaactta

SEQ ID NO: 26741 - DNA, 1196 bp, Mus musculus
aaagaaactttagggaatctgcaaacattaaggcctttttttttttttttttaaacttcatatgaaatgacttatgccactgtcaggaggctgtttatacacacttttacttgactctttgcaaacatttttcatatggttcaaatttgttgtatttgttgcctgtaaagtatttctgagtcagtgttccctaggccaggcgactacttaggatgagttctcagcagtggaaggtgtgtgtgtgtgtgtgtgtgtgtgtgtgtgtgtgtgtgtgtgtcttttaaagacataactagaataatttaattttgttaataaaatttgaataattttactcaatttaattgtgattccagagttaatctgaatttagaagaaatgaaattcgtgtgtttgagatataattcaattacaattttactacttaaagaatattatttccagtgaggtttcttttgtaatctctcaataccctatgtaaaattaaaattttaatttttcccaggatacatgtgatgcagaaaagtgttacgaagtgctgttgagctttgttataagtgagctgtctaaagggaagttatattatgaagaaggcgctcaggagtgtgcgatggtacgtctgttaactcagatcttattgccacgaggagtgaacatttgaaaagctgcatgtgctgtagcttgacgtcttcacttttctgttttaactttaggtcagtcctattgcttggtctcctgagtccatggaaagatacatacaggatttctgcttgcctttcctcagggtcagcagccttcttcagcaccacctctttggggaagacttacccagttgccaggtataatttggccttggtgttctagtgggcgaatttccaaaccatactgatgcataggagactccttctgtctctttctatgcagactgtgcaacgaggatattctggttttcctcagaggactagatgtcctgaatattaactattttatgttactggcaccccccaccccctttattttttctgataacattgctagtttggaatggttgagcagttttagatcaggttagtgtaaattcaggccaaatgcttgagtaagaatggtatttattctgttgggtacttttatcactggcgtcacatgcttttaatactcgtttaaaaggtgcattgctcagaagggtggctgttaga

SEQ ID NO: 26742 - DNA, 1104 bp, Mus musculus
ctgtttggctctcatgattaatgctttgtgctattcttgtgttgcaggcgaggcaagcctctctacatctgtgaggagcggtacagagttctcgagcagcagtgggtttcccacacgtttgaccacatcaataaaagatggggtccgcactacaatgggctgtgacacacacctcagcattgcatatattatcattttcactgagattgattttcatcaacaataagctttaatttaatttggggggattgatgtctttgctgagggataaaaagaaaacatacattatgcagccttcccaaaattaggtgcttggtaaccacagtaatggtataatattttttctcaagtatccggacaacaaataatttaaatcattctttagtggtcactttttaagtgcacaataataaaagcacaactgtccacagaaatcattgagaaatgattgtccctataacgccctgttggttgttccccgacagagaggatgtggtttatttgaggtttccctgctccttttgtgttctcatttgcatctgctaaacataatgcatcttttcctttgtcacccttgtgttgatttgagattttcgctgtatgtaattagaaacaaatgtaaaacatgatttatgtgaaatattgtatagtaaaaaattggtctaatagtagaactttacatttttttcttattgtgaggaatctgttaaagtttaaggctttgctgaaaacttaattcattctcaggaatttcataaatgctttccgcgggtaaatagttgaactagctgtaagatacagtgcagtgcagtgcagcgcacagagggagggcaaggcgtgtgtgtggttggggaggtccttagaaataagtgtgtgtgggctgagggtggagctcagtggtagaaagcttacctggctaacatttacagaaccccagtttcatcttaagcaccgcacatacacaaaatcaatttgccatttcaactaaatgaaaataagagttgttagtgacgagcatatgttacaataaactcaaaagggttaagaacatatacatggcagagttttgattctgtgcatgcccacctttccttaccaaccaag

SEQ ID NO: 26743 - DNA, 1229 bp, Mus musculus
agtacttgaacagtcacactggttaggccggagaactgaaaaaaaaacatctgtacatattgtcgtcttactgccccagcgcttgtttagtgtgtaacctaggcagcctccctctttccttggcaccatctctgctggcacccacttggatccctaatacacatgaggtgggactggggaaaacagaatgttcctaagctttgcctgcttggtttggccatgagaagtggttctcttcgtctgattccttcagggtctctccctatttcttgctgctttgtccttcactggtcctctgtgagattcattccttttaaatggcagtgaatcttgctttgcctcggagaccccagtgggcacggttccacctcttctgccaagtctgtttatccagccctctgctgatacagcctcgaaagggttggtggctcaagactgttagcctggcagagccaggggagggagacgtttgctccaggaagacctggggcaggtagaccagaccgcccaccactgcttctcgctgcctcttcacctgcccactaccccccgggccagtttgcctcttcgggattgtattttccaagccttgtactgtgtttgtctgatgttaatgtgtgttgctccttgaatcgagtttggaggaagaattgaattgtatgtgtgatggcatgttggtaatgccagacttaatgtcacatgggccctcttggcctagctaattgaatgctgaaagtggcaccgcgtgacagccacagtgctgactcctgaattctcaatagtgttttgactcaagggctggcagcccaggggatggagcctgttgggagcaaagacttccctctgttgatcctccccacgtaacccacccaggccagggcagcttctgcctgtgtttggagttctacattaatgaactacacttagtatagtccttacttgtattctcaaaagggtcctacctagcctgtctttctttccaaaaccataccatatccttcagccccagagcctggctgccatgtccatcctctttgggagaagtacgaatgtgtgtgtctaaattaaaagaaaaaaatatttaaacattttttaacaaaataaaatttatttttgtattaaaaagaaagaaagaaagaaagaaagaaagaaagaaagaaagaaagaaagaaagaaagaaagaaaggaaggaaggaaggaaggaaggaaggaaggaagaaagaaagaaa

SEQ ID NO: 26744 - DNA, 1259 bp, Mus musculus
ttttcaagagacaactggaccagcagcaatgtatctcagaggttcagtagcattgaaagtactgggtttgatccttagcggtaaagaaagtggggaggtggtagacagaaatgtggtctaaagttattcaaaactctgttaaatccaaaaacaggaaaatatcctacttgtcaatatatatcccagagacaggcaactaagtccccactcctcgctgtcaaacaagagtaagttatgagggtactgaaagggggctctggcccagagtccaagctttgtatttaaaatggaatgtttaggaaagacgttctctctttgccccatctactgcgaggatgaagaccattctcagcaatcagactgtggacattccagagaatgtcgacatcactctgaaggggcgcacagtcattgtgaagggccccagggggactctgcggagggacttcaatcacatcaacgtggagctgagtcttcttgggaagaagaagaaaaggctccgggttgacaaatggtggggtaacagaaaggaactggtcaccgtcaggaccatctgcagtcatgttcagaacatgatcaagggtgtcacgctgggcttccgatacaagatgcggtctgtgtacgctcacttccccatcaacgtcgtcatccaggagaatggctctttggttgaaatccgaaatttcttgggtgaaaaatacatccgcagggttcggatgaggacaggtgtggcttgttttgtctctcaagcccagaaggatgagttaatccttgaaggaaatgacattgaacttgtttcaaattcagctgccctgattcagcaagccacaacagttaaaaacaaggatatcaggaagtttttggacggcatctatgtgtctgagaagggaactgtgcagcaggctgacgagtgaggaggcctcagattttacatgtgtgtttgttttacagttcctggccccagaaacgagatcctgaccacaagaacaatttgggctcttttgggagaataagagacttatatattgaaaaaataaataaataaaaaaataaaatggaatgtttaggctaaataaatatttaccacaagatgcttcaggcatgatggagtttctctctagtctcaggagtgacgggaaatgacagacagataccattgcatgattgtagtccaatgtaaacatcagcagaggtgaagtctcttacgggtcttgtgggaggcttccctcatccatgtgaagaaactgaggtggctaact

SEQ ID NO: 26745 - DNA, 1290 bp, Mus musculus
tgacgtctcctgcttccaaggtccccaccactgttgaggacagagtcagcgactgcaccccggccgtcgagaagcctgtgtctgatgcagatgcttcagagccttcttaactgggaaccaatgttcagaaccgacgtggtctgtttagttaaccacggggtcaggtctggaatcgcaaactaccattgatttcatactagtgtgtaccgtatctgtaggtgtcctgtacataattctaaggggaaactacgcaagaggctgagggcttgcctcccaccacgtcggggggttacagccgaggagggcaatctgagaatgtgcttgtattttaaacaaccaaaaaaagttgtcatgggtggcttgctgccaggcatctactgccgttctgggaggttcatctttggaagagagatggcggggtacccactgggttccctgtaccactgctatgccttgtgtaaggaaatgaaatattttatgcctagtgcccacatgcaacatttcttgtactttgtaagtcgtttgcaagaacacagaccacctcactaaactgtacaaggaaacaagaatttactgttggtctctgtgagtcgcatctctattacggtttacacaaaactcccagttgcagatgttttgttccggtccatggcacactattaattgaacatctttttattctgcctgtacacagatcttgttttgaactcagaattattcagacaccattttgtagctgctgctgttgctttagatgcctgtggtaagatggcatttaaagagaaagagaggagctgcgctctgtagctacttaacggtatcgcggcaataaactccagtcgctttacggtctccttgtgttctaagtggcgagcgtgtacttcatgtgtgcctcacatctctcaggtcagcctgtggtgggtgtgcttttctaagtttccaagcgatgctccatcgagtgggactgatgtcctgggtgacggaaaagcatctgacagccccctttggaagtaaggtggaagcagtttgttgactgttgacctggtactagcataaagatacccacaccgcagtggtggccattgctgactctgccagaaacccagcccctctcccaggatgcatttatagagacacaggcctaaagtcagtgatgtagaaatctccacagtcccagcactgggcatccctgaagcagtctggcagctcatgagccaaattggcaagttccacactcagtgagagacctgcaaaaacaggtggttttttctctctctctctctctctctc

SEQ ID NO: 26746 - DNA, 1162 bp, Mus musculus
ctgccacagagagggggctcccagctcagttacagccttatttctctatgtccttcggcagcgtttccaataaggacttagctgcctagtgtggtgtgcaccaacagtagtggtaacagccttatggtttgtggggcttaggggccttcccttgtactggcaatttcctctaagcactttatggctcctggaagttattttcacactcatacagagtgcctgcctttatttaaaccccttcagtctgtcttcactggatttccacaagcttttacaacccagtaagatacccgtggtttgaataggtatgaccccccccccccaatcatgtgtttaaatacttggcccatagggagtgccactattaggaggtatggccttttggagaaagtgtgtcactatgagtgagggctttgaggtctcctatgctcaagttactcccagagtggtacacagtgtcctgctgccttagatcaagatgtagaactcttgcctcctctgggtaccatgcctgcctgcatgctgccatgcttcctgccattgttaaacctactaagcctctgaaactgtaagccagccccagtgaagtgtcttcctttatgagagttgtcatgatcatgtctcttctcagcaatgaaacccctaagacagcactaaagggttatcatgatataaagaagtgctctcccagtgagccagtgacctctttgaaggcacaacactgttctaggttattcttggatggctaaggggatactagaatagaaatgctggcaaggtcaactattgtttgatcaaaagagcagtgctgggtaagaaagaaagcctggatgccaggccccatcccattagccccctccccagcctcattttccacagtcatcttccataaggcgccgatccacctggcctcctgatcctagggcgctgctgccaccctgggattgctgtgcatctctgatgcagggatcacactgtgaaccctgagattgtgttctttattggaaaaacctgttgctagttatggtgtggcttagctttagcacacacctttaagccctctagctgcaatacccttagtatacacctgtaatcccaatggagataaaaatttgtagaaggaaacagccacgtttgaaagtgatgttgtgcccttctcgtg

SEQ ID NO: 26747 - DNA, 1631 bp, Mus musculus
caggaataccatgttacagtagaacaaggggactctgtaaataacgtttataatacttaaatatatttgattgttaccagagagttgtaatatgaagggtagtttttcattatttaagaacacatggaaaaatgaggagacatttgtaacccgggagctacagtgcctggtacagcgtcagcactcggcagctgatctacagaaaccaaagcaagaactgagtgacagcagccgctgtgtttataacagaatgtgagagttagggtctttggacagttggagactttgtcatttgcctattctgacttttaccaagttgtacctcgagatcacgtgtcagtggtccgccgccctacccccgaccccttaaccggttatgttaaaggcaagctgtcgtttctggacactttacacctttaacacaaagagctgcctatttcaaatcagttgaagttactaaatgatagtatttccagggctttcagtgggttagattaacaggcgtttttcttttgttttcaggcctggttcattaaaacagaagacagtgtgtaaccaaaagcaggccagttgtatgcaggataatgatgaattcccttctggctctattgtaaactactgtacagatgtcggattacaattactgagtttcagcagcttattcttgtacaaatgtttaaaaatacggcttttctaattggatattgtattttttttaagtcttcttgaaggcgctttaattgctgctaaatgatattgcttttttgctataaaaaattgaatgaccttgaaggcacaagttgactgtacatcatagagagatattaaaagcaggcactcgttaacaatcaaggcatgtgcagtgatccatgctgggcatattgagttcttcaaatcagttttttaggttctggagctgtggaacacatagaaactagatttataaattgttcatggttattctacatttctagaaagttcttagcatcaaggtgggatgatagtcccatagaatgtttctcgtggtttgtacagatttgttaaaatgtgaacattttctaactaccttgtgtggtagaaaccaatatttttttggggatgctgtatttcattcttgaaaggatttttttttctttattgtcaaattcataatgccgagacttacatgtaagttgtccatggtgcagacaacaggctatccctgccagccgcccctaacatgtacagttacactgtggctcttacctggtgttgcaagccatttcgtttgtttgttttcattgtacatagacacactgtctgtttaagatgctgctggaattatagagaatgtagccaaacagtaataaacaatgacagtaaaaatgtaaagactgtgaaaattacactcaaagaacccttaagattgagggtaataacatagctgctttacttaaaaggcaggtaaattccttatgcatactcaggacaagcaggaagtgtttcaggttgttaaagttaaaaacaaagtttagaaaaaatattaataagagtatcggagataacgtacccatgtcttctaagtttttccaaatgtagatttaaatagcctactaatacttgggctcagtgaaccagtataacctttgtga

SEQ ID NO: 26748 - DNA, 1194 bp, Mus musculus
gggattctgccactataatacagcaggtcagcagaataaatactaaatgttatacttgaaatttgctagtcattgtaattcttacatgtatttgcaactgtttagacagggttttgctttgtttacacaaagtggagaaacttgtagagaaacaaacctgccttgttttgcattcatacccagttaaaagcttcagtgtatatatctgtgcatttcaagagagaataaaacacacatgccacatgtgccacatcccctcacacaaatttctctcttagaaggaagtgaagaatgtacagtgagggaagaggaggacatcagtaacctagcaacgaggttggaggggaggggtctaagctgattaaactcacataggaaagaaagtgttcccctcagtcaaggcggatgtatggattggaaatgaaaatagaaagatgatgtgtataggtagaaaagaaagtagacatggtttccagagctctgtgtctcctttttcctttcccatctacacagccacacttgagtatgacagtcatgacaaattcagacctactatgtattggtaataactgactgttggctcgtatctacataatatggataaagttagagaaaattggtagatttctttctgtctgtatctctctctctctctgtatgtgtgtgtgtgtgtgtgtgtgtgtgagagagagagagagagagagggatgagggagaggaagagggaaagagaagatggacggacacaagagttagagggcaagaaactggagtagacatgatataactcatgaattgggatattatgttgtcagaagagactatgagtaaggcacatttttgtgctgaaaatatgttgagacaaattgttcagtcaggtggtgtggctatgggacttattcatgaattttaaaatattggcaattagtattttgtgggtcatataatcaggcagtatcaatctgcagtttatatgacttgatctttatgatatatatcagaatataaaagtatgttttagttgtggtacatattgttaaattccctgttgctgcattgttgggcttgaatagagaagggatacgtccatttattttgtgtttgatcacctggcctaccactaataaaatctgttcttactaatgttcatcctaccctgtaactgcctatagagaccaattcatttccagaaata

SEQ ID NO: 26749 - DNA, 1211 bp, Mus musculus
aaaggggggtattttgtttttatgaggaaagaaagaatgagacatgactgtgattcttaggatgatggcagatgacgccttacattgctggtgcgtgtgagactcagactgtgatcattatgaccgaggcacatgcataatgctctccttacattgcctgggaactttagtgatcttgttgcccagatatggcccagttcttttgcttttgaaatgatattaaatatatttttttaaaaatcaccaatataagtaaaatcctgaaacagcaggattttggtagcctgactaatcattctagacatttgtagcattgagaacatgttaccttgcttacttagctacctggattaaaaaatcatacttgattttcatataagtgaagattggtttatactttgtattatttttctttaaaatcattcctaattttcacctttaaaaatctttcacaggcttcaacaaataatgaaagttctaatcacagttttggaagcttaggatctctaagtgacaaagaatcagaggtaagtaatttcattttaaatgtggtgctgggaaagtaagaacttgcattgtcttctaaatgagcgtctcttcccccttcccaatcttggtaccaaaggttactattttaaagtttccttttagagtttttatgtagtggtttttatcttcctctggggtagtggtggtagggagtgggggtggccttaatgaagcacaatattgggataaaggaatatatttggcattagaatacagggttgtttgtttttttttttttaattttataacttaatttacacatgaataatgtagaggtgttatcaatgcaaaccagccattcatagttttataagatgaatgtgagttttgaagtatgctgcgtttcagcttttaaattattattttagtatttcccatcttagtttaatctttataagggtttgtgtactttcctagttataaaaatacatctttcttctttgtagaaattcttgtggaatcaagctgatggttttcattttgcatatttttttttaaaaaaatgtgataaattcctcttgcctagtacccatttactgacctcaccaagaaagtaggtggtatttacaagtggatatttgggtccacagtgtggttcattctgtgcatgatatactcgatggcgtcttctaaaaatggtgggcacaaatgtatttgggttt

SEQ ID NO: 26750 - DNA, 1183 bp, Mus musculus
agaaactgccaagttgttttctaactgttctttaccctcttagcagtgtacagggatatggtttctccatccctgtcaggatttggttactatctcttctaatacagcattttggttggtgtacaaagcaacaccaatagtgctctgttttacctttccctgttgaccagggatgctgtactttccccatacacctgcttaccattgatgtatgtcttctctgatggagtatctgctcaaatccttggttttaagtctggttgcttttaaatcttgagttagaaaggttcttgtatgtgatggatgggtaatagacctttgtatgataaataatttacagaggtttctcccattctttgggtattttatctgagaaacttgcatagttgtgtcacagaatgtatactttttgctgagaactgttgaggactgagtgtgttatgcccttcgcaggctcgggtgctgaatgcttggtcccagctggtggtgctgtttgggagatttgaggagatgaggtttacttagctggaggaatgaggtactaaagggtgagcctttgaaagagttaacacttcctctgcccctttccgtctctgctttcctttgtctcttcttcatgttccctctgtgatgctattgccaaatgcatgaaaccatgtgatgaaaccttcaggcaaaccaaataattcttctctttaaagtgttttccctggtcataaaatgaacccagaaagatgtttatagttttagcccctacattcaggtcttggattattttaaacacatatatgcatatgcgtgcacatacatactcacacgcacatgtgtacgcacattcagtgtatgtacctgtgcttatctagttgtttgtaaccagccataaatgtgtgagttggtttctctacacttagttctctgttgatctatacacaataccacacacttcagtgtagctagtgataccttttaaaactggaagtgtgcttttgccaactcagttcttgtttaagattattttgggtatcctgagtctctttatttcagtttgactttcagaaccagtgggtcacctaatagaaacaaaagcaaacaaacaaacaaaaaactaactggagttttagtagaagtcttaggtaaatgtttagaccagtgtaagtatttggagctttaggaagttgtctcg

SEQ ID NO: 26751 - DNA, 1212 bp, Mus musculus
agagggattaaaggtgtgtgctaaggatatgtctgtattccagctagatcacacagacctagaaggtcttcacatgtgatcccttgccagagcagccttgttgctggattaaaattcctctacatgtgtaagtaacccatgctgtctagagctctttgtgtagcctgggctagccttgaacttagggtcttcctgccttagcctccttagggttaggtttgtaagtatgtgctacaacacctggcttgtataggacttcagttctacagtagccaagtgttttgtggaccatcttttatgtatgtgtgcgtgttactgtgcatgcttgcttgtttgtgtgcgtactgaactgcggtcagaagtatcaatctataagatgttttgttaaatggagtgcacattttataaatttgtagtttcttaatctttttagagtgttcatttgtaaattttgtactatagtctcactatatgtaatatatatacatatgtgtatgtgtgcacatatacatgtgtatgtgtttgttgtttgcttctctctctcttcataggtgcaatggatgagcttcacagtctggacccaagaaggcaagaattattggaagcaagatttactggagttgctactgggagtactgggagtactgggagttgcagtgttggagcaaaagtgagtaaaattttaatctcatttaaagtctgtgcttcgtgttaagtggtctagaacatatttggtgttgagatggcttgaccaccagagttcaagccccaggactcatgtttgaagtagagaaccaagtcttacagattgtccattgaccaccataatatgtgcttcggcccccacaatacaaagcactaaaactacagagtatgttttgtgtaggagctatatacatgcttaatggcaaagtgttgctttttatgatttttatattgtgtagaagttagtgtttagaaacctgatttctttttatttgctctgcagaagatctctatataaatggagttttgtttggcaattcttgctattatttcttgactgaccaaaaggtccttgcctatgcctgtttatatggaaggaatataaacctgctttacctgtagcagtttctaagtgtgatgtcttacatggaatccttttctctgttttgaactgagttttgaacagagagagggggacctagtttcccaccaagtttgaatagattg

SEQ ID NO: 26752 - DNA, 1184 bp, Mus musculus
cagccctgataagagtctttcatcttccctctgaaatttcacaagccaggcctccatcttctgcactgttctaaacattatcttccaagctcctacacaacatcccacagagctcttaacaccaaatggatcttctagcccaaagttccaaagtccttccatagttctccccaaaacatggttgtgttttcacaggaataccccactcctggtaccaatttgtgttagggtttcattcctgcacaaacatgaccaagaagcaagttgggggaggaaagggtttattcagcttatacttccacattgctgttgatcaccaaaggaagtcaggactggaactcaggcagctcaggaagcaggagctgatgcagaggccatggaggaatgctgctgcttactggttcaactttctttctttctttctttctttctttctttctttctttctttctttctttctttctttctttctttttttttgggggggggggttcgagacagggcttctctgtataaccctggctgtcctggaactcactctgtagaccaggctggccttgaactcagaaatctgcctgcctctgcttcccaagtgctgggcttaaaggcgtgcaccaccacgccttgctttcttatagtacccaagactaccagcccagggatagctccacccacaaggggccttgccctgttgatcactaattgagaaaatgccttacagctggatctcatggaggcgtttcctcaactgaagctcctttttctgtgataactccagcttgtgtcaagttgacacacaaaaccagccagtacagttttattagattttttttttacctatattcatgaagtagatttgcaactttccttttatataataaatttctttgtcagattttgtgttatagtaacaattcctccataaaaatgaattgagaaatgattttgtgtttaccattatttctaggcgtctaagaacagtattatatttttctttacttttgatagtttattgatcaagccctctaggtctggacattttctggagacatttagaataatggtgttagtttctgttaatgtggttagacttctttgaagttttcatttttgtgtcagttttgacacacaaaatcatagttttagggatttatccctcaccccctttttaaaggaaaattcaa

SEQ ID NO: 26753 - DNA, 1181 bp, Mus musculus
ccacatatggtagaaaggactccatcttatgtaaaagctccctaggatgctgtcccaagagaccaagcattttgaaacatttccattaggtgctaacgtgaatataaaatgctagggaaccgaggacagttatctaggagtcaaagagacatcattgatgcagggataactaattcttaaagactactataaagttttaattagtaaggctgggagagaaaaacaaaaataaaaatactaaatataggagccaggtatggtggaacacacttgtaatatcagtgcatggcgggtagagcagaaagatcaggagttccaagccagtgctatagccagttagcaaattcaaggccagcttggtctccatgagacctgatctaaagacgtcaacaaaacataaagatatactatatactctataccaaactttacttaaggattagaagtaggatttgtaatgtaaaatcatacttttgagccaaaaattaccacagcttctttgtaaacaaaacaaaccaaaagaaaaaaaaaaaaaaacatatcaattctagtttttcaattcatcagttcttatgcggtcttattgactgtagtccgtttgtgtgtgtataaataccagtgcacttgactttgtttctgaggacatatttgcatgtttatgtgtatgtgggtgtgcacatatttgcagatgtgcctgcatgtgtgtgcatgtgcgtttggaggccagatgtcagccaatggtgttctcaagagccacctaccgtgtgttttcagatagggtttcactagggcctgcagcttactgatactgctagcctggttggctggtcagggatgctgctgtctctttcccagcactgggactaaaggcatacttaccatcatgcccagatacatacatgggtgggcatcagactcagactttcatgcttctgtagcaagcattttactgatagagccatctccctagcatatgtgttataaaagattccaggcaagtttcaaatgaaagcttttcttcatttgtaccctgtttagcttttaatacagctaaagatgtctgtcttattttctatctatttgctgagtggctatgtttatttagtgctgttttcatatgtaagcaagaacataaaggggcctctggtaggccccttctgtgcattgctggcccctggtgg

SEQ ID NO: 26754 - DNA, 2190 bp, Mus musculus
ctgtaatccagcactcggggagctgcagcaggaggattgctgcaaacttaaggccaacttgtactatgtagcaaagccttgctttaaagaaaacaaaacccttgatctcaaaggcagaggcaggacaatgaagaattccgtgtcagcttggcatgtaatgagttcagagccagcctggactgcattgagactctgcttaataaagcataggagaagagcaacaggccatacttgattcaagtttaaggttaaaatatggaattttaacttggaagatttgtataaaaatctctccattttgtcctgaccccatgttaagaatggtgtgaattccaggccagtaagtggtggcacacaactttagtcccagcatttagtagacaaagacaggtggatctctgacttcaaggccagcctggtcttcagtgtgagtttcaggacaaccagggctacacagagaaactttgtctggggtaatggtagagaatgccatgaattctccagtcagacttgaaaacctgcaaagatgtttctagctgattatgatcagcaggactaaggagagaggtgttggctgtttaaaaatcaaagaactagtaactagtgtgtctattcagtcaagaaataaaagaaacctaaaatcatctttttatgcaaagaaaaaaattacaggttgactattccttatctaagatgcttagcacgaaagtgttttgtaagtgaagttttccttgattttaggatatttgtgggtacattataaaatcctgagaatgggtccaaggtctaagcatgaagttcgtttaatgtttaatttgtgtcttgtatacataacctgaaggtgcttttatgcagtatcttaactgtacctgtccatgttttaactgtgtcccagcacattagatcaggtgttgaattttgtagtcattacatcatgttagcactagtttcagtttttagagcattttttatttctggattatggatattaatatgcattgatgttttagaacaaagcagaatgtatgtgagctaaaaagaaatccttccaaagctggtcctgttcagaattgtcatctggaacacagacgtaattacctcgtgaacaagatagtaacgtgttaaagtctaatactcacgtctagagactgaagaactcaggcttggtttatgatacttaacatctctatttagtgtctctgaagctcggagagcattttagagacagcatcgtaattacagagcagttaatagttacagcgcccagccctatctgacatttacaccttagtgtttgtttttgctttgttgtttgagtggtttttgtttggatagtttgttttctggggtgtgtgtgtgtgtgtgtgtgtgtgtgtgtgtgtgtgtatttagataaggtcttactctgcagctctgactgccttgctacactatgtagatcaggctagcctcaaactcacagaactctgcctgcttctacctttcattgctgggatgtctaccatacctgacccattgaccaacaggcttgcacaacatgagtgagaaacaaatccaagagcagcagcagagagaagaagggtgatgctgtttagcttggaagttcatttgctctgtactttgagagcatttggaacagtgtgtctttagacttcagtcttagcaaagagtctttctaaggtaggaattgaatttcttctcctttgtcattgctatgtatgtatatacatgtgtgataacagaaactcatattcagaaaggctgttgagacatttcttagatacgtggtaagaaaaaggaatgggctacttctagtctaactataatgtgaccactaagaaattcctagtgtgagctgagcctaatggctcacatctaaaatcctagcaactgggaggctgaagcaggagggttgccacaagttggaggctagcctgggttgcatgcctataagccatactgggctacacagccacttttaaacccagctccatccaagagctctgacacccacttatgacctccacaaacacccatacatacctgtgttcacacattcacacacatacatacaaatatacacaacacacacacagagcaaaagagagagccagctgtgcccagctaacaggatgagatacagctgtttagttttggccagttgtggcagtttatgggaatgtgaaccac

SEQ ID NO: 26755 - DNA, 1607 bp, Mus musculus
gttccaaacaaaccctgggttcaaaaggctgatatgagaggggcacgaattgcagacagcctgggctacacagagagatcctgtctcggaaaagaaaaaataaaataactatttcatactagtagtggtggaaaaaatacaattaaaagttttgaatgcattcctctccttcagcaagacccatagtggtgtcaggaagtctgtctacaaagcatccttgttgtagctttgcactggtggcaacaacagagtcatttctgaggctgccacgacatgttttacaaacaccttttgttttgaaatgttgtaaatcattgttatagtcgctgtaattatggaaaggctctttaggtcagttattacttttcaacagaaagattacttgaaaacaaagtaatagtagataagatgaatttttatttcattgctcagcaaacattgtctttcttttaacagcagatcgctgttccccgaaatgatgaatgggcaagatttggccgaacactcgcagaaattaacgcaaaccgagctgacgcagaggaggaggcagctacccgaatccctgcctagcctgaaaagcggctgtagccttagcaaatttggcaaaaatgattaagtagatctcaaactatttgcatgcttctgattaaatgagtgttaaaagaaaatgccatggataatctgggtttaatacaggaagcaaagcttacaatgcctttttatattatattcactttgttttggattggtgtcatttttaatacagctgacaactttacagaatgcagccttttctgaattctaacacttgggtgtatattgttaattattcttttggattcttttgaacttgtaatactatatataattatttctaaagcacagattaagtaagttctgcatatttctaagtagccacaattccttattccgcactaagtacatacctccgtgtcagtggtgttcttcctgtccaagtgtataggaatattgttccctccccgcatgccgtcgcctacctgttgtaagtttcatgttgatgccatttcccttctcgatagttctatggtagttatctataaataaaaacaaatatatgctaacttctcaaattttcacttttactttttgaaatttgaaattttctcttaaaaattttttgtttttaagttcctaatgcaagcagccaccttaaatagtttttagccttaaatatacaccatgtacggataatgttgctctccctgggcattgcaaactcatgttggagaatttgtcggtggaaatgttctcttaggttagcttctgcctgactctgttacttgtcctgatgtagcttgttctgaagaaaaaatgctcacttcttagtttgcagggaccgagtgcactgtgtatgtacgctctgaagcgtggctgcctggagagagagaagcttgcctgtggtgcagcagccacacaggagctgtgctcagtgtccatactcggctctactcttgggatttgctagcacagttttacaaacactcaaggcagatagcaatgtgtgcattagtgtagaagtcggctgtgtcaggacaggagggaaagactgggatcagaccttacag

SEQ ID NO: 26756 - DNA, 1213 bp, Mus musculus
gcccatgatattcttcatgttttggatactactatgtgtttgtcttacacattttcctactttgtgccatgtctttttatgatggttttgatatactaacattttaattttaatatgtccaaatgtattggtatttttgttagcttgttgagcatctcattaaaaaaattattctttattgttctgggactgttgctgagagacagcatgcttgcctagcggctacaagaccctgggttcactccccagaaccaccagagggtaaacaccagacctctaggtaaaaatgataaagttattttcttgttatacagtttagagtgttgcctttcacattcaggttccatgcagtttggacctctcctcgtgtctctggcaatgtggggcagacctttgtttctctgattggcagccaggcttgccagcactgtttattgaacgcctgtcctttcccagcggctctggagcatcatcgttgttgttcactaagaatcagcctgggcttcactgtctctgggctccttgctgtagggctctcctgtcttagatgcaggttctcgccctactctgttcatttctgtatccagtacaatgcacgctcctgatacacagtgtggtactcgtctctcctgttgtttgagagctatgattcttcctggttcttcgctcttctatgtatattttatcagcttatcaaaaccgttttaaaagcactgataatttaaacagtaatgaatctataagctgctttggaagaatctgtgtcatgatgggggcttctgatccaggaacatactatatctctacttaaatatttttcatgtcttaataaaagtttgtgctcaccaaaggagtcgtgtacatctcttgttatatgtgcttttaggaaactcatgcatttgaatactatagataatctctctgtgtgtgcatgtgcatttgtgtgtgtgcacatgcatgtgcatgcagtgttaggggttcactacaatatctgtgcatggtaggcaagcccttctgcattcagtcacattcctagcccttagtgtttgagacagggtctcactggttaacctgggctggccagagctctcactcttcttgacttaatttctgggaattgttaagtggatgccaccttgcccagaactgtgccatcatgctcaagatacaactcgcattagtgtaccaatcctggtctcatctttcagccttg

SEQ ID NO: 26757 - DNA, 1240 bp, Mus musculus
cagaaatgacttctgtagtccataagggaagctgagaaatgtagtctttcagcaggaaactatcaaataaggcaatttataaaaggatgtgtgtaattggaggcttgcttagttccagagtattagtccatgatgatcatggcaggcagggatggtactggagcagtagctgagagctttatatcttacataaagggagagttagagagagtgaaattgcctggtttaggcttcttcaacctcaaagctcactcccagtgatatacatcttctaacaaggcctcctaattcttcctaaaacagttccaccaactagggaatcaagcattcaagtaaatgatccggggtgaccattctcattcaaaccaccatagttattaaacttgaaaagttgattaaaaatcacattctttaaagatttattttttatgttatgtatatgagtgccctatctgcatgtgcacttgcaggccagaagaggccctcagatcccattatagatggttgtgaaaccaccatgtggttgctgggaattgaactcaagacctctggaagagcagccagtagtactcttaaccgctgaaccatctctccagttccctaaattcacattttgttaattccttagttttagtcttttgagataaggacacatggtagactgtcctgaaactcatgtacccaagtctagccttgaactcttaatcttcttctctgtgttttttctaaaaattacagcaatgttactcaaaaggaagatttattgtaagccatatggtattatagcaatcaggcaccattaaaataatgagtgatacaggtttcatggaaggaaaagttttagtgattttttttccctaagttgagagatagatgagagaaggtgttaggtttttttttcctgttctgttaaactttgagataggtcatgtggtatagcttaggctgacctagagctcattgtgtggctcagcctgtccatggatttgcactacttctgccttagtctcctctgtgctgggagtgtagacatacttgccacactaggcttatttccacatcttttcactcttctgtctattggagtaatatgttctgctaaagttttagaaagggtagaacaaagtgaaagtaaaagttacccatagttcatcactaagtaattccttttgtataataatttaggcattttatcatgcatccactttttgccacggtgctacagctgcatttaaagtct

SEQ ID NO: 26758 - DNA, 1122 bp, Mus musculus
ttttcctctttcattgtgtatgaaatatagaaaagtaaaaactaaatcacatactgagtttctcaaatttagaataagtaggcttttgatgccgaagctttagtgtaaggaaaagaaacattttgagtaaggagaatattggcagtatcctactgtagtgaaattcttgaaatagaaatgtctgtcacctctaatgtctagctatatatttcttcttttgaacagttcgttttcctgaagatcttgagaatgacattagaactttctttcctgaatatacccatcagctctttggggatgagtaagtaacatatttgctaaattaatatggtatgaacaaaacaatactatttttctcttaggatttaaagtcagattttattttttttaactcttgtttttcatgatgatttttaaatgtatattagaaaaatagtttatacattgagcaccactttgtatataatacctattatttatgacaacaggcatgtatatttgaattttgactgcagtattagccattgcatctctattttgtgcatgggtagacttgaacaattgtctaaggacatataagtggctagaattcagattcacacaatctagacttaatagtcattgtaactattttttagttttgcctacctcttgtcatactacttgcaatataaccccctgaaatgtagaaagtttcactcaatgatttaaaaagcaattcaagaaacgtgtgtgcacacacacctgtgtatgtaatagtgcatagaaagcgaggatgttgatgtcctgctccgatattcttcatcttattcctttgagaataagaagggtctctaactaaactggagctaggccagtggcaggaagctccagctagtcagtctcctttctccactccccacagcactggcagtacgggcacatgcacagatagatacctggctttttatgtgtgtgccccaatttaaaatacatttttttaaagacttatttatttaatatatgtgagtgctctgtatgtacacctgcatgccagaagaggacatcagatcacattatagatggttatgagtcaccatgtggttgctgggaattgaacctgtgacttttggaagagcagcc

SEQ ID NO: 26759 - DNA, 1200 bp, Mus musculus
tgtgcatatgtatgtgtgtatatatatatggggtgaggggtgccaaagccagagaaaacttggaagccagagaaaaacttggtgagagttagttctttccttctatggtgtgggtcctgggatttggactccagttggtctgcttggtatttggcatccttacctgctgagccatctcactgctcctattacattaatatttgtttttttttaatacctctgccttttcttggggtaatttcattgctttttaatgaagatgtatataaactaagtttgttcattttcctagttgtattttgggagagatttgattgagagatgcacgggcaagttgtgtgatctgtgaattttcaattagtttattcttgtttcctaatgaagattaaatttgacagatgaaaccataatttttttctggaatctttaacttctttataggaaaataacctctaatccagccctgattgttgagtctagggccatacatgcactggacaagccctcttctactgagcatatatatcctcacgtatttttatttttgtgacagggtcttattaagtgactcaggcttaccttgaattcattatatagactgggctggtcttgatggtgggattcttcctgctgagtaactagggttataggcctatactgctaggcctagctgtaggcaagtctttatagagtactttataaagtaattattgtatacatttgtgtgtataaatatgcacatgcatgtgtgtgtatgtaggtatagatgtgaggtcacagaatagccttaggtggtggtcctcaggctttggcaacctatgttgtttaattttgaggcagagtcttaactggcttgaaactaccaagtaggctagggtggctgtccagcaagcctcagggatctgaatgtctgcctttaccacattgtgcttttaaatacatgccactaagcctggctgttgtatgagtgttagtgattgaacttgtgtccatgtcctctcaaggcaaagctcttcaccacctgatctaccctacctagtccagtgcacccactcacattatcatcaaagctgtaaaattgcaactttgtctgcttatttgagtagtaaaacactaatgcagtctcactaaacataaatgagcataaatagcccagtgaaaagggtcacatgttaatactaataatacttaagatttcac

SEQ ID NO: 26760 - DNA, 1178 bp, Mus musculus
taaaaaaaagaaaatattttcagttaaaaactaaatttattaatttttatcctttgttctctattcctcaggcagatgatgttgaaggcaaaatcagacaaatcattccacctgggttttgcacaaacacaaatgattttctttccttgctggaaaaggaaactaatttcaagccttttggaaccctcctccatacatacacagttcctagtcagacaggaggtgaaacctttactttccagatccacaaggtaaaaagaagtagttccctttgcatggaacctgtatgggattttatattctgcaaatgtagtgtgagataaaaaggttttattgacactaactagatctgttttgactgtctgtttgtatacatatttaatctgagacttctaaccattttcccacaggatagttttgtgttctacagactttcagttacctctgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtggaccttattacctccacaaagccagcattttaattgtggcagcccaattattggggcagtataatgatatttttcccaggaaagaaaaactattgtttatggggcttgagtttgccttcattatgctttgggggacttgagaatggaactgaattaaatgctgttgtccgttaaggccctgaatgtaggcttaaacagtaaaatgagctttgcctgtgttttcttttacttgccacctattcatctttataataggcaagtgcactgaagtgatgtaaagaggtctgatttatccaagttgctgcacaccaattaagtgaattgtacattcagaacatagcaggtgtacccattgggccctcacagagtagcttgctgacactgaaaattcagtcagagaatggaaaagaaaatggacactgcatgggagcgcgactgtaattgacctgcttggctttctgttttatctgcagatttgagaagtataataaggatggagctacgctctttgcgaccgtaggctacatgacagtctataattact

SEQ ID NO: 26761 - DNA, 1147 bp, Mus musculus
gtcttccttctattgcttttgttttaaaatgctccagcagtaacaagctgctatgttctatgtgcacatgcaaaaatgtacaggtagtgccttccttcccgtttgtaggataatgtttcttcttagattcagcttaggctggggatatagccagacagaacacttgtctagggtatgttagtccttgggttaggtcttgagctacacacaagcattaatgcgtgcaaaagagggagagagactgagtgagagcagattttacttttcattctcacaagaatcctcttcagccatttctcagtcccaagctatctaacatcgtgtcctataacacttcggtcacttgttactatcttcgaggctactaatttcttgagagcagagactatcttttattttttcctccgctggttttcataattctttgtctattaacagataaattatgtgttcttttagaaaaacttgtttcataacatgaaagtattcacatttttttgtttcatttgtttagcaacatgctagaagggtttatgaaattcttcgactgctggtgactgacatgagcgatgctgagcaatacagaagctacagactggatattaaaagaagactaattagcccttacaaggtcagactttgagacgcttttggtacccgagtgtgcgtgtgacttggaaaattgagtgtatttatgagtcacagcatgtgtgtgtgtgtgtgtgtgtgtactacatgcatgcctggtgtcagtagggacaagaatagggcatcacccggaactggagttacaggcagttgagagctgccatgtggctgctaagtactgaatctgagtcttctggaagagcaagtgctttttgccaccgataatctctccataccgatttctttatatgtgtatgtgttggaggaatatgaacaacatgattgcagatgcctacagaggctagaagtgcagtgctgggtctcctgaacagtagttaacagaagattgtaggctgctcacatggggtctggtcctcaatagcatccagtgcttttaactactgagccatccctccaggcttttaaccattttgttctttggctatattatattcactgtttaagaaaggaaagctaggactggaaaggaaagatataa

SEQ ID NO: 26762 - DNA, 1272 bp, Mus musculus
tccaaccagactgttagtctgagattggatcttagcttcttagctcactgtctcttgaatttctccaagtcccagaactcactctgtagaccagaactcagagatctgcctgcctctgcatcctgggattaaaggcatgtgccaccactgcctggcgtcactaatattcttaattaatttgttttatgtatatgtgtctgggtttatgaactagagctgagctggcatgggtgctcttgaacccaggccctcctctaagcacggttagtgcttttaactactgaaccatttctagcccctactacttaaagatttcaattgtagctatatgagcaaatgcttttttttttccatctaaaaataattgcttcctacttagaaaaagcagagggatcttgccaagatgaagaaatgcctgagaccagaagagctgacaaatcagatgaaccagatagaaataagtgtgcagcatgagcagctggaagagagatttcaggagctggtggaggactaccggcgtgtcattgagcgacttgctcaagagtgaagcccttgttccccagaatacctgcagatttctgtgcatcgtgctgtgaacctctgatgaccctaaagttatctatgttctccttagtggaatatttccttttgagagattgtatattttaaaatactgtctagagtttatgaacatatattgcattaataaaagatggcttgtgaaataccaccgcccactgctttcttcttaaacagtaaaataaatgattggttgtagtatattaagttataatgtggtgcttaaggctttaggataaatattttgagttacactaaaactttgcatttgagttgtatgtggtggtacacacatgtaatcaagtactgaggctgaagcaggaggatttccttgagttcaaggccagcataggtttccatatgacaccttgtctcaaaaacctaaaaataatctggaaagagggctcacagattaaaagagtgcttaccctgcagcgtagacatcagcacctaggcaataaactggatatctagcacactcctgtaaacccagctttgaggggagcagaaacaggatgttgaaggttgctgacttccagcctaaccaataaaccatgagcccctgtctcaaagtattttgagagtgacagaggccacttggcaacttgctttggcctctgtgcatatacccatagataaatatttaaagtccaaaacacattacattttggaagttttaactgttccctatgt

SEQ ID NO: 26763 - DNA, 1295 bp, Mus musculus
gcctgctctcttatagaacccaagactaccagcccagagatggcaccacccacaaggggcctttcccccttgatcactaattgagaaaatgccttacagctggatcttatggaggcatttcctcaagggaagctcctttctctgtgataactccagcttgtgtcaagttgacacacaaaaccagccagtacagtacctggggggggggggggggggggggaggcagcgttggaaacagatgtgtacctactagatagaacatgatggctgcttcccacctagagttgagagagaaaactgttctgtgagtcacatggtctatgcttgttctatgaagagtgtcttccgataccagcattgcgcccagctacctgccagttctgtaagggacaggctcactctcctctgtttgacaccaggtgtcattccgtctcagctgtgagacctgtgccccggaagcctctatctttgttctcttccactcctcagcagctgtgggactcgtgggctgcagggcagagaatgatgcccacagctctggctagactttaaaatatgcaacattcaagtccctaagttctttctgttttgtcaccaggttgcttgtgggggcacctcgggcagaagcactcccgctgcagagggcgaacagaacagggggcctgtacagctgtgacatcacctcccggggaccttgtacacggattgaatttgataatgacggtgtgttctgccctcactgttcgtttggccagcctgtctgtgccatgtgacacttgccaccagataggacaggaaacaaagcatttattcctgcagagaaggcctctcacttttaattttttgtcagtcttgagtgttttatctgtcctgaaaatacttgttgcctcggttcatcccggttaaactagaatggtgtgtttatgttgccacctagtggtctgttgagactgttgcaaaattgagttcatggctgtgaagaaacactagaaggggggaaaaaagtcacgtattgttaaaatgttgggggaggggggcagaagccaggtggtgacagcctacacctttaatcccagcactcaggaggcaaaggcaagcggatctctgtaagtgtgaggccagtctggtttacagaggagtttacacagagaaacttgtctcaaaaacaaaacaaaaaaacaaacaaaaaactggggggaaagacttattttgtttacttttctttattatttaactcatgtatttgtatatgtttgcctgtttttgtggtattagggccttgtgtatcctattca

SEQ ID NO: 26764 - DNA, 1101 bp, Mus musculus
attttatgatgggttgcatctaatattaattattccggtgaacaagccagaagtttggtcattcagatgcccttggggtttataaacaggctactggtagaacatagggagatgtgagccactttgtttgtttgttctcagacccctttgcctccttcagaatgggtttcctcaaaagtatatgtctgagaaagaagtccggtgtacgttgttacgttttgctggtctgtgccgcgaggttctcatttccaaagatgagtgggtgtagggtgtaatgatctgcctgagcctgtggaaggggcactgcttgtcagacacgacgccacggtccggcctcttaccacactgcttaaccgtttttcttcaatctctccatgcacacggacaggcctgctgtttctgaccagcctttcctatacagatcccgatcagtttgtttataaaacacggcctcccagggagcggcctgacgcattccctgatgtgatgatgaatagctacttaggtttgtgacctctgagatgacaaatgaattattgccttgctcatggtcatttcaaaattgttttggtccatacagagcataaatcttcttattttctatttcatttccagtgaaacacatagaaaaagcatgctcagtggccagatggttttcagcactgggtcagccatgtctcccggctctaaacttggggctcatcatattttcaattcacctcacaatttgagaactgcgacagtagtggtgacgctttttataaataaaacccaacaaaaagggtgaagttaatgttattctgcaccagctgcttttatacagagagcgagatggattcatttgaagagttttggcaatggatagttctatctgcttttctagcagaccttagagtcaccccaagtgcattataattggacattccaatgttgtctgccctttgaacaatatgtcactgatccaaatgacagttcactcacctctattgttgatgcgaggttctcaaatgactgaatcaccatgcatggtttgtttgcatgtttgtgcctgagaactgacttggtccaaagtaatgagatgctacttaccgtatgtattag

SEQ ID NO: 26765 - DNA, 1142 bp, Mus musculus
gccacacagctaagcaggtgtgagaggagggcttggaactcagattctctagcttggtgggggctcatgctctgctgcaccccaccgccttgacctggtcaaagtcactttgatagagcaggagccaagtgtttgtcaaaggagggtagaagatcatagggaagtggactgactgtggagacctttgggaactcatctctctgcatttggttccttacaggtccacttcttaaaggaaggatgtggagacgacaatgtctgtaacagcaaccttaagctagagtataaatttggtacccgagaaggaaatcaagacaaattctcttaccttccaatgtaagagtcacaagcagaagtaacagacctctaggctttggttacagaagtaactgaacatgggttgagattgtctttgtctctctttctttcttttttttttaatagtcaaaaaggcatcccagaattagtcctaaaagatcagaaagatatagctctggaaataacggtgaccaacagcccttcggatccaaggaatccccggaaagatggcgacgatgcccatgaagccaaactcatcgccacgtttccagacactctgacatattccgcttacagagaactgagggctttccctgtaagtgtttttgagaaagcagcagggagggaaagaccggtgtcacatagcacgtgaacaaaccgtgaccccaaggccttttctgccgtaggagaagcagctgagctgtgtggccaaccagaatggctcccaagccgactgtgagctcggaaatcctttcaagagaaattccagtgtaggtgatgcctccccactgtcttactgttctgaatgccagtgctgtgcccagaggcctggccattggtaaccgctcttcccatatatttttttcaggttactttctatctgattttaagtacaaccgaggtcacctttgacaccacagatctggatattaatctgaagttggaaacgtaagcgtaacttcaacctctccattcttacttcaggagaacccgagagtcgctgaattagcactgatctaactcataaaagaaatgtaattgtaatgagaaaactgactgttcaaataaaaccccattgtttccccttttcattttcagaacaa

SEQ ID NO: 26766 - DNA, 1099 bp, Mus musculus
agtgttgaaaataaaaaatggacccgagccaagcctagtaatgcaggtgtgttaatagctgaggcaggaggatcactgatttagtctgtctggatttcagagtgaattcagggctggcctgggcaatttagtgggtccctgttccaaaataaaagtttaaaagagtcaatagatagttcgtgcttcctaccaccacccaaggccctcggtccaatcccaggtgctacacacacccccaaaaatagaagcctagagcagagctgtggtcaggatgagaaccgggcagccacacaatggaagaatagcttacagccagtaggtagtgaaggcagcccatccctgagactgcagccatcctaagaatgtctgtgctatgtgtggccaatggaggatcctaaaaaagatatttctctgtacatctggaattgagaagccaatcacagtggctcacttctacaatcctagcacttagaaggccaaagcaggagggttgttgcaagtttgagggagcctaagctatttagtgaatcccaggttaaaatagaccacagtgagaccctacctcaaaacccctgtgaatgaaagattgaatgaatcgatcaatcatcaatcagtcgatcgatctattagtctagaattgacttttgtaaaataagtccctgatgtttcctttggaacaagccttggccatggagcagcctttccaatgacagacagaactgtcctgtttccttggacaccttcagaaggaagattgtctctcccttactgtcctgtgacctgtcagtggggctgagaacgggtctcagttctcagttctagaaggttaccacccaagggcctgatgtcaagtctggttgcctattcacaaaggaaaatccttgtcttgggcatgttattttatccagcctccttgtagagatggagtctctgtatgatcctactttctttctagccttttgtctagaacccatctcttttgaaaatggagacatattttttattgctggtcttctactacctcctattttctgtgatttttgggctacaatagctcaggacccatgctggcacttccttgtatatccgaaggtgcagt

SEQ ID NO: 26767 - DNA, 1150 bp, Mus musculus
gagttacacctggagaaacctaccttgtccacacatactggcatggtaaaaagtcattttaggaaattaaaatgaggatctttagtttgatagcctaaggaaaaaaaagtttaatggctcctctttgttacaaagcttgtcccctgtttcacagtgtctttggaatctgaggtttgtagaataattgcacccaaacttacccgttcctttccacggctgaaaattgactaaacgtctgatccttctcaaaaggatgttggctgaaggctggaggtggagcttggaggtagtgtttactacacatgtgcaaagcttgactccagtacagcaagatttaaacacaacaacagaacaaaaccaagtaattgtggtgaaacacagttagctgctgatagctgttcagacgcaaaagggagtggtgggtacgtcattgtatagttttctctgcttttctttaaaacacacacacacacacacacacacacacacacacacttactttaagacttacattagaaatacaacccaggcctttccagttctggataagattttcagggaaagcccattgaagcaatattctgtggttatgagaaatggctgacaaaggaagcgacttgtctgtcctcccgctttttcattcagaacatgtataggagcagaactgagccgaactgaagccatcggtacctgatgtgagctggcaccgggtttatagtggtgtctcttttgtgccctgcaggttcgagtgacggtgtttccctcaaagactgtagctcagtattcaggagtagcttggtggatcatcctcctggctgttcttgccgggattctgatgctggctctattagtgtttttactgtggaaggtaagttgtgtctgtctcttgagtttgggatgtaaacttcatgtctttatagatgaggattcacactgacacatttgtagttccttctttcattatttctttttcccaacattatatatatatatgtatatatgtgtgtgtgtgtgtgtgtatatatatgtatgtatgtatgtatgtatgtatgtatttaatgtatgtaagtacgctgctatcttcagacacacccgaagagggcatcagatcccttcacagatggttgtgcaccatcatgtggttgctggg

SEQ ID NO: 26768 - DNA, 2695 bp, Mus musculus
aaacacatggataacctcgaaaaaaaacagtggatcaccaagtggaatgaaaacgaaagttactcatagagaggagggcacaggaaagaacacctcacactacccaaagcccccccttattttttccagctcagaaattcaggtggcttcaaagcctgctcagctcccccatatatgatttcagactgacgacacccagtatggacctacagtttcaactgtggatattgttacacctaaggctcctgttttgcacagccaaatttaagactggtagagtggatttttctttaactgccttaatttaactttccggattgcctttgtttttgacgtggctgacttccacacgctggggcagggcctgcccatctgcactgctgggatgctctcccccaggtcacctgtgctaacagagtggctatcccagcctgctcccacaagcattcttctcataagattgaccttggctcaagactgccaatggatagctgtgcctctggtgaaagttctgtcttaaatgtgcaatagaaggtgatgttaccctttggccttctttctccatctcctagaagtgaggacccttgctgacgccaaatgcacacaggttcccgtctcccttgtcactaaagcacagggtcgacagacttgaatgctagttacatttgtttgtatatgatatttatttttttcttcaagccatcttgctgttgactaataggccaaagatgcttctgggtggtttaagcaatgagaatgagaacctgggaggtcttgttgttgttgttgttctgaccttacttatttactgcaaaaaaaaaaaaagatctttataaacatgcaagggtcattttaataacttaaactcacctgtacatgataccgtaattgcctttctggcaggccttccaccaacccagaaagtttgacaaagggggttaactgtaggacatttcgtccttccccggcagtggatgtactgttttgagccctgtgtggaacttctgaacttcgtgctgtaactttcagaactcttagacatgggtgtgctcactgaactctagggtctgtgtgctagatgctgccaacgctgtattcaggacctgaagtgagtacccgtgtggatccagaccaatccagtgtgagactactgaagaacatctgttgccagaacggccacaccaaacagatggagtgccccagcacttagcttcttaaataacatcggaaccattcagccagcgagtctgtgtttgctttttgttcaaattgttcgccgaatctaaattcctccaaaggacttgtgactactcttagctcattgctaaagtgcttgcttaccgtgcctcggcccgccttggttggttgtaaaaatggtaggagggggaaaacaattattttatatatatgttcaacagagattgaatatattatcaaatctttttttaattgtgctttaaaataatttatatggagagcaacaacagcaaacaggtgccaacagcaaacaggtgctaatttgtttggatattagttatataagcagttctctatcttaagactgggtctcaagtaacccaggctggccttgaactccttaggtaacttgggatagttttgaacttccgattcccctgcctccccaccccagggctgtgattgcaggtgtgcgcttgggactgaccccaggctttgtcggtgctagggcagcactctgcgactgaattaggtcccagccacttctctgtcttttaaaagaacaaaacattgctaaatgtgccattgttgctttgagttttaattctttttttttctttctttcataaaacattacagtcttaagatattaaagacctttattctggttctatttctgtcttttcactcaaaactggttttacaaatgatgccttgtttacagaaagctctctaccacagggcctagtcatgtgtaaagtctcagtttctctctggagtatcttggagcctagcacactggctttaaaggacacagctaagaagctgataccttgacagtgtttgtagacctttgttataaaaatgaatgtcctggaaagggttgggagggagttcaacaacaaagaaacaagaatgtcatgtttaaatttaatagttgtctaaaatgtcatctcaagtcaagtcactggtctgtttgcatttgataggtttttatactaactagcattataagattatttcaattagaaaatacctgtggatatttgtataaaagtgtgaaataaattttttacaaaagtgctcatcgcttgttaacacagcatcatgtatgtgaaagcaaactctaagattataaatgacaacctgagttgcctttctttgtatttcatcaagccaaagtaaagctttcaatatttgtttagtgtcccatataatttcagaacagctaaagatacctaaagtgtgatacaatataaatgtgattgaaggtttgtaattttatttattttagtgtgtacgcttttatgtgtgcatgtgtgcccccagagtgcatgctgaggtcagagaacagcttttgggagttctctctctctctctctctttctctctctctctctctctctctctctctctctctctctctctctctctctcagattctctctctctctctcagatttatttcatgcatgtgggtacagtgtcgctgtcttca

SEQ ID NO: 26769 - DNA, 1161 bp, Mus musculus
aggtagaggggagagagttcaggaccagctagagaattccaggtcagaccagctgtggatacagagtaagactgttacaacaacaacaacaacaacaaatcctacaattaaaaacatttttaggcatttaaattttcaatgtttccaaaaagaaaaaaaaaaaaaaagtagacttctggaaccctgaccatctttctgagatgtctcaaagacaaatatatatgcagatatatatttaatgcatataataatctctttagcctgctgtttcttttcctttgtttatggcatgtttctccatgctgacgtttttttaagtttctgtggccctttctgtcattattctgttacggctcagaccttccctcactaaaattgttgaggtatattttcttctgctgagagctgtaagttttcatttgtcggtactgttggcctcttgttgggcaagacggaagtacgtttctttaatgctcctttgttttgtttgcttcacactagatggctatgagaacgctaggcggctttgtgatttgtattatgttaactctcctgaacttgaacttgaagaactaaatggtaagccagcctgggggcgccagttcaagtaacgggtgttctgacagctaaggagcgagctgagatttgcttgaacagtaaaggggctcttccatcaactccgtcaccaagtgtgaaggcagcagagtcatgtgtgcagcgcacagccacatttattgtttagtttgattcctcggtagaacattttgctgttttgttttggctctatttttttaactgataattttaattctttgttattttcttcagagacagaaaaaaaaatactaagaaaagattttttaaaaaaatttttgtatacagctcatagcaaagtttatcttttttctactttctgaattctaagtcagtttttattgttgaaggcagaaggctgggcatgtgaaagacagaggaggcactcacctgtctgagcagctctcatggtctcctccctgccttttggataaagggttcagaggtttggataaagactgataatggtcatttgacaaggaaaacctctcccaggttaagataatcctttgagaaggtgatgggaaaaactatgttttaataggcttgagctaagccatattctga

SEQ ID NO: 26770 - DNA, 1203 bp, Mus musculus
taagggtggaagtaaccgctttgctttgcacctacattaatctttaagtagctaaaaagcagttgttcaaacctaatgtgtttgaactttttttttctccttgaaatttcagttaggtaaagattctaccctgtaatacttaaaactttatggaagctgtgacatatttatctaatgcccatgacagtggctttggtctggaacctagtattgaactaagggaaataagtgtagcctcctctcctcaggtctgctcagtccttagtggccagggggcgctctcagttccccatccagtcccagcttcctctggccttatcgtttctactccagtgtcacaggtcctgtcactagcccgtgcttaggcagtgcaggcctcgtaccttttagaagctagtcaaaccatttcatgtataaatacttttaatttcaaaccaatgagaaaggaaacttaaaagtcatgtaatgcatatatatttcaaaattataagtagttgctttaaaaaaacctatactttaatataatcctaatatatttcagaatgccatgagagcgaccatggagcaccacgcggacaaaggcgtttatcccccgattcaggttcacgtcacgctgggcgaggaggatctgactgtgaaggtaatctcgataagagaaatgggtgtgtaggcatgtaaaaacgatataatatgtctaacggctgtaatgtataatttattctcaagggaaaggatttcagtcaactagataataagcactttgccttgtttatctgacaaattatagaattatctctcgagtctgtttctattctggtccttaatccagatgattcgggttgaaggaacactggaggcagactttgatcagtgaaaagcttaagtatttgggtgcgttcagtgtgatggaggatgttaatcttactgtggtttcagccccttgttctgtctgctctgttccgttttcagcagggcctcttaggactgtaggtacggtatacttgtgggaactgagggtctgtgaggagctcccggtcacactgagagtaaaagctgcagaccttcagacccactgctcggtcttcccatgcacccactgtgataccatgtccttgcttagactacacgtgcttctttgtaaggaatcaggtatagaatgtagaatatacatatagaacatgcaactcagctgtcctttttggc

SEQ ID NO: 26771 - DNA, 4647 bp, Mus musculus
atacattactatatagtgaaaaagattggctttcttctcaataaatctgtgtatgaatattaaggtagtagtagcagactcctggctgggcttgcacttttcaagagatgtctgttctgcttgggtagacttttccaggctggctagcggatacctgaagcatcaaacccaactagtgtgttaccagtgctccagttgtagtaaatagcatttcctaatgtatccaccctgaagatggtgtgtggttagtaactagttgatgagatgccagcagaaccctgtttactttgtggtcgctgtttgccactgtatattatctcagataacgaactctcagaagtgtctgacttcttttcaaccccaggctctgtcgacagaatccgtcgagagactccctgtgtacaataaagccgcctggaagcattacaaagccaaccacgaggctgacgactggtgtgtgcccagccgagagccgaaagacatgaccacattccgaagctcttaaacgcacatgggacgcctggcacatccacatgtggtttctgctaaatttggaagacatgtatttggaaccacactgttccaaatatttcacgtgtgatcttcacaattagtgtttgctgaagctcctaaaggatcggttatgccaactgtattctgatgtgttgggttaattgggcgtggttttgaacacacataattttggtcaactacccttggtatggtatggggtgtgaagttcctggtttctgtaggaagctgagtatttctttcaagttttcacttacttctgctagaagcatctgaagaacgtggagtagctggctagcggcctctctgcttttggagttctatcatctgtgagtggtgacacctagtcagatggtcttcttatctcccacgaagaacaacacagtgatccgttagaacccacacaggttgtcagagtgctgaaatgaattgatcatggcatcatttttttgcagtggattgtaatgactggttccccatggagctaagtccagagcgtggttatcgagtttactgtcagcacaagggattttctttaaaaacaaagtctcactgtgtagccccagctggccttgagcttacaaagccctcggtgtcctgagcgctggaatgagaagggtgtgccaccacatctggcttacaagagaaacgttagtcccaaaacaagccaaatggcagcagagagtaaactgtttgggaagcaccaagtggcccaggccgagctgaccgactgctgaggtgatctgaggatgagcgtgagattctctgggtcccacccagggatccagaggctgaaggccagggaccaggtgaggctcatggctggcctggctggaactatatttgggagtgaatcgtgactactgctgttgtcagagtgacagactagattgggaagcttgtcgggttgctacacattaggggacataatctgaatctcaagcctggtgcaagctaaagcattagcgggaagaccagggtgacagcgagaggtcaggtgaccaaaggctcagccaccttggtttccagtggtgactaagaacatgtatttttctaaaatatccagattttttttttaaatcaaagaaaagtcagcttatattaactacagaattcatttgcagctatgtgttgatttaaagtctgcaacaaacgctttgaagtattgatgttatttgtgttagaatacaaacctatggagcaggtaatgacacctgggttctctctcagtgacccagagtcacacagaattggtgccccagcctgagctgtctctgctgatcactgtccactgtctgggatatttataacctcctctgttaggtgatggggaagtacttggaaaacatgctttgccacttgcctagagggatttgggggtttggtttggaaaatgtagtgagttaaaacatgtcactcttgacatgttttatccagtcttcactctgtgtcctacacatacatacatctgtaatacaaaagccaaatcatgtgacatggcacaaaatagaactttggtgccagtgataggaacatgcagcctgagcatgcgccagggtggtcagcccagatccttagctgagaggtgaggggcctgaaactcaggtcctattggcccagggtttttagctaatactaccaaatgttggaaaatatacaccgtatacctgctgtttctaattgaggactttgtaagaaataatagatcatgctcctgagtggcatttattcagtgtattgcacttactagctttcaattacactttactgcaatgatgaaatattttggaatcttttgtacaactgtcaataaacgtactatttttacttgtgaaatactttgccctctccaaggaattaaaaaaaattatccccctctctgcttaagagctaagaaatgttttcagacaagaagaatttaaaattagtttactttagattctttttaaggtgtagcacctttttgctctgttgtaatggtaatggatggagacaatgtgacaaagctctaggggacgctttccagagttacttttaaagacacctggaaggtttttagattcttaaggtgagccattttgtctgccagcgatagttttatgtggtttaggtatgaaaatagagttgatggttggggaatggacagcaagtgatttttataacctgggcagttagtgagtgtgccagtgtagtgtaggaaaggattgtaagaatatttcaccaggcagtggtggcgcacgcctttaatcccaacacatgggaggcagaggcaggcggatttctgaggctagcctggtctacagaatgagttccagggcagccagggctatacagagaaaccctgtctcgaaaaataaaagactattccacactgtaattccaaatgctggctggttttgatgcctttacatttaataatggtcagtgtcttacactgagatttctacatgaagacatagaagcagaattctaccgcagcgtggtgcattttcggggtgactgaaaactgaaaagatggatcagctttaaaaaaaaatttgagccacttaaggatcttagaaatatactcgtgtcctttagacagcagtctgtttcatcatcaagactcaatatctgtacaggttcaacgaattgtaactagttgccagcactggctcagtgggtaaaagcatggccatcaagcctgggttagggatagggttggagatctttcctcagcacgaatggtggaattagagaaagaaccaaccatcctgtgagttatctgtggttctccacacgtgcactgtgcacatgcgcatcccctacatacaccacactaataactgtagccaggtgtcttgcactctcaaccatctcctagcagtgcttgaggcaggcttgcactgtagatagcctagtgggcaaagcaggtagagttcgtgtgcttagagttatcctagatttcccttttctaatacactgccaatgattgacatgtgctggagaactggtggataattttgaagagctgtataagtaagtcattttccacagtagaaataacagtagggaaaggcttagtgtaactggcactgccttctactcaacactggtggaatctcctttagtcaagacagagtatgtcctattgctcgttgatagcgtgggtccaccacgcctgcctttcaccgttacagcggcatggcggcacacacctgtaagtagatctctgagcttgagccagcctggtcaacatagggagtttcaggttagccaaggctacatgtacggaccctgtgtgctgtattttttttttttttaaatcaatgaggtctaaaacaactacagaggaggaaagagttgtgtggttctatgaaactcagtgagtggctaattagagagggaccccagccagcaaccttctcttatgtcatcaggtttacaaggaagtacaaagcttgaaaggagaggtggccagggttaggtttggttgttttaactgaaggaacttctcatatccgattaacttgtgttctcaatactattaattcttctctcagtcaaacccaagacactataaaaaaaatagaattaatgctttgtgaaggaaaacaacgcattgctattttacacaatcctggcattcttaaatgactgtatcacttgttctaccttttgtgtttgcaaagaattaaacagtgtgctgtccacttttctttgcctgtagtcttcatatttctgtagcacattttttttttctgtagcacattttaatcgtaggctttagtaggaagatacaagactgcctattttgttggcttccaaaagctttgactcagctagggataaagaaggctttataccctagcaccgtggaaaccaagtatgtgttgctaatccaggggcgggagcctgagatctctgggttacagggaagctggaagcaggaagacctaaagttcaaggtcatccttggctgtacagggagcttgggttccacttgggatattatagatcctgtcacatatcggtgaatagtgacaactgtctttttacttcgttaagttacagatttttgagcaaaattttcctagtaagagaaactcagtagttattttctgagattctgaaagt

SEQ ID NO: 26772 - DNA, 1168 bp, Mus musculus
gtcagggttctctggacgtgagaactctgtcacaagtgtatggactgaaaaatctctccaaagacaagaattcccttactccaaatgcagcgatttgtgtgatctgagttttcagcaatagtcagcaataactaagaacgaggtaattattgagaagctgggatatgtgaaccccaaaagatcttgtctatatgttcataataagaaattgctccattggcaaagagaggcaacacatatttataaaaactgcagattgaattccacttacacattttgaaatagaacatactttaaaaatagtatctcccaccttttgtcgaaaacatagtcgccaaagtcctagggcgctgtgtagcatggtgtttgagagcttagggcctgacttcagtcaatggatattcagatcccagctcccgagcttgtttggcacgtagacaggttaagcaagcctcagttttctctgctataaaatgcagataataatggggttggcttcctaaagatgctgtgaggaccagttaaggcaatccatgtgagtacatgctcctggctcctggcacctagtcagcactcatgtatgggacaactgttactgctgttatttcagcagcctgacgtctgaacacacccatcgttcctccgtgacttgttagcacacatcaccgtgggtctttcccttccagggctttaaaataacaagctatttgcatcatcctgttgtatagtcttcctaaactgagaaactccatagtcccagtgatgactcttttgatcgtattctttctttttctctctctctctctctctctttctttctttctttctttctttgtttctttctttgtttctttctgtttgattttaccagcgaacaacattttgtcattgacttgctgcatttcatattacaaaccatggtgctttaaagcgccctcactatacatgtctcttgtcccctggaaattgagtctccttgtacttgagagtcagtcatgtaggacgttctgtggaatagaacgtgtgagctgggcagaagtgtccaagaacagtgtgactcttagagctgcgggggatgacagcacagcccgtgctgaatctcagatggaacccggaagggtgagagactcacagacaaatcaaaagacaatggttcgtgaccaccacc

SEQ ID NO: 26773 - DNA, 1161 bp, Mus musculus
tggagaaaaaagttgtctgtgtttgttaaatagtggaagcaggcaggcctcacccagccggccactagtgttctttctccatggtatccttggccatttgtgttttattgttttcagtaagcaggcccagggattctcaggatgaagcacattgtagagccctggcatcttaaactgacatcccttcagccaaagaaatcccaggttaaggagcctcactgagccactcagtgggcaagagtgtcagccccgtagttcaccctgtgtatatacaacctggtgtcattttcccatccacagtacagaccagtacccatttcttggggctgttttgggagaaaaatggtcgctaggtcgctcttcagtgctttgttaaaatgctctgagttggtttttcccaactaggaaccacctgttggttttgaaggataagaaagagtcccgctgctctggccggttcctggccaatttcaaagcccacaccttagctttgtatctggttagtcctccaatggatccactgagcacccacgggccgggcagtagtggagactcactgaattctctctctctgcaggtgtgaaattgaggcaacccttgagcgactgaagaaactagagcgagatctcagctttaaagagcaggagctcaaagaacgggagagacgtctcaagatgtgggagcagaagctgacggagcaatccaacaccccggtgagtacgccacctagtggcttcccgcagcatgcacgctgagcacgggacagcatgaccacgctcctccccacccccaaccctgccctgccctgccctgccctgccctgccctgccctgccctgccctgctcctgagaactaaaggccttcattggtagtaataagtatgaaacaccaaatgccagagatttaaaaggggggaaaaacctatttaaaagaaaatgcctcctctgtatctttccttagaaactattatttccttaagaactgcatttatttgtatgttaaaattacaagagtaaagtctaatatgtttagaccatccgttaagccctaagaacactgagggaatgaatgcccttagatgctaccagtaattaataactcattgcaaggaatgccttgggtgtgtcagaacttaagcacattttctaagattgaactgg

SEQ ID NO: 26774 - DNA, 1189 bp, Mus musculus
actgttcaccctaggcttagcttgtcccttacacagaagcacatggtcccaaagggacgtgtctagtcatgaaacaggatgagcacaagcctgctctttacatgcaataacaacactctgtttctttgttttccagaggtgcataataacactactagattttaatctatgtataagaaaaaaaccactctaaataggaaagataaattatccttcttagacacaagtgcatcctgaaggggtctttttgttgcgtgtagcctcccggaacacacccagtttcttttctttttactgtcctctgttatgctggttagagaaatagattcaggtaacacttagtgtgaaggccaggcttcccagagacactctaagaaggctagcactagcagccaaaatgtatttaaactataaacgcatataaaattactagataaagttaaaacaaaagtttttatcaatctaactcagaaattggtatcattcatttgacaatgtaagttaaatatttttggtgggctttttttatatagaagctgtaacatgaggtgggcatggtagctcacgttcatagtcctggccctcagaggctgaggcaggacagtagtgggtttagtattagctaagtcgcaagactatgtatgagcaacgttgcaagactctatctcacgaaaggactaggtatagctactattgtttctaagtatgtttggtcatgaagtcttctggaatttgagataggacaggcctttaatcctcggtgaggattgaggggtagcatcaaagatgggaagcatgcactacaactttatctggaaagaaataactagtgggctcttctgggtatctgttccctgtgcagtctcaggtagactatgtaatctctgagcctgtttaccctttgttaccatgacagtacataacaagaaaaaggttcagaaggaaagtatgtaaccacgtagcctagccccaggccatgccaggggccaggtgacaccagctatggctaattgccaagtaaaggagacactgagaagtaagtgggttctataaccttctggaccactacactatctattgcaagtgacactggctcagaagtatgaagttaaaagtagatagctttcatgaaaagtaaagagagcaaaaatgaggaatgtaaaatgcacaaagagtttaattcagttgc

SEQ ID NO: 26775 - DNA, 1211 bp, Mus musculus
tgagcatcacagaatggcaggattcactacgtgtgtgctggaaattgagcaaggaaggaagatggggctagaggaaggagtcttgaaagcatgctcaggaaagaccctctgttgcatgacgatgctacagagcctgagaaggtaaagggacctctgagagtggtgagttctgccctatatgtaagaacataaacctcaccacccactaatcaagagttggttcagaactcatatagagcatggaaataatgtatttcctaaattaatatctaactcatattctatataaaaattgtagtgccagtaagggaaagttactgggctctatacccagcctaggttgagcaccaccccagcacatccctcccatctcctaactgctgccttcttctctaccaacattgcagtcatgttcacaactcagtactgtcatgaagaaatcacaggtcttagcacagagcacagtgagccccagggaagagcttccaaccgctctgtctagaaccacggaatacgccactgggcgctttacttctgctcaaatcaagtgttcgtctagtggcattaaaatgtgcaaacatacctgaaacctgactcatataaacaggacccatagaattctcacaccttctgtaaaaaaaaatactacaaagctttagttaattttataagagatgcctattcgctacatgaagaatttctaatgatgctagtgtagacggtctaattcacttctcagatcagtttttgaaatggccaattatcagtgttagattttgtttcagtgtcctgacttgcaaaagaacacaattcagaagttaaagaaatcctgaaacatgtaaagttcagaatgagaattagagctacaggttgtggtgatgaatgtcagtcggacaccctaaaacatttccctcttcacttgtaaagctaacgtgtagaatttgaggacatctatagtggtactcagctgagaggtaatgcagccttggccagccagcatttactgtagactggtggcatcctgtttgccagggacagacatacacacacacacacacacacacacacacacacaccgagaggtttccatcctcgatctccacagcattgtcctgtccccacggtggtgaagctccttaaacctgacacatctcctggtccatctctacattttccccccaaaacaaaatcacccacaccttttcagaaca

SEQ ID NO: 26776 - DNA, 1184 bp, Mus musculus
gtcaggttcaaagacagaaaggccaggggttggggtggcagagattggcaatattatgtgtattttaatcgcagttaaaactgaattggaagttgatagtttaggctattatttcctaccgtcataggcatttaaaccatgtttatggatgaacttagttatccctagaggatcttttgaaaatagggattatttttaagggaatgagaagggggcaggaatttattaaaaaatcatttagacatgtaggtctcaggacagtaagggtggctcagacactgtcttacaccagtaacagagtattcatttgcaagacttgattttgttacccaccaaccttgctgactggttaagactgattttgctcatgtcctttattccaaaaggattttgtggtgccacttgtctgccactgggcagattttaataacaccttctctctggttaactagagactgcagttgaacagggaaggctgcaggacccgaagtcagtgccggcactccgggcctctcagggtagcaatgaagtttccggcacgaaatacccggagggcggccagcaaaaaagcagcgcccccaaagccctctgagagctctgcaaacgattcccactctgactctgaagaagaagaagaagaagaagaagaagaagatggcatgaactttctggagaagagagccttaaatataaagcagaacaaagcaatggtaggtatttgaatggacccaaacctttccccactttcttctaagcagttcctttcttctctctcctaagaactgtttgtaagctgtgggatttgacgatgtgtttgtttcaaagatttatacttatttacgtggagtagagggtgaaactgtgcagctgctcttggaggccgtaagagggcattttgtatcccctggacctggggtttgggatggttgtgagatctcaggtggctgctgggcactgaccccgggtcctctgcgagggtaacaagggccttttgcagctgcgccagccctccagcccccatccgtccgctctttacatcctgtaagagttagaataagcctagtagggaaatgagaaacctgactatgtggacttactaagcggagagttgaggggcaggctagccttctttctacaaattgcctgttgtcaccggttctaatctctgtttacgctcttcccct

SEQ ID NO: 26777 - DNA, 2075 bp, Mus musculus
gtatctggcaaagtatcatggcttcgggaacgtccatgcttacttgaaaaggtaatggcctcttccttcctttcttccttccttccttccttccttccttccttccttccttccttccttccttccttccttcctttctttctttctttctttctttctttctttctttctttctttctttctttctttctttcacatctgagtcttccattcatttatgtgccttgataaaagatgatagaagtctgagtggctggtctggggcagggaaatgttagtggaaatgcatctttctcagggtggggagtgtatgtaaaattcagtgtgtgtgtctaagatgtccactgacaatatatgttaggggtccataaagacattatttaaaggaagaatttgactttccaaagagaattaatggttgaaaaccgttttgacgtcttcccctttgtctttcacagtctgaagcaggaatttgaaatgcaagcgtagagcctgaagattgtctgcccgccttcggcctctgaaggctctcttgttctcgacgttgtgttgatgggaacccgagtaagaatctcggccatccgtctgccttagaacttggtcgcgttgatctcgtatctcacacttgtttctgaagcatcatgaaaggcatgctactccttacatttcagcgatatgtagtgtctcagagcttgccccggccccaccttgtagcctccctggtcttttgccaccacttagattctgagctatctttaactggcagcttgagaatttgtgtgatcaggacatacccaagcactttggggtacagtagtattgtgaagcaacggttgtgatgaatcacagagaagagccccttaacttgtttacacagaatcaacgcacatagtttagtgtctagtgtttatattggctaatgttttaaatggaaagggccaaggcacaaagggccggaaaccatgaggaagaattaggtagttgttgtaaactggagtatggccacattggatggctttctggaggaatacatctctggggtgctgtgctcagtgtacgtcttgtcacagctgacactgttgctgctgtcatctggcctacccagtcacccaaaggtttgtgggaacttggtaccataattactaaaaattgctgtagaaaaggtgttctgggaaattaaagatgatagctcagcagcgggttgatctgaaaccttggtgttctgcttcaggaacttaaccttaataatgtcactttagatcctggcagtttcctaaagaggtaaccctgggggttgtgtccagggtttctatatatttaggttttaaacacttttggaatgatgggaagtggccttttagagatgggtagctttgaacctctctgccagtgtagtttatgggtgggtgcctgaagtcaccctccctcccctttccctacaggtgggtcattcagtactggtgacgaagtgactgagtccctcacctgtgtagcctgtcagctgtgcctactctgtactctgtctgtggtgctcagttggatcttgaatcattcagtgtaaatacagctttttgctctgtaatgcttttatacaaaggtttttattttaataataaaacattttgttctaacttgtgtgtttatttttgttttttaaaaaagtttcaatattactttcccccctgtgctttgaaagggcatttctgcctcttctaaagcttgctttggattaagtttttgaggcccacagccagctcttttataaagggtctcatttgttgatatgacttttagctggaatctcaaagtggacaagacagccaagttgactgactgtacaacatgagcccggggaagttttatgttatttttcctttattgtttgcagtactttaacactttaatctacttttcaaatacttactgaatgtgtgccatgctctgaggtttcaagaccgaactagaagacaaaaaacaacaaccttttagagccagatgtaacatggactcacagaaccaccatactgaagcaggaggattgcaagcttgaagaaaccctcacaaatgccattttt

SEQ ID NO: 26778 - DNA, 1113 bp, Mus musculus
acgagtatagactggatctccaccagtgttgagccacgtgctagctatcagagcctttttgcatgcagtggtgggctctttggtttatcccaccttccacaggctatgaaaccacagcgctgtatgcctgagaacttgaagggctgtggtcctggcttgtccattgccatacgctctgacaagttgacgctaattgcactcggtggttgcttttctccaatgactgtctctccctggctctcagacatcctcgtttctgttgtctgaatcttctcgtctgcttgctcccttctcaggctattcagtcccatgatggcttctgcatttacccctcgaatttcctttatacaaactgagaagtaggtgactgggttcagtcttttccttctttctaggcactgatccaggtagaaggcttacttggttaaacagctgctctatcttgagcccactctgtaccttttattgtttaaaaaaagatccccccaaagtcttcagggttctcaaaaaacaagggaaatgcttacttatggaaaagtggggtgattgtatcttctatgtagaagtagtagtaattgtatggaaatcactggactaatgagatggttgggtgcaagaaaagatgaatattgaacatgctgctaaaaaaaaaaggttaaatgtttttaactttataaataaactaaataataaaaattgtctgatctaaaataaactttaaacaagatcaattttatgcatttctcttcttttctactatgcccactaaattatcaaaattatagaagtgccttacattacatttctattaaattgccctgttctaaaaaggttggtgactggggagtttttaacattctcgtgacatgctgttcatagttactaatcctgagaagtttccactatttaagaaaattttccagaagtgagagagtcccatattcctagtcttcagtatggagagcccaagaagcaaagggttatctactggaaactgttgctttatttagcaacattagcctagcctcttggtgcctggcccagctatgcaatgcatgtataagggaaaatggaaacccactctcaagcagttcactacaaatctggattagt

SEQ ID NO: 26779 - DNA, 1224 bp, Mus musculus
ataatttaactcacacatatgtccttgcacatctgtctgattgtcttattagtgtatgttgacagaaatagaattgttgggtcaaaaggaattgtctgctaaatagctgtcttgctttctccttaacactagcagtgtcttagttaccatgtgtaaccatttcttactttttactttaaaaaaaaaaaagcttttaaagtttgataggcaagaatagctattttagtctatttttattttattttattttactgtgtgtttgttttattgcttggtgagattgaacatttccagtactttttaaagtttattttgtgagtggtctgtcttgtgggactgttaatttatgtgtactttcacacacagtgtattttctcagttctttctacattgctttctgtcagtgatccatccgcaggctgtgttctgtgaatgagtaatggagcttgcttacaagtaacagacattcttaaacaacaaaacaagttaggtttttttagaggctaaaaattacctatgcccaaaattgtagaaagtaatcctctgatagtgtgcttttttttaaaaactgcattgtcttattagtgtactaattttaagcgataaaaaataccaaggttcttaggatagtagttaagagttgatctgagcagaattcaataagtatcaatgcagtaggcctactgtataaatagatagtgtctaattattagaagcattaacatagtctaagaacattctgcaacttaagatttttatttttaaagacagaatattggcttttttctcaatatatacatttatatacataaatggataagatagtatttttagaaaactaatttcattcatctttagaaaactttcgtttacttttttttgagccaactataaaagaaactattgtctcagtaattaagagcattgactctttcccgaggacccagatttattctcaacacccatatggcagcttacaaacatccataaatagaatcccagggagccaaatacctttttctggcctctgtggtcactgcatgcttgtagtgtacagattacatgcaggaaaaggactcacatagacaaaaataggtttaaataaaagaaattaaagttgtcagttagccagtctttatatagtagaaccagtgtagttgaagaaacagttgtagtaatgaaaaagtgacctaaaggcattattgtttcataggttttgcacga

SEQ ID NO: 26780 - DNA, 1227 bp, Mus musculus
taagttgtcacaaatacatcacaacgttttttgttttcttcatccagacaggtgatttggcttctgcacagttaggaggagcaccaaaccgatgggaggttttgtcagctacacctacaactataaaagatgaagctggtaatctagtacagattccaggtgctgctacttcaagtgggcagtatgtccttccccttcagaatttgcagaatcaacaaatattttcagttgcaccaggatcagattcatcaaatggcacagtgtccaatgttcagtatcaagtaataccacaaattcagtcaacagacgctcagcaggttcagattggcttcacaggctcctcagataatgggggcataaatcaagaaaacagccaaattcagatcattcctggctctaatcaaaccttactcgcctctggaacacctcctgctaatatccagaatctcataccacagactggtcaagtccaggttcagggagttgcaattggtggctcatcatttcctggccaaactcaagtagtcgctaatgtgcctcttggtctgccaggaaatattacctttgtaccaatcaatagtgtcgatctagattctttgggactctcgggaagttctcagacaatgactgcaggcattaatgccgatggacatttgataaacacaggacaagctatggatagttcagacaattcagaaaggactggtgagcgggtttctcctgatgttaatgaaactaatgctgatacagatttatttgtgccaacatcctcttcatcacagttgcctgttacaatagatagtacaggtatattacagcaaaacacaaatagcttgactactactagtgggcaagtccattcttcagatcttcagggaaattatatccagtcgcctgtttctgaagagacacaggctcagaatattcaggtttctacagcacagcctgttgtacaacatctacaacttcaagattctcagcagccaaccagtcaagcccaaattgtgcaaggtattacaccacagacaatccatggcgtgcaagccagtggtcaaaatatatcacaacaggctttgcaaaaccttcagttgcagctgaatcctggaacctttttaattcaggcacagacagtgaccccttctggacagataacttggcaaacatttcaagtacaaggggtccagaacttacagaatttgcaaatacaaaatactgctgcccaacaaa

SEQ ID NO: 26781 - DNA, 1220 bp, Mus musculus
ctctccctaccttgagccatgttgtagtcccaaccggacggagtcaaaggggatcccatgttgatctcattttgtagctgtgtaggctgcccattggctcccgggatattttttctagcctctaacagaattctctcttgctttttggttgtgaagaaagtctgcaacatctgctgacaatcatcccaagtaggctgatgagagaacataagggactccaccaacactatgaggcattggggatcctctgagaaaagggggtggttagtttcccagttataaagatcagcagaggaaaatgaccagtactgaaggggttgaaggttgggcaggtgcactggagtctgtccggactctgtactctctggctcagtgtactcgcagtaggtctgcctcccgccaccctgagaggttcggcgccctgacactgggggggggggggggggtgcggtggcgactctggacgcgagctgggcccttcccatggatggcctcagctgcggtgggtgtcacagccgctcctggggagcctggcgggtgccggcacaggccctgagaccttgccctctcccctccccttcgcccgtcccatgggcatgagctagcagccgacttagaactggtgcggaccaggggcgggtattgaggctgtggataagggggaggtagtggagctaatggattagctggtggctccgatttgggagaagccttcacttcgatttctcttgaaacaccagagcacaaccacaattttgggaaacaaaacccaatttcaccagtgtaaacaatctattttctttaaaaaatcaacaccaaaaacattacttgctacaaagtttgtctgcctgttcctgcacacaaacgcaagaaggtgcagcccccaatacttcaaagagacactgccctaaatcctatcttttataagtctggttctaggataagaattacagagtattacgcaatttaggcgtatctttagaaacctgtttccttgggttgtctcatgccgcatgttatagttctaaattactccaacccagagttaccagttttaagccaactttctaaaaccaatggtacaaatttttaatcataaccaataacttatgagccaataatctataaccaagacatataaaacatatttatacctttaaaactattcagaaacaaaaatgaaatggctgcatatatttgtttatttaacccaaacaaaa

SEQ ID NO: 26782 - DNA, 1606 bp, Mus musculus
cagataccttagaaaggtaccatgagcagcatgtaatgaaatttaatgacattggtatgatttacatctgtgtgtcaacagttagtgagaatgcagtatgattggtacacatatgtggaaacctagtcctgtccaaaccagaaggattttgcttatctttttttctttaggacttgtatgccttcctacacatctcttctttttcattatgcctttaacatgacccaggaactttccttccatttatttctcctgtttctcctgagagtttagatataagtaataagccatttatttctcctgcttgtcctgtgtattttggatataagcaataagccagttcctctctttttcctatgtatttggttataaataataagccatttcctgtttttcctgtttgcaggctgctggaaaatacagacaacaaggcaggaattatattgttgaagatggagatattatcttcttcaaatttaatacacctcagcaaccaaaaaagaaataaattcagttattgctaagatcgacgtacaacttctaaaatgcatatattggggcttggggggatgggtgttttttaaattaaagtttctgaaatctaaagagacaaagttaggaatgggaatcttctacaaacaaattatttttatttgttttaaaattgtaaaatactatgtaccttcaatgaaatgcaagttactaagcgtgaagagctttgctttctcacgtgattaagaccctactgcacactgtagaggcttttcaagccatattactctcctgatgcttcattaatctccatcatgtatgccaggcctgacacgtttgacagtgaagacaatgtggcttgctcctttttgaatctaaagataatgcatgttttacagtactccagatgtctacactcaataaaacatttgacaaaaccagccttggtgtgtttggggatgtctgtattgactgactgtggtgtgttgaatgcgatatggcacctgctggctgctgattacagaattttaaggcgtgtgtgacgcaggacctggcagtgtggggcagctgcagttgtatcttagaagtgagtctttcatgggaattagaagaagaatatgcctgggattgtctcagaaaagttaattaatttgtagatggacatttattgaaagatgacagcaatgatactgcagaggttgaagaacagatgactctggtcagaaaaaaaaccattttgtctccaatgccagtgaattctgattgttgttagttctctaaccaagtggaagccattttttctcacttttctttaaaattattaaattgtaaaaactgaccatttcgtttctaaggggttgcttctttatttcaattctgattcgtatgctgattctaatactgaaaaataattcaactttgatcgtttttaaacttcctttgctgttgaaatatttgcagccagttgaaaatcgggcatgtgtatgagtcaggaacctgtagactcatagcatggcaggtgagcaagtgctggccactcagtgacccctgggtcatctgccatgccactcccccccaagacagagatatcctcaactccttccttcctgagtaa

SEQ ID NO: 26783 - DNA, 2765 bp, Mus musculus
cagagcacggagcctgcactttcacagattgtcatggctcctccctcccaggcacagccctcaggaagttgattaaaacctgcagtgcaacagttttagatactgattagtgacttcaaagggaaatcaaggaaagaccagtttgcatttatgcgaaatctgtggttgtaaatttttttttttttacttgaagttaaatttgtctctggagttggtatagcagcagttgatgatcagactgaatatgtttttagtctctggaagactgattttccttttttatacatattgttaagatttattaattttcctgtgctcaatgtgtaaattgtatcataactcattgtggttgatttcactttgatttagtggcatcttaataaatgggggtgttactgaatcactcttcccacttccatttctttgcccaccccttcaccctgagatgtgatggtagtcttgttatcatttataccaaagttctgcagagtccctattgtctgtgtaagatggacaaagttgtaagacactagggaagagaaagaaagacggaaagttccttttaatctttttgccttttattttgcacattatgcaaaaggaagaatattagaaacacttttttttaagtgagtgaaagtatggtaagacggttagtgctttgtgcacttcttagactaatcaaggtcatccatcgccctgcaatgtttttaagattaagtaaacaaaaattttggaatcttgagcatttcaaaaaatgacttgattttttaagtcttaaattcagtattttaaacctgtgttcttgaggctgaaaactatgaaattatataatgtatgatacagggttatcagatagtaatttttaaaatttgctcttgtcatttgggatttgttttgtttgggattttgttgtgtgtgatttgttttgttttgttttgcagatttcaggtaacaaagtgagacgcttatgcataaagaagtgtgatgtggttgccagaaaagcctaaaattatgacttagaaacgttaagactgtttcccccattgtcgtacttgtacttgcgagctaacttgtacttattcttgtgaaagcactgtcatcttttagtagccaattttgataatgtttctcgtggaaaaaaatcagtatctatctttagaacaatgtaattataacgtgggaatgtgagtgagagaatgagtatgtgtatgtgtgtgtgtgtgtgtgtgtgtgtgtgtgtgtgtgtgtgtgtgtgcgcgcgcgcgcgtgtgtgtgcatcttccactagtttatgccagcgatattgcttgaatgtttaacgatgccttcagtgtgatgctggcaatagatgactgcagtttcagatgccattactgtgcaggcttggataactaacattccatgatgtagcttgttctgatgaaatgattgtagttacactttgctcattctccagtcatctgtggaatactgagttttctaatgtgccattatctatttttattctgcagttacgttaaaaatacagtacaatattttaaatagactaaattgttaaacataaaaattaaaaaaaaagtagtagatgtgtgtaagaaaactttgtaaaatagttatgagtcctacccagtagcaacttctggcgttcaagcaggattccattctgtaaatacctgtaatgtgtttataataagttgtgtagtctgttctgcatccatactacattattgctatggtctcagtgtcatctcttaaagagattgacgtttccaaagccgtatggaatgcccttgagagttcaggggaacacccaccccacctgcctcctaagttccaatctgggaaacatgcaaattatataaatgacatttcacgacttttgagtatgaagataataggaattttattacatggcttattaaaaatgagagcattttggttgctgattctactttgtatctattactttcacctgatctcatatttaatcagtttaaatcacaattttgtcatagttatgctaaggagttgatctcaaaggcacaaaacatgaattccccatgcaagctttttgttgtagatggataaggttggtcagagcctccatgtgtcaccctctgcaccctctcaacatttttctttcatcttctgatttgtgcaagcttcagttctttggtaacagatccttgcaattgtaaagtagaagtgcatagatgtgagaagtcatgtgacggggaatgaccttccacggtggacagcgctcgttttaaatcagtctgtactcagcaaataaaaatcaatattagttgtataaacacacaaaaattacattttgaattccaggatgtcacactacttctgtacctagcattttgagtccttatatttgcaatgttacacaaactgtactattttcttttatgtacagtttgcatgactaaaccatcagagaataaattctatctttaaattatgtttataatttgcttgtttttaatctgtcttttacaaaataatacctgataattttcttcctcacttcagagcatttaatttcctgagaagagcatgagattctttccatttctgtacactccactccttagaaagcccttaaccaccaacaggcattgcttctgttttctgtttactttaggttccattgacatacagtgagtgaccttttcattttatgtgtcctatctgggacaccactcagacgttaaccatgattaccctagaaaatatcttataactcatgt

SEQ ID NO: 26784 - DNA, 1311 bp, Mus musculus
tattcagacagcttatggagaaactcttacttgttctttttttttaagagttatttattatatgtaagtgcactgtagctgtcttcagacacaccagaagagggcatcagatctcattacagatggttgtgagccatcatgtggttgctgggaattgaactcaggacctccggaagagcagtcagtgctcttaaccactgagccatttcttcagcacccacttgtatgttcttaaagaatgaaagcaaaatagggcaaataacaaattagtacttattatgacagtggcttttactgcagacttcagtcagaaaggacatttgggacccatataaattctcgaacaactttatagaaattgatagtacagttttgttttttaaatactgcactctcaaaaaagccagatttttttagacacacactgttaagtaagacagtttcccttgccttgagcatgggaaacccagaggcccacctgtcacaagccacacctaagccatgactacatgtacaagtacatggtagacagatgggaaagacaagtggaacagattgaaaattatgaagaggccgccctctcgcctgtcacgttgaacgcacgttcgtgtggaacctggcgctaacccattcgtagacgacctgcttctgggtcggggtttcgtacgtagcagagcagctccctcgctgcgatctactgaaagtcagccctcgacacaagggtttgttaaaaaaaaaagaattatgagagaggtagaactagagggtggagaggaacagtctgatgtgagtagcctgtcctaccacctgaggccatggtgaagtcccagcccatgctgctgctgagggccatatttgggtctgtggccaggcagcatcaggggtctatgtcaatgtttgtggggtgagtaagctggccaggagggtataagagctagtcttgccacttggctggttgcactaaatgagctagctgggacagtgctgaagagctccccctggtgttatgcgtgcattggttgggggtggggtagcaggagaggtggtggactgaccaactcagctaccactcaggcccagattcagggttagcttactccaggcatctaccccatttatgagctgctagagaatgtgaaagggccagagctgcagatccaaacctagaggatctccacaacagagggcaacaacagaatatctgagaggagttcctgtgaagatccagtattgacagtatagcagaagccagaggcctcgaatcagatcaatgactcattgtggataaacaggtatagtgtatgacacact

SEQ ID NO: 26785 - DNA, 1223 bp, Mus musculus
agagaggacggaagcctgtgggagcccgtggcctttaaagtgcgattcagccctctcctccggggctagtttgtaaacacggccggcctccgggctcgcgggtggctggcaggaccatgaattagtgacctggaaaggtgagtaatggtggaagggccacgggcttggaggttgtagggatgcagaggaagaaggtgctaacatggcgacgtcgctgcctgtagtctccaccccccgcctcccaccccttttgcgcccctgctgtggaccccaaccctacggacggcggtggccgcgttgccgcctctggtctggcggagcgaccggaccgttaggtaacgcgctgcggctccggccggcccctccctcgcgcgctttcccaagcctgagcgagaaggaataacggctcttctccgacccctccctccgacttctcctctggtgtggtcacttgagaggtccccgaggcgcccttcggatccgcccatctgtcggggagacccccgccgctagtccttgatcgcgctgcccagagggcccacgctgggctccccaccggggactcgggcgatcgagggtttgggatggtgcgttgaaggattgggaagcaagggtctctggcctcggtggaacgtgatggagccaatggtaatggagaacctgctggtggtctcggccttttctgtcctttctgccgccctcacactcccgccgccgccacccccccctttccaggtggggcggggctgaggtgtgggtgcaggttgattctgctattcccccccacaccccatttacttcgaccggtgttctgcagagcttttgtaggaaaataatctgtgccttttattaccccagggacaaggaagagaggtagggagagatgtgtgtatgtctccccgggatgctcactcattgaaccagaccttggaggagatgggaactatttttatgcacataggtattataaaattgtctcttctttaatggagactcttaaactgggaaggtcgagtaaaactaccaccagtataattgagtaaaagggatactcatgatagactctaggcccatcgactaatacctagtttaccttgtggaagtcacagtttcttggggattataaactagggacacgttcacaccagatgcaggtaatgctgtttttaacatctgaccaaacacggactgttctgagctcagtttgtcctgtttgaagaaat

SEQ ID NO: 26786 - DNA, 1258 bp, Mus musculus
tgaagactcagtgggaaagtagacgtggaaagagggaaatgatgaaataatggtagcccttttgaatgaagtgtctgctgtgtcttgcattatattctgagctgtgtgtgcactggtcacttaaataagtgaggatagagctaggggctagggaacacgcctataactccaaccagtcaggagagtcaaggagatcacaaatgtcaggacccctcaaggtggtgtaaactgaggatttatatttgcatacgaagatagctccctgactttatgccacatgattaggagtgggtaaaatactctgagagacaaaagcaaagtggtataggagatagcacccccatgagacttgcaaagatccccatactagatatctgactctaccatttacccaatgtgctgacatcaacgttgcttcacagtaacagtcatctgtgttgtgtctcttttagaaacccttcactgaagcagcagctgttctcatatgctatcctgggatttgccttgtctgaagctatgggtctcttttgtttgatggttgcgttcttgatcttgtttgccatgtaacagaaattactgcctgaaatgttggcattcatagtaattacggatgtaattctgtgtatcttgctgtgactccgaagactgtagtactggtgtcatggaaatatatgttatttccacagtcatttcattaaagatgaaaactttaattcttgctgtgatttgtacttatataagtgtggatcatcataaagatgatctgttgaggtaggtggttgtccaagtcagaggaaggtacagcagttaccctggttttgaaaaagtgatgaatatgaaacattgaaaaacacttagtgaagtagaccaagcaaaagacccatagtgtgattttgtttgtataaaataggtaactttgtagagactaggccaattagaagttattgggaactctaggagcatggaactgtgggtgactgactgttagttgtggagtttcattttgggtgattggtgcttgaacaaggttataaatgcacaaaaccatctcattacatggttaccataaaccaggcatggtggcgcacgcctttaatcccagcacttgggaagcagaggcaggcggatttctgagttcgaggccagcctggtctacaaagtctacacagtgagttccaggacagccagggctacatagagaaaccctgtctcgaaaaccaaaaataagaaaaaaaagaaagaaaaccagtaggtgagt

SEQ ID NO: 26787 - DNA, 1099 bp, Mus musculus
gcttagtgtggtctgtttctttgccttcgtagctatgtatttacgcacctactgccatggcatagtgaagtcagtatttctttaaaaaacaaaacaaaacaaaaaacaaaaacccctacttattcaaacttgtgtgtcatttcaccaaataccatcagtattaaaaccagaatttaaaatatattccctctttccctctgactttaaagtattcattcccagtttcttcccccacatccccagtagaatattgcaatatagcccagcctggcttggctttgtgacttgaggcctcagattcctaggtgctggaatcattctatgagttgctgtgccttgctctcctctaaacattttacacttatattatttttctatttcttttgaattatattaatgataaatctgcattgttccaccaaacaaatgctacctgctgtatgtatgtgtgcttacacacaattttgtttttggggggaacagtcctgtggagattttgtatcttgagtatgggaaagaaacaggatgtagaaagactaagcagccttcctagaggtctctattggtgtgtggaaacgtctgagatctgactgtaagcagatcacttgtgatgccgttggcattgaagccacagcctcatacatgctaagccctgctctgagctgaactgtttcttccactcccaaggccttactgttaatcatcattgtattaccttctaattcctgcctctgtcacctcacgggatgaaagctaccttttaaactctgtctgcgatcatgctgctttcctatccattctgtgcagtgggtcctcagacctttgtggctgtcttcagtctttctgtgtttgagagaggacatctgaattactgtattgactgataaagtccggagcagttgtctttccagttggctctcacagcaacttttttgcattacaactactgtcgctgctccctcccctccactgcttacgtcctttcagtatacataggttattgttttcagtgctgcatatatgcaaagtttctcctagttgcctacatttctcaagctcttcctcctgaaatacctcgtttatgtaataaatagcttat

SEQ ID NO: 26788 - DNA, 1391 bp, Mus musculus
acagtcaagtgcagtatttctcttgatgtcttttattttacaactgggccaaaggcacataatgtatatagttaatgtttacatagtaataggaaatacatctgcacttgactgtacttgaattcttggtattatttatatttgtaatataatgatgatatataaatggtttttgtgtgtgtgtgtgtgttttgttaaggaaaataaagatgacctggcagcgtttttctttgttaaatatctagacttcctcacatagtatgttgatggatgacttggctatctgaaaaataccttggtagggaaaactcactgtatgaaaactatatagcaaattatgatgtttttcttttcatttagactttcaaaatcagtgacataagaggtttagtgtttctaatcagaagttaaattttttctgattttgaaacatattatggcataggtagtttttaactttgagagacaaataaatgcatttttaaagataagacagttaaatttaatgaaactcactagactgagtatgtataccaagtatcaggtgggaagatttttgatgtagactagttattcttaaacacaatatgattatttgttctagtttccttttatgtgtcttatgttgaaacaactgaagtgaatttacatcataggggagacatgttacgatagtgtttctggctaatcctttagctatcaaatgtttaaatatacttattatcatttaaaagtttatatttatgagtaatacctcatctgacatatataaaagaacccagtttgttaatattctgaggcattttagtgtagtgcctgtaattgaagcatgtggaactggacttgaatgtcagctttgcaatcgtgggcatttcacctaacctctctgcatttatttaagctgtaaaatgaaaagaataatatgttttccataggtactgggaagttaaaaataagttatatgatgtgcctagctttcttgctagataattaattaataggtattaggttacatggtagaatttattggtattattgaaacccttgtgaaatatggaaggaccgtagatcctttctttggtagataatgaaattaaagaaaactatgagcattcaatttatttgttctgaacagaaattttctgcattaatgtcatatgcacgtgtcaatgatagattaaagaaatggagaactgaaactagaatataatctttttataaaaagatgtgtttatttttattttatgagtataaatgtttgacttgcataaatgtctgtgtccaacatgtcttgacaggtatctgtagaggtcagatacctgggtcatttgaaatgatagttacagatggctgtgagctgccacgtgggtgctagggatcaaacttggctt

SEQ ID NO: 26789 - DNA, 1185 bp, Mus musculus
aaccctaacttcagctgcagggagttgcacatcttctggcctctttgagcatctccacacatacgtacatacagatgcacagactcatgcacataaatacaatagcatggaattaataaagcattctatagtactgttcttaatgctttgggggatttatagaccctttggaaattggcagaagcaatggtttctctagagaaatgaattcgatagttcctgaggaactccagggggcccctgggattcaggttgagaactcacctattggaatgtcagtgatcctctggtattcttaacaaaacagtcagggtttgatttttgatacatacagagaaatgtctaactctaattgaaactttatttttgcctgtagattctgatttatctcttgtaatgatggattttgttttgaactttgcttcctctctagcatctggacattaagaactgtacttattttcttcttttccaagagaacagagagaaatagtaagtttaaatattttttataaatctatattaaggaaacaaacaaactcatcttactgtgtgctattttgtaagccaattatgaaatggtttgagatagtgtggtgtgtcagattgtttgctgtacaacataacaaaggtcatgagtataagaaggttctgtctgtatgtgtcaattcttatttaggattttttttatacaaaacatttttaaataaaagcaaattgtatttgttaaattaatctttgtggacaacattggtacagagtaaaatattgtacatacatacttgttctttttattaatttaatttatgtacatgtgggttctacttgcatgtgtgttcctggtacctatggagtctaggtgaggtcagtggatcccctggatctgtaactagagtcacagatggttatgagtggctgtgtgggtgctgggaattaaacctgggtcctcttcaagagcagagagtgcttttaaccaccaagccatctctctagctttttcttttaactgtattactctcattaacgtcacagccctttagcttggttttagttgaaatatacaaatacaaaaatctgcttctatatatgttttatatatgtgcaagttgtaaagatttttttcaggtcttaaaaagtatcttgctgggtggtggtacctttaatcctggcactcaggaggcagag

SEQ ID NO: 26790 - DNA, 1164 bp, Mus musculus
aacaacataaacttcctaatgatcagcgctagatgattgaatataaaatgctttattaatcaaacaagtgcacttgaacattttaaatctttatggtgagtaaattaaaagaagtttattaataatgtttttaaaaattatgcctgcagaatatttactttattatttgattaaatgtattatttatatttttctttctgcttttgtaacgatggttcaggtgtcttctggctcacttccaggaggtttctttgagcatttttgtaaatgtttgtcagggaagagtctgggccaaatattggaaaagcacattagctgaagagtgcaatgtattgtccaggctgccgattccttaaacttgggagagtgttgtccagtgacaggagtttgaggataatgtcaaagtcgacatttagttgggcttctgtagtccatacaaattatggccattgaataatctagagaattaatacttgaaaactaattgcaatattttcactaactattcattctggcaagtggccttgctttctttttgaaccctgcttgtaatggcctggggtttctaggtctcgatgctctgtgtttctgctttgtcaagtaggtgccatattcattgtatccttcttgcactgctcctgtgctcccgtgttgtaagccagcttgctgtatgcatctcagatgtcggttggtacgtccaccctctgctgttcttcaggaaatccgtggcctcacagattggaaatgagccctgagtgtaaacagccgctccagagcatagctccttaataaagagatgtacctccataaagagcagagctctttcgtctcagagaacaccattctggccagtcacaaacatgtggctaaggctcacatgaagggggtgacttagtcaagccttctattttataaacaaacaggtgtggggtgtgggttatatacttcccaacctgtttggtggtggtggtggtggtggtggtggtggtggtggtggtggtggtggtggtggtggtggtggtattggtatggaggcctcctagagtgaactaactatccacacttgtttcattaaataattctggcatgatagtgtgacagctttgaacttcaaaaggattcaagtcaagtcctaggcctgatgacccagagtccaggttacac

SEQ ID NO: 26791 - DNA, 1157 bp, Mus musculus
ctgcccaacaccaagggcaggtcttcttcctcatcttcctgctcctcttcagctgccccgggccagcatttgcagccaatggccaaggaccaccatacggacctgacgaccttatagaagtggggaccctgggcctatcccttcttgcactccaggttgaggcgaagctgcgggtgcaggcggggcctgctgtcacctcactgggctctaaggtactgtgggggtggacctgggacctgcaggccgccctcggactaggttaccttcctgcccgagggcagccccctccctaaagtggggaagggtgggagggtgggcgggcttctttaagtagattatcatatggcaggagctactgagaacataaacccttggcgagtcattaaactcctgaaaatctctgctggtggattgaatttgcaaatgaaggttggaggctttaccccagtgggaaccgggatggtctcctccacaccacccccttcagggagctgtgtggcttagtaactgtgggggagttgaggcagaaggccagccagtgctaggtgctttcagtgcaagcaggagaggctgagccagaatcccagaactttctggattatctatagaatttcttctgtgatttaaaaaaaaaaaaaaaagaaagaaagaaattgtttgcttccagtggcccatgcccaaagaaataaatccaagaaggaaacgggttattttatgtttagtttatatttgcttaaatatttatttgttcggggaatggactgcagaaaataaccgacacctgcgtgccaaaaaccttaagatggtgaatagtcttaagcttcagggaactgggttagaaagctgtggactcctttctggccctattccggattttgagctcctccctcctaaactacccaccctggagatgtgtggaggaggcccttaagccttcaagagggaagctgaggagccaggagaagcgagtttttgaaaatatgtttccgaatgtgcttctatagcactgtgtttacaagcagttccgggtggatgaaagaagggggttggggaagaaacaaatggtctaatattttcttctggggaaagaaaaccaaacctgtatgccctgggccatcagataatgtctgaatttcctacttcaactagattccaaa

SEQ ID NO: 26792 - DNA, 1296 bp, Mus musculus
aagccaccatgactttgaaagaacaactaccactgtgtgacactttggctcccacttctctcaacacatgtccaacggctgctgggtttgatgtaagactgagccacaccctgttaaccatcctggattggagtcagaaacctgtgagcttcagagtgcatctctcactcctatctgaactagtttcagccatgactcttggaatccaatactatcataagcatttgttaaaatagaaaatgtgggtgacgcctcccaggcgctcggctgtgtcaagatgaagctgaacatctccttccccgccaccggctgtcagaagctcatcgaggtggatgacgagcgcaagctccgcaccttctatgagaagcgcatggccacggaagtagccgctgatgctcttggtgaagagtggaagggttatgtggtccggatcagcggtgggaatgacaagcaaggttttcccatgaagcaaggtgttctgacccatggcagagtgcgcctgctgttgagtaaggggcattcctgttacaggccaaggagaactggagagaggaagcgcaagtctgttcgtggatgcattgtggacgctaatctcagtgttctcaacttggtcattgtaaagaaaggagagaaggatattcctggactgacagacactactgtgcctcgtcggttgggacctaaaagggctagtagaatccgcaagctttttaatctctccaaagaagatgatgtccgccagtatgttgtcaggaagcccttaaacaaagaaggtaagaagcccaggaccaaagcacccaagattcagcgacttgttactcctcgtgtcctgcaacacaaacgccgacgtattgctctgaagaagcaacgcactaagaagaacaaggaggaggctgcagaatacgctaaacttttggccaagagaatgaaggaagccaaagaaaagcgccaggaacagattgccaagagacgtaggctgtcctcactgagagcttctacttctaagtctgagtccagtcaaaaatgagtctttaagagcaacaaataaataatgaccttgaatctttaaaaaaaaaaaaaaaaaaaaaaaaaaaaaaaagaaaatgtgtcaaatggcacaacaaatactttatatttctgagcatgaaaaatatataagagagtatgccaggttttttggctaaatttttgttactgagagttactgtcattttggaagagattaactacaattgagaagatagttctatcagactggtctataagcaagcctgttttgttggttaatgattgatg

SEQ ID NO: 26793 - DNA, 1119 bp, Mus musculus
tatttgtaggtaatgagagatccccaaacaaaacgttccagaggctttggttttgtgacctactcttgtgttgaagaggtggatgctgcaatgtgtgctcggccacacaaggttgatgggcgtgtggtggaaccgaagagagctgtttctagagaggtattttaataacatgttgtataatacttggatatgtttcagtttggtttttttgacttataattattttatttgtaggattctgtaaagcctggtgcccatttaacggtgaagaaaatttttgttggtggtattaaagaggatacggaagaatataacctgagagactactttgaaaagtatggcaagattgaaaccatagaggttatggaagacaggcagagtgggaaaaagagaggatttgcttttgtaacttttgatgatcatgacacagttgataaaattgttggtaagtaacaatttatttgagtttcgttttcataaatcatctaagtcagtggttctcaaccttccttatgctgtgactcttaatacagatactcatgttgtgaaccccaaccataaaattttcattgctacttcataactaattttgctactgttataaatccatgtatatctgataagcaggatgtctgtgactcaacctataggctgagaactattgatctagatcaggaaacatttctaaaatattgactcattctcttctcagtctaccatcttaataatattttaattaattgcatggtgataaagggttcactttaacatggttttccaaacaaaaaataacttttcttttgtttttgacttaaaaaaatatagttcagaaataccacactattaatgggcataattgtgaagtgaaaaaggccctttctaaacaagagatgcagtctgctggatcacagagaggtgagtaggctcagatacacataaacagtgggcatgaacagttgtgggaaagatgtgaacttttcactccaattcttgttacaggtcgtggaggtggatctggcaactttatgggtcgtggaggaaactttggaggtggtggaggaaactttggtcgtggaggaaactttggtggaagaggtaaggtgttctcattatatgtgc

SEQ ID NO: 26794 - DNA, 1119 bp, Mus musculus; identical to SEQ ID NO: 26793

SEQ ID NO: 26795 - DNA, 2189 bp, Mus musculus
attgtggtagtggtaccaggaataaaaaattaaggaatttttaacttttcaatatttgtgtagttcagtttttctacattttagtacagaaactttaacaaaatgcagtttcgaaggtgtttccttgtgagttaacacgtgaagaagatcattgttaattactattttgtatgaattttgctaaagttaactgtaaagaaacacctactgacttgcaatttaaggggaatctattctccccatttccaaaacaatgatgaatgggcgctgacatgtggagagaatagatatttgtatgtttgcaatgtgtgttttagataattagaattgggaaataaaaaaatagcatatttgtgaatttaatagcattaagattaccttcaaatgaaaaagatctcaaaagttgctgtttggtttttgtgcattttctttcaaagtgtaatcatgattttagtgtattagatttattgagtcctagccatgttaagaacatctccattccacatttaccttgatcccgttgaaactgctgccaatagttcggggtacaaagtgttcatactgctctttactcaccaaggctggtagatgtatgtcatctcccagtttaacattactttcccatacagacccacaaagtctgctgggtctgagcaaactggtgggtacctggtttgcttttgcttataaaggtctcaaggcccattggtctagtcattttccttggttaagtgtcccacacacacagcttttcagagcaaaggaataaaagtcactcattgaaacccctgactggctggcatgctttcctgtttatccattttgctagatgatgaaacaaaatgatagtaaggtgttgtccaaacaaagcagcagaagatgtagcacacacggttgctcagtgcaagcacctcacagccccaaatatctgaactcaaattcggaatgtcttaaatccccaaagaagaacacatggttattctttgtgtatatatatatatatctctcattttaaaacgtcgggtgtgacaatttgtttggagaccctgtttgagaggagtttcagataaaaggtcatatataaaaattgtctactgttgcgccagctagtgctgaacaatttcattcaaatcctgagtatgtgccctgctgttacttcctttggcagttgaccgttgaaatcagatttttacttggtttttaaagtataagctaaacaagcaataaaagggggaatggggcgtgctagtatttcaatttgctctcttgttgctctacttctgtgcctctgtgcattattaatatttggatgcatgcagtgctagcatggaactttggtcttcacaattactgcagtttttccagaaaacactcacaccaataaatgtaacagaacattccatttgttaatgggcatatgtgcataagcagtgtagaaaataggctcatgttagaaactggctacatccttcataactaaaagtgtggttatatgaatggacactgtcaatgttcatagcttaaacctgggtacctggtcaaaatgcttaggaaacattaaaattgagctaaattgtctcaagtccttttattcatataataaagattgaagggatgggggggaggctgacattttctggttttgtttgtgaaattgctggacacaaccttgacagtatcctttaatgtaatgaggtcaattgtattgttaaccatctttttatgtataatagtgaaaaatttacagtaagttggtgtttacaacctataatcaggtaaaatctgtatgtgacctgtttataagttgtactgagttagtttttgtgaactgtggaagagtaagccatgagagcgatttaaccagctttaaaggacataagttgtgctttttaagcacggtggatcaaaggaaaacccactaagacaggacttcagcagccatttgagtatggacaagtcagcataaataaagaatgagaaggcagcagcagcaagagcttcaacaacagagaagtggaggcataagatactatgatgctagtgagcaacttcccaaaagctagttaaagctgcttattgcaactgaaatgtcgaagaaagtagcaggaaggagcttcgccttttggaacatcaatgagctagttgccacaggcgctaggtctagcatttagacctgcaaggaagggcaa

SEQ ID NO: 26796 - DNA, 2189 bp, Mus musculus; identical to SEQ ID NO: 26795

SEQ ID NO: 26797 - DNA, 1616 bp, Mus musculus
gactgaaagctaatttagagttctgacaaagataaaatacttatctattgaaaaatgggagttgaaggaattattgaaaagaacaccttggatttgggggtagggaattgatctaaaatgcacttagcctctgctcatacaatgtgaccttctttcctagtgtcttaataccgaaaacaagcagctggctgatactaccgctgttcccagcccagaagccacactgacagaaatggacagcaattaccatttttactcatcgatctcctcgctggaaaaagaagtgggcaactgtggtccacatttccttcatggttttgaggattctttcagcagcatcctctccactgatgatgccagccagctgacctccttagactcaaatcccaccttaaacacagattttggcgatgaattttattctgctttcatagcagagcccagtgacggtggcagcatgccttcctccgctgccatcagtcagtcactctctgaactcctggacgggactattgaaggctgtgacctgtcactgtgtaaagctttcaacccgaagcacgctgaaggcacaatggaattcaatgactctgactctggcatttcactgaacacgagtcccagccgagcgtccccagagcactccgtggagtcttccatttacggagacccaccgcctgggttcagtgactcggaaatggaggagctagatagtgcccctggaagtgtcaaacagaacggccctaaagcacagccagcacattctcctggagacacagtacagcctctgtcaccagctcaagggcacagtgctcctatgcgtgaatcccaatgtgaaaatacaacaaaaaaagaagttcccgtgagtcctggtcatcaaaaagccccattcacaaaagacaaacattcaagccgcttagaggctcatctcacacgagatgagcttagggcaaaagctctccatattccattccctgtcgaaaaaatcattaacctccctgttgatgacttcaatgaaatgatgtccaaggagcaattcaatgaagctcagctcgcattgatccgagatatacgcaggagaggtaagaataaagtcgccgcccagaactgtaggaaaaggaagctggagaacattgtcgagctggagcaagacttgggccacttaaaagacgagagagaaaaactactcagagaaaagggagaaaacgacagaaacctccatctactgaaaaggcggctcagcaccttgtatcttgaagtcttcagcatgttacgtgatgaggatggaaagccttactctcccagtgaatactctctgcagcaaaccagagatggcaatgtgttccttgttcccaaaagcaagaagccagatacaaagaaaaactaggttcgggaggatggagccttttctgagctagtgtttgttttgtactgctaaaacttcctactgtgatgtgaaatgcagaaacactttataagtaactatgcagaattatagccaaagctagtatagcaataatatgaaactttacaaagcattaaagtctcaatgttgaatcagtttcattttaactctcaagttaatttcttaggcaccatttgggagagtttctgtttaa

SEQ ID NO: 26798 - DNA, 1181 bp, Mus musculus
ggatgggtgtgtgcgtctgacttgggccttgtacagtcagtgtgggttttgtggaggcaataagactgaagtagtagacaatccccaataccatttgcaggtctggaactgcactctcttttttaaaaaacatgtatacattttagggctgtagatttattttcctggttttatttttcattgctgacttttgagcacagaattatgataatcaattaaatttatacatcacctcattgatttttccaaactttttttttttaaacaacttttgggattttactccctggccttgactaggacaggattgtaccccacccctttttctttttcaccaagacaactgagcagaaatttggctgagcagtgttgtgggactatgatgtgatagttttaatcctaccttctgctttcgggcagctgcggccagcacagaaaccttgcaagctcactctgtatgtaagctttctggacaagggatggtcgccaaatttttagtttggatgtcttatacgaaagggaaatagtcttcattaaagttcgtatttcttttacctcggcctctcaaaaacaaacaaacaagcaaacaaacacccaaaagaaccaatgaaaatattggattctgtgactaaataatgtgtacatactcatttcacaaatatttatgaggtctacatccggacttgcatggcatgaagattgctttaatcttggagatagtggagcagttgttcttcaaggacatgagtttctgaaattgccctttctaattactctaaccctttggctcttggcactcctgaattacaggatgtgttttatatggtgattagtgtaatttcattaatgccgtctatccttcggggatgtagattcttaaggtgctttgcttttgtttaatagttgctcaggaaactcgaaaagggagtctcttacctacccttagtagcttgtgtgactggccattatagcattgtctacacacaaaatcagctgtgcttggcctcacagggcctgtgtttgcatgttctgttaggaactcatctgccagaatgctcagttccattgacaaaagtcaggggaacccagtcagacttggtcctttgctttcagaatgctttcatttcttctctgaaatggcatggagggagtgcctcttttggcccttctgaggtcaatgt

SEQ ID NO: 26799 - DNA, 1090 bp, Mus musculus
tttttttaagtgcggagatgccatgtatttattatatttaaatatattagcaggtttttttttctgccctattttctgattcttagatatgattgttaatagtcgtacaaatagatgtttcccatatactgttttctatgtggaatatcttatttattcctttagcaactctgttattacatattactactgtcaacattttacaaatgaggactcactaagactacttagttactagatagctaagcagtgacttttagtttaatgttagcacaaagatgagggtatgtttctatccagtgcatgcataatgtactgctcttgttcaatgtcacagcatagagtaagggggggttactttccttacttctcattactaccttgctactgaagctttgaatttggaacttagatattccccaagaaaatgttaatggctcaaaggaatgagacttcttttcctttgtaacagaaccggattctctgggttgatgagaacaatctgacagctcacgtagaggctgggataacaggacaagatttggaaagacaggtatgttatctctttaattaagcttttccaaacagtgattttctgtgtctgaaggaactgcctttccacaatacattgttcactcagtgaatttgctcagtttttattgtaggttgaattagaactgagagtacagtagtgaatgagacactatcccctaccctcaagggccttgtactgggatagaaagttggagaaatagacaatggatgattcaggctaagtaagactagatttagattgtttgtgtcatcaaaaggggccaggtaggaagaacttggacaattatgtatcatagaagtttgacatttaaaatgagacttcaataaaagggaacaaataagaacaaattatgtatgaaaatgccataatgaaattcattatttggcacaataactttaacaattaatgagataaaatgagactggcgaatgagtcagagttaggaaaaaggggctcagttctgagaaggagtgtgcaggagctttcagggtagcattacttttggaacccttaatctttctactctttctcagt

SEQ ID NO: 26800 - DNA, 1135 bp, Mus musculus
taacagtttgaactaaacacaaaatgctgctgtgtcatttggcttcacataggtgattcattgtgcttaaatgttctttagaaggtcttcctcccccacctcaaattattaaccttcttagccttcttttgtaatgtactatttagctttgatgtatgtgtctagatttaacaagatcttcacgtgtgtttaagtgatttctgaaaaaaatttactttaaaatattaagcataatttccattttcaaatttaaacaaaattttggtactaaaacacattgtagaaaatgtccttgataggatgcatgggaagtagtgtctgagttttctctcctggaaacacacatctacactcactacacccacacactcacagtggagggaggcaggaacaaaagctgggaagtacttttataaacatggacttttgaattaaccttcaataggttcttgagaaaattctcagtatattttattttctttgaacatgcctacatttcactttgttttataagatgtatgagttcttttcaggtgttggtgagtacgtaggctgtagcagatccttttgaactcactctttagatattaaatatttaacatcttgttctccttatacctcgtttcccatttggaaagcttccgtcttttctgcactatcttactccactgtggtctttgacttttagagtactggtcatcagattccaagaattgtcttcagactgaccagtttctaggatcactgtcactctccccccaaaagtacagactttttaaaacaaaacaaaacaaagaaaatcagacagtctatatgattctgtctgtccttaaacctgccatgcagcccgaacagagaatttgtgatctttttgcttcagcttctggtattaggattacatgcatgtaccaccacacccctgtgtttttgtttttgcttcttaacaaatttgtaaaggtacttttttcacaaggggactacatcttaaaaaaataaaaagaattgttagctggtcactattgagccctcaggagcaatagtttggctggcagggctatcgttgatgacttcagtctgccatgtctttccttgtcttagtatggattgctaggtagactgccataaactagcaggc

SEQ ID NO: 26801 - DNA, 3763 bp, Mus musculus
ctgtatttcagctacatttgtttgttggtttaaaatgagttggtttttgttctgtgctttgtttctacatctatagattgacagatggcgctcctgggcctcattgtaggtgtaccagtttatagccaactaactggttgtcgtttcagattttagtcaggcagcacaaggctgcccattatctgaggaatatgctgccagctgttttacatgctcctcctctcggtgagctgaggcagagggtgtcatccgttgctcggctagcctctcttctgtcctgtcctttcttaaacatttctctaaagcagataatctagcaaagattctgctggtgagagatatttgtgtatgttgttaaagcatactttcctgtgagtaggtcattggggaggacactcaagacagagctggtagtctgttactagcatgccttcatctgtataaggtgctcagcctaagctttgcttgaagtgcatacatgttacaaacttaaattgccaacatataaattactctgtcagcagacacacttttgtcctccgtgtctgttcctaggagggtgtgagctgtatttgtatcactgaggtgtcaactatagctgtgtcctggatcgttcatagcgtgctttgtaagaacagctgacttaattcacgtgaagggcaggttgtaccatgaagtgaaggccattgtccatcctccagcctcaggtttcttctgccccatgcctggtaagctgcacacgcagtgcagcatgagcaaaggaaagtcttctgagcctgctgtctccgctgtagagaattatttggctaaagaaatagtcattagttgactcaaagtctcaataatttcaatgacaacgatctttttttttaattagccacaaatagcctgataaattttcatggaaaaacattttcagtttaattcttaataatggtttaatgcttttttgaattactggtttaacctaaattaaaagaaaatgtattactgcatatgccataatcacaagtttgaaatatcctatttcttaaataaaaaggagaacgttaattacatttagcagacatttttacattcaaaactggatattgaaatacgtggaacaattgctttaaatcactgtctgttgaggttcctgattcatgttttgaaatgggttcttttcttaatgcaatacctaacttttgataattttttaaaattaatatttaatcagataatgtaagtcaaaatgcagacgatcctttaaaaggacacactgtctgtctatgtagcaacagctccagatacgttggggcagtttgataccttttatatcttaagtagccttaaacagaacagcgaaaatttaaaattgacaaaatatttttaagacttcaaaatagtaaataatttttaactattataattggcctcaaactaacaaatttaaatctgtaggaaaatcaatattaaatattaggttaacaacaaaaactcaatatttattttttggaagctgcctttttattgatgatttatttttaattataaaatttacatcagatctttgattaaagactttgatggtttgaaatagccggacactcaaggaaattgcttctagaattataagattctttataaaatgcatcttcatgaaggtgattctctaattggtaattgaaatgtagcatttagtaagattccaacatctcactgcaagtgtctacatgtttccaagtagttattttaataatttcattagtaggtccagttccttgcatgtgattgttaaaacgtttttctcaaggagttcagcttttcacagcctcagcgatctgtactgtaattgtaacacctgagttgctgggttggttcttatgagctttatggcagttggcagtttatgtctttgcttcccttttctgtgtatggaggcctcagcaacctcgattctataatggttactacattttgtattttaagtaatttctacagggatcattttggaacacatgaatgttcattagtagtagttcttactgcaaatcaggaagccttcccagccacttctgggaggtgctgcgttgtagactgtgtctgcggaggaacatgagttcatgaatatgcacaaagcacttaaaccttgtctcttctttcagaagtgtctgcacatggcttcatgaagctaagcccaggaaaatactgttctctgaagcatcttaactcaaagagtagtgtttttcctgttgggtatcagaggcctagaacactgacttgtccttcccaagttagtcatatgtgtaatagtttgcttaaatcacatgcaggttgggctttcagtgggaatgggaacttgctgctagtgagaaatggagtcagatactaaagactcaccaaacaggctgtattgaccttggagaaactgctgcatccatgtgtggtggtgcataagtgaattgagtcttaatgctatggtccttgagcatctccgttagctgaattgtggagaccacatgtttcttgtgtccaacattttattacagaataaaggattaacctatggtctttttagaaatggtaggttgttactcaaaatgcttacgtataataggattattgacctgaggttatttatgaatctggaagctttctggtatgcatatttgtgttgttggtgtattttgggaaacaaaagctcaataaaatataagcttccattggtgtgtatattatatcagatataaacacatgtaggaaccctcctttccccctccagaacactgtaacagtcctagatgacgtatttgaaaaagcctttctgcatgttaatcccagagatattttttgtcatactctttcataccaacagcttctaagtgtaactgatcagagaaactctgacatgctaacctgaagtgtgttgctccaaatggggccagctttggtagcactgtcagaacaaagagatgcagagggactgcctcacaccatgcagtcacaacactgaaggcggcctcagatgctgtctgtggaaggtgtatctccagtctgaggagcttgagtcaacagttttagtaattttgagggttccccccccccccatcacttaatccttagtgatttttgattttgacagaggctcagcttttaacaggagaaaaggagggagcacagccggtgcaggttaggactgaagagctccgagttctctgcctttggcattgtcagttctggaggcttggcttggcttggctcagggctctatgctccattatgagccatctgcctacagattcatttaattcttaccagtttctctttactaaaaaaagaaaatcctgaaagtataaaaggtttccttaaactgttgaagtgtgtgtctgacatgaaggatgtaaccaacctttctgttccttaagccaaatagtgttcatcttcagtgtgaaacttaactgtacaaactgcttgtataatgtcaagagattatagaaacattattaataaaatgaacatgagcctatgattttttaaatcaaaggaagtgtggagctgttttttcttctgtatgcatatgttttcaactttacttttttaacctgtatttccagatttgaaagtagaaagtaatttttataagtctgctaatgtagcattgtctagataacccaactatgactaaatccctttggctttacagctgaacatatcataagctaagttgtatcagtctctggttatttttaaaccaagactaaactcctaggtggtgttgagt

SEQ ID NO: 26802 - DNA, 1195 bp, Mus musculus
tttgcttagaataagcattttattaatgtgatttgactgtagccaccaaatattcttggaccattcaagagttgctgcactacgtaagactttgtacacactgtaagtgtacagggacaacagtttaggtctttgtgtggctaaaaggcgaagaaacaaaaccaggccagggagagttaaagagtcggaggacccgcagcctctgcgagagttgggagtcctgcgggatctcacagccaatcagcagcgaggatggagcccgccatcagctggtgctgggtcctgcctttaagaggagtccttgggcacagcagttgcaccttacatcttggcctccctgcatcagtggaccaagggtggcccagggcacggctgctgtgattgtggtaggtgctggcctattggaagagagccggctgggcagattgggcctgggagccctgattgtgggcagatgcaacgagggcctgggtggaccgagagaggagcgttcaacggtccccagcccccggggccaaggcttcagttgtgaacaacaaaggctgtgttattgataggaccctctgtagcgcctcgggtcctggggtggtgaggatagcttggtaaaacttccacagatgttggccggaggttggcatcgaggtggagggctgagcatttaggaagctggattcttgttccaattggtgggtattatatagccactgccaggggagaaggatggacggtagacagctctgaaggactcgcagacccaatgaggagatcctctcagtcgcgttacctcgccccacccacacaaccgcgtggaaaagtttgtgttttcttatgcatctgtttagtccttcttaaaacagtctagcgagcttcccctacctccttcatcatttgaattatttggactttgtgaaatgtaagcgctttgctggtgccttggtggttctcacattgacttactgttcatgaaaagttagacgcgctccacagtatatagcagtatcaacacctatttcaggcctgaaaagtgacagagagctaacctagactgcgtgaggcccgaggtgtgagccttggcaccactaaaaaaaaaaaaaaaaaaaaagcaaaaataagcagaaatcccaagcaaacaacaacatgggatgtcactaaatctttattatcttatcatttaattattatttaaaataatctt

SEQ ID NO: 26803 - DNA, 1161 bp, Mus musculus
caggagctagagactcagggctggagaaagaaccatcactgactcttgtgagattctctactgcggagtagaaataatgttacatactaaatagagcaggtgtcaggcataattagtgaagtcatccattcattcaattgaccttattttttttccaaagatttttatttaactctattttatagatatgagtgttttgcctaaatgtaccatctgtgtcccatgtgtctgcagtatccgtgcaggtcagaggaaggcattggattcccaggaactgaagttacagatggttgtgagctgccacgtgtgtactgggagttgaacctgggtcctctggaagagcaatcagtgctcttaaccactgagccatctctccagcactcagcaacacagggtctcactacccagcacaggtgggcttttaactaaatcttctttgtcttggcttcccaaatgctgggattccagatgtataccaccacacttggaaactaaatattttgacttttaattatgtgttgaatactgtgttccacacaagagataaagtatcaaacaaatggccactctttcctctatcatgaagttaacagtttagcctcatgtagttaatgattatatagagctcatagtttagggctatgaaatgcatgtgtacaaggacacaggagacattagttttccaatttcctttgactatagtgcccaaagccaacttctgtattgtctaactagtagtctctaagcgtcaggaattacagatgttacaatgattttgacacaggggttacaatcgttttttcctggcatcacactctgtggaaggaatgttctgtttaccttcagcttagaaagtacagggagtaacttgcactaaggttccacttttccttgtcttagaaggaagaccagtcaggtgaaaacaatgtcatcattttattgacgtgaggaagtgcaaagatcacgagtaagacaacttgcgcaccagcgccatctagtgggaaaccgttttcttaaactgcagtgcctgtaaaataagaatattgattctcatcctgcacgtttagagcttatagtatttccttcaagagaagcactgggaaactataggaaaggcatttatatctgtatcacccaaacatgaaacatcgtatactcgag

SEQ ID NO: 26804 - DNA, 1147 bp, Mus musculus
tgagagaactcaggttttggctaggttccttgttagagactgggacagccaaattcctgattaaaggaaagaaaagctttgtaaatgtgaactaaaaagccttatatttatggctttagtggaacctttcagacgtcatcttatacaaatgatgagaaaggaaaagcttaagggtgaagggggaaaaagatggcgcagaagtccctccccaccagctgctactgagagccaagctttaaagtagggcagctttgccttcatagtgatgcaggttcacctggcttcccaattaaaggaactacatggttttcagcatggctagccatcagcgcttttaccattattgaattttgatacatattcagggcagagatcaaaaagggtcaaattacttgaaaatggtgcggtggttaggatagaaatagctataacttggatgtttataccatgacttttgtttttgttgcacatcctctattaaccatggattgcatagtgagattttctacctttggggtgcattaaataattttattagtcaagagtggaaccctgaacctatagttgtagttcttcagagactgaggcaggagaatcatagaaactgcagagcctggaagacacagtgagaccctgtatcaatatgtgaatgatctttttttaaaggttcaacacgatagtatgatagactcccacattttacatgtcatgacaggagggatttcttcggtgtggttggtgcactgttcatttagcttttataggacgcacctcctgcctgctgggtgctcttgtctctgaggaataagcctaggattcagtgagccccacccgagagatctaagagccagtgttgaaagtagttgagctcccttttaaggtgagtcttgtttttatatttctctttctgttagcggaatatagacattttactatttcagagcatctggttttaagttaatttacagacttttctctctcacaatgcagtcagtatctgccagcatcagctctctaagtaagtctggtcttgtttacttggaggcatttatgctgaaccaggtcagactggccacgccacggaaggttacagagctcccgacagtgagggatgctaactacatcggctgcacgtgatgattttcat

SEQ ID NO: 26805 - DNA, 1266 bp, Mus musculus
caccccactccctgtctgttttgtttgtataagcattgacgagtgattgaggtagtgtgctgtggatacttcaagaccaatgaaaacgaatggttttctaaaggatttgctttacaggtacccagcactaactgtcatgtttgcatgcgtcattacagaggagctgagtgccaacggacagtatcagtgtctcgcagagctgtccaccagtcctatcaccgtgtgtcacggctcaggcatctcctgtggcaatgcacagagtgacgctgctcacaatgctctgcagtatttaaagataatagcagaaagaaagtaggcttggagcgacttaggaaatctttctgcggcgcaaagaagtttccctcgcccttctttccaagcaaaatgtttactgtaatgtatgtctgtgtgtcctttccaaatctcttcagattccgtcaactttccagatttaaatgtctcctggtaggttattaagctctttttaatggcttcaactttgtattggtatatcgtgtttataaactttgtaccacaaggctgagtgtggttttcattttacagggtcagacgcataggttgaacatgcatgtttgactgtaacggtaaagagataaaacagccttactggtgctgaaactcttttgtgcaaagctttgtggagtggattctgaagagcccctttagactagagtgttgaggcttgtgatgaatgtcattgctaaatttcagggaacgtggttggtttgctatgtatttgaaaccatggaataaagagctgttcttataatgggagctctgctcattttattacacagctactcacttgatcttagctttattctttgtaggcaaactttcctatgaacgtgttcatttgtattgtctacatgcctctagcttactgaggaaagtcaaaggtaaaaacctgtggcctaaaagaaatatgcaaatgtatgtattgatttttctctaggcctatgcaacataggcctttgacataaccattcgtagatgaattagtagttttaaaatgtgttaacaaaatgcaaacaatacccttccagttcactcagttcttttataggactatttcaaaaacatgatttgattcaaaggtcagagaaaaaggctagagagatggcccaatggataaaggtgcttgcaaccagtactgaccacttaagttgaatccctgaacccacgtggtggaaggagagaaatgactcccacaaggtgttctctgacttccacagatgtgctgtg

SEQ ID NO: 26806 - DNA, 1201 bp, Mus musculus
gaaacactaagctataatcaggcctacaggcctacacagggactttctcactcctccatcccaattatttgcatagcttcggcatgcagcattgtaagggaagacttgtctactctgccagcctgtgttaaacgtgccagttggagatggcagtagctgagtctcgctcgtgtcatagcagcaatgacgcttcagttatttatttaggtggttgtcaatgtggagcgcagcttcttcagaagtaggcattgattccccaagtagctagtcatttcaaactcccttgacaaaactcttctctctcccctgtttataaccccccccccacacacacacagatacattaaaacccgatttatacaggattttttttttaatgcaagatacatcaaaatcttagagaattatataagcagatgatgggacacattttcttgcctggctatctggaggaaaatgcatttatagtctgttacaatactagtaggctaacattcctggctaatggttatttttttaagtggttttaatagtaatgtactttatacattcatacaaacgtacacacacacacacacacacacacacacacatttaagaacttcaatcatgcatctatatcactcctatccatctcccctcctccttgtccgacccatctcctcatcccaaaatatgatttcttctttaattactattgctacatgtactttccctgggactatttttagatttatctttatgcttatgagtgttttgcctgcatgtatatatgtgtactatatgtatgcctagtgcccacagaggacagaaggatgctaaatgcattctttaatcccctgaaattggtgttatggatgattgttagccatcctgaccctgtggggacttggaaccaaaccaggttctctgtaagagcggagagtgttcttaaccaccgagccacctttccagcccttagtgtgtacattttaaatatttttattaagcaactcttatgtacaatgcactacaaagcttatctaagtcactaatacatcggccctacaaccaagtagtagtcagtgcgattcagaagaagctaggtgaggaatggacaggtttgtgcaacattgaataatttatggccaagtgactttttaaagatccagactaaattttttttttaatatagggtcttgtgtagctcaggctagcctca

SEQ ID NO: 26807 - DNA, 1374 bp, Mus musculus
atcgcttggttaaattcatccaagcaggtagatggcatgtagtgtgccagccctcctcctgacaatgtacaaaacaaatctttgcctctggaaattacataatttatcttaggaatgctaacgtttctccttatgattggcagtggtagaaaagtgagtttctctctcaaacaaacagaaggttatcaggaaactggtgggattttgtttgtctgaaaagacctgagatgctctttctcgggatcagccgtactcgctgaacttgtcaatcactttccacaggacctcttcactgttcaggaaacacacttaatggagatttggcatcagcaaccattccggaagaaagcagactcatggccaagacacaatctgaagaacctcttctgcccttctcctgaggaaacagacatgcccagcttcctcctgaggaaacagacatgcccagcttcctcctgaggaaacagacatgcccagcttcctcctgaggaaacagacatgcccagcttcctctgagtgtcgctatgcaaaagctgctgtaattaaactcggtctgggctagctttgccctctccttaggatttctctgcactttatagaatattgtaaacaaacaacccacatacttttgaagtgtattttatctttctatagtttacttgcaagagtattttcctaataacttcacagtatgaatgtgcatctttttttttttttaaacaaatgatggtgtaacattttgacatccataaggacaaatgtagatatttttctaaaaaactgtgagggactgacagcttggtcagtgtgtattgtagtatataaacatgaaatctcgccagatttatttgacagaaatgtgagagatgtaacttgtgccatggaccaaaaggtcacttcaccccagcttaaaattaattaccatagcagcttgatggtgattatatcatattcctttaagcaaaaaggaaacgcttaatattctaaaggtctttagcccaaataccatgacatattgagcatttttttttaaaaagcagactccgctgtccttcatatgtgaagttgacatctactgatttgtcaataccaaacatcagattacagtatttaatttttatttatttattttcttattgcatcagaagatggttatgtcctaacttttatggcctccccaatttaagatgtatatgcatagttgttattacgttgttctaagatacatgaggcaagtgtcccagtgatcttgttcccttacacgagagaagtaaacagctttcaatgggaatggagttcagtgcttttcagaaaataggcagcaagctgctgttgtaaggtatgatttgcagctctttggcatatctagagaca

SEQ ID NO: 26808 - DNA, 1522 bp, Mus musculus
cgataacattcactgtaaaggtgctggactctccaggaccacctggtcccattaccttcaaagatgtgacccggggatctgctacactgatgtgggacgcccctctccttgatggtggtgcccggatccatcactatgtgatagagaagcgggaagcgagtcgccgtagctggcaggttgtcagtgaaaaatgcactcgccagatcctcaaggtgagtgagctgacagaaggtgttccgtactatttccgtgtttctgctgaaaatgagtacggtgttggtgaaccctatgaaatgccagaaccaattgtagccacagaacagcccgctccacctaggaggcttgatgtcgttgacactagcaaatcctctgcggtcctagcctggcttaaacccgatcatgatggaggtagtcggatcactagctacctgcttgaaatgcgacaaaagggatctgacttctgggttgaagctggtcacaccaaacagctgactttcacagtggagcgcctcgttgagaatactgaatatgaattccgggtgaaagccaagaacgacgctggctacagtgaacccagggaagccttctcatctgtcattatcaaggagcctcaaattgagcccactgctgatctcactggaatcaccaatcagctcatcacttgcaaagcaggaagcacatttaccattgacgtgccaatcagtggtcgtcctgcccccaaagtaacatggaagctagaagaaatgagactcaaggagacagatcgaatgagtatcgcaacaacaaaagacaggaccaccctgactgtaaaggacagtatgagaggtgactctggcagatacttcctgaccctagaaaacacagccggtgttaaaacatttactatcacagttgtggtcattggaagaccagggccagtaactggtcccattgaggtctcatctgtctcggctgaatcatgtgtcctatcatggactgaaccaaaagacgatggaggcactgaaattacaaattatatagttgaaaagcgcgagtcgggtaccaccgcctggcagcttatcaattctagtgtgaagcgcacgcagattaaagtcacacacctcacaaaatacaaagaatactgtttccgggtcagctcagagaatagattcggggtcagcaagcctctggaatcagtgccaatagttgctgaacatccatttggtaaggaaaatgagtaccaaacttcaaagtctgttttaaaatttttaaatttctactgaattctataaaaccatatctttatatttcccttctatatttagttccaccaagtgctcctaccaggcctgaggtctactatgtgtctgccaatgctatgtcaattcgttgggaagaaccctaccatgatggcggtagtaaaatcgttggctactgggttgagaagaaagaacgtaacaccattctttgggtgaaagaaaacaaagtgccgtgcttagagtgtaactacaaagtgacaggcttggtagaaggactggagtat

SEQ ID NO: 26809 - DNA, 1193 bp, Mus musculus
gtaactcggttcctgttgatgtgaacagatgccttttctggcaaaagaagtttcaggggaaaggaaagggtaaggggtcccccttgctctttcatccacacagacccaatttccccatgcctccatcaatggttcctagccatgacacatattctacccttgtccttcacttcctgccccacgattaagatttgcattcatgggttgtgctggctgtctaatgctgagcatagtggtcttccacccatcactcacttgttctaaggaagacacaaggaaaatgacaattccacgtctgtctctatctttctgagtccactgggaaaggggtaaggggaaaggtagctaactaacaactttcttgaattcttagtttatgccccatctgtgtaatctacgcccaccaggtatggagaatcattagctcacgggttaaagaatgggtaatggagctttaatgatggtcttcactggagatcccacccttcctgcaggtcacaggcaggtgcaagagggagcatgctggaaagagagtgagaggtcaggagaagctgctaggatccggttcaagaggagggaccatggagaaggtgctggcatggcttttactatagcagtgtgctacaacgctgcatgctctccactcttcttctggtccgcattctggtgaaaccacagtgtattctgccctctacacaggggtgcagcctcttctgcttccctatgctacagtttacacttctgtgagctctgtttagttttgattcgagaatcatccagcgtgtcttggttctcccggggctatgaaagattcatggccattttcaaaaaagatctttttctaaattttcttagttctttccttccctttcatcttcttccttctctttttccgttgctttgcccaaacatctctcccttcggagatggcgcagctctgcaactacagagagagcatcggtgaagcaggctgcatgtgttcccagccccgcctctctgggtttccatgtccctgaagagctgtggcatttaagaagcttggtccccctgcctaaggccttccagaacttctatttacagggacagcctcatgatgaacttgcgctcagagccagcagagatgacatatgacccttccagtcatagtagggacgccccaggattgtctgtaccccttcaggaatgagcaagcc

SEQ ID NO: 26810 - DNA, 1194 bp, Mus musculus
actcaagtgaacttttactgggtctagggcactaactaaatatgtctgtattatctggcttcccattctataaactgctcacactaagtggagggcagagtcctacataatctgcgtgcagcttctctgtggcaaagcagttttcaccaatgattaaaagagatgattgaaattaattttaactcttgtttgagttcctgttgccattcctattccagacaagcttcagaaagagatggaaaaatccacaagatgagagttaataggagatcaaggacttcttagaccattgtttcagatttaacaatcttgagtaaagagtctgacatagagatatgtaaactataccatggccataagctctccgtaatgttctactggaaaacaacaaataaccttcaggggttcctctttggaagattctcttggaataatgtctttaaaaatcagttatagaaactgggtgaatgagagatgtgaagttcgtgtgcctgtggtcccctgtaagtataaccacagcagagttcttcagaattgtaagagaggttatgatgggatgtggtggctattataggataatgtctgacttacaagcttaactgtcagatgggggtcatctcaaacactgctgtgtctgggaacaatacacctgagtgacagtggccagtgtccattagcttttcttacaatggtactttgcaaaggggcaggcccaccaggccctctcgccattccataccacttagaactgcatttcctgcaagctgttgtgataatcaaaatatgatacatcctcttagtcaacttgtttcataaaatattaagtatcaccaagttcaaaggcaatactttaaggaaagcaaaacaggaagtctagtgccgtgggaggcttctttgtgtttctcatgaatactttgtctttattgttttgttctaaaccaaatctaaaggaggacattttaccaggctctttatgaattatgataacctctactgagccttggtgtaaaaacatactacctgtatgtaaatacatgtcccaccatggggacatagtaatagaatatttaactatactttgcctcacctaaaatttatgtttaagattatctctccaagtaactttccatccacatttacttaagaaaaattttaacaaatgaaattgatcatattggtcaccatttgtgtgtt

SEQ ID NO: 26811 - DNA, 1722 bp, Mus musculus
caaatgacaagccctgttcttcctttctattgtgagttagattgttctatttcagaacttattttaattcatatcacacatcaaggcttctttactgccatggtatttgggaggtttatttgtggacttggtgtattattaattcatccttatgttattactaagtggtgtccccatgattggatattgccacttgttttctcagtttcctattggctaactgggctgtttgcaggactgtcaactatgaacaaagctgcagtggtcattattaggagcatacatatgaatatagttattcacgtgctcgtgagtaaatacttagaattgctggctcgcaaggtggtttttaaaaggaaactatcactctttttcccagtgtggttgttctgtgccctgatttttatattttgggtgtgtaaaaagttgtaaacaattttttctgattctcatgttgaaatagtaagagaagttgggggtagaaattatatcgctcacatttgaatgtggtagttggtatttgaggggagggatgctgtctgtcacaaaacagctcccccaagcggttccccagacataaaattttagaattcgccctaccctgtgagaggttaggctctaagcatgctaatttatagctagaaggaacagcacaagcctgattatgttgcatttaccacccactttcagtaagtaaagtaagacacatcactgagtagcaaagaacactttatgatggaagtggagagggcagaaagaaaacccaaagcatacgcaggagtcagttcctggtaccgtagagtgagaaagacacctgtgcagggaagggcccactgtggtcaggaaagcagacaacaggatgggaagaactctacctcacagtttacatagcagatagttatgttttgtagacattttagcctttaaatgtcacagtcttcatcttttcagcccacctttgttagtttcatacttgggtgaattttttctactgtgtattatcctcatcttctgttctattaaacaatatccacctgtgaaattacggtcatatgtttccaatacccatgttcagataccagtgtgtgatttacctttcctatgggatttctaagggctgggaaatttggcttctactgtatatccttataatgtgcccacattgtaaatatgcaataaaaccataaaaaatacaagggcagcagattttcatatgtatttctttgccatgttgttttttgacaagtttgatttctgtaaataaagattattcataaaatctagggggaatttactcattactggtctctacagtgtgatctgatggattttacatctttaaccatattttaattatttttaaagtattttttgaccagtattttctaaacaacttttattaaaagaacagaaaatgtagcttctttagaagacagaggtttctctctcaactctaacaacccaaccatctttgctgagtggcatggagattcaatgctctagctatcctagtaaagacttgatgctgtatccataacgttgattcaaatccctgaaggtaggagctcttgcctgtgctctgtgttcacaataaagagagagactgtgcagctcagtatcaaccttttatatttctgtctgccttatctttagagtattctcagacttatccagccctaccagttacacacacacaacacacacacagagttacatccatga

SEQ ID NO: 26812 - DNA, 1224 bp, Mus musculus
tatcctttaagtgggaggcaggggatgggaatgccaagtatactaacagggctgtcagagtatatgtctgtccttcgtaagatcagtgtgctgacctgggctttggtaaagtgtcaccagtctctcctgaggaacaccgacagggacagtagcaccctttgaagatgtgactgtgcatcattatttccgttgttctgtagaggtcacttcacttcataggagaggtctccttcacgaagtcttccctgtggactgggtttccaaactcttgtgatggctccaaaagccaaagctggatttgaaacacttcagggtgactcggtaggcctcctgctgaacaacatctagcctgtgtctcagccccagccttggttccctgctttacagttttaatagtttatatattttatgtccttaatccatttcagagtggcatgtggtataaatacatgaactccatggatgtgaaggcatgaggacatgaaggcagacagactcataggtcgggccagagatggtgacaaggctttgctccacaggtcagtgtggaggtggagctctgagctgggcttattgtcatgggtgggaatccagacagcatgagcgttggtgcttgctgtccttggtgtagatgagatacatggcatgctaaaaacacaataggtgggtggcttttaagtttagattttttaagggagagaggccagtttgaagaagaagctgacaatgtgctggattggcaagcagttaggatccaaggacatttaaggagaagtgatgttggtgggaagagtctcaacacagtagaggggacagggcttccttcactctctggatttggatttcttggctttcccagtccctacattacattcacagtttatgtcagtccaagtccttttcattatacaagttagctttgctttgcataggtaatgcatgcctcgacttcagtttatttgaggcaagaagattcctgaagacttaccttcattcttgttccttgagcactgtcctgtgtgaagctgcctgtctttagaatgttcatgtgcccgcccttccagcaatatctggtttttgcatgtgtgctttcttacccttttcacattaaagatacctcagaccctattgccacactgtcttccagggcagcgctcacactgtctgaaccttggcttatttttcctcgtaccagaactcgaagagctttgttctcctccccct

SEQ ID NO: 26813 - DNA, 1157 bp, Mus musculus
aggggctccattgtctcaaaattgctggcttctatgatgtgcaaagctggtctgactcatctcatcactatggatttacaccagaaggaaatccagggcttcttcaatattccagtagataatttaagagcctccccattcctgttacaatatattcaagaagagatcccagattataggaatgcagtcatcgtggccaagtctccagcctcagccaagagggcacaatcttttgcagagcgtctacatctgggaatcgcagtgatccatggagaagcacaggatgctgagtctgacttggtggatggccggcactccccaccaatggtcaggagtgtagctgccatccaccccagcctggagatccctatgctgattcctaaagagaagcccctaatcacagttgttggtgatgttggaggaagaatcgccatcattgtggatgacattattgatgatgtggatagctttcttgctgcagcagagaccctgaaggaaagaggtgcatacaagatctttgtgatggccactcacagcttgttatcctctgatgctccccggctgattgaagagtctgccattgatgaggtggtggtcactaacacgatcccacacgagatccagaagctgcagtgccccaatatcaagactgtggacatcagcatgatcctatcagaagccatccgccgaattcacagcggggagtccatgtcctaccttttcagaaacataggcttagatgactgaacagttctcctatggtagaactcccacaggccaagtgggagcccagcgtgtacgctgggagggcccatgcccggacagacacacgtgaccctccctttcccacatcttcctcattcattcctgtgaaggtacaaggaccagctttttaatgttggtttaggtttttgtgagttttaggggtaatttttataacagaaagacctcctctgaaatgaaagaagttaaaacctgatcgtttttagtgtaaccattttaaataatacacttgtgagatttttaagctcagcctttttttaaagttgcttgatccaactgttcaaaagaattaaataaaatgatctgctgtctactacctagaatcaaaaagctactgttggttccaatacgtgacctttttaggaacgctttta

SEQ ID NO: 26814 - DNA, 1846 bp, Mus musculus
tccaggactgtcacaaaacttccatttcaccttcccgattgctcgttatcactacgattggcttctaatccattctgctcctgtcacatgttattccagtatctcatttctccactttggttccatgtaatgtgtgtactttatcaggctcatctccctcctcaggaagatgcactagtcacaccagcatcatgaaacttgtagtgatgcctgtgtccttaccacagtgacaacagaggctgtctctgatgtgtctaacaaacttagtcagtcttccaataatttacccttttctgtgaaacactcgctgcctccttcctacgcttttccagtgcttctacacagtttagatgtgcatacatatgtacataaaaagaaaagctatggaaggcctttacatttttctgtgcatgcccacactacatacttgtgtgcatataaccatgtacatatgttatttgccatctctatcttagtgtgtaaaaagtttccaaatctgttgtgtaattacagaaatcaactttaagggccagtgagatgtctccgtgattaaaggacaccaagtctgaaataagctgagtccctgacagccacaggtggaagggaagaaccacctcccacatgtcctcttacctgcgcgcgcgcacacacacacacacacacacacacacacgcacacacgcacacacgcacacacacgcgcgcacacacacgcacacacacacacgcacacacgcacacacacacacacacacacacactgcaaaggcattttttttaaagagacgaacttcagtgacttgttcctcattacctattatatttagggagccttatgtataaatgcataaaccactttcttatatttcacttactgatttaacaggtagaaattctgataggtggctataggcgctttcatttgcactttctccatttccttcattcctttttccgtttcagaactctccagccattctttgaaggtctgttacccagagacaacccacgcaatacccggtttgccatcaacttcttcacttccataggtctcggaggattgacgtaaggatcatttgcagaattttatctttagttacaacattatgtcaagtgcctggtatacatagtgtaacacattacatctgtgttagggatgaactgcgagaacatctgaaaaatacgcccaaggtcatcgtagcccagaaaccagaagctgaacaaaagaaaccagccctgacatcttcatcttcagagtcttcctcggcgtctgattcctctgactcagaatctgacagcagcgagagcagctcagagtcctctagtgatgcgagcgactcctcctcctcctccagcactcagagctctacctcaggtatcacggctcattcaggtattaccctgctcatttctaacaattgcagggctcgattgctgcttacttatttttgccatctatttaaaacatttattattggagatggtcatgtgtcactgacagtctgcagtgttatatctgtttcagaagcctcttagacagggctaattcattggcagctgcgattccagggatgtccatgtgtttacagggccctcctgaggctttattacaaggcatgtgggttttagttgtagtcaagctttatgtggctacttgacatcattgtactcattggacggctcactgggggctttgccgtacctagctttccccagattctgatttgtaagtccatcacttagtcttgcctcttgttttgctgacacaaggtcttacaacataattaaagctagtcttctcctcactgtgcagcccagtttgatcttgaactgcagtctctgtgag

SEQ ID NO: 26815 - DNA, 1214 bp, Mus musculus
ctccagaccggcatgcgaggcgccttcgggaaaccacaaggtacagtggcgagagtccacatcggccaggtcatcatgtcgatccgcaccaagctgcagaacaaggagcacgtgatcgaggccctacgctgagccaagttcaagttccccggccgccagaagatccacatctccaagaagtggggctttaccaagttcaacacagatgaatttgaagacaaggtggcggccaagcgcctcatccctgatggctgtggagtcaaatacatccctgaacgcggtcctctggacaagtggcgagccctgcattcctgaggactttgctggcagaaaagaagtacagatgaggttatagtttgaaaaacgttaattccgtttattgactttagaatgttactttgcatagtatagaccattacaatggaaagtacctgccttaagaaacaagaaaactgcagtttatggagaaagaattttctattttgacccatgtacttaaaatttttggtgtatactgcagtgtagcaaatgttttgtggtgacggtataaatggtactgtttgttatcttggattgagtggctagagaagttggaagacgtgtgagaagttcttctttatagagaattaaacatgaaaattacatctcaaaaaaaaaaaagaatgccaactctaaaaacaaaaataataggaagcaacaattacttttccttaatatctcttaatatcaatggactcaatttcccaataaaaagacatagactaacagactggctacacaaacaggacccaacattctgttgcttacaggaaacccatctcagggaaaaagacaaacactacctcagagtgaaaggctggaaaacaattttccaagcaaatggtatgaagaaacaggctggactaaccattctaatatctaataaaatcaacctccaatccaaagttatcaaaaaagacaagaagggacacttcatactcatcaaaggtaaaatcctccaagaggaactctcaattttgaatatctatgctccaaatgcaagggcagccacattcattaaagaaactttagtaaagctcaaagcacatatttcacctcacataataatagtgggagacttcaacactccacttacatcaatggacagatcgtagaaacagaaactaaacagggacacagtgaaactaacagaagagatgaaacaaatggactta

SEQ ID NO: 26816 - DNA, 1186 bp, Mus musculus
acaattctaagggatacatcgaattataatgacattgagaaaaaaaggaagtatcttcccctggtctacatgagaaattggtattattgctacagctaactgtgctgcagacttcatgagcaaagacagttcattaggaaaatggcctctcacaccaggtcagtgctcaacatttttgttcatttgtacctggcttcattaaagctttcttgtgtcttatattacatggaatatattttccatattttacactgtatggtaaatgtcaggaaactctcatgtctggtatttgtgtttgaaactttcttttaggttcttgcttcctcaaacaaactttttttgacattgattcaatgtagccaacaccttcaacaatacccaaagcactcgattattatacctccatttaccatagtttctctctatgtattatctcgttgtttgttatggttattataaattatctatctccttgtacagattgtggacttctcaagaacagggactttggatttttttacttgctgctgttactctggtgcttagagacttagtacagccttagcaaatattaattgtccaagagacaagactatacatctgatgcagacacctgttgcctaaatcatagcactataaatcaatctgttgagtataccacaaatgaatctcatcctcatcgtcacttattctacaaaagataacaattgcaacttatctctctgattctgttaccgaatttcttctccctgctgagaatcagaagtcctgagtaagaaatcctcttttctttatttactgaatgactgattaatcgattgattgatttttgcatcatttggttgaatataactagggacttgggtaaacattacccaacattaaagtcctatacactgtcatcaaaccagcctttttccttcatataataagaattctcttgaatgcatgctacttttttctttcctatttatcagtcttcagggcatccctcttattctatatttagggctatgcaaaattatactaggttatagtttctactttacagtgtttagtttataaacacagcacatgactgatgtttctgtagtgtttgcttgctctccgtgatgtcagttaaggttacaatgacgtcagtggacaggttcctagtgcttaagggaactgttaattccttttctct

SEQ ID NO: 26817 - DNA, 1191 bp, Mus musculus
gagagaggagctggagggaagctcttccttgggtttctgacccagcttgtctccttctttgcttatgctaagatagttgcctcctataagaaaaacaaagtgtgagcaaagcttaggtttcacagctgggtcctcagtacacaagctgtatcaactccctatgatgttttccctttaatctattctttctttatcatgcttggtctgaactactttcctggagaatcctttaaaaatgaccaaaaaactaaggtgagcagtcccttagaggatctgttttgtgttcttagggattaggccttctgacttttgtttctgattttccaacactagtatcatgagaaaatgtgcctgtatatcctttctaaggactgtgtatctcatgcatgcgaagtatcggaagatacagaaagatatgatgtgaagacctgagccacggggagtgaaaacggggctgtggactgattgacgtgcagtgtgacctctgagcacacttgacatctctacgtcttcttcctttgttgcagtgtctcagaactgctggagctttacgaggaagatcctgaagaaattctatataatcttggatttggacgagatgaaccagatattgcttctaaaattccttccagattttttaattcatcatcctttgccagaggcatagacattaaagtatttctgagtgcacagatgcaacggatggaagtagagaacccaaactatgctctgacaagtaagggctctgatgttagtgtgatgtttgaaacgttgagcaactaggccagatgatctttgttttcacatctgacattttaaaaataaggttaataatagactaggttttttgctcattctgaattaattattctagttataatatctatatctttatatctatctatctatctatctatctatctatctatctatctatctatctacctacctacctacctatctcagtccatttcaggtgcttttctgtaaatctaaaataccttggccagttgagtcttttctcttaggcctctacttgttttttctctgttaaatggtgtcttgaaacaggattcctcccaggttgctcgtggaccaaccttatgtgtgctttaactgtactctgcagttcagtgtagaatatactcgaatgtgtattttcttaggagggcatttgaaaaagtcttagtg

SEQ ID NO: 26818 - DNA, 1196 bp, Mus musculus
tgagtcctgctgacttcctgccagcctcacatttagtccgcaggctgctgtgcgaagtgacttatgagaagctctatcatactttcccaaagaattgtgatggcacaggaaatggtggcacatgcctttaatcccaggacccaggagacagagacagcttggtctttgtgagttcaaggccagcctggtctatagagcaaggtccagaacagccaaagttacacagagaaacccagtctcaaaaaaaaaccaaaataattaaaaaaaaaaaaaagacgtaaagtgatttttttcgtaatgccttcggctgggttgtgctacacaggactctgatgtgacacagggggtgggctttcctaccaggtgtctcttctgtgcttgtcacttgtacactgtggccttctgtgatttagctgactgccacaattaagcggtatgtactttatctgaaaacaggaaaaatagcgtggtcatattgttcaatgcatatttttcgttttccattgtagattaaagagtctattgttggggaaattcgacgagaaattgtaagtggacttttggcagcagtgtcttcaagtaaagcacctggtcctaagcaggacagccactgagcggacgccttcggtaacgtttgtcatgtcttacacattgacacttgattcacaagtctttgctttcttagggaagctgttagaactagctaaacttgtatttttaaaatagatgtcatagttgtcctacagtatgaaaaccatatgcaacccatatgtataaacaattcaatttaagaacagaattgcctgcagtgtattcttacatagaaagtccttatagtaaataaatcctggagttggactgtagaccagaatcttactttaatattaattaaattgtatttcaaatgtacaatgtgtgggcaagaatttgagaattagtcaaaaaattttaatgccttaccttattatttttgtcatttgaatagatattctgtagatccatttctaatcataatttattaaggattgttttatgtgacttactacaataatagctataactgtattttataaattatatatatattttattaatagcaatgtttattgaacacaccaaggaataataatgtgtacaacactttcaaagctgaaggtgtttattcagtgttatgaaaaatgttgatatataatttc

SEQ ID NO: 26819 - DNA, 1389 bp, Mus musculus
ccttctttttagggttgagatggatcccattaactaatataggcattgtcagtgatttatgctggtggaggtgttgtttgtcctatggaagatattttctactgagctgggctactgtacacaatggacagtgtgcatttctgtacaggttacggttctatgcataaacattttagaaaacaaacatagaaacttaggcactttgctgactcctttctgaactatcagactggccatttgaaagcctagtatttatttgtatgtcaatatttgcccagttgatgtcctatgtagagttaattgtaaaacttgaagaatttcagacataaccaacttataaatgacctatttcttcaggctagcttctacaacactgacctccatgaggtatttactgtgcaataacagattcgtcttctgagagcttgaagcaacccatgatttgtccctccactgctcttcactgggttcacttccaaggagactaatggctctattgtaaaaattgctcttaattcttgaagaggctactgagaagcagtggggtagatctcatgaggttacctacagctacttcatgttcttacactgtaagccttgttgctttgccccaacaattgtaatttgattatagctatgagccttatggtagacactatgtaccctctgcggtgtaattgcattatagctatgtgccttgtggtaagcactatgtactctctgcattgtccaaatgtcttactttaaggtgtttcttctgtcttttcgactaagtagtattgtcaagataatggggcctgtgacttgaatggatagaatagaaatgaataagctggtttttgtttttccaaatgagatttagatttgtttttctcatgcataaatgattttaattcagttttaaccagtgaaaactcgtggtttttctgaaagaaaaaagaaaagggtttcctatctggtattatatatgtcaaataaatgtataaagtaacacccaaatgttattagaaactagtcttttagtatttgtaattttcaactcttattgtgttactttgtgtgaaaatttttagtcaaaagtgcttggaataatggaatggttagcattctttgaaagagtatctaaaaagtttataaatatttgaactatcacacaaaggttgatctctaaaaaaacaaaaaaccccattaaaacaataaagaatttattttgcctaaaatgttaaatttattttttgagctgtaacatgaagaatttggattacatttgagggctaaccaatgaagtctgaaaggtttattgggccttccctccctgaagaggctttggcagggcttttaggaaagtcggtgtccaccaccacgaggacacagcaggacatcactctt

SEQ ID NO: 26820 - DNA, 1950 bp, Mus musculus
tactataactgaaattaagataaagaacgtatcatattaccacttagtgtcttaataccttttctgtcactgtgtaaaatattctgacagaagcaacttaggataaaaatggttctgactcacagttcgagagcacagcgcattcacctagcgaggaagtcgagaggcaggtgctgaagcggctagtgacgtcacccaggcaggaagcttgagcgcctgctgctgctgctgctcagtgccctcctccatcttacagtcctcccctgctaggaagtggcaccgtctccccagctcacgccccacgggattcccagagagcccgtcaaggtgacggtagaaaccatctcacacaggatgacacaccagtaggtgtgacaatacctactgtgtgcaggtgaaaactggcacatcagctgttattgagcaaagagtgttttgtgatattctcttcagtaagaacattgagtatgtgtaagaaagtaaaatactgattaccttataatacctttctcttttgctcacctttacatgcatgcaggatgagctttgatggtgttgaagaaaaagcatgtaaggaaaagaatctggagaacggcatcaaaagatccctttcccaagtgacgatgctcctgaggaagcagatgcacgtgacctgggcctcgcagttgcctgtgtacacagagctcctgtgcggcactgtgggctgcacatgcttcctggagagccaggcagcgccatctgagactgcagtccacatatggttctgtgttgtgtctttgttgttgttgttaatccttttagaaatacacacatcagtcttagctcagggccatatagaaatactccacaggccaagtccagcccagggactagtttgctgaccccagaactgatgtttggacacctggccctgcacgtggctctgttaccttcagactgtacaaagtagacttgggttttcacttgtaaatttctgatgcgcttgaaaagaactgacttgcttttcagtcacctcttctaattctgtctatgaccatatattttattttgactattttcaccacataggaaaataaaaattacccatttttcctactatgtactactgtatagacagaggctttcttgtaagagttgaagagttcttaatttatcacaacagtaagtgtaaaaatcctgtaagctgctgtcccaggaacaaggtaagaagaagtatttacagcagttgatgggctgtgtggctgtcacaggtctaagcctgtgtttagtatgtacaccttcatttatttgctttcataaatgttcctactgatggttttgttggttttgtttcacgtgtcttcctgatattgacatatttcccttctgggttctctgttttgatcactcatgttgattattttttcccctgtagccgtggtttttccttctgtccaatattcactattccaataggaacagtaattttagatttattttaattggctcatgatgatgctgtttttcaattattgtctttttcagtaaagtttccataacaactgaagtactttttactaaaatcaagcacacaatggactcttcccatttctcagttgtttagactcagagggtcacaggtccctgctgcaactccaaaaacagagtgacctctagttcagttctctcccggtgtgtggggtggtcagaggatgccagtgaataaagtcaaattattttttctaaaattcttttgaagatgattgttgtgtttggaagattttatcactttccctgctccctagtcttgtcttcataaaggctatgccataggtttgtgctagggaaagcagtgtgcattagtttcctttctacctcattcagattctcctgtgttttattacattttaactccctgactcgggctctgctgtacatgtgagcacacatgagccttaccgttcctaacga

SEQ ID NO: 26821 - DNA, 1416 bp, Mus musculus
tttcagattgtacaagaatcaccattcctgacaatggatctcttggaatcttgttttccttatgtgttgctgagaaatgcataccatgctgtctacaaacaaagtgttacatcttctgcatagagtacttactcaagacaagcacgagtttctgttgccttgttttatctgtaaactgtggaactattttaccttaaagcctgaaaacagttttgtggatgaaattttcttcatgctgttgtattttctgatcattggcttcctaatatggttgtactacagtacatttgattgatttagttatacattctcaaaactcagtgaattctatgattttagagtatcatttgtttgaaataccattaacactatgtttttgataactgataatgaaaaaacttgcttgtttatttctgaaaaagaactgtatttagtgattattttagatagtgatatgctagcccccatctgtgtgtaaattatttcctatagggagagttctgatctgtacctacggttccttctgagatggagactggatgtgcacatcggtgatgcttacgactacatttctactttatgttgaacatttgccaaactaaatacctaacgcggtttaaccttccacatggcagacaacttgagcatcggaagcaggttccgaggttctcagacagcagcacatgctgccgccgcctgtagaaagcctactgtagaaacatctcatcccgtgctgcccggctggcatctgcactgcctttaccctgctgtataataaacaaccagacacttggcaactgttgatacagatggtagtcccgaatcactttttatatgttttaacatttgaaattcaagtgtacctgccataacataaataaacactagactgtatcacaccttgaatgatttctttaaaatctttggaaacttatttgacaatatgaaatttttagtttaaactttgttaatttatcagatttattattacagaattttttttaatgttttgaaaaatacttccggaaaaatatactgaaattggtggggggcggggagaatgtgtgtgtgtgtgtgtgtgtgtgtgtgtgtgtgtgtgtgtgtgtgtgttcggtttgctgattgccaaatggagttgttgaggaataacaaaaatggagtggccatggaactaggctgtgttgttaccgatgggtcagtgctaggtaggaagtccacacgtgccctgctttgtgtttggcgtggatggcagagtggcacatcttgccttctgattgctattagacagcctctgctgctttgcattgtatagcacagagctgccgttcatagcttcaatgtacacggctcactgagtcgagatcagcaaaattgcttatgaacccatttctgtttcccttgttcagatatagaaag

SEQ ID NO: 26822 - DNA, 1099 bp, Mus musculus
tagctggccactcctcctgcctgccactgtgttccccatagcagtgctttctgcacgttgtgctgactgctgtataacctcatggacattgttacattcttaccctgatgccgacaatgtgagaatataacattctttcaaaagcatgttagctccatgtctttctccaatttcatattcttaaatgagtgaatatattagaaattagtggttttgagacctatacccaatttaccaactttctcatgaaataattaaatatatcaatttagtggttatatggatgattatttatcctcccatgaacttatataagaggaaatggtgatactgcctaacccatcagtgtttcttcaaggcagagaagataggtaccatttccatagacagcaaatcgcaagttggaaatgctcattcttggtccgttaccactccctgcacctacactgtctacccaagtgaagcacaggtgacacgctgatatctttccctacagcggctcaatgcacagagaaagacgcaagtttttacggtctgcactaaaagaactggccactgtcctctctgaccagcctggcctgcttggtcccaaggtaactgagtgatagttgtaccctatccgccctgtaaagcatgttttctgtatgaaatttgcccaaagtggtagccaagaatgcatttgctggcttgaggctcgcatcacacttctgtctttccttagttcttacgtgtgtgttcatctttatgtgaactgctgtgtgctgtcttgatctgagtggctcttttacatttggtgttaattctttgtcagggacttttcacatagagcaagttttcagttgttgagtaatgagttttgttgatttgttttcaataggcactttttgttttcatggcgttatcttttgcccgtgatgaaattatctggctgctccgtcacgcggacaacatgccaaagaagagtgcagatgactttatagataagtaagtgtcacattggagcaccgtccatttcctgcttattttggttgatgggtcatgagtctgagaacatgtattaaagcaaaggtgttttaaaaactctttggggttctttata

SEQ ID NO: 26823 - DNA, 1137 bp, Mus musculus
gtgcctgtatgtatgtatgtattacattatgaatcactagcgaatgaacctccagtgatggaggttgttgcccattgtagaaagctacagtgtaaccaaaggaacttgtctgtgcagtacttgtaacttgtccttgtttctctttgtttgaagttggctttattctgtgccatgggatgctaaatacggaggctaccgcactgaacctttggaagctagctcttcagagtagctcttgcctctctctctttcgggatgaagttttccacattcacaaagctgcagaagacttatttgtaaacattcgggggtatggtgttttcagatttgttcattttggggggaggaggtggtgaatgaaatgtctttagtagcataggttttggggttagagagttgatcacattgtacaggaaagtttggcctagactgtcttactttggtcccagcaatttgcttttaacaatatcctgataatagtagaaataatattctttttttgtttgtttgtttgttttggttttggttttttcgagacagggtttctctgtgtagccctggctgtcctagaactcactttgtagaccaggctggcctccaactcagaaatccgcctgcctctgcctcccgagtgctgggactaaaggtatgcgcccagctagaaataatattcttatagataactttactaattacaaatatttacagtttctcacctttttgaaattggtattctagagaaatacgtcttctttttattcagacttaattttattcataaatattgctaaaagtaaaatatagagtgtattacccagcatggtggcttatacctttaatcccaacactcagtggacagaggcaggtacgtctctgaccttgaggctagtttggtctacagagtgggttccaagtcaggcagggtttcacagaaaaccttgtcttgccccattcctgccgcaaaaaaagagaacagagtggatttataaaagcatttgaaacaatcccagatgtcattgaatcgtgcctaacagtcacagaagcctgatcatagccctgagggatcatggttctcgagagcagattacacccaaaggacgtagagtcactcagtctctgcaaagcgaatacttttct

SEQ ID NO: 26824 - DNA, 1510 bp, Mus musculus
caaggagccaatctgtgagtatagcaggatgtatttagagtcattttattgctatgttcctttaccaaaactgtaggttttgtgtgtgtgtgtgtgtgtgtgtgtgttttttccccctaggtccctggcctatctagtctcaggttcttaaccacctgggcagtatcagggatgggctccatcttctggagtgcaccttaaatctagtcagatattagttggttacacccacaagctttgtgccactatggtactattgaagtgcaggcacttcacccttgtagatggaaatttgtagcttagtgatagtgggtgacttctgtgcttactcttgccactagacaggttgtccagataaaaacttaaccgagaaatgttggtgctaaaggatgtaaatgaaaccaaacaaaaacaaatggacttaacaggtattcagaaaacatttgctctttccgttcctagcgcagccatggctcgtggtcccaagaaacacctgaagtgtgtagctgctccaaaacattagatgctggataagttgactggcgtgtttgctcctcgtccatccactggtcctcacaagctgagggaatgcccgcctctcatcattttcctaaggaacagacttaagtatgccctgactggagatgaagtaaaaaagatttgcatgcagcgattcattaagattgatgtgaaagtcaggaccgatataacctaccctgctgggtttatggatgtcatcagcattgacaagaccggagagaacttccgtctgatctatgacaccaagggtcgctttgctgttcatcgtattacaccggaggaggcccagtacaagttgtgcaaagtgagaaagatctttgtgggcacaaaaggaatcccgcacctggtgacccatgatgctcgtactattcggtaccctgatcccctcatcaaggtgaacgacaccattcagattgatttggagacaggcaaaataactgacttcatcaagttcgacactgggaacctgtgtatggtgactggaggtgctaacttgggaaaaattggtgtaatcaccaacagagagagacatcccggctctttttgatgtggttcatgtgaaagatgccaatggtaacagctttgccactcggctgtccaacatttttgttattggcaatggtaacaaaccatggatctctcttcccagaggaaaaggaatccgcctcactattgctgaagagagagacaagaggcttgcggccaaacagagcagtgggtgaaatggtctctaggagacatgctggaaaagtgtttgtacaagcctttctaggcaacatacatgctagattaaacagcatggtgaagcaaaaaaaaaaaaaaacaaaaaaaaaaaaaacaaaaaaaaaaaagaaagaaaagaaaacattttattcaatcacaaaagaatatacctttttctgagcatctcatgagattttttaaaattaggtatttagctcatttacatttccaatgctataccaaaagt

SEQ ID NO: 26825 - DNA, 1456 bp, Mus musculus
ggacacagataattggctcagaaaaggaagacctgcccttgctgcttgaatttcaggaaacaaagaaaatttagttgctgacatattaatgtcttctatttctagaccttactgatctcatgttttgggggttgggggttgttgttttagagaacaaattaagtgaagcttctgggggtctggctgaaaatggtgaaagaagtgatttggacgaggacagcggagggggaggacaggaaaatggatccatcgatgctgttcctgttgatgaaaacctgttcactggcgaagatctggatgaactagaagaggaattgaacactcttgacttagaagaatgatgaggatgaaaactaggtcagctcactaggatcaacatgaactgagattgactcattaattgtttggccacctagaatcagcaggatgtttctttccccatgatgaccctggagggattctgtcctccacaaaaggagtactagccctgcgtcctctcttctgaccttgactacatctcatagtaagttcagagtagttggtgataaattaaaaatggtcattacagaagatgattgtcgttgtaactgtccactcatgtaggaagtgtaaccgctttcccagcttttggttttcattgggcatgtgtaatttccagaaacaacagattcacacttaagacacttgcgtttgatgcagtttttaatgagtggtgtcctttcctttgtatttatatgttttagagactgcctgaaaggtgagcactgtacttgataaaggaaactgcatatgcagattcagtattgtacttctgtggacaattaggtggacactgagaatgggacttgtcaacctgacagggtcagctacagtgccgtgttaaagctgtttgaagttctccccttttttgccaataaagttgtaaataaaaaccatcatacatccaaatccaactatgggcctttttcttttaagttttctatgaaaggtttcatagaaaacattcctagctttgtattttaattaaatattatctgtaatgattttaggcacaaaaggcaaaaatttaatagatttttcaagtatgtgttatataaccatagagtactgacaggattaacaattgttatttttcatttccaaaaagactaagtactgttactttaattccaaattgttagatcatcaacctagttaaaggcctcctacatttaattcttccttggaattaacattacattaagtttgatgactctgtttacaagaaggtaaataaattcaccagaaaactcggagcttaggagctcaggggcttggctgaggtcttgatatcccttgaaaatttagagtaatagcacattttaaatggacattaggttagcactagataactttaatcatggtattgtggttttatgaggttatttgtagtgtttagatttttatttttttcctg

SEQ ID NO: 26826 - DNA, 1096 bp, Mus musculus
ataagctacaagcacactacaatattcactagtttcagatttctttaaagtgtaataaccagagaaaggagaaacctcagataaatctggtttgggtcagtaattttgcaatttaacatttgagcagaaaagcaggactacttgtattaaattgcacacattacttcactctgtcggcctggtgtgataaaaatgataagatattcttaggtgtcttatatcagtacctacaatagagggaaagggttgttttgtttttaacttcctgcttaattaacacatagtgtaatagttgtgtatggttatggttcactaactttagtactggagacttacctccagtctcctactgagaaagaaattagttacttagttaatggctttaggggttgtgggtgtaatgtatgcttacccacaaagcaattttctaatagaaaggacaaagtgttggctatctactacccttgtgctctcctgaagaagtgtcttttcttccataacttttattccattaaaccttcccatatagtcatccccattcttcttcaaactcaggactgtttttttcattagttattaatgcttgcatatgtatatacatttatgtatgtgtatatggactgttcagtccacagttttatagatttaattacctcaaaatcagagacagctaaaagtactaattgatagggtctattactgggtagtttctgattacagacatctgtgaaattaaaaattatgaagggtaaaaattgatacttttatttaaaaacaaggtacagatgatagaagtattaacagctgaatcatccataaggtgagctaggatctcaatgtttacaaggccagaggggcctcacagggacaaaagtttagtgacatgctaacattcatgtacctttgttgtataaaaagaaacacctataaacataaaaatgcgagtcagaaattttgttttaaaaatgctttcctagggctggtgagatagcttactggttaagagcatttgttgccttaaagaggatctgggtttggttcccagcccccacatgttagttggcaactattcataactgcagttccaggggctctg

SEQ ID NO: 26827 - DNA, 1137 bp, Mus musculus
acaaaagtccctcagaagtgcctggaggaaccagggaacggggtgtgcctggttctttttcttttgattgcagccagtccccggcttgcagggcttcggctggaggcgcgctgccactgcccccctggtcctttggatctgggccgcagtcccgggacagcctcggaggaccggccgccagcgcgcacggaagtgcgcccggccttctcctgtgggaggccaccgtgagcgcgacttcctctttcggcggggcggcccggcctggccggctcctcctcctccccggcctcctcccccagtccgggctgctcacggttccgaggtactgtgctcgccccgccacttctcagcgccaggcaccgcgcgagccagcgacagagccggagtcccgggtcggacaccgctcctcctgggtgccgcccggctcagcttcgcgccgcccggccgccccgccgcccttgaccgcaagcgcacagcacagctcggcagttcgggggcgcgcaggcggcgggccgcggccaccgagcaccgggacagggactgaagtctttcggctctgcgccccgcgcgcgccccggcgatggctgctcccgggcgcctgctgctacgccctcgccccggcggcctcctgctgctgctgccgggtctcctgctgcccctcgccgacgccttcaacctggacgtcgaaagtcccgccgagtatgcgggtcccgagggaagttacttcggattcgccgtggacttcttcgagcccagcacgtcctcgtaagtggccgcgctcgagtccccaggcgccccctcccccaccgcgcaccctcagcggatccgcacccagccgctggctccagggtcctcccggccccaaacccgcctactctctccatgccgcggctggcccaggtctggcatggatgaaacttttgtggggatgacctaacctgacactcagcatccagtttcaccgtgtccccaacttcttctgattggctggggacagtgcgagagagctttgaaggagctctgttaagcatccaggaaaagtgagacatctgtacaggcttgtcctgcgagacttttggccatctcttgtcattccgtaacttgcttcacttggccccagaatttttttcttccgta

SEQ ID NO: 26828 - DNA, 1050 bp, Mus musculus
tacctttaatcccagtgctgggcaggcacgggtaggcagatgtgagatcaaggcctctacttaatctgtgtagtaagttctaggaaagccaaggctgtgttccaagaccctgtctcaaaacatacaaagaaagaaacaaaataaaacaaaagaggcctgctcttttctgaagggaaccataaaggagtggatcttggggccagggaagatggtggggagggctggggggagcagagggaggggaagcagtggtcaggtgtaatatatgagaattaaaaagaaaagcccagagctagctgttgtcctgtttgttaagctttatgcctagaagacagagaatctatagagtttctctttggccttcacgtaaggatgcttaatgttcaactgttacaaatgccagtgtgatctcactgtgtaaggaaatggtctgttctggcagggctgtggaatcgccaagtgcttgcagatcacctgccaggttggtcgactggatagaggcaagagcgcaatcctgtacgtgaaatccctgctgtggaccgagacgttcatgaacgtaagcagacagacgtaccagcaggtgtatacattttttcaaagagttataaggcttgctatctaagagaccatcgcttgttatttctgtgcagaaggagaaccagaaccattcctattcgctgaagtcatctgcttcctttaatatcatagaattcccttacaagaacctgccgatcgaggatctcttcaactctacactagtaagtcaccggcttcagagcacggatacctgccgtgcaaacaccttagtgattttagtggaagtttaactagaacaagtgaaaagataagttattggagaggattatagaatggaaagcattctctttctttttttaaattacatttgttgttgctgaggagggtcacgtatcacagtgtgcaggtcagaggacagcttttcagaactgattctgggacgtgaggattggaccttggatatgaggtgtggtgaccagggcctttagctgacgagtcatcccaccgacccag

SEQ ID NO: 26829 - DNA, 1106 bp, Mus musculus
gatcatcttggcagttctcgcagggctgctgctactggctgtgttggtatttgtaatgtacagggtaagtaatgggcgttgaagggggtagggggatggaataagagaagaagggacaggatgaagggagtaaagaaaaggagaaaaggacccacagtgttgctgcctggtgagcagggcttatttcaggatgggacactaaacaaaaacgccatttgaattttcgaggtgataatagagtcggtcatactttcagcgatctgttactgagctagaactatgctttttctttaactggcagatgggctttttcaaacgtgtccgaccacctcaagaagagcaagaaagagaacagcttcagcctcatgagaatggcgaaggaaactctgaaacctaaggtgcttcttaagtggcgccacttctgtccgctccaagttcaccaccgtggtggtggatttcaacatctctcgtgaacagtgaaatcccaggactgtattgctgagagcacccagcagtctcagtttatccacaaaattgaaatggatatttgtcgacttctctttatgaataagttcagattacatttacttcgcctacactaacgtgtgttcttagggacttaagtgatggaatttcaagtgattatctttgttcagtgtacataagacagacagcactgagtcagcacgttacatagcatagtacctcttcagttactgttcctaattgactgtgtggggtttctctcttcgacgttacgttagggcaattaggattgtaaagcagttcaaatttagaccatcagtaagtttgcacaggcacttagaacaggtacacattacactacagttgacttcataagctactgaagactttgcaattgcatggacttagattttaatatcatttacacagtagaacttttaaataacacgataccatcaaaattctttcctgggactatagctcacttcgaagcgtgtgcaactccctgggttcaatcctgcacactgggaggaaaaccagcagtttcctgtattaacaatggtacagtatttttatatgaaagttaggtttttatttatgtgtagtctgcattgtgtctt

SEQ ID NO: 26830 - DNA, 2459 bp, Mus musculus
ttttaaaagtaattgaagtttgtctcaccgtatcttaggctaattccatgtgcatatggatgagctaatttggagaatatattttcataacatgaagcacatttatgtgagttgtacgaattagaatatagacaggaccctatatttagctttaataaaattttaaattaatgagttctggcttgaaagatcataatcatatatgcaataattatttttttaaaccaatacatttaaattcttttaagaaacattttggtcttagggacaagtgtctctaagctacttaggactaccacacaggtcactaagttggcctatacaaacttttaccttctttgtctgtcaacataatagttgtcattcctgaaaatcaatgaaattcattctttgtaaaaatcaatattgatttttacagttattcctattatggcttctatgccaaggaataactttctgttagagattgaaagatatttgtaattggaaattaacatgatgtagttttcaacaatagcatggattttcttttaaaaaatataaatttgtatctctgtaaacttaggaactgtaatttgagagttaacactctgaaaaaaatgttgagatactctttatcccataacagcataggcatgtagtcaacaaaatagcaagagattattttagattcatatttgtaatttaccaataattaacatttatttctaagcataaaattttcataatataggttaattaaagaaattgattgatccagaggacatttgacacatgtgaggaatattaacgtggatactgatttcttatagagatatttattttagagttggtactttaaaacatctgtgtgagggttactttcctcccttatgtttaattatcatcataattctgattgtgttctgaatgactacggaaggtgaaacagtcaaaatattgtcttaaatctacctgtattacaatattacttattaatagtaaatcctcatgaatacattatttatataatgaggaaaatcactaagagcagacaagagtttgttgccgccttacgagaacagtgtgagtttctgtagtgagtctaaccccgaggagggaatttagtggcaaagtatatattggtagagcaactggttcttgtagggcaacagaaggccaaggtggcatccatccccatttgagagaattctggggagagcctcaaggagaaggaaaggaagttgttctagagtctctgtgtgtggccattgcctatctctgtgtcaccttgttcttactcgtggctagcttgtacatttaatttgatgagtaaggggagatgaccaaaatgtattatgggatctaaaaagacaaatacaattgcttgatgtctagtaatttgtaaaggtttctttggacttggtccttttatttgaaccatgaacctgtggctatgccatctgcagtatacactggcattcattataatttctgatatgtcatggacttcctgtgaggtactgaatctttgaattttgttgtcattgttcttaagtgcaatataacaatgtaacgaaacttaaatataagtcactatttagtaatcttaatccgaaatttattagtatttttttgttagcagaaaagaacaactctgctgtagttgtagatatataggtgaaattttttgttttttgctttttctttgcttttttttttttgtttgtttgttttttttacctctaaaccatccaatctgcattttattttaggtggaagatgaactattccttaccagttttaaaacactttcagtatattaaggtaacttggaagctgtgtgtatcaaattcttttgctcgctaagtaacctggaagataattttttttggcttctctcgtgatcacccacattgggtgagacataagatgagtctctcctgaaatctgtcatttgctaacttgttttgagttagtaaaagcaggtaccatgttctgctttgtttccagtgtgtaacttgtgactgtacaataaacttgaacgtgtggtgccagcttcctgtgtggattctatcctctcctatgagctcatgtttcctaattacgggaaccagcgatactgcatcaaacagtgacttcagggtggtgacacagctccctacaagtgcaaagatttaagggtatagttatctaaaggaagggaaccaacaaacaaaaggcaaagggagcctggtgttaagacacattcctcggaaggagatacattcttagcgtttcagtgccttgaaataatagcaagaatcagtcggtgagattatgtgaaattgaaaggcatctgcacatcaaaggaaacagcagaaaaaagaggctaactatggaacaggtgaaagtctcagtctgctttgcagcctgcagaccactaatatctaggtgctgtaaagaactcagaaaactaaactccacaacgctaaaccatc

SEQ ID NO: 26831 - DNA, 1241 bp, Mus musculus
cccaagaagtcacgagtgcagtgggcactcatttcatcaacaagcacatacagtttgaaacaaatatggtggccttcaaatgtattctcactgagaagcataggatctatctcacaatctacgtattcctgcatcgtaaatctggtagcttctgctgacattctggcaagttgggtttccataaatagacagctttagcagagctcataccaggccttctacttcctgtcaagaatgctggcaagaaacaagaatgtggcacttcctttgccaaaatcacagacagcaccctacctacctagtaaatctcgtcacagactatcttgagtctagtcaaagacaatcgttgtcccagacggcagagccctccagagaaacactcctcagacatcaacagatccttttacaagagatgaaatggacaacttcactctgtcagccaattcttttaaataacatatgtactgaataaaataatagaaatttaagtttttgacaattataaagctacaaccaaaacttatttgcatattaatacagtactaatttatactattagttttttttttaagatttctgtttcttaagagagcaggaaaatccatattggaatatgaattttgtattgacaacaagaagacagacgagggataagactcagtttaggaaaatctatgatactctaagtcataattccctgagggtcgcttttctctttgaagatcagatgagctctcagaactgaggtgagaattactcagtaaggagcccccaactctaaccctctcagcaccacagggctgtgttctgactttccaactgtttgaatgccaggagtgtgctcactgctgtgcatctgatcccagaaacaaaggtccaggtttgtgatttctagaatgaggccaggttgaacgtgccaatcaaatgatctggctttagaggttgggaagctatctggctcaccactattgcccccacggctggtttccagcctccttattaggttgtctgtttcattgaagtctctcctcttgttcagacttgatgagcatcagtccttgtgtgtgacagtgcatgaggcacattcaggtcgttttgattggagattaagagaagaagggatttggagatgagaaataaggaagtttcacaaacttgatctgatcagctctttgcccagtcagtctagcaggatttcttatttagctttggagagatgtctcatactggtcaagaacatc

SEQ ID NO: 26832 - DNA, 2691 bp, Mus musculus
ttcccctggagcttaggttacagacagttgtgaacggctatgtgggtgcttggaattgaccgtggtcttctggaagagcagtcagggctcttaaccactgagccttctttccaacctgtttggttggttttgagatttaggacgataagatttcaaaacaaaaagaaaacccagtctggcctttatcttattctgtagctgagggtaactttaaattcctgatactcctggctttgcatataaatattgggatcataagcatatgccaccattgaggtctcttgctaaatattgcaggctggacctgaacttaagaactgcctgactttgtccatcaagtgctaggattagctatgtgtggcaccacgcctgtgtataattgtagccttacagttagagcagtgtgttggaatgaatgcttcatggttgaaaagccacgaccgggaaatctgctttcaagtactgaggtggcacggtggatggggtgtaaatgaaatgagactagccatgaatagtcattaaggctgttagatgtgtggaaccgaggtgcaggaccacggagcacacatcaggaaaaacagtcgagacagcagcagcagtacaggcagcagcagtacagcagcagcagtacaggcagcagacagcagcagcagtacagcagcagcagtacaggcagcagcagtacagtagcagcagtacaggcagcagcagtacagcagcagtagtacagcagcagcagtacaggcagcagcagtacagtagcagcagtacaggcagcagcagtacaggcagcagcagtacagcagcagcagtacaggcagcagcagtacaggcagcagcagtacagcagcagcagtacaggcagcagcagtacaggcagcagtagtacagcagcagcagtacaggcagcagcagtacaggcagcagcagtacagcagcagcagtacaggcagcagcagtacaggcagcagcagtacaggtagaggtggcttttggattatgagtttctttaactgccaagtgcagacagaggttaggtttcagatgtctatgagactgaagttctgggatggggaattctggaacagtcataaggatggaagaggaaggctgaaccaaggagactccctgtcacattttagcaaggtcaacgctgtttttaagttttgttaaacttggcttgatggtaaaattttcatttataagcatgactgtagacaatttaaattttttgtttatggctattggatcattcggatactttaaatggagcacattgtagtagagggtagacaacgtggggaaattggccaccatgctagcgcagtctttggcccagcaggtgcatttgcacatactaatttgtttctaggaaggacagaagggaggcatggaaatctcatgtatcacacaccaaagccagtccctctgcgcagctggattatatgggctgcaacgtggctctctcctgctcttaccagagcgcctggattcatagcccttttcctgtgcacaatcaagttggaaggcagggaatgatgccataattgctcctcttttaaccatggctgcttcttatccatatcaccccttttaataccactgtacctttaagaaaggtatcaattgacaatttccatacctgaatacagtgttaccttggtaatgtttaccaccgtacctctttccatctcccccaacccactgtaccttatagctgtttaaattccagactacaagactctgcagttgccatcttttccttcttttcttcaaacttgaaatctttctatattggaaaagccattgacgtgttaatctctcctaagctacactctctttcatctttgtgcctttataaaagtgcatggagacacacaagctacctatgtctagtgagaataagctgtcaacattgtaggcttgcaggctaaaatcttttaggtatatcctcatgcgtctgtccattggcttctatgccactctgcctcatggttgttgtgtgtatattttaaccccagctgcaggggttagtgtctgaaatcttggtcctctgctagagagaacaacaattttcctttagggctaggatatgaaatctcttctggagtaagccttggagtctgacagtggttttgagtctatgaacagttttgaatttggggagccaagccctgtcctgggttgtttcacttaagccctctattttccacagactctgtgtattcctcttgctcccattccaactgttcccacccaagaaggatgccttgtgcttctgcacattttactcagtcgtattggcctgtgtggtagccagagatccggttagaggactggtaaatggaattagagaggtatgagaaaggattttgcagaaattggatgtgctgctgtactcctgtaatcccaggccctgggaagtgggggcaggaggatcactacccatccttagctacttggtgagtttgatgccaaactatgccacatgggaccaggtctcaaacaaaacaagcttgctttgcggtttgcctacatcttagaaggctatttattctactgataacagcagaagaagttgtactgggtaactatctttttgtttttccggctgtacaatttgaaaaatgtaattgaaggtaatttacagagtatcaaggagtagttttattttgtttcatttttgttttt

SEQ ID NO: 26833 - DNA, 1069 bp, Mus musculus
tacagagacaagaggatttacaattgaatcctacccaattgctagaaagctactatctacatctaagcagggtctgatgcaatctttaggaaggaccctagctcctccaaattctcatcatgtcttctgtctagttttgagaccccaagctcttcttgctgaacacagttagtacttaactggatacatttgtaacacacttctggttcaacttttacttcccatagaaccctttagttctggtaacacattccagtaatgatttcttcattcccagttgctttgtaaactgcattataatggatccatttaaggaaaatgatctcttaaataaaaccccaatttctttcatacttcatgcatcctgaaaatatttgtccaacaaccatttgattcagatgcttgggcttaaggctcctcctgttcctaagcgttccatttctggtgatggaggccatagataaatgagtcagtaaggtaagcactgttagaatagtgactgttaaacatgtactagagaggccgactgccagaagggcagcacggcatctttgaggtgtactgggctcattaaaggatagctaggattctgctccttgaagatttgaagtcatttaagtcagatggaacactgcaaaactatagaaatgcaaaaagtagacacctaatctgcaagaggaattctctttgtagaaacatttcatctagtaaatgaagtagtttgaaaaaaaaaatgtcatcaatgtggaatccctaatacctaggtctttcaggcattgagcatcaatggttgatatcacaaaaataaagaaataccacccacgaagtttaaaaactctggtagagggtatggctcagtggtagacttctcgtctcacatgtagggagtcctttgttcagttcccaagcacagcaaagaaagaatttagttttgagtctgatcaagcctttggattcaactagtatttaaacaggggaaaggcaggggaaatactgaactatattatcaagatgacccaattctttgataaattagttacaataagaaaagagtgtaggaaggacaata

SEQ ID NO: 26834 - DNA, 1963 bp, Mus musculus
cgtattacatgttttccctgcttgatatttaccacaacttgctgattatccatattttggagatgaagaaattaattttaaagtaattaactaacttgcctgaggtctcatttttgttggttcccttggactagttttggaaccaaggctgagtgttcacctcttataatgggtttataagtatgcactattatgtctggcttggggtgttaggcattgaatggagaacttcatgcgtgttaggtgcgcgctttaaatttactacctacagtgctacatctttagtactatttttgtttttgttgttgttgttgttgttgttgttgttgttgttttgggtttttttgagagagggtcttgttgctgcccaggaacttgtagtatagaccttgaacttggggccagtcctcattcctctgccaacagattctggtaaccaccatgcccagtcctgaatcctttgtttttttaaactactgatttcaaatggtttaaggcaaaattaatggaacacaagaatgaagatgacttaagcatccttaaggatgcttttctggttgctggctgataccagccactagctgaaataggaaacagtgatgagtacagggtggcagggctctagaatcacaggacggtttcaatctgtttaactctcttcccctggcgtattaaacttgggttcagattcggaatgacagaagtggagacagtcatctgtcaggagacatggtatgctgggctgccctgcctcgtcctggtctctctcactctttccatggtctccacctatctcttctcctcctccttctcccgctttctctctagtgggagactggcacgctgctgtgggaactcatgggtcttttacgcagaacccgtgcttcctctttgtcccagcagacttactgctacaatgcagacttgcagggcttatatgggaccaatgcgggttgtagctgtgcctttacagtgcagctctccacagcaacgccctgcccaaggtggagaaggttccaaatgggcagtgcctagtaaccacaacgcatgggtgccctgtgctgtcagaggccatcacctcctgcagaagggcacgcaccttctgacttgtcacatcccagcttcacactacttcctattttgacttttttgcagaattgtggtttcggagccaaagttagcttggtaatgatagatagagcaaatgcctattatgcgtggtttctgagtttaatcctcaggtcagacacaaattcttttttttaagcacttttatatgccttacttatttttattgtatgtacattggtattttcctggcatgcatatctgtatgatggtgttgggtcccttgcaacttgagtcagtcgcgagctgccatgtggatgctgggaattgaacctgggtccttgggaagaacgaccagtgcttttagcctctgaagtatctctcgagccccaacacaaattcttaatctgtgagagtgtacataactattttttttcttttggatttttcgagacagggtttctctgtatagccctggctgtcctggaactcactttgtagaccaggctggcttcgaactcagaaatccacctccctctgcctcccgagtgctgggattaaaggtgtgtgccaccactgccactcctgttgtccattccctgtctgctttcaggcattttcattttctcataacctagacctgctcagcagtagtgtcacatactctccatgtggcatctgtatatacgattgtatatgctcgttcatgctttatgcttctaatgactgactgttttgccttagtctgtgttacatttttatttaggcctgttttcttcctgcttctgaagcactcatttctggctgctatggaaaccatacaggctacatcctcaggggacaagccctccttaagatgagctggttgtgacccttcttgctcacccttccctat

SEQ ID NO: 26835 - DNA, 1111 bp, Mus musculus
aagataaaatgagattatgaatggaattgcacttaaactataattggcacataccaagtatgttgtagctattattattattagcactattttgagataggctccctttatttagcccagtctggtcttgaactcacagtagtcttcctaccttagcttcttcacggctatgatttcaggcatgagccaccacacctgacatattactttattatcgtacctatcattagatagttctctctgcaattatatgtacatgtatatgcatttgtttatattaattagatgattattttgcaaggtaaattatgtctaactacttaaaggattatttcaagggctacccaaaatgacaattagtgtacatgttcagttcccagattaggagaaagtggtatcagtcatttgatggatagttacacttctctcatctaggtcctattctaaatgtctattagaaatgatctgtacagaaattaaagtcagggtttacagatcactttatggcaaggccaggtggaagcatccatcaagtctagatgagacttaataatagacttttgaacctgatggaaaaagacttttttttttccccaaataccaaggttttttggatgtctgaatccttgggaggtaaggaagtaatctgcttgcagagcctatgagagctatgaaaagatttagttggatgaagtcaaataaaaagccacatatatttgttaagtacattgctatacacgaggacttattctggttataaaggttatcgtgagcacaggcccttgtcctaagaaagccagagaaagagttggaaatagtaatgttactagaccactgttaaggagaacagtatagagtagggaaggttgtgtaaccaactacaggaaactgcataatttgaggcaagaggtaatgatagcttagaccactgcgacatattataaaaacgattaccaattcaaggtctatgtaataatgatagtaacagctggtatctcccctcttcttccctcccctctccttttccctcccctccttcccttcccctctctttccccctccctatctcttctcctttcctctccccttctctttcttcctcctccccacc

SEQ ID NO: 26836 - DNA, 1097 bp, Mus musculus
tgtgatccaagttcaatgcttggaacccacataaatgtggaaagagaaccaatctcaaagtgcatgcatacctattaagcagcaacaaataccccgttgggagagacagcaaagacccttgtactaatcttgataatttgcaaattttgactacctgtgtgacccacaaactcgtaaatagggactttgaagtggtacttcattggtcacacctctagaagattaaaagaagtcagtgcattttctccgaagatttagaaacaactcccataaacttgagccaggtccttaagttaggcagagtagtaaaagagcagtggaaatggtgatagaagatgcataagccaatccttaaatacttaagatgttggcacaagcacggactataacaagatacagatttgggtcagtgagctccagtggtcagaaggcctactaagcaaagccctggtagacgatgtgaatcttagagcatgtaattagtgagtaagagtgttggacaatgacatgtaagttgaaagggtgattagagtagaattctgtattgaagaaaagtaaagatgctgatcaaaacttttgtgaaacgtgtctctattagctgtaactattgaaggatagaaatagaacatatgacttctaaagaaaaggcaaaagcagaaggtagctgaagttgatagaatgacctgggcttaaaggctgcagcagtagaggagaggcgtatgtcatgccagtgctagggttagcatgcaacaagtgaacagagcatgggtgggaagcaagtgtagagtcagaagacgtcttccaaaaggacgaagtaacttgagtaaagcttcagtagctggtcgtgtaagcttaaacacaagggtaggacccaatactattacgtcttcctgtcttattttataaattgctttttaagaaaaccttgtatctatgcatgtgttcacatatgtgcacacatgaaggccagaggccaacttctactagcgtctcttggtctctattttgggggaaagtctctctaaacttgaagcttactaattggctatactgcccggccaacgagctcctgggatgcgcctatctctataccctag

SEQ ID NO: 26837 - DNA, 2020 bp, Mus musculus
tgctcagctgtgtatgtttcccctgtcgtcctgtcctcagccttaacagccttctcttttttccccacagcagaagatttagcgccactctacctgctccatatgggcttataatatattacttttattttttggtggtgaaatggactgatgatttttttcctttcttcgctggactattgtgccaactgccaggctgactcctacccttgtagcccaaattggctgccgtcatccgtgaattacctacatcttccactgaagtttaattgtcctatcctcccagaccctacttccagttttcccccaagaaacctgactctgttatttgcatatcttgagaaactgctgcagattagctctttttgccagccttccctggaactcttggccttgcatagagggagggagagtggaactctctactggaagcaatgggaagaactgaaaattacacactgtctgttcagcagtcagcattctgacaaactgatgacttttaatcaagactattttttctggtgtggggggaactttttattttgttttggatggggaagtgtgagttcttcccttatccagtggcgatttttgaagccaagaaggctggaaacattggcacattccacctggcaagggccctcaagtaagtgaagtactccccaacctcagagtgagaactcttgttcctcctgttcaaggcagggaccacaaaggacctacagactccatctctctgtcagcttcaggataaccttggggtgctgtcctgaccaaggctgtccttaaccctcctctcctaccctgtgataaacctgctaacttgacctggctgttttgcaagatgctttgtaaaaaggagaatgccatggaaccccctggttgagaagaaacagaaagattgtctattgagaagatgaacctctaggaggaatgtacatgaagtggttagtctgaaactggcaggaagcttcagagctggctttcctcagccccctcaccccatctctcttcgtcctttataagcttgtcctccctctcctccccttccctggatttgttggccaacttacaagacttgtacatagctcctccccctttgcccttgtaaggtaggagttgccctggctttgcctcttctttgtgcctttggcctggggtgcatctcctccctctcttccaggtgcctttctttgcctctgcagtctcatttctcatgattttgcaagttagaccttgttattttcttacccactgttgacccccagtagctgaagcaaagaagaggagtggtaacttagggaacttcacgtccctactgggtgttgttaaagcctctgacatagccacaacaggcttctgcttaacagtgtgcagttgggattggtgaaaatccatcccgataagtctcaaagtgaggctgttaggagggagtgctgtgactctgactccttagtcgtccccagttcccatcatctctgaaaggctacagggaatcaggccatgcctccattacacccttttctgttgtagtgagtgttacagcttggctagagaagcagctactatgtgggtgcaattttttttaaacatttttccttattttctttccttaatctaaaagctctattcaatgcaactggaattctttatccctcttgtcctgttccttaatatattgaggctatggggtaggagaaaagtgcacagcccaccaactccttttcttatacattgcagtcaccccctccccccaacctttgcttccttcccatttcttcctagtcccgtttcccttttctggcaaaaaggagctctgtgctctctgtgaccctcagagtacactgcacaggggagcctcccccacccacatctatctgcctctggttttgggttctcttgtcctcttctgctcttcctggtgctctttcttctcggtggggtgtgggtaatagaatagccatgggctttggggacctttaactgtttttttgtttgtttgttttgtttttcctttttc

SEQ ID NO: 26838 - DNA, 1215 bp, Mus musculus
ggaggaccctgaaggagccatgtctgttgtttctgtggagaccacagatgatgggaccactagacgcacggagaccacagtaagctgagattttcgtgtcttagaatgataggtcctctgtggtattttagtagagaagctaacgagttaagtgagccaaagccactgtctgccagaaagaaagtgatgcctgggcaaagagacaaggtaaaagaagttcaggaagtgggaagagaggaggagtatgacagttacagtagcttccggagaggatgttagtgattgggcagtttttttccattgagggcttctgtaggatggagaagagatatagatgacacacacttctgtataaagacctagagggtagggtttctatcttagagtactgtggaatttaaacttagattctttatttcctcaatagttggttttccttttcttattccttaaatgaaggtcaaaaaagttgtgaagacaatgacaactcggacagtacagcctgtccccatggggccagacgggctgcccgtggacgcctcagcagtctccaataactatatccagaccttgggccgtgattttcgcaagaatggcaatgggggccctggtccctatgtggggcaagcgggcactgccactcttcctaggaacttccactatcctccagatgggtatggccgacactatgaagatggttatccaggtggcagtgacaactacggcagtctgtcccgggtgacccgaattgaggagcggtataggcccagcatggaaggctaccgggcacccagtagacaagatgtctatgggccccagccccaggttcgagtaggtggaagcagtgtggacctgcatcgttttcatcctgagccttacgggctagaggatgaccagcgcagcatgggctatgatgacctcgattacggcatgatgtctgattatggtactgcccgtcggacaggaacaccctctgaccctcgacgacgcctcaggtgggcaggagtgggggaagaggtagctttagggactcctagaggtcactaagcacctgtctgctctgagggctcttcctcctagagctgatctttgctggctgaagatgccatgctgactgtttggatgcgtagttgccatggaggaagattttacaatgggattgattggtcctcactccctttctttcttccttccctttctttattcttgttattg

SEQ ID NO: 26839 - DNA, 1131 bp, Mus musculus
gggaaaacgctttggggaagaaagcagcaaaccaaaccgcagcaagtaaagaaagtaagctcttttctgttttcccacccagataggtagggaaagggaacaagaccctcatcaaagagaactgaggcttaggcgtgccgttctaaaatgctttgttatttagcacctcccacctccccccagatctgcagtaattcctcagagattgtatagtctccgctttaaatatacatataatatatatgtataaaacttcctcgtctttctctctcccttttttttttttaatttcctataataaagtttcctattggataaggtcagctccctgatttatgcctggttcctattggaagctcgcaggggctgacatcacttaggaaagctagggtagggctgccagatcagtttgtcaccacccaggctgccttgcctttggctgggtgcaacttccattttaggtgttggatctgaggggaaaaggagagagggagagagagggagagagggagagagggaaagggagagagagagagagagaaagaggacgatcaagagggagggagggagagccagcgagcgagacagacacggagggagaggagaaaggcaggaaagatcctggaacgaggaagaggaagaggcggcgaacctcgctggatttgtctttctcagcacattggtgaagctttgggtttgtttcttaaaggactggctttagaagtccacatttgaggtgtgtgctttttaaatttttttccttttattaaaaatgtgtgtattgggaaaggggtaactcaagtggaatttttttcttaatggtaactggagggacttttaaaagggtgagaaagcctgttagtgctgacggtgaattttaaccaattatttttttcacttttaatactttggaggtttcttggtattttatttagttaaggaaaaggtaaaacgtacaagacctggaaacaaacttctaggtgtaataccggaagctggttggaaccaggggtagaagttgtgtaaattcctttttttgtgtgtacttttatattatttttttccctggatttagctaacatactcttatttttcagagctcaaaaagttgtttgggggggggggcatgtt

SEQ ID NO: 26840 - DNA, 1363 bp, Mus musculus
gatggggaaaacaagaaggacaaataggatcctgcattgtttttgcttcctctcctgtcaatttcaggaacctttgaggcccagttccagctataaccacaatccttgcctgaggccttttgatttctgtttggctgtgcctgggtaggggcactgtgcctgcttctgattttgaaagaagcatcctggaaaccatgaagtattctactatgaagggcgcatctgccctggtcagctgtttctcgaagggagtgatcttatcgatagaggtagaaatggtttccctccaaggttgggtcaatgtgtaaattgctattcaacacttggatattaccagtctgtggtttaattattcctcctagtgagcttgcaaagcatagactaaattaaaccctaatgttagatgtcagtataaagcccttagaatttttcctcaaggaccccttcttcctttaggcctttctgtcttgatctgtgcattaagaaatttaagtttggggctggagaaatggcccatcgattaagaaagagcactggtggctgcttttccagagatcctgagttcaattcccagcaaccacatgatggttcataatgggatctgatgccctcttctggcatgcaggcagaatactatatatagtaagtaaatcgtaaagagaaaggaatttaaggggttggagagatgactcagtggctaagagaattggctgttcttccagaggacccaggtttgattcctagcagcacatagaggctaaaccacctgtaactctagtctcaggggctccaacatccgcccttgaccttggctggcactgtatgcatgtagtgcacaaacacgtgacggaggaacacataaaaggcttgtatgtgttatcatttaaggtcactgttcccaattaaaagccttcaaccatgattttcatcattggaaatagaattgaatggccaccctgtgttgtgggaactgagaagggcaatataaacctgagaggttcctttgtgtggtggggcctgaagaagaaagccccacggctggacagctgttctctcctcctatcccaccgcttcccctaataaagggactgttcttttgattgccttgctgtttttcctttactagtgggcagctgccgggggactgctttttttgtttgtttgtttgtttttttaatcctaaaattgaatatcaaacccagggactctaaaagccaaacacctctagacctcaacttcctttttaaggttgtggatgagggccttgatcagttggagaaatgaaccctaactcaccatcctcttgatttcacctgggtgtctgagaagataggcaccagctacagcgtctggattgtaaatg

SEQ ID NO: 26841 - DNA, 1644 bp, Mus musculus
atttagattttttgttgttttgtgacaaggtttcaagatatagtcttggctggcctggaactcacttgtgtagaccaggctggtttctatctcagagatctactctcttctatctccagagtgctagaattaaaggcatgcaccacgacatccagttaggtccatcttttagtttttgaatgttcttactcttttctttgttttctccagaaccgacatagtccagaccacccaggtatgggcagctctcaagccagcagcagcagcagcctccgctaataggactactggacttggccaaggatggctttcctgtgatactgaacctgctgataaaaacttgtcttccaggcagttggaccctgttgtgggggcatccaacagctggagaggggccagcccctgctgtgcatgtgactaatacactttagggaaggaccatgcttttttatggttatgtccaattggcattttcatggattcctttttacaagaatctgtttttcttttttttccctcttttgtgcaatttgatcctaggacttcaatgttttgttttaaagcgtgtttaacaaactgaccggtatggctgccttttaagaggcaagtgccattctatttgaatcaaagtttaggacaaggcattaagatgcaagagattttggatcttgccatcacattatttccttagcaggctggaactggaaaatcaaaatgcgaatagagaacatggtctgaaaacagtaacttgctactattttcctaccatagacacaaaatactcgctgattatgctcagagcagagtgcatggatgatcttcacctttcacctggaaagctggcccaaataaggtttatacctgtgtttatataccacagggaactggtgagccacaatcacggatatattttagcaggaaaagccaattagtatttgtctcattatgctcccacctttttctggagcctgacccctaagacttgtgaacactaggcaagttttatcttttcctttccctctcttgactttttttttcccccctacatactttttaaatgaacctctggcaagaagcttaatgctggatttggttgttttgaaaaaagttttggtttggtttttgtaggttgttttttgttgttgttgtttttgacacatcacactatgcaaccttggctggctatgaacactaggctggccccaagcttgagagacccatctgcctctacccaccaagttctgggatcaaaggcatacaccaccatgcttagctgtttttactttcaaaaggaaacaaaggaatagcaagagattcaacagagaggatgtatttgttatgaaaagctaggtttttctcacccagcagggcatttaattggatagccagaataaaaacagaaccagagaatgaggtttctcttttgactccctaagaccattcaccctgccttaaccagacaaaacacaagtcaggggggactggttagatcaggatttattttattccttgttggtttaaaatggctaatcagaataaaaaaattaaagggtctctgtatagaggctggagtcttccctgtttaaaggttagaacccagctaccccctctacccagcaccatattgagatgggctaaggggta

SEQ ID NO: 26842 - DNA, 1665 bp, Mus musculus
gtgtcaggggtgggtggcaccacttatgagatttctgtgtgaatcttggcgcctcccttcccccacacctctgcacctacaccaaagggcctcaggtggccaccttccttccttcaaggggctccccttctttgcatggacatttttaaaatcaccgactccatgaggatgaggtttgttttacaaaatgccatgaggttaaggagagttgggaccctgagactggagtggcacctccccctcctttgatcttttaagaccttcccttccttgatccctggaccagactcagtggacatttgtgcaattgctcgccctggagggaaccagatcatttttaaaccagaaataattttttttattattgttacggattctatttttttcctcttctccgttaccaggtgtgtgtgtacatatatatatatatatatattataaatatcaaagaaattatatatctatcctgggatgggaaaacaagggagggatatatagatatatatatatatatatacataaggagggggattttattcttccctttccttagaccagcaggaaaagagagacattaaagtcttccttttctcaatggttccctctcttttgtcccagttaccaactaaggaagtagcactctctgctggtgctaagagattaggaaagaaacctgggtacatctggggttctcagataaaagaacttgggagagttttttaggctccttcacatctagtttccccaggaaaggggtcagttacatgacggtggtgggagatcaggaagagagcttggcctaatttaagaaacaccaggcaaccctgccctccattcttgggagacagggactgtgttgggcttcagtgagccccttcaatgcttccctataatcagaaaaatcttaaaatccaaggccaggagagaagaatccaaaaagcaatatttttcatcacatgccaaaaatgggatagagagaaggagtggcaggcctaggcccctccgagtgtcccttggggtttaccccttagcccatctcaatatggtgctgggtagagggggtagctgggttctaacctttaaacagggaagactccagcctctatacagagaccctttaatttttttattctgattagccattttaaaccaacaaggaataaaataaatcctgatctaaccagtcccccctgacttgtgttttgtctggttaaggcagggtgaatggtcttagggagtcaaaagagaaacctcattctctggttctgtttttattctggctatccaattaaatgccctgctgggtgagaaaaacctagcttttcataacaaatacatcctctctgttgaatctcttgctattcctttgtttccttttgaaagtaaaaacagctaagcatggtggtgtatgcctttgatcccagaacttggtgggtagaggcagatgggtctctcaagcttggggccagcctagtgttcatagccagccaaggttgcatagtgtgatgtgtcaaaaacaacaacaacaaaaaacaacctacaaaaaccaaaccaaaacttttttcaaaacaaccaaatccagcattaagcttcttgccagaggttcatttaaaaagtatgtaggggggaaaaaaaaagtcaagagagggaaaggaaaagataaaa

SEQ ID NO: 26843 - DNA, 1213 bp, Mus musculus
tttttatttttttaagtctgtgggatagtaggggcgaggggtggacaggtggatgcacatgtatacctgttaagtgagaagtcccagggattgaacccaggttgtcaggcttggtggcagatacctttacctagtgaagcatctgactaaccgtagtgccatgttttaaggatgccctttattctgtatctttttgctcctaggaatttgaccatcactgcccttgggtaaacaactgtattggtcgcaggaactacagatacttcttccttttcctcctttccctgacagctcacatcatgggtgtgtttggctttggcctcctttatgtcctctatcacatagaggaactctcaggggtccgcactgctgtcacgtatccttgaatgcctttggcttataggatgggggtggggttggagggcaagttgaatccttgagtctggaaaggtaaagggcaagtggtcacagtagaactggggaaagcaagataatattgttctgttttccttgaccacttggaatcagcatggcagtgatgtgtgtggctggcttatttttcatccctgtagctggcctcacaggatttcatgtggtgctggtggctaggggacgcacaaccaatgaacaggtaaggaaaactggcaggagactgaatagggcatgtcttaagccttactacagaggaacatgacactttcacaaatagcttgccagcgaatatttaatgtgatgatgtagagatattacctgtagtggggaaagtgaatgaagtaggcctacgtcctcaataagtagagttaaagctggaaatggtggtatagatctgtaatcttaggaggctgaggtaataggattgatctacttggaccctgtcccaaaacagtcagaaaaattaccttaagaaatggtcttgttagaattcttttaacaaatatttagtctgcaaatttatagaagttaattgggacagactttaggaagtacatagtactgcttaaagattatttttgtgcacataatagtagctaatgttaattacttagtcttaccttgtagttagcctatctgtggattctttaggtttaatcaaatatagatggtatagatggggagggaaaatcacatcagtactgagtatacatatcctttttcttagcattgttctgtaaataatacaataattggtatagtattagtataatgatggaaa

SEQ ID NO: 26844 - DNA, 1122 bp, Mus musculus
ccagtgtcctgttctttgcatacgattcagagcttgtttcgtgttggctaagggagctggacaatgggcatgtgttactttgttttccaatagagtgatggaggaaagactatgcaattcaaatctcctgttagttacatcggtaggtagttttctttttatgtcctagtcattcactcttactttttgttgaggtgtgttactattccacctaccagaggcccaggagcaaacaaaaatacctttactgctggatagtggaggcgcacgtgtttaatcccagcacttgggaggcagaggcaggtggatttctgagttccagggcagcctggtctacagagcattccgggacagctagggctacacagagaaacaaacaaaacaaaacaaaacacctttagcttctggttgtggagagactggctgtaaacagtgagtctggcagcaataagaactgcagaaaaagataaagggactaaaccagtggaagatttttttgaatagtggcctgatgtggtgatttaatcaaatgtttaatttgggtcctaggcacgtcagctttactggaaagatgagcgaggaatccaatgatgacaagaagccaacgactaagtttgaactagagcgagaaacagagcttcgatttgaggtggaggcctctcaatcggttcagttggagttgttggctggcatggcggagatctttggcacagagctgaccagaaacaagaaattcacttttgatgctggtgccaaggtggctgttttcacttggcatggctgttctctgcagttgagtggccggactgaggtggcttatgtctctaaggacacccctatgttgctttacctcaacactcatacagccttggagcagatgcggaggcaggcagaaaaggaagaagagagaggtccccgagtgatggtagtaggtcctactgatgtgggcaagtccactgtgtgtcgactgctactcaactacgcagtgcgtttgggccgccgtcctacttacgtggagttagatgtaggccagggctctgtgtccatccctggtaccatgggggccctgtacattgagcgtccagcagatgtggaagaaggtttctccatccaggcccctct

SEQ ID NO: 26845 - DNA, 1128 bp, Mus musculus
aggccgtggtgagtgggccgtggtgtctgatacccagggtaaccctgattcctgattatgccattgccgtgacagaggctcagcctttagacccaccccgggaacctaggctgtggttagggtcacattctcggggctgcatgggttcagacccacggttttgtgtgttccgtcccaactgtcaatcctctggctctaggagtgatctcgaggtactaagagggctcggtttccatccccgagccccatgacatcgcgagtgaccttgagctggacactgtcctctttaagggcctcatctccacttctgttaagagggctgattacgtttactgagcggggtattggtccccgctggtctgaaacactgtaattcctcgcgccctccagcccccccgggggggtggtactagggtgaaccgggagggatcgatgctgactgatcatgtccgctcctaggactaaagaccaggaggctattctctccacggtgctaagttgacatggatccgctcagagcccagcagctggctgcggagctggaggtggagatgatggctgacatgtacaacaggtaaagagaagcactcggcttcaccttgtctaggaaaactcgccctagtcacccctagcccgacagagtgaagcacttgtaacgaatgctttcgataaggtagtggagccaagtcccgccctcctaatcccgccccaccctcaccgcgtgcttcgctgaagtaaatacaggtcactggaaggacttggttggctatttggagggaataaaaggggtgtatgatggagaatctcctgcccaggctctgctgagtatcaagaacatataagcactttctcttctcttctcttctcttctcttctcttctcttctcttctcttctcttctcttctcttctcttctcttctcttctctcctcgtttccatctttctttctccttagatagcccatttacccttgtttatgtagtttatgtattttgtgtttgtttatgaatgccaacatgcatgccatagcgccacacatgtggaggtcagagggcagcttaataggatctcatcttggattgaactcaaatcttctggtttggcagcaagtgcctttgccgcctaag

SEQ ID NO: 26846 - DNA, 1182 bp, Mus musculus
gagggtctcggggtagccccagacttccctttccgcctcctgctcgcttctgagaatccgatctggtgcctagaggctggctagctgtgggccagaggtggctacagagcacggtgtgccccttggtgactttgagagactttgggaacttggggggttgtctcctggagcgggatcggggcgccctggctcgggtaggcaagcccggcagcgcgccaggaagttgcttcgctcagaccagacctttctggttcctgatagcgccctgcgggccagtggcgcgttcgctcctggcactgccagagcgcgcggagccagctccgcagcaccgggctctatggggcctccatgaaggctccatctctttggctccaggggtctcaggagccaccatgatggagtacccttcccaagggccgctaggaagcccttctctgagcgctctgtttctctgcagagtctcggccaccatggctcccacgctgaagcaggcgtaccgcaggcgctggtggatggcttgcaccgctgtggtggagaacctcttcttctccgcggtgctcctgggctgggcctccctgctgatcatgctcaagaaggaaggcttctattccagcctgtgcccaggtatatctgagaagggtgtgggggtgggaggtgaagaccgcgagggacggtagaaggaggaggcaggaagttggaaaacaaggacaggtggtcaggcagagacaaagcgacaaagcagggctgcccaagaccggaacactgggcagctaggaattggacagcctcacttcatgatctcttcaaacttcaggtgccactctgtcaggattctctgattcagtgatgagtgaaagccaaagtcccactaggcatacatatcctgagactgattgcctatgacaaccttctgtctagagtagtccgtagactcttagaagttctgcacctacctggataaggaatgctcaagttaaacaggtcttttgtgtgtgtgtgctagcaagcattgaactacatcaccaatacacagagagttcttaatgagatcaaacagaagtacacaaactggagaatggacgtgaaggacctatactcttggtcttttcaggaccttggagttcccaggtctacaaatcatcccttttgtacaaagttaaaagccttatttcctctagaatg

SEQ ID NO: 26847 - DNA, 1310 bp, Mus musculus
ctcctccatgatgggagtcttaggcaggtccctgaagaagatgtgtccagccagtaaggatgtggcttcctttgcttttctttccatgttctacaggtgaacctgggcctcctacttctctcgttcctgggatttctcctaccttcctacctctactactaccggtctcgcctgcagagagagtatgccaccaatttggtagacccacagaaggtgctcaatacttcgaaggtggctacatagactcctgaggccaagagacttggaggacaggcagtcaaggcctgataaaccgaagggaatggcctgtggctttctacctgcatcgtgttcatagagccgggttctgtggatttataaatactaagagttctatttttgtagggacttgcaaaaaaggaaacaaacagaacaaaacccccaaaccaaaaacagcccttaaaaaactccccccaaccaagctatccatcaactgaagacagtgcccgttccagtggtattgggccatcgtctttgaaaagaaagtgtggggctgccctttctccacacttggcctaggagcctctgtggagttgccttctgaaaactcatgggatcagtgaacagaccacactaagattccagccgccaagtgtgcacacatatatgttacgcacatgcatattgcatcctttcctgcaggagaaggactgaggggctggctgtatccaggatggggtgtgggggctggagggcgggttccctccctgatgctgtttcttacaggtcttagaggaaataaaaagggaaatgaaatctggctggtgtgtatctgtgactggaggagtaggttgttgtctttccagaactctatccctctgcctcacccatgcttggctgggcctttaggaaggatgcttggtggggttggagtgatagttcagtacttagagccctggttgctcttccagaggacctgattgctcacactccagtattcagagtgagttctaggacagccagcgctacatggagaaaccctgccttgaaaaacaatacaatgtgtgtgttgtgtgtgtgtgttagtgtgtgtgtctgtctgtctgtctgtctgtctgcctgaccattatttgtctagccatcttcctcttctcaactatgtacttactgccttgctatctgtcttagttattttcctgttgtacagacaccatgatgactttaaaaaaggaagagtttgaaggaacttacagtttctgagggctttgagtccctaacttccacagcagggagcatgacaggaggcagccatggtgctggggcaggagctg

SEQ ID NO: 26848 - DNA, 1113 bp, Mus musculus
ttaagaaagaaagaaagaaagaaagaaagaaagaaagaaagaaagaaagaagccatgaaaataaacctaaagtccttcaggtcaccttaatgtctaggtagaaaataggccatagaccaagtaggactttggtccttctgttggtgatgggagtaactcagagttgctggagtggcccctctttcctgtttccccaggtatcgatggggcttgccattttcctgacattggtccatcccttcctggtgtaccgtgagtgccgtgctgagaagacaaaatcgtctgtggatgcctagtccactctctagcctcgatgatgccttttctgttcattactcgactttgatgatccagtatctacaaagactgcctccccaggagaactgtaatcggcagtcatagtttttcttaaaccactgccaccacaagaaacaaaccaacaaaaaccaaaaaaacagaaacaaaaaacaaggcactcaaatgtcacctaggacttttgatttccaagatgagtggaaatttcagtggccaagcagccttcacaccaacccaaagcaaagatttagatgagtttttagttactccctgcacagggccacagcagagctcattgcaagggacagggagatatgtcacagagtcatgctaccccaaaggacttgggatccaactgactggctagccagaaagattttggacaacactttgtatcttgcctgtgagcaatgtctcctcttcaggaaaagggctattcattgacttagggcagcttttatatataattagcttggggttggagagatggcttaactcttaagagcactggctgctcttccagaggacctggtttgatttttagcacccacatagtggctcacaaactgtaactgcagtccctccatggatactgcatgcttgtgcacagacatatatgcagacaaaacatccatacacattaaacaaatataatttctctagggaatacttttatacaataataaagcctctatgtttaaggcaactactgcttctacctctttgtgtttgtatgagcatgtgcttgtacaagtgcacaagtgtcctcgtggggactgggtgcaaggtggaggtgga

SEQ ID NO: 26849 - DNA, 1141 bp, Mus musculus
ttattgggagggatagctctgtgggttattgttgtcaatgtgtccacttttggagcagaacggatcctgcctggtgatggcctcggttacagtttacccttggagtgcatgcaaagctctaggttcccagagacttattctatctccctaatgactagctgtcccccacccccacagctgattctgtcaaataggtcacattggaagttcctgcccagtgtcaaatatgaccatgccaacccttctgcttgcaggtgactgagacaacactgaagggtactgcttcaaccaacccagtgttcaccagtgaccaggccactgtagagaagcagtccacagactcgggggcctattctattggtcactagggcctcttcccagggtgccatgcttatccttgggctgcagaaccttcaacaggccactctatctcagcagacagaggtgggagggggagaagaggggctcttatttctgatgttcaccccaaagaccaggtatctagaccctcactgttcagcagacaggcagtgcttcccgctaagacctgaatcttgcctttaccccttgcatgcctcccatctgcttccctgggtcccaagcatccatccatttccaaaggatagagaaaatggtagctaaggttacatccatagaacctaccacataccagggactcccatacacattatctctttgcacccttaaaataatcctataaggtagatttctgggggtggggggtggggggtgttttgtttttgtttttgttgtgtttttaagagaaggaggaatgaactctctaggtgtctactcttctgtgtcagttgccttccctgccttcccatgatgcccaacagtgagctttctcaggaatgcagaccctactttaggagagcccagggaaatgcaatataaactctgatataaattctgcaatataaatttctgatatggccaagtccagcttcagcaggaaatagaaggtgtgactgtcagtggatttttccttgcctcaccccgaatctcaagctcaagctgaggaatagacctttattctcccatgaggtcctcacacatccacacatctggaccctcctccagaatctagacagaagacacacacatacatgactgacaa

SEQ ID NO: 26850 - DNA, 1155 bp, Mus musculus
ttggctggctggcctgggagcagaggccagctgtttgaatacccacctgtgttcacaggcctttgcccagaatgttctgtcaaaggcagatgtgatccaggccaccggagacgccatctgcatcttccgggagctgcagtgtttgactcctcgcggtcgatacgatatccggatctaccctacctttctacacctgcatggcaagacctttgactacaagatcccctatactacagttctccgtctcttcctgctaccacacaaggatcagagacagatgttctttgtggtgagcaaacccctcatggggtgcctggttttgcctaagtttttagtagataaaggtcatgctgcctagaggtccgtgttgttcagtcgcctgggcttcaacgcagccgtgcccgcttgtccttttcagatcagcttggatcctcccatcaagcagggccaaactcgttaccacttcctgatcctcctcttctccaaggatgaggacatctccttgactctcaacatgaatgagtgagtgtctcactggacttccttcttgctgctatttacgtaggaggcaggcccgccgttggacttcatcttgctttgtttgtagggaagaagtagaaaagcgctttgaggggcgactcaccaagaacatgtcaggatccctctatgaaatggtcagtcgggtcatgaaagcacttgtcaaccgtaaaatcacagtcccaggcaacttccaagggtaagaatatgggccgaggatggggatgaggcgggaagtgttgccttagtaaagaagtctctcctgtgatgggtgtgctctggtagaagcctgagtgcccttgtgataggcaacacttgggtcaaagccccctagtggaatctgcccttgggctctgctcctgttggtgctgacaaggcttcctgcatcctccaccaggcactcaggggcccagtgtattacctgctcctataaggccagctcaggactcctgtacccactggagcggggcttcatctacgtgcataagccccctgtgcacatccgctttgatgagatctcttttgtcaactttgcccgtggcaccacgaccactcgttccttcgactttgagattgagaccaagcaaggcactcagtataccttcagcagcattgaaa

SEQ ID NO: 26851 - DNA, 1099 bp, Mus musculus
gggccagagacacagggtgaagacagctcgtcaccttcctttgagactccttctgaagacactggaatggatacgggagaagcacccagcttgggagccaggtacggttctccatcttggagctgggagggaaggtgtgactgttctttaaataaggggcctctctgaggagggaaacccagctctctcagtggactctagtgtttggaaaacagagtcctttagggccgtgactgttcagttccacgttttatattttatgatgaactttgaaacacaaaagttaaatgcattctattttagaagatgaatgtaaaatttgaggcaccattttgggctttctcaatgcgtgagttatggctgtctagggaagtagaacctgctacatctttggtttctggtgagctaacactctctctttctctctctctctctctctctctctgagagtttgtgtgtgtgcaggcacatatttacaagcttctgtgcctgtggaatgacactacctctgctgtcatctctgtcactgtcttatctttttggggacacattgtctcactactctgaaacttgccaagtaggctaggttggcaggccaaggagccccaggcgggtcacctggcttctgcctccccaatgctggtattataagcatataccactgtgtctggccttttttactcccgcaaagcaaagcaaagcaaagagaagacaccgtgggatctggggactgtgctcaagtgttcactcttgcaagggaagcacgtcaccaagtgatgtatcttcctagtatggtttctgctgagctctgtcggcttcaagctctgatggaaaatgagctcctggaatgcttgcacaggtagtggaaggaaccctgtggaagcccaggttaccgaagcctatgttatagtggacggtgactctgctcgtctgatcaacggtttgggaactcaggaatctcgcctgctcttgtcgtagtacccagaagagcagtggccgaggaatctgaagttgttgagaaccaagtccctgccctgtgaccttgacccccaaccctttttcttttctttgccctggctgacctcgagacactctaggt

SEQ ID NO: 26852 - DNA, 1198 bp, Mus musculus
tactgattcttgggcatctcaagtctctgtcaggttcttgaggtgtcctccaccttccgactccctctcataaccgctttcaggtgtggccactattcaaagcagatttctaaggagtgggggtctgccggctgccccactggggttggttcttgaagagggagagcagcattctcttctctgttcaggatggatggaggaggctccctgcaggcttaacaggacagtggcagcttgaagatggctttgatgatgaggcttctggaggctcccactaagcagccatgtgtttttggacacagctacatggtcatctgagcttagaatttatcccaggcacgagcacctgaatctcattgtatataacagaaaacatgtttcatccacagctggaaggaaatcactgtttgggtgtatgctgtgtttctgatacatgtcctttctgacacagtaccatgtttggagagagctgtgtgctctgtggccatgcacgtgactcagtgtctaatatctaggacttgaagttgagcaaagttttccagacttacctgactaatgtctggtgagctggtgctatgagcgtctaatgtggggaaataaatacaccatggagtgcttacctttcaagaaaaatttggcgatttcctttgtatcaggaaacccttgagaatgggtcagagtagtctggcttggagcccatgtggtagtcctgactctctacccacctctgtgacctcaggtgagtaacctgaagcactgccttttctcctcagggtgcctttggccttctcaacctcaggacccatatcgtcataggtaaactgagaatttactccaggcactcttggagtttgcatgaagaaggtttacacgtgtaaagtgatcgaccctgcctctcctggcctaattgcttagacaaacaaccaaacaaaccaaaaacagaaacccaaaaaaactagtctcctgtatttttatctgttttgcaagtgtggatgtgaagtgtccagaaagggaggccccttggggatatttttgttgctgccctcatgttgaacaaatacactgtggatggcagtcatttggtcagactgctggcaggaataactatgataaactagcatggtgtgggggtgcgcttcagcctgatctagggccatctcatcctggagagagtggcacttctggggctgccagagct

SEQ ID NO: 26853 - DNA, 1179 bp, Mus musculus
gcccaaggacattgagcttcaaatcacagaacatattctttggttcataagtaatcccaattccattatccttctgtcactgctgcaaatacagatatggcaacatcagaagcactcaagatttccagagaggtagatgggcgcagaactctaactataatcactgaacttgatctcatggatgtgggtactgatagcatggatgtattgatgggaagggttattccagtcaagcttggaataattggagtaattaccagaagatattaacaataagaagagtgtaactgattcaatctatgatgagtatgcttttcttcaaaagaagtactcatctctggccaatagaaatggaacaaagtatcttgctcggaccctgaataggttacttataaatcatatcaaagattgtttaccagagctgaaaacaagaataaatgtcttagctgctcagtgtcagtcttttctaaatagctataaaaaacccgtggatgataaaaaagtgctactttactccagcttattatgaaatttgccaccgagtattgtaacactattgaaggaactgcaaagtacattgaaacttctgagctatgtggtggtgctagtatttattatattttccatgagacttttgggagaaccttagaatctgttgatccactaggtggccttaacactattgacatcttgactgccatgagaaatgctactggtccccatcctgctttatttgagcctaaagtttcatctgagttgcgagtcaaatgtcatagtaagcatctagaggagtgcagcctacggtgtgtggaactggtccatgaggagacggagaacatcattcagcattttagcaattacagcacacaggaattgttactgttccctaaacttcatgatgccatagttgacatagtgacttgtcttcttcctaaaaagaatgaatttatgaagttcctcggcaaatggatggacctggagggcatcatcccgagtgaggtaacacaatcacaaaggaactcacacaatatgtactcactgataagtggatattagcccagaagcttagaatacccaagatataagatacaatgtgtaaaacacatgaaactcaagaagaaggaagaccatagtgtggatactttgccccttcttagaactgggaacaaaacacccatg

SEQ ID NO: 26854 - DNA, 1117 bp, Mus musculus
gagatgcagaccagaaatggactataaggtggtatgtcttatcatctgagaattctacccttttcatctacagtaggtgcaaactcagagtccttgatttgaggaggaatgtgcaccatgacttctggagcatacagactggatcccatgaagataactgcccagcacagatcgtggcacagaagcagccagtggagacctgccctaaccctagaagggagataccttttatggtggtgaccgactttgaactcacgcaggagagtttcgatgaatggaccatatacttgatgcagtggatccaggagagaaaatcttccattcatctatgctgtaggaagctgaacagttgtgcctcaccagtctctaatgtcatagagatctttaaattggtggatttaaactgtatcctggagctacagctgagtcagtggtggcctgaagtcctggaagaacttgatccttacctggagggaatgaataatcttcacacactcatgttagagggattgaagcccttcagatttactgcttgtgaagaagaccaggaagacgagtggcaaagcacgttgccttctctgctctccaactttggcagtctccagaatctctatttgaatgatatctaccttctagaagactcccttgacaagtggcttgggtaaggggagatgaacattctccagaccatagaaaacatatctcttttccttagaagttgttagtaagaccttgatggtctgaccactgtaaacctagaggtgttagagacaaacatagcatatctgaacatatgagttctaagctcagatataagtgaccatgtaccagcatgcttctaattgctcatgtgcaaaaggttagtttgagtgcagaaagggattgaatatagatgatgggaaatgtgtatgacatttggtttgaagatggggaagtggacaaagttgtggtagggaacagatcaagggcttcttagggacacccctaggataaagctgaacccatcatatggacagactaaatttgggacaagtgttacctgccctgatttcaataccattttgcaaaaataatcttcttgctctctccctagctgcctgaagacccctttgaagac

SEQ ID NO: 26855 - DNA, 1190 bp, Mus musculus
ttttccctgaccaacttatcactgagtagagagctgttaataaatatgtagatttttttgttgtttctgttgttggaggatacctttgaactatagttatctgataagatgcatggggttatttccatcttttatctgttgaggcttgctttgtgactgattatattgtctattttggagactattcaatgaggtgctgagaagaaggtatatttatttgtgtttgggtaaaatgtactatagacatctgttagaaccaattgaatgatctgtccattggtgaaagtggggtgttgaggactcctatcaatgtgtgtggttcagtgcatgagttaagctttagtaatatttcttttaagaatgtgagttcccggactctgcatttgcgcccacctggcagccagagccgggggtgtccactgcagcccgctgccagggtgtcgcaccgatgcatgggcagcaacacgggtcacgatgacagattatggcaaggaacaacgcaatgagttggaggttctggagaccatctaccccaactcctgcacagtattatcagaaagcccaccaagcttcaccattactgtgacattggaggctggagaaaatgatgaaactgtccagactactctcaagtttacatacagtgaaaagtaccctgatgagactccactttatgaaatattctccaaggaaaatctagaagataatggtgtctcagacattttaaaattactggcattgcaggctgaggagaatctcggcatggtgatgatattcaccctcgtgacagctgttcaagaaaagttaaatgaaatagttgatcagataggaacaagaagagaggaagaaaagaaacgaaagaaaaggaagcagaagaagcagagaagaaactgttccttagcacccctgttatgattgagaatttcttgcgttggaaggccaaatttgatacagaactcctggaaattaaaaagaaaggaatgaaagaagaggaacaagcaggggaaaataaactaagtgggaaacaggtatttgaaacagatcataatcttgacacatccaatatccagttcctggaggatgctgggaacaatgtggaggtggatgagtcattgttccaagaaatggacgatttggagctagaagatggtgaggatgatcctaactacaatcctgttgccccagggagt

SEQ ID NO: 26856 - DNA, 1171 bp, Mus musculus
ttaaaaaacaaaatgggcttaagacctgaatagagagtgatcaacaagaaaaacaatggctaagaaatatcacaaaaattgtttatcaaccctagtagtaggaaatgcaaatcaaaaccacttgagattttattttacccagtcagaatgatcaagatcaatggaaaaggagaaaacaaactaggaggggatactggaaaagtagaactgttattcactgttggtggattgcaaactggtatagctacttgggaaattagtgtgaagaactctcaaaaagcaaaaattaaatctgccactgaaagtataacaacgtaaaaacagaattctaggcctttaggcccaggcttgggaatgtggcctttgtaaaggtatgttaatcataaaagagatagcgacattcctctacccacccgcttcctgggttcaaagagtgctcattcaaagaaagtcaccctggccattaccagaacctgcaatgcaaatgtgctattgttagaggctcttagaagctgtcttgagagttaacaattaccaggtattccttgtgactcttgtaactttacacttcctgtgactcttaactggtatctttggtatcttccaacaacgccctccccacttccttgagtttcggtttcttcctttaaatacccccttacccagctactcggggcgccatggtcctctacccctgcgtggtgtatgaacatgggcccgagagcgctcttgaataaaaatcctcttgcaatttgcagcaagacccgtttcttgtgggtgattttggggtgtcacctctcctgagtcagaacgtgggggagccctcacattgtgggtctttcaccacatgacccagctataccactccttagcatatcctcaaaggacattctaatcaccacttgttaagctatgtcattgcttccttagtcacaataactagaaatggaagcaaccttaatgtcctacaactgatgaatgaataataaaaatgcgacacatgtacactatagaatactactcagcagtaaagaaaaataaaattacaaactttgcatgtgaatacccagaactagtaaagatcttactgagtgatgtaatccagatctagaaagactaaacttgtatgttctttctcattggaggtactaacctctaatttttcatttat

SEQ ID NO: 26857 - DNA, 1212 bp, Mus musculus
gagctccagggtactggttagttcataatgttgcacctacagggttgcagatccctttaggtccttggatactttctctagctcctccattgggggccctgtgatccatccaatagttgactctgagtgtggggagcgggtgtggcggcagtcccaaaggcgccagggactgcagctaagtcatatgacttgcacctgacttcctcatataagacacaaacatcttgagtgctgctcaggtgtaccaggatacaggtgaatccaatttggtggagatttgcccctgctgccctgattagctgaagctgcgtgcctggtgaggtggcgtggcctgctgtgcgtggatgggaactgagagtataaaagagtgagaggcccagggttcgggggagatataaacgagggagatataaaaacaagggagatataaaaacaagggagatatataaacaagggagatataaacaagggagatatatggagaaagaagaaacaggactgaataaacgtgtgcagaaggatcctgttgcagcgtcgttcttgctggcgagttgggggcacgctcgagagttaatgatccttccgcaggtgcgggcgggcgcgacccgctccggggacagtgccaggtggggagtttgactgggcatccacttctgtgtttgctaggccccggcctagtctcacaagagacagctatatcacggtccttgcaacaaacgcttgctagtgtatgcaatggtgtcattgtttggaggctaattatgggatggacccctggatatggcagtctctagatggtccatccttttgtctcagctccaaactttgtctcagtaactccttccatgggtgattgtttctaattctaagaaaaggcaaagtgttcacactttggtcttcgttcttcttcagtttcatgtgttttgcaaattgtaccttatatctcgctatactaaatttctgggctaatatccacttattagtgagtacatatcatttgagttcttttgtgattgtgttacttcactcaggatgatgccctccagttaaaaccatttgcctaggaatttcacaaattcaatctttttaatagctgagtagtactccattgtgtaaatgtaccacattttttgtatccattcttctattgaggggcatctgggttctttccagcttctggctattataaataaggctgctatgaacatagtg

SEQ ID NO: 26858 - DNA, 1561 bp, Mus musculus
gtgtgtctctgtgtgttttatagcgtggtgatctgtgaacatttcagtgtgaactcagaataaccccttttcccctcgaagtccactggctttagtctatctgcagtgacacacatcagtatctactgtatatataaatactaaactcttacaccagtcattcctatgaattgaggtgtacaaagtttgatttgtatcaaagatgtaattattatttttaaaacctcttttcactacactgctgctgtaattactttgaatttttaaagaaaaaaaatgtagttttttttttttttttggcttcaggtgtgtattcaccaagaatttcagaatttatgtggttttattttattggtacataatctgtaaacttctcaaggcattaacatgacaagatttgtgtcttttattttatcttgtggctcaggttatatttgaagaagtttcaagtttatcttctagtaggcaatgaagtctatataaggtcttatgaaggaatcgccaggtccctggactcctgtggctgttttccacagtaacaacacatcctgctgtatgtttgggacaatggtatcctgttgaagatgagggtgggtcttctccaaggacctggccactgtgggccccggaactgccttctgatgttctgccttctctgttcctcgtgtcaccagcactttgatggctgactggacctgatcatgagtatttgtagggttagagagggtgacccataattgaaagtcccctgctgtgtttcagcgctgtagtgctgtggtgtgtaccccccccccccttttcctttgcggtactgaaaggattgaaagaagagggtcatggcattgtcatgctttgggggagaattttacttctcacatggaaactgcacttttttttttctaaatcctttgcattttgatgttcatttagtgtacagccctacagagaatgggctggcccaggtagcttgggccccttgactcaacttcactggggaacttgactctgcagttgtgaatcagggaagccatgctgtctccaggtgtggagtgaagctgaccttgggctcattatttccaaatgccctgtcaggtctgtctaggatgtgctgacttcggggtgctatacagaggggcctgtcctggcaatagttctgtgcaccacctctctgcctcctcagtttgttaggaaccattgtagagggtggtgaggggtccaatcccatgcagcgcctatgccctgcctcatctgccagaaagcatgaggaaaggacttgcccctaaagtagtcctgtagaagattagagtcccttaaaaaaatcaaagcaacataatcataatcacaccatataaaattgcaaaacccagagccgtctccacttcttcccgtgtgggtctgcaaagtctttaggcctcagccccaacaagccattcccagtcccaggaggaaggctagtggcagagaggtctggagttccaaatgggcaggtcacaagaaggtcaccatgccattccacatctggaggaggactgtgtggtggagtttgcatagcacagccatt

SEQ ID NO: 26859 - DNA, 1177 bp, Mus musculus
gttctggtctgggaaggcttaagggcaggtcttgtgacggacatgtgaagtagagcaccatgacatgttcaaagcactcagaagagcccacggcactctatttcaaggaaactagcttgccaggcaggctggtacacaagggcctgtctgccgttccacatgcagatgggtttgggaaagttggggatggtggtgtctgagagtgccattccacaggtaggcctcccggtcaggtctaggaaataccactgtgactctcttatctttggccccggcattgacctggggatttttcaggactctgcttggctcggccctgctaatgctgggtctaaccagcagtgttgaagatgtgccagggtactctgatccctttccaggctttgcgagtctgtttttccagctcggttacttgctggcacacataggtcaatatacaaggtgttcttggagacgccagggcctaatgttgacttttgcttcctgggatgtgttctgtggaggaagtgggttttcaggtggtggtgggaatgggatgtggtctggagtgattggtactgcacacagagaataaggttagctaggaggggggagcttccccctgctttgtgctcttgggctgaagtgcctcaaagggagctttgtgagttggggaggtgccctgaattctgtgtgtaattttaacatttgaaatagcaggcagaagcacacgtgttcgctttattgcatatacttaatttatttctgccaaaaatgtataagaagcaagttcaaatcctgactttgacatttatttgctagttgtgtgagctcttgccattatatttagccttgctctctgagcttcgtgttcctgggttcaaaaaaaaaaaaagcagaacaaaactcatagttacaaggttttcttgcataattgtctgtaaagtactcagtgtacagttcttgctacaaagcaatttggtaatggtagcttttatcctaattattagagaggcagttgggtatggtagtgatggtgacagtcctggcagtgacagttactgagtgctttcagtgtgtcagctgttcttccaagtactgtgtatcagttagcacatttaatcctcatgataacccaaggaagtagatgatgtcataacctctttattgataatacatgcaggcacagagaggttaa

SEQ ID NO: 26860 - DNA, 1190 bp, Mus musculus
gaagagcaatctctgctctgcctggctcagcattcccggcacgaccttccagggagcagtctagggcccaggctggtcctctcgagtttcacccactgacttccttgctttgttttaattgtggagttttgctatttgaggcaatcctggtggtaaatgtggtatatataccccattctctcctatcatttgtttattaatttcatcttactagtgttaggtctgtgcgcgctctctctctctctatatatatatgtaaaatattatcatcatgaaatcctctatgaaacgtctttttttttccccctttttttcgagacagggtctctctgtgtagccttggctgtcctggaactcactttgtagaccaggctggcctcaaactcagaaatccgcctgcctctgcctcccaagtgttgggattaaaggcatacaccaccacgccccggcttgaaacttttctttaatggaggctttgtagttaatttgtgtgtcactactaactgtttcactttatgtggatatttaagtcaaatcctgtgggattccccccattgtgttacaagttgcaacctattggcaattgtagtgttccgaagacagcctgagcctttccttctaccttgtttgcttgtggtgtctcttgttcaccacagtgtgccagtggaggtggcctggagcgtctggagattttcttgcctctaccacccttgttgctgaggagtgctggggtcacagacacagggactgtggcacctttgtgagggttctgagaatctgaacttagctcctcatgtttgtatagcgaattctttacccattcacagagccctctcaccagcctacaattcaagatttaaccccaaatctgcctgcctttaaatccagtgccatctctgatggtattatgtctcctgtgtccttacctgttggagttccagagtcttccagcaaaaacaggtctgtattgctcttcatgagtaagcatatcttacttgcgatctccagaagtccgtttactttgtatttccatggctgactgttgttaagggctttgctagatgagagtgttcctcatctcacatgaggacgggttgtcttatgtagtgtacactgtgtgtctcatattaaaggactatcacatggtttggaaaatatcacatgtaagagcaatatttgatttaggaagg

SEQ ID NO: 26861 - DNA, 1194 bp, Mus musculus
tgatgactggaaaagtcaggtaaaaattaactaatttactaatttaaaattaatttagttaatttttttcagttgttttccttaagatttgttataaatttggcatgttaatttctgttactcttttgtgatatttcatttaggctactttaagaacatgcattttcaaacatcatttggacttgggtcataatagccaagcatatgaggccttgacccaaattccggactccagcaggtactccccaagttgttttagagaaagcagtttaccaggcctgtgtaactcaccaagacagttcaccctcacctgctgctttctttctaggcagttagactgtttgcgacagctggtggtggttctatgtgaacgctcccaactgcaggatcttgtagagtttccctatgtgaatctgcataatgaggtaattaatttgtccacttttgtctagtaacaagtcttttggctgccatgattgctactaacttcaacatctgattgcttgtcttttgttaggttgtaggaataattgaatcacgtgctagagctgtggaccttatgactcacaattactatgaacttctttatgcttttcacatttaccgccataattaccgaaaaggtgagcagctgagccagaaccttggtggtaaaagcagctttgttaggttaaccctatttccagagacattgtgtataggatatgtgctttaattatatgtaagatttatatatttatatatatttaaattaacattgaaagtttatatttatgggctctcataacattttcaagtgacttccagtaaaccggtactggaataaacttcattcattttctgcctgactataaggggagtattgattttctcaaactggaagtactttgtgatccttagttttagtttctaagtccttggctgtctcccatttttattttgtttcctagagtaaaatcctaactgcttaacttcttaaatttccttagttcaccttaatataatagtcttccctatggttaaattgccatatcccttcaacattatgcaaattctttaaaaggatcacaatttagccaggcagtgatggctcatgcatctttaattccagcgcacaggaggcagtcagaggcagacagatctctgagtttgaggccaacctagtctacagagcaagttccaggacagccaggg

SEQ ID NO: 26862 - DNA, 1384 bp, Mus musculus
gtgataatatattggaccaaaatgggatttaccagtcagaatcagaaacattcatgcatacaaactttgggaaaggtgaaaaataataaaaatatcctttgattttattctgtatattaagatttatcttttaaggaaacaagtctctatactatttgtttgaatgaatgccctttgacatctgtgtttttataaactttagaacgtatactgttaacatcctatttgttacatagtttatagctctccaatgcagaatatgacatgctatggatgggcccttgcccttgaagctttctaaacttacggctctccactacagcataaaaggcactggcctgtattcaaccatgttcaattgtagtctgaaaattagcataccctgtttctgccatatctgaagagcaacaaataagaggatagcggtgctgcctcgcagttcacatagcactgcccagcctttcctgtgctaaccgccatgtcaaagccagtctgatctccgctttagtctacccgtctcattttgattccagccagagcaaagagacttgtgctctcactgcaatgtgtttgccgccgtggctctgtgcttgggtttactgtaccctgtgaggttttattagtccacagtaattagaccatggcttgttttgttttgttgtttgtttgtttgtttctgtcagaaagttgaaaggctctctgagagtctagagaaatggctcagtggttccacaggctggccactcttccaaagaaccggagtacgagtcctatgcagctcaccgtcaccgtaacaccagctccaggggctccgacaccctctctaaactccactggcacctgcactcatgtacacacagaaacacataagtcaaaataatataaaaatcgttgatgttgttgttgctgtcttaaaggttctgttaggctaggagtgtgtggctcactgatagaacatttgcttagcagatccaaggccctcaatccccagcaccagaggcatatagtaaaatgtaactgcaatggctgtaacagatgtcctgactggtatactagatttggtagggctgagtgccaaggcctttgtttgatccccaataccacaaagggagaaggaaaatgatagtaacatggagttttcatattgatatttttttaccagatatattactgtcattattgtaacattgcaaaatttgctatacaaattttatagtgtatacaaacacactacttttttaataattcctttcctttgccagccctccccactggatcccagctgcctaaaacccttagggtctgccaggataagtggtacacacctttaatcctagtgctagggaggcagaagcaggaggacctctgtgagtttgtggccacc

SEQ ID NO: 26863 - DNA, 1154 bp, Mus musculus
cttcactgaacccccaggggcaggggagacacaaaattacagatttggagatagctcatctcttaggaataccagagttcacttcccagtaccaccaccaaccagctctttagctccaggagatataaaagccttcaggtctcctgaagcacttgtgtatgtaggacagaggcagagacaggtgggtctctgtgagtctgaggactacatagtaataccatttcaaacaacagcaacaacaagcaaagcaaagtacctgaaagatcctttttttccatttcctccaatataagatttcatgtatcccaagctggcctagaactcactgtaaccaaagatgatcttgaatttctgctcctcttgcctctgcctctaaagggttaggattagttataaccagcacacccagtttcccccggtctctgtgtgctgtcgtctagaactctacctactaagctgcatcccaagctccagttgaagaccttaattggctttttgagattattagagtcaaatgactggttgttctgtgaaacatgctgcagggctagagagagttcagtaaaatgtcagctttatgacctagtccaggctcctaggctacacacatatggtcatatatgcttgtgatgcccatgctggagggtagagacaggatccctgtggtgctggccagccagactagcctactcggtaagatccagactaggagatcctgactcaaaaacaaaacaacaaggacatttcctacaaaatgacacctgagacctgagcttgacctctcgccgccacatacatacaggtacacccgcatatagagggaaacacacaaacacaaaaatatgtgttgtgggctgaagagatggctcaggggtcaagcacaattcccagcaaccacatggtggctcacaaccatctgtaatgggatctgatgccctcttctgggtgtctgaagacagctacagtgtactcatgtacataaaataaaaaaaattttttttaattatttttaaaaaaaaatcaaaaaataaatgtgaaaggcaatttgctctaggcaatgatggtggcacattcctttgatccccgaactcaggaggcagaggtacgtggatttctgtgagttaaaggccagcctggtcttcagaacaagttcc

SEQ ID NO: 26864 - DNA, 1198 bp, Mus musculus
tcctgctcttcctgtctctttctactgagtgctagaactgagtgctggagttacaggtgtgggccactatacccactttgtatagtactggggagccaggcttagggtctcctgcttcaagcactctcatcagctgagctctgttgctaacctctggaaacacccttttcctgtcttgtgtttggatcattctcacttgacttttttttttttttttcttgccaaatttgagtatcaaatagtttagtaaaactatgttaaatctcttctgtaaagcaccttgcaaatctttggccttccctattatggttattaattgtaaagtgagtcattggctgtaggttatagctgacctctatttttaaagtggcaatagaagtcattacaggttagcattagattatgagaagtgttcataatgactagactgtttcattgatcataattttttgcttactgtgtcttcatgtaggggtctcattcctcgcctcctaggtgacatcatttctttgtggctgtgtaactcactggcctatctcatcaatacctatgcactggacagtggggtaggttatggctttggtaaaatatgctggtgagggctttctttgtattcactggcagccattttagctgtaagaaaaatggtagtttgttatatgctagacagaacattatacagtaaaaactattatttgacttttcaaaggctgatggcatggccatgctatttcctatagagggataaacctagaaattccctcaagtctgacttgagtgtgctcatggatctagtcctgatgttgtcagagcttcatgacttttttgttttttgttttttttcttttctgatgcttaacttcagagtgcacaagacagagaatagctgtttggtatatttggaggttttctgcatcttctgggatattaaaggggctcctagaaatctcagcctgagaggttttgaggtctgaattatctcttgtgtatagtataagtaagacctcccacaggcttttttctatggtgtggaactgttaccaacacaatttttcatttttcaaatattgatacgagtacatttcttcctaatccatcatagtgtgataagaatttgtcaatattggtggatgaggacaatccatttagaaatcttttgatttcagtatgtcagttgtcttgattggcagttttttgt

SEQ ID NO: 26865 - DNA, 1144 bp, Mus musculus
tgaaaaagactggtataagaggtacttaatgaaaatgctatgacacggctttactgggtccagtcttgacgtactcatttcagttacatctcctagaaacctgtccagttctgtgtgctggtttagatttgccgtgttcatcttcatgctagactttatttctatttcttttcttttccagggaaatatgagccgaggaaacagcttgtttttccggaaggttccttgtgggaagacttactgttatgacctaagaatgttaatctgaagatgtggggcagggacagtgacatttctatagtcccaatgcacagaattatgggagagaatgttgatttctatacagtgtggcacgcttttttaataatcatttaatcttgggaaaatggaggtgattggtgtctgccttttttgttctttgtcctagcacaacatcttttaccactggggttccccattagttatttgaagtgagacatttatttctccaaattcttgttttaaacagaaaacagacacatttccctaaaggaacaagcaggttttcatgtagatttgagtctcaggttagggctttgtcaaatgaagaatagaaccccaataagaagcagctaattctataagttgataaaattaagaaagcataccatgtgggagtttatgaatgacctgagtagacagatgctagaaagtcagcagcaaccactagtctacctcccaccatgcttccaagcagccgacccatcttacctttcagtgctgctgagttactgtagatttctgccttctgttcctacagaagggaaaggcatcaccaccaccaagaagaaggtcaggtacagaggcttaaggaagctttgggaaggaagggagtatgatggcctttcactccaaagaagctcctagcctcgtgtagcacgagaagcaagcactgcagcacacacagcagcaccccgagtgctcagtgcccacagcctccaaggtctggcctcaccgcggctcccattgcctataagcttctgctcctaagcgtttgtttccttcttgttactgcagaaggtgagtagtttgggtcttatttctgatgacacccttgaaagtgtaactccttatctgatgacgtggaccaaagtccacatggttc

SEQ ID NO: 26866 - DNA, 1161 bp, Mus musculus
tgagttagaaatctgtatccatcccgatggagtcatcccaacgctgacttttctcagggatcacaccaatgcacaattcaaatccttggctgacttgacggcagtggatgtcccaactcggcagaaccgttttgaggtcagttaactgtgagatttggtagagtacttgccctccactcacaatgctctaggttgatccccagcactgcataaagctaggtggactggtacacttctaatccttggtacacccgagtctagctctgtggaagtgacggcaggggggccacaagttcaaggtcatctacagtcacacagagcattcaaggaaaactggcaatatgagatgagatgctagcttataaaaagattggtggcattttaggactaaaggtgagaaagggcatagaagacttcctgagtgacagctactatggaaaccagagccttcgtagttgcagcttcggttcaggtcacacagagcataacaggatttttgcccagttttgtttgttggcttccttctttcctttttccttctttttttttttttttttttttcttgttttgagacaggatctcactgtgttggcctggaactacttagcttgcagaatgagttagaactgtaggtccatgttacaatgttttgctctgcttggtttttctgaaagtaaatttgtgctgggtgtagtggcacatgcacacagcacttgggagacagaggcaggcagctccctctgagtttgaagccagcttattgtacatagcaagttctaggacagctagacctggtctcaaaaatcaaacaaacaaaagaataacattatacatatgtgtgtgcactgggccttggacctggagccctacacttgctagtcaagtgctctaccactgagctatagccacagttggggatttgatattttgtggttcaaaaggatattttgtggctggccttggatttttttttttttctgttaactagcacaattagaagatcatataatattaaaatatagaatttatcttggtgactttagaatgttcatatcattgcaggcataattgctcgaagcaaagaacccaggaaagaactgttagagaagcaattattgaaaatgtttggggggctggcagtatggctcagtggtagaacac

SEQ ID NO: 26867 - DNA, 1256 bp, Mus musculus
tggttttcaaagtgctctctatggagtcttcatttacttgaagaaaactgattatacattattcactttatttatatgtgcaagtacatgtgggcatgtctatgccttggcgctcatgtggagatcagaagacaactggcaggagttagttctctaattttaccatgtgaattcctgggaccaaactcttggctatggttttcaggcttggcagcaagtacctgtatccactgagctaccttgccagcccaaatctttttaaaagttaattctgagagtccttcagcatctgctcataggccaagggcattgttatacctgctccttcttttcttggttgattttctaaccttgctcttcaggtacacaactggagcccagaggaggctatagaagcgatcgccaaaatccggtcacacatctccatcaggcccagccagctggaagttctcaaagagttccacaaggagatcactgcaagggcagcaaagaattaactactgattatctctcatgctgacttaagagtctgaagactgtggataacaaagaacttggatctccctgagatatagtaacaagtttacaggacaaagcagcttaacccgaccacactgcaaatgtgctgactggtagataatgtgtctcctttgccttccttcctgaaataacacttggatggctacagagaacaagattgtctggctaaatcttattttctttgacagggataaggaaatattaattttaacagagatctgttgtttctaatgtgtgtaatggcactgtaaatcaaagacatttaatcctagagagggaaagaagtatctagagctgttcttattactgtcagaatccaaatcttaattgtatgacttggcaaagtgcttgcccagcatgtataataaggccccaatttggtccctagcaggtccaaaaataaaaataaaaatacagttttcccctggccctgtgggactcccctcacacttctggggagtgatcagaatgttcaaggatatatggggtgtaggcaggactgctgagtcaggatggaagaagtctacaattagtttccctttagaagtcacccattcaggagtcaacacagacacacaaatcatttcagaaacgtttatttgtatgaacagttcctaactctttatttagcttagagcctttaaaagaccagagactgtttttatttgagtctggaaaacagtttctgctattaatcagaaacaattgtttctact

SEQ ID NO: 26868 - DNA, 1102 bp, Mus musculus
accaggctgacctcgaactcttgagatcagattgcttctacctcctgagttgttgggattaaagaggacgtccaccaggctgtcagcattgcattttgtatttagcggtgttcttcggcttttccctgctcctacctaattcaattcgtatttgccttaaaacattttaaagctgggctatacagagaaaccctgtctcaaaaaaccaaaccaaaccaaaacaaataaaacagtttttaaaagggattttacaaattcattttttttatgccaggcatggtgacacatacctttaatcccagtatttgggataccaaggctctatgaattcaaggccagcctagtctccatagcaagttacagaccagccagagttacatggtgagagcccttctcaaaaaagagaatagtaacagtaacagtttattgcatgtgggggcagggtgttgcacagccatagtgtgtacatgtgcaggtctaaagacatcttggtatagtggcttctccttctacccgtggcatctgaggaatgaactctcgttcattcctgtaatagctttatgctatgagttcatattttattaatgataccttcatttaagtaaatttttaagtgttttgaggaacaaatcaccctatgtttattgtattttttatatctttgtaggagccctggtcatgcagttggttagtgtgtaacatttatatgttatcttttagtacaggctttcaggcatcaaggcaggccatgaagtcagggtcctctcaccttttccccttcccatcactgggataatagaagtgagttatgacttgaggccttccttcaggtttttgtttgttttgttttgtttgatagaacattttcttgccctgggtgtcctgcaactccctctgtagacagacaaatctgtctctgttgctgtctctgcctctgcctcctgagttattggggttaaaggtgagcaccaccactgcccacccttaatgtttttttttataactatttatttattatttatttatgcatacatgactgacaaaataatattgtatcctgataggaaatttaatgaaccattattttgcaaagtttttgtga

SEQ ID NO: 26869 - DNA, 1162 bp, Mus musculus
tgtagcccaggctagcctagcctctaaatttaggatgctcctatctctgtctcttgagtactgactggggttataggtgtgtcaacaaacccagctctgaagttttatggatctctttgatccaggttgtcatcttctaactttggctcactgggacagtcacagtgcagctcagataaacctcggacttttaagagcctcctgcttctgccgatgcattctcaggtttggcttgttgtcattgtttttattttttgagatagggtgtcttgtaacctaaggtttatgcttgctatgcagctggggcagaccttgaactcctgacatgttttcctctcccaagcgctgagattatacgtaagtgccaccactcttggcattttaaaattttaagattttggaagttgatgaacacagcactagtcttgtgttcaagataattgacactttgttagaagcagttgtgaatcttaaaacctagtcttctaaagtgttccttttcctaactctaaaatatcattagtcttatttgaccaatgaattttcttttggatacaagatctccccagtaagctggactggaactgtctacctcgttttattacatttatttatttgtatggatatgtaagtgtaagtgtgtgagtgccaatggagacagaggacaacttgaaagagaaagttttgtccttccactatgtcgtaacttgggatcttattcaggccattgggctttgtgacagggccttctttttttcttcccctttacctgccaagccttaccagccctgcctttgttttgctgtttgttctcttcctggctgtcatctgaatggatgctgggattatagatgattacaggtatgtgctgtcatacctacttctccttcagttccttttgggtaggtgagtggattaggtattgcgactttattgatttcttagtgaactagggtgtgtaaatctcttagctctatctttgtagtccaagtagttctccagtggtggtaggaggtactggggattgaacccttggcctcatgtatgctaggcaagtgctctcctattgggcttcacccccagctgtttgttctttcttcctttttcctcctctaacttcttcctcttccttttctaagatttatttatttaatgtatatga

SEQ ID NO: 26870 - DNA, 1175 bp, Mus musculus
caaatcttttaaaagttaccttattggagccagagatgaagatgaatgcttataggtccagcagttcatgctaagacaggagaatcattgaacctagtagtttagaatcaatcttagcaacatagtcaaatctccccattttaaaaatgaacagaaaatgattactagaaataaattgcctttgccattgtctgtcagagagtcacttgtgaaaaatagaatgcagccgtcatatcttcacaaaggagaatttctgccttgactcaggaagaagtggtgtaaattataggtgtctgtccacagcacgcagcagcagtcagagaacagtgtatagaggtttgtttccccttcatacattctgtgggtttcagagatcacactcaggccatcaagtttggcagcagtcatttttacttactgagccatctttctggctccaaaagaaggaatttgatcctttggttttggtgtttatagggttgctcatccccaatggtggtaaagtttgccgacacccagaaggacaaagaacagaagagaatggcccagcagctccagcagcagatgcagcagatcagtgcagcgtctgtgtggggaaacctggctggtctgaacacacttggaccccagtacttagcagtgagttctgtggtttgctttctgcagactttgcaagctcccagctgtttcttcttctgctgtctctagctaacaagcagtgtcatttgcaacgttggacatgtagagatattatataaaaatgtaggcattgtcattaagttgtgttagtctaccttatggttccatattgagacttttgttacaattaaagtaaaatgttgattttaatttaaagaattaccagtatctcatttccctgcctctaagagaaatccttaagaaaatcttcactattcaggatcattttccatgtctctttatataagatgttgagatcaccatcaaaatctttattaagtcccctaaaaacatgacagatgtatctttcagcagactgaaatatgactttgagtcatacagtctaaaagaaggtccagatctataatctattattgatgttatgttataatttatcataatattataggggattattagatttttgagtcacaaaagaaagggcatctttgtccatagttgcacatgactatagt

SEQ ID NO: 26871 - DNA, 4091 bp, Mus musculus
tttgttgctgagaccctgcttgcccagagactgtcttcatgtgttaggtgctttgcaggaaatccaagccttaggttcccctctgtctctggcagttggatgttctcttggtgtccttcatgtccttttgaactttcccctgtgtccattgttagcatgtgcaaaagttcttgtcatttcccacccctgcccttccccgtctcctcatttcagggctgcatacagtgagtgtcctgttctctctctctgtttggatgtattgctctgtgtaactcagtggatctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtattttattatgtttgtttctttctttgttttttcttttttctttcttttttttttttcccttttgtgctgccaaattggttttgctagaacgactgctgaagggaaaatatttaaacttgcatttgaatataaaaaaaaatctatttttctagaacttcataagataaccacttgattttgtgattccaattctttgtaactgtctcagagcagccctactagcacatgccgtgtggtgtttgtatccttgtgaacacacagccagtccgcttccaggctttgttcctctgtgtgcttagttttaaagacaactttgaaataaacaatgaaataaaagatgtcactaaaatctttgaggctcctgaacacattttgctgacatagttttggggcttgaggagaccgcatgttgttattaatttttgtttttctgagttctcaactgcagaaaaatgtctgaaatacacccttacccccattcccttttcactgaatgctgaggtttgggccccagctagccttttttcttttccttttgtggttcttcctgaagcagccctgcagggaagccctagggtccctcttcccctcccctcccctcggctcagccagctcacacccgtgcttcttcctacagtctccacagcaaaatgtgatgctttcaacttttttgggttttgtattcttttgcctttttgttttgaatttttcctttcctactaagattatgcccagaaaaaacaagttgtgcatgtttcctgctgtttcttcacaccttcgtatgtatcaccttcacctctctgttttctatagtttgtgcaaaaactgactgatttaaaggggtttcaaagaagatgttttaaattgttatggggttgattttttttctcaagattgtatcgttttattttgaagtggcaactttctcctctattgcccttagagtgtttgcctgtgcacttagactgtcactctttgtggtggcctccaggtctcagtgggggatccaggaggctggctgctctgctcagggagtacagggggccagaggcagaagcagaaccaaaggtggctgtgggtaggcaggatgcttagggcatcaaggctagatcacggagggagggagggcaggcgggcagtacttctgattacccagaggaggccatcggtgcactgagtggcaatatacctgcctgcctgcgctttccctaggtgacaagcacaataaatactacagtcttcacactgtttacagctctgggcaccaaccaccccgcactggctcttcactatggctctgctcttacttagctaatagagttggggtaagggcaagaaactgtttttaaattgggtgaagagccagatagctactgttcccgggtgccaggccagccagttctttggtttcctaagggaaacttaccctcttctcttgtagcaccatccagcctcagggtcttggggacttggaagaatgtgaatagaggaggagaggctagaggaaatgagtagacagggatggatctgtgaagagcagaggctgcagggaggatttttgacagatcccactgagacttaagcactggtgggagggaaagtggaagcaaggttgtccaggaaagggtggcaaggtgcagcaaaggatgggggtggggagagaagcacggtctggcatcatccactctctgcctggtgttgaaggaactccagcacagtttctgctctgggacccctacaggttgcccaatatattatgcttgaggccaccttactaggaagaaatggcagccaagtgggggacttaagtatgctgcttaaggtcctggaaggggtggtaggatgccagcgcctagcatgagagagcctgctgtgtgcccacagtctgactgcacagagcgcctctgtcggcaggaggtgctgcggtccccttcctgtgtactgagaagctgggcttgccaatatagtttgctttcgattccaagaggagctctgggaaaacctgtggataaaaccaaatgccaaatgttggacattgtttccttttccttttctctctgattgttttaattgttccgtagtggttttaatggatttgagaccctggagcggcagctgcctttctgatttccagctgctttttgtgaataatttaaaaagaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaattgccactatgaccaaacgcacagtctgttctgcagcaacaacgggattcaatcaactcaaagtcgtgattcagccgtagaaatgcttttcttgaccttgtttgagctttccttttttcctgtttgatttataaaagatgtcttttgtgtgtgaacttgtgttgtactctgtagaaaattatggattttgctttaatggtttttaaaaaaaaaaaagggcaagaagagcccgtgtcgcttttcttacctaatcacagtttgtgtagtggattaaaaaaagaaaaagttgttaaaagtttggagcaagggagtatgtgtttaaaaggactctccttcctttttgtgtgtgtttccttttgtcccaatggggaacctaaatctgttttaattgcacagacacacagacaaaaagtcattttgtatctgccaagtgtggtaccttcctttgtttatttgctattaaactgtttgagaagaactgtttgtcttctgcgttgtcaattgcccgggaaagggggggaggggaggggatgggatgggatgggatgggatgggatgggatgggatgggatgggatgggatgggatgggatgggatgtgggtgacttccatgctgacagaacctattgataattcagctgaagtcacacagagctcccgaaggaaaagacagtttctctctggaatgctagttgtgtgacatgtctgcattctacaaagtaaccataatatggaaacaccttgaaacactttggtagctttaatttgtcctccctcttccattacagctgatggcctgtgtgaatcctagatcatggccttctcttcaagcctttagtcttcagccccaaaagtagttagacctttaaggtgccttaagttaattcttcaggtattctagatcattctctaatggagcctcctgcctaggactgcctttgaacttctgggagcttgcagttcagctacttgtgtctaaagaggcagagactctggccgagcaacagccctgtctctgtccagtccttcactacagctaccaccctccatggagactcctggtactgggtggtccagtcttcacagaggtgaagccgcctctctgggcgctagagctgacttgtgggtggagcccctctatttggggtggacctggtgggtagtgtaactcaggtatttcctggacactgtccatttgataatcacatgaggaataacagagctcttgtcaaccacacttgcctttaattactgttttttaggtctccatttctgctcttaccccctgccccccctcaaaacagaatcctgccatgtaatccca

SEQ ID NO: 26872 - DNA, 1118 bp, Mus musculus
agcccagtagatgggcacagcccaagcatggcgtaggagaatctaaccaggaccagatgagctgaagttagatctatccagtttccagcacgtgacctaaacctctaaagtctgttgtttttgaaacttgagaattagccacggtgaatctcaggcacagtgcctggcatgagggcagatgatgggcagccacatcgtgctggatgatgcacggcttcatcagcaatcctactgtcttttgtctgtataaccccatgttcccaactcaggcaaactttcttcctgggatctcagatgcagggttctagaagtctggtgtatcagtgatcctgtaaatagctttgtccaatctcatttatactgagaagaaaagtcagtaaagacttgcctgctagcagaaagcaagttgattattgtgcgatgggtacatagtaggacatcttccctttgctgttccctctccgtgactaatcaagctctgtggtgtcttgtttctccagtcctgatgtgaactatgaagagctggctcggtgcactgatgacttcaatggagcccagtgcaaggccgtgtgtgtggaggcggtgagtggtcagcgtgggtgggtgggttattggaagccttgctctttccctgggtaggtcagggacccacacttaggaagttggaagtgcagggaggcattctgggtcttctctgtccggctgcagggtatgatcgcattgcgcaggggagccacggaactcactcatgaggactacatggagggcatcctggaggttcaggccaagaagaaagccaacctacaatactatgcctaggggacacctctagtctgtccgctggtctgagggctaaagttgataataaaaggtgttttctgttcttcgccacagtctttctcagcctctgtggactctgggtgggagtggaatgtatggagaaggccttttgctcagaagctacagcctcaaaaattctatagatggccatgggacccaaaccagctgtctgggtgaggccccatggcaggaggtgcaagcacagctgttgcctgagtcctccccagtgccccctcccccagcctctttatgtcatctttccactgttcattgccatc

SEQ ID NO: 26873 - DNA, 1183 bp, Mus musculus
ctagctggtcttctcttacgtctgagtgtctttgtgttcatctgtcacggggctaagctagcctcattactttctcttcctacaatagcagactagccttctgttccctcagggctccagagtgtgtgtgtgtgtgtgtgtgtgtgtgtgtgtgtgtgtgtgtgtggtgtgtgtggtgtgtgtgtctgtggggtcactgtgagcccactattgcctgtccttgagatgtttgcactgtggtcccttgtcctagtccttatatcctccagtttaggagtcttctctctgtcctctatgatctggcactgtggggcacctgggacagttccactctgggaagtgaaagacacctggggacaaatcttcctggctgagggcctgggaggaggaggggaggttcaaaggaagctcagtaagtggtgggcgaccttcctgcttcctcacagtttctaaactgtgggtgcatgtcatgctgctgcctgccccagctccatcgatgggtgtccctgagtggctgccatgtgccgagctgggatttgtgcagtggtcttcctggcctttggcatgagaggacggaggaatgaggtgatggtgtcccagacagcaccagctgctctgcctaagggccggggataggtgggtcagggctgagctgagcccagagtgcacgcctgtctgcaggcagagtctcctggcttcagtgccagaagaaagctatggactggataggaggagaatgtaaatatttcagctccacattatttatagaaaaatgtacagctgtgtgatgtgaaataaatgtcctgaactccacttgggctcctgtgcactcctctcagcccgggcctgaggaaggctgtccctagctcatctgcatccagcgttggcatactgagagcctgccctggcctcctgcctcctgggcttcctggggtgccagaaaggaacacctacgacactacggctgtaaagtcctgagatgttctgggcactagagaggaggtgacttgggcattcacacctgaacagcttgataaagaagtcacaggaaaacaggggtactgctctgtgaccctgtacacgtgtgttcagatgtgctgtggtgacctgggcctcccaagggccttcggaccagggttctgtaaaaaataaagtggtaacccatgtccaaccctcatgggct

SEQ ID NO: 26874 - DNA, 1117 bp, Mus musculus
ggccaatggtgtgatgaattccttacaggtgaggctgcgctgctggacctgggaaaaagtttgccttctactgtatctaatatgctgagtagccatgggcagctctttagagagcacttgggtttggcagggtagttactctccatccctgagtttgggctaagcctctccctaaggtgataatgtgtctgcactgatttgcctaagcttgttccttgtactgctctctcctcctcccaggttctgccaggcaggacttgccttttccttagtatccaggtggcttttaccccagcttccaccacaaacttccaacatgggggtccccagccctctgcagtagccagccctcattctgtgggaggctctgactttgtgtttttattctccccactcaggatcgctacggttcctactgatccaggctccatggctcaggcctgtggtgacgacagcaagaaccctgagtcccaggctggagatgccggtcttgtgggtctggggagttgttgactttgtgtgtgtggtgtgtgagttggatgacttgggaggatcttggagcggggaatggtcggcatcagcccttgtcttcagcctgtgcatcgagtccttgtcctcatcccctcacactctccctccatgctagtgttcttctccagtcttgccccaaagctgctgctgcttggcctgctgcactgggagtgaggggggagctccatcaggatggctttatggatctaattcttccccaaggagggaaggcacaaggcttctgcaggctctaggatccttgtaggtggtctgggggcttgggcgtccatcttctggaaacaggggaggcctagcaagagttgtgctgtatcagccctcagggagaagttctggactcgtcactgctgttcctgtcagtggcctcttctgggttccagggaagggttaggagaaggatcctggtagctcaccaagagctagaacttttgcttggtacccaaaggttttatttgggattagcccggaggcctgagcactcttccattgtcacagctgtcccttgaaggctgacttctgcctaggtgtttgagagcctttatctaccattactgtgggtcacagcgcc

SEQ ID NO: 26875 - DNA, 2288 bp, Mus musculus
tgcctgtaactctacctccaaggggattgaaaacctttggctctgtgggcacctgcattctaatgtacacacacacacacacacacacacacacacacagagggggagggatatcctgtactaaggatatgatttcaccatcattagttccttcacagtgtatttcatggcctagacgctgacattctgccctgaatataaaacacacattggggccatttttttgcaggacagcttataaatttaggatacatcatcatttagactccagttgctagaaatgtagtctgccccatttccctatgttggctcattagctgtatttttcattctccttctgtatgatgacaatgacattgctataaacttcatggccaggttaaccctttcataactttaaaggtctctaacaccacatattgccatatgttcccagcgaccctgtagtgcattaaaagttaatttctatggtagttttctatgagaatagtatttaatctgctgtttctttgcagcactgttaatattaggaaggctgactttatccaaaacggtaacatactctgttaaaggccgtagacagcctccctgagtggactcatcggtgagaggggatgcattagatggttcttgagatgtttacctgttcagctcagtgacccatgccctccttttatgtggtcaccaaatgaaaactggaatttggaattaatcatgtcccctctttgcttgccaccttcagtttagtgtctgtgttgctacaaaaatggacatgtttttcccttgacattcttctgtcagagttttctggagtctgaaagctgcctcggtggtgatgattactggatgattgcctatactcctatgggctctccattttcagattacactgggctgtacggcttctatttctttggcaggaaaacccaaaggcaacagaatacattttttcctcctgtctctggcttagtttaaacagtgactcacatggaccctggggctttgcttcgtattctcatctggggaccactttctacccctgttttaatttgtctctagtgttcctttggaattctttatattctatggcacataggatgtgtctctgagttagacttgtggtgtacacggtacagtagtagccctaaagaaaatgacagtccaggtctgtcctcagctgtgtcagccttgcagcagtcaagataggttggactgctacaaacaatgactttagggaagccaggcctgctcagggagtttgcagagccaggcggaggggggctgggaaaggattccccagaaacctcaagtagtggtttcatcgaagtgaggataaggatgctctgttaaccttaaaacttccctggaggcgcactcagaagaggtggtcatgagtttatagaggctgtggttgtatgaagtgtttctcatagaaggacttgatctaatctgtagttcggagttttgttagtggaaaacccagacacccctccttgttcataagtggttctgtctggttttacctttccattctggatctagccttctgagtctcatctaataagggattcttcatttttctctttctagttttaacagcgtatgccaaggaactcacattctcttccgggaattcagctttatacaagccacacctcataatagagcatcattccttcgggccttctggagatgcttccgaactgtagggaaaaatggtggtaagtattctcaactctattttgccccatttccaaccaccccctttctattctttccaaacattttccttttaaaaaatcccatttatatattggatatgtgcttatgtgtgtctgtgggctgcaaagtgacctattcaggcagttagagtgcacgtctggagataacggtgcacagctgaagttcataggacagactgcaggagctgcttctctgtccaccctgtggcttctggggattaaactcacgtcaccaggcttggcagcacgtgcctttcttccaactgatccagcttgccagccccatctgttattattattgtcctataaatacagtttgactctaggctttggaataccttattctgaggagacaactctgctgggtcagaaatgttattagccatcgcgcagtgatacccatcaggaaccaagtattgctctgaggacatgaagtataataactcgctcaaccttcatagcagctctccctgcgagctactataatctccatcttataagtgatgaaacaagactagagggctaagcagtgtggaagattacata

SEQ ID NO: 26876 - DNA, 1151 bp, Mus musculus
aagctccacttctgggataagtcttttgtccctctaggtatggttggtactccacaggtcttcggtgctgctacctacaaagagctctcagagacatttgctctacctcatttctgccaaacactgactcttgtcactaagagcagtaagttacccatagagactaggtcctttatgagcgattgctagcctccacaggctgggtatgaaagctctagtctcccaggctgggtgtgaacactctagcctcccaagctgggtgtgaaagctctagccacctagggtgggtgtgaatgctctagtcccccaggctgggtgtgaacactctagcctctcaggttgggtgtgaacactctagcctcctaggctggttgtgaatgcttgatgctcctctttcaccaggttttaataaatgtggctcaagaaatggcggctgttcccacctctgtttacctcggccttctggtttctcctgtgcctgtcccactggcattcagctgaagggagacaggaagacctgtgacccctctccagaaacctacctgctcttctctagccgaggctctattcgccgtatctcactggacaccgatgaccacacagacgtgcacgttcctgttcctgggctcaacaatgtcatctccctagactatgacagtgtgcatggaaaggtctattacacagatgtgttcctggatgttatcaggtatgagtggcactggaacaggtgggggacacagacctgatcctgagcagtcatgtgtgaggttacattctctattgacgaataagcggactggatggcttggccgtttgacatggagttagatttctgaccacttcacagtggtccacacttacattgcttgtttgctgttttggtgactgtaaagctactcaggggcctgagattggaagatcgatagttagaggcctcataggcaaggtccagtctcaaaagagtaagagcagagttgcttaccatggttccccacctacaatctcagcccttaggaggccgaggcaggatggcttgggttgacgatcagcctggacaatgtagcaaccttctgtctcaaaaacaataaacaggatgcagctcagagtgctcgggaagtgcactctgaaagtgaaagcactggggggtgggg

SEQ ID NO: 26877 - DNA, 1198 bp, Mus musculus
cacctcttgcactctatcctgggccccctgaagctgggctcagtgtgattccttgtcagcacagagctccgtctccctttgccctggcatcctatgtgcctgccccacagcaccgatgcaattcatgatataagactctggtcttccccatcacagctggcatgatggcctccctgtgaactggcctaccaggggctgggactggaggtcacaggttaaaaggtaatggacagaggttgagagaaggaagaagcagcccagctggtctgggtgcttgggaaacctccagcctcaagtgttggtaattatgaaaaaccttggggggcggggattcgagccctggaatcatgtccattgctggcagtggacattctcctcatccagaagtcactgctttgtcagttgtgatacaggtgaagtgtgggaatggcttaggctcttcttcctcctgctggaatgtctggggccatttctaccttggataactggatagctcctgccatggcaactcactaataggaattccctcctggtgctgtgatgggccgtacttttcttaagcctttagctatgctgtgagcttgagtgaacattgggtgggccttggagagcagacttgtagaacgtttaagaagctctgcaaagaaagcatagcatcctacccgagcttcacctattctactcttctctcttccattctgtgggattctaagggaaacaattctgtcacagcctttcaaagactggctcaacattttcctaaatggtcagaaagagcaactagagagacacaagacacccaggggctcaggaggagaattgtgaggttgaacctcttgagttcattctcaagtgctcagggatccaagttcatggacacagcctgtggctctcgggtggtaaaggtcatgtgccaactcttctcagcccctgtccacactaaagtgccagcattagcttcatgctcctttaggccaagggcttctctcaggggagctgagatttttttttttttttttttttttttttttttgtgctgccctagaatctcatcccagtttttctacttctgagagaggggagtctagccttgctttctctaaccggtcctgtgtcacctcaatcgctaatgtccaatgatgaggagggtcagtgaagatgtaaagtggtaagcaaggagtggagaggtggtgagaac

SEQ ID NO: 26878 - DNA, 1183 bp, Mus musculus
tcaatgcaaaaaatgatgaaaacataaaaattaaaatcttgtgtgccaatgagatggcttagcagataaaaatacttatgatctatcctcacaaccttaatgaatctctctgacctgtgtgataaaggagaaaagcagctccttcaagctcgcatctgacctgcacctcctcctgtctcatgacttcccacatacatacatacatatatacatatacatatacacatatacacacaatcaatgaaatatgctttaaaatttttttttagttcataagttaaacattgagtggtacatgtttttcttgtattcattgtcatctattttaatagataaaaataaaaattactttggttgttcaaaattttgatttttatctaattatccttatagatactgcatcttaaggttccgtgtaagtgactgatgtcattggctcctcatgctgttctgatgtttattcttgttcaggtgatgcagatgaagcttcacattgttgctttgattgcccagaagggaaatttttctaaaacgtctgctcagattgtattagatggccttgtagacaagattggagatgtgaaatgtgggaacaatgcaaaagaagccatgacagcaatagctgaagcgtgcatgctgccctggacagctgagcaggtgagttccagagctgtctccctgtgttgtcccaggttgtccccaatgttaactgaggcctaccaatcacagttaattcttgagtatagttttttataactgtggggtctttgtgtatgtatatgccctggctgacctgcaacttactatagcaaataacattaattttcttttaagacactgtaattcaaatggatcagtcaatgaaagtttcaaacaagaatgttttaaaactctgcacctcatttctttttaggataaattaagtcttttgttaatagatccttatacttaacacctagaaactcatatttaataagtgactttaatatgcctcatatttaatatatgaatttaaattaaagtcataacttatttctatgagaaatataagaaaagtagagatctgatgctatgttttctgatgctattgtttcaggtgatgtcaatggccttctcacaaaagaatcctaagaatcaatcagaaactctaaattggctatcaaatgcaataaaagaatttgga

SEQ ID NO: 26879 - DNA, 1136 bp, Mus musculus
aatgcgtgaaataaccattgcactcagaaaaggtctctgtcattcctccttgaccaggttggagaaccaaaggatgtcattcgtaaagatgtccgtgctatcctgaaccggatgtgccttgtctacccagccagcaaaatgttccccttcattatggaaggaaccaagtccaaaaactctaagcagagagcaggtatagcaaaacatatatatatgtgtccatctatctttctagagttgctgagagctgagctcagagtcccatacgtgctaggcaagttctctacactgagctatatttctcaacccaccccctttcccccaaaattgaagttaaggtgcaagtctttgcataagtgagtctcaagaagtcatttataaatgagcagtgaaatttcttcagtgtctgtgtagttgattccaattttcttcttcaaactgtgagagtgatgagttgcacactggtggagccatagtatcaggtgatacaggcaccactcagtactaccctggtgacaaaatcaagtgcacaggggccatctgactcacaggcataccttgtcatgaacacttataacaccattgtctcatatatgacagtgtaaatgacagaaaaatctaaaaagacccagaataagatttgtcacttcctgtgtgccaaagaaaagttgtagaagcttctataccatatttttttgagtttcattaatctattctttcttccccaatagagtgcctggaagagctaggttgcttaattgagtcctatggtatgaatgtttgtcagccaaccccaggaaaagccttaaaggagatagctattcacataggagaccgagacaatgctgtacggaatgctgccctcaacaccattgtaacagtgtacaacgtgcatggagatcaggtgttcaaactgattggaaatgtaagtgacacttctctgtacgccttgtcagtatgttgcaaaaagaattccaagatttcttggttgttgggtttcctgccatctcactctactggagtttcattgattattaagcttaaccatcaagatgtcctagatccaggtatgtatttcaggtgctttcattgttgttggacctctttactgtgtttgaatagattttttttttttt

SEQ ID NO: 26880 - DNA, 1136 bp, Mus musculus; identical to SEQ ID NO: 26879

SEQ ID NO: 26881 - DNA, 1196 bp, Mus musculus
ctcctttcctctgtgtctcacacagagaaggctttgccattcccttagggctgaggctagagtccttgatacagaccatgttagcagcacacatttattcaagaatttgttcacttggggcttcttccactccccatagttaggatataaaatacaatgcttagttcttcctagtgtactgcttcctaccagtttcttctacaggcaaagcaggtcctatttggcttttcatggataatcggggatcaaaaatagagtagaaaggaattagggttagggaaattaattagggttgttttttgttttttgttttaacattctgaggttttaaaaatgtgttggtacaaacatgcaatcccagcacttagaagtttaaagtactggccagctgggccacagagtaaatctttgtcaatatatatatagctgaatattgactagaatataccaactatgtttttcttctttgtctcatatattgagttttaaccttcctaacacagttagaactggatagctatttcagatagagagcttggcccgggaggcctccactggagtactgaaagacctgatgcatggactgatcaccttaatgctggattctcggattgaagatctggaggaaggacaacaggtgattcgttctgtgaacctcttggtggtgaaggttttggagaaatcagaccagaccaatatcctcaggtatatttataccctcgtcagtaaaacttgggatagtctcttatttgtctacagatagaaatcaggtagtcagagttgtgagtggctcagtcagtagagtgcttgcctaccattcagagtcctgagtctgccccccacccccaccccacctgacctctaaaccccctggggcctccagtctcttgagggttagctgcttcatctctgaatgaacacagacccagcagtcctctactgtgtgtgtgttgggggccttatatcagctggtgtatgctgtctgtttgatggtccagtgtttgagagatctctcgggtccagattaattgagactgctggtcctcctacaggatcgcccttctcctgagcttctttcagccttccctaattcaacaacaggggtcagctgcttctgtcctctggttggatgcaaatatctgcatctgactctttcagctgcttgttgggtctttcagagggcagtcatgataggt

SEQ ID NO: 26882 - DNA, 1178 bp, Mus musculus
aagtaatggaggaaaataccctatgtccatctctgatctccacatacatgtgcacacacataataaatcagtattatacacatagagaacatatactcacctaaaattagagccttgaatttggaaaattgatgataaattatctttattttttagtcactccttctgtttcttattttttaatggtttgtttatttttatgtgcattggtattttgtcttcttgtatgcctatgtgaaatattggatcccctggaactggagttacacactgggtcttctggaagagcagccagtgctttttgtatggtttgttttttgggttttgtttgtttgtttgttttttgagacagggtttctctattgtatccctggctgtcctgaaactcactctgtagatcagactggtctgaactcagaaatccgcttacttctgcctcccaagtactgggaataaaggcaagtgctgcggtcacccagctgcagccagtgctcttaactgctgagccatcttttaccctctggtttcttattttaatagtgtctatggagaatggttcgactattacctgacaccatcaacagcattaacctagacagaattcttctggacatccacattttcatgaaggtctttcccaaagagaaattgaagcaatgcaaaagtgaatttcctataaggactctaaagacccttctacatactttatgcaaattaaaaggacctaaagtgagtaagaacaacaattgatctcttgagtacattacatggaagtcattactagcatttgaatgtgctgtctccttcagatcctagaccaccttacaatgattgataataagaatgagtcagaattggaggcccacctgtgtcggatgatgaagcatagtatggaccagactgggagcaagtctgataaggaaacagaaaagggagcttctcgaatagtgagtagcctgaattcccaggggtgggggtggagtcttaggaatcagagtaagcggtctcttgatttgctgttatcgccatttctgcctaatatttttaaaacacttgagtagtgaacacacgatttttgatctccaaaaaagagttctgtgtctgtgcccaaagcatggttagatcattaggtaagtccactgtgagctctacttaactggagaggaatggaccagcat

SEQ ID NO: 26883 - DNA, 1472 bp, Mus musculus
cctccctaggtaacacaaatggagaagaagtggggccatctgtctacttggaaaggctaaaaattctgcggcagcggtgtggtcttgacaacacaaaggtattgttcctttctgtgtggggtggagaggagcgacagagtcacctcagtagagtggcctgcccttggtatacactgctgaagagttacatcttgactgctccctgaacttagcccatgtctccctgtcctctctcaacagcaagatgaccggcctccactgacctctttgctctccaaaccagcaattcctccagttgcctcctccacagacatgctccatagcaagctctcacagctccgggagtcccgggaacagcaccagcactcagacctggattccaaccagacccactctgcaggaaccatgacctcctcctcctccacaactaacattgatgacttgaaaaagagactggagagaataaagagcagtcgcaaatgaagctgcccaccctcggcactctgcagctttagttactgatctagaagccctgtagtgtgaagcggccgctgcaggccattgtacacaaactggttgtatgtatcagactgcagatgggaggagcagtggtgcctcaagtctgcacatgctctgcttctagaagactgactgtggattagcttagtgtacagactttaaacagctgctccctcagctcagagtaggttccatatcctttttttttgttttgttttaatggctcatttgtaaaattgtcctaatttttcctagctttcagccattagaaactcttttaatagttccttttgagttgtgagctcttcttctgtagccctgaagggacactgtattctgtatgaatgcatggcatgagacaactaatttaagagacttttataaataaagtttgcattaactatacccatttcccaaaatgctctgggagttctgggcaactattttctgtcacctatttaaggaaagctaggtcaatttattgagttcaggtagagggttaatggcctgcttaggtcgtctcctttctctaaattcacaagttggggttgtagctccactgaaacaggagagactttctggcctgctgtccatatgcagacccaaggagcagaggaagcccatcctccctgtttggaggccttggtttatgaccttcctctgctcagctcctgttgtttggagggacatttatgtgtcctactgctttgctgtaccaatgacaagagattgtttgggccaacagttcccacaccacaagtgaattgggttcactggtgcatctgggagagcttgctcttttcctgcctcaatatctggtccagactaattgcttcatgctttggtttgagtgagtacaaaaaatgtgaaatgaagattcacttccagaaaaatggaggctcttcctccatagttagaaaactgtttcatgagtaaaagtttctgggttctag

SEQ ID NO: 26884 - DNA, 2272 bp, Mus musculus
atttcctgactgccttcctggtgcaggtgagatgtcccctggcttcctcagcccacctggtgaggtgacggggaggagatgctctcattgcttggatgctctggaaggagctgctgggagtaggaggcagaggccagagattctagctgcagccctttccttccacagatatctgcccactgtgaccagaacaagatgaccaacactaacttggctgtagtcttcggccctaacctgctctgggctaaagatgctgccatcaccctcaaggctatcaatcccatcaacaccttcactaagttcctcctggatcatcaaggggaattgttccccagcacagatgcccagggggtctgagctcaccacctccagccccttctctggcagcccgagttggacttgtcctcctggcattaaccttactggagtccagggctcctgcctaggaaggggccctgaagccccagaagatggaagttggagcctactaactgggcagcccctcctgtccctctgcccgtcccaccttaccggccctggaggcctctgttaccgtaagacattttctttgccttatacctctcactgcctctctggttgctgggcttggttcttctaggatttagccacagtaaaccttttcctttttcctgcctgtttccctggcgagtgtagaagactacatcactgctggctgtgctggtagctggggctggtcctctctttcctgattgctaggaagtgagcattggcctgggtgcaagttccctgtgcctgccctccctgctaatagggatgataagaccagagttggcctgtcacttctgcctcctgggtctgttcttccccaagtggtactgcccccagagtgtactattccctcatttctgccacacttggcactttggatatcaagactcagaatctgagtgtctattgaaatggtcctgtccactcccagggagagccgtagtgtctggtaggatcagttacagcagtcctggccctccattcattctcatgtgcacagatcttcagccaaaggctatagtaggtctttcaggtgtggagtcattttgatccctgttctagccagagataccaatgtctctcactttctacctggggactctcggagagtcagaaactcagaagccctgaagactgacagagcttttactaatagatcacccctgctggataggttctagcagcttccttaggggagtgtggtggccacagggcctcttgtctttcagaaagctgagccccagtgatgattggtagctttcattctattcctaatgaagccttgtgactcttcccgaagtccactgcctaatgacagggaggtacctgcagtgaccttgccctacaggtgtggctaggcatgacagctccagaggtggtactggctaccatgagatctgtactgatgatcttgcagctgaggctgggcctgacctcactggctctttcttgcaccactgttgtagcaggtctctggtgccacaagtgctgctgtcagtccccagcctcacacctgacccagcctgggtcactctgcttttgcccacatttttgtatcaagtgttgctacactccatttactgaggagcctttggacctcttgttttcctcctgcccggtcctgtcagtctgtggcaggggacgctcttactgtgaatctagtgttcacatttaccacgatttccttggcaccaatcatgtattttaccgtttgcactttttgtatttcaataaaaatgtaaatgaaaaaaacccatttggctgtttaggaagtaagaccctgaaattcacaaccagacaggaagtatggtatagttgagaaagagagctttagggagtcccctccttagtccatctgctgtctgctaaattttctcggggaaatatgaacaaacctgtactccagataaggtaccaattaatgtccaaaaaaaaaaaatcagtccaagtctgcttgaggattgtgatctcaagaagctgtgtcccagaggactctgtgggaactgcacagatggggtccctcctttagtcagccttcatcttctgcacacttccaaaatcacatgcaactggggcagagttatatagagtatctagttaggtgaccctggctagccagagttatatagagtatctagttaggtgaccctggctagccttctaaaactatgcaggtcaggctggcctaaaactcaacagagatttgcccacctgaatgctgggattaaaggcataagccatt

SEQ ID NO: 26885 - DNA, 2307 bp, Mus musculus
ttatacaaaggatgtttcatctttattttcccactgtcatgattttggctttgtttacctatcttatgagttgtggttcactgggattcatcagagtcctgtgcagccctgtgacacacaccacgaccctaccctctattccccaccttgcacttgtcccttctctcagcccagtgtctgctcagattcccttcctgttagtttgcctggcactgcccagttcctgatttttctactgatggctggctgcctcttcaaggccttctggagtaagcccctcttctttgcctgctacaggactccttaccagagaagctggctgtgcatgagaagaatgtccgagaattcgatgcctttgtggaaaccctgcagtaaaagtgtcccgagtgtctgcagcaccccctttctgtggacccagcagagaacctcctcttcctcagctgcttcctagccttcatgctggttctggccaggtgaaagacagggtggttcccctatgggacctacaagtccctgctcttgaacttcctggagactcatggcagcagtcaggcccagtgccggacttggcgaggactcgggccgtcgagctggaagctggctgtaacagagcctcagcaaggactgtcctcagctgcttcacaaagggtgtcatctgttcttcctgctaccagcctcctgcctgggtctaccctgaggccggcccctacctgcttgtccttaccatcaaccacctgacattccagctggtggctagaacgctgggcaaggcagaaagaggaagaaaaccaaggagaccaacccgggcgaaggagggccctgcatcacttcctggaccaccccactctcccacccttctttctccccttcccttccttccgttttcattcactccctttctcccaccttccatcccttgccttcctgggcctgtgcttttgacaatatgacaggccaatctgcctaaaatgacaagtattccaaagctagccaccatttcccaaaggctgcaacagcctgtttgtagaattcgttattgagagtcacagaaaggttctttcctcgttttccctcaatcgctgctgcgtggatatagaccatggtaaatatttattactttcagagaaatcagatattttatagaagtatgtttggggttagcagttccactggggaaggaggagggtttcttctgggatgtcggcctcccgtgaagattgctcagtacctgtgaggatactcctgtcacatctaaggagagatcaggaatggcctggcaaaggccaagcggccccctcaggctgcgtgtatggacatgtgcaggcgttaggcttccccagcatgctgcgtaccccaggaaatctcgggtatgttcagtgtggtgactcctcagagttgtgttgcacacggtgccccaggagcactgtgtgtcctgctgctcaagttcctgagcctggagcaggactagggagctcttcctccttcctctagtcccagagtctgtacgaggccctggctttacaagctggattggttccccttcaagaaaccaaagctgagcttatggttgacgtaaaccttcaggtttgcttgagtgagtcaagtgcctctgccagcctgctctgttcctctgtccctggatcctcactggcagcagctgttacgcattggagcaggtggctcgcaactgcttgttagaaatctgcatgtaacactggagcctttcccctgtgcatgctttgctgccacagagaaatgtgcccagcggtggtggccaaatgccattgcagcctttgggtcaggggcacactcatggcctacttaaaccagatataccccccagagccagaactgtaggggggtgagggcacgggttctttgcagggctcagccagtggcctttgcagacagcagcctttatgtcctagattattaggaaggaggccagggaagctgagcagagcatccttcacggtagcctctgcccttcagccctacacaatggaaggatgctctctagaccaatgcagccaagctcaggctaggaccaggtaaggcccctccagtgctttgttgggaaatgagagctacacctggaaatataatcaagagatttccaataaaaagttttctgtacttcatagcttcctattccaaatgtcttgacagctagttcaccagtcccacctctgcatcactgagccaccaacagctttcatgagcgaagggtggagcctgaatttcagagtcctgagtctcaaggctgcttcagtcttgagacttgatcaagtaactaacagccctgac

SEQ ID NO: 26886 - DNA, 1134 bp, Mus musculus
tcccctccatggcagcctgcactcagatggctccagcgggggcagcgggggcagcacacatgacgactttgttatgattgactttgtaagttgccaccaccacccttggtctttgctggtctctggagagtaaacttagaagcatctgttacctgggaacaagagatctccctcaggatggggtggtatacaggctacaggggcagcatttagagcctgaggacttttaatgtcatgtctttgcttgaaattcagcttggatgggttttccaaaagccctttccttaggagacgtttgaagggtctaagggtctagatcataagcctaagcaggggaaggaatggcatcaccaggacttgctcatttccagacgagcaaggtgcaaagactcttcctcccacttaggtgagcctagaagacttttcctggctaattcctgactacatatatagattacatacatagccttgtacatagattaacttttttaattcttcatggttcaaagatgaactaacctgagtttgtattgtttttaaagaaaccagctttttctaaagacgacattcttccaatggacttggggaccttctaccgtgaatttcagaacccccctcagctgagcagcctctccatagattttggagctcagtctatggcggaagatttggtatggaaaccccttccctcccagggctcctcctccagcctcctctcctcatctgatagtcactcctgtgctacacttctagaactttctttctgttactccatcctgcccttgccttctatctttgctgaaagagaaaaggagtctttttaactggctttcaccaagtccatggtgcctggcagtcgtcctaaactgccttgagcttgttttcttgttcacagcacttatacttactgtgtgtttgtgcatgtaatgtggcaggaagggggtcatgtacatgccacaacacatgtgtggagctcagatcagaggactgctttgtagagttgctgtctcctgcctttacctgggttccaagaaccaaactcctgttcttaggctcacacgataagtgcgttttctcagggccacacagccggctcttttctgtgctttcttggtgttgctcacacttgctggg

SEQ ID NO: 26887 - DNA, 1170 bp, Mus musculus
actatgccataatgggccctctggacttgaaggtgacttggaagatattctaacaaatactgtattgtgcttcttgcattacaggcaatttgagaggaccccacctatcatggggattatcattgatcactttgttgaccgtccctatcccagctcttctcctatgcacccctgtaattacaggtaagggctgagacgagtctcccccaagctacagctaagcaatagcagcctcgagccatgtgggtagaaatgaaaaggctagttttgttctcgctgctgcctgttaggtacaccaaggcctgagccaccgtatctaggaactaactgggtgttcaggtttgtggccacatcacctcctccaggttatttggggactgcaagatgtcgggactttgtgaactatgaaaaatggtttttggtttgctgtctggctttataatctctggctagaactcgttgacacagctcccagcctttcctaagcactgtttgcatactttctgaagtcggctattgtgattatataaactccatcgtcgttcctccctccctccctccctcccgacggtagaactgctgaggacgcaggggtcgcgtacccgtcagtggaagactctcaggaagtgtgtaccacatctttttccacatcccctccctcccaggtaggaaaagggttatgggggctgtgtgtattcgtgtgggctttagggaatgttgtccaaacttaatctatgccctttggtgatgagatcactctaacatgcatgtgttgatttagttgctccatttttagtttagttttgttttgtttttgttttgttttgttttgttttcaaaatagggtttctctgactagcctttgctgtcctagaactcactctgtaaaccaggctgacctcgaactgagagatccacctccctctgcctcctgagtgctaggattaaaagtgtctactaccactccttgcttattttcttaataagtaataaatttcacttcataatagtagactatgtaccaaagagcaggaagtacttaatataaaattgaaaacaacatgcagaagcactgcttttcttcaagctgatacagccatctgcctgcctggccacgccctctctacctgcctggccacgccctctctacctgcctggccacgccctctg

SEQ ID NO: 26888 - DNA, 1142 bp, Mus musculus
ggctggttttcactttatatagttttgggtgaccttgaactcctgaatctcttcctcctgaatactagaagtgtgaactaccataccaaacactatagactgaatttaaatcttttaaaggcttataactcattaaaattattttcacattcattttaaatacctgcctgcttttaactgtagagtgcattggagcaacttattagaaaagtcttctgcggggctggagaaatggctcagtggttaagagcactgactgctcttccagaggtcttgagttcaaatcccagcaaccacatggcagctcacaaccatctgtaatacaccatgatgcactcttatggagtgtctgaagacagctacagtgtacttacatataataataaataaatcttagaaaagaaaagtcttctgaaggccattgtaagcagcacaggcagcctaatgtccttgggcacacgagaagggatgacagtgtgaatcaccgctacttagaaaagcaactgaatggccaagtacagttgactgttaggaaaagtattggctaagtgaagaattaatagaagtcataacaggattacagctttggaaaatgctgcttccacttctggttcacagatatatgaataaaatgtagaattaaaagacattttacacgccgggcggtggtgacacacgcctttaattccagcacttgggaggcagaggcaggcggatttctgagttcgaggccagcctggtctacagagtgagttccaggacagccagggctacacagagaaaccctgtctcgaaaataccaaaaaaaaaaaaaaaaaaagaaaagaaaagacatttacagttcttttaaagtcatttttacagtcattttaaaggggttacctctcccttttagtattgtcaatggctttcttatttaaagataacttaagatggcattaaggtcagattctctgaggtggatgttaattactctgttttaaataaagatttattgttttgttaattattttacctttaaccctttgtggattttttttctctcctccctcagccgagtttattttttggattttgtttatgtgaataggcacatgtgtgccagggcacttgtgaaggacagagaatgtgtgggagtagtt

SEQ ID NO: 26889 - DNA, 1196 bp, Mus musculus
cctcagtgagtttgctttctgtactgagacagcaggaaggtggctctcaggcatctgtgtatacttcagccacagaagggaggggttttccatcatcagggttggcaactgagtcagatggagggaatggttccagccaaaacaactcaggcagcattcgccatgagcttcaatgtgacctgagacgcttctttttggagtatgacaggctgcaggagctggatcagagcctgagtggggaaactccccagacccaacaggcccaggaaatgctcaacaataatattgaatctgagagaccaggtccttcccacctgcctaccccacacagcagtgagaacaactccaacctgtctcggggccaccttaatcgatgccgtgcttgccataatcttctaaccttcaacaatgatacccttcgttgggaaagaaccacacctaactactcatctggtgaggctagctcttcctggcacgtctccactacctttgagggcatgccaccaagtggcaaccagctaccacctcttgagcggactgagggccaaatgcctagctccagcaggctggagttgagcagctctgctagttcacaagaggagaggactgtgggggtggcctttaaccaggagacaggccactgggaacgcatttatacccagtccagcagatctggaactgtatcacaggaggccttacatcaagatatgcctgaagaaagctctgaggaagactccctcaggaggtaagctgctgctggcctgtgctctgcctccccgcctcttctccttaatgcccatcgtccttcagtcttagcagggttgtggcttatataaagcctctgggacccatgcatctggttctgatcttgcattttttggggaaatctttctttgatggcagagatagcatcaggcctagtgctgtgagttaactgttgtactagtttatttttgtctaagcccaaagctctggttttagccttaaaagggaaatgttgattgggttaaagaagcatgaggagatataatcattggggtttttttttttttgccttgacttttgactttgaaatatcatagatataggactacttgttgagataagactgtgttccaaaggactatttatagtgagaatttttaaaaagacctacagtggggacagatattttgttcagcattttgtgctagata

SEQ ID NO: 26890 - DNA, 1157 bp, Mus musculus
cagtctgatgtgtgaacctttcatttccccgcagggcatttagttcctctggttcttagaattgaacctaggacttttgcagacatgacctgggtgtcttagtgaacaattcagtatttctgtccttgagcctaatctttatctgtcagcaaaagggacaactctatagaatgaagaccaatgtactctcattgtgtgcattacacactatggtctctatgagatgtgcataacaatatgtaccttcaagcaattatttcttatttctgaagccactgaaaaatattttcttcctgaactggttgtattggtggtatatacctataatcccaggccttcagagacagttgcagaaggatctgatgtttaaggttactcaactacatagcaagttctaagtcagcttgggccatatgagagcctacctcaaagaaaacaaaagcaaactaaaaggaaaaagaaattccttttcttttttccttttttcttttttttctccctcttcttcttttcctccctccctccttcttttctttctcccttccttcctttctttctttctttctttttttttttttctctttgtagtactggctgtcctggaacttgctttgctttgtagaccaggctgactatactctgtagctgtcttcagacacaccagagagggcatcagatcacattgcagatggttgtgagactatgtggttgctgggttagtgttcccactaacttagagtttctgttgctatgataaaacaccatcatcaaaagcagcttacacttccatgtcattgaaggcagtcagtgcaggaactcaagataagaacctggaagtagggggctggaaagaggctcagtggttaaaagcactgactgctcttccagaggtcctgagttcaattcccagcaaccacatggtttgatgccctcttctggtgtgtctgaagacagtgacagtgcactcccatatataaaatacataaataaatctttaaaaaaaaagaaaaaggaaaaaaaggaatctggaagtaggacgtaaaacagaagccatagaggaagcttgatcctcttgacttgcttgcctgctttcttacatagcccaggcagcaccccttacccagagatagcagagcccacatgattgacagggagat

SEQ ID NO: 26891 - DNA, 1276 bp, Mus musculus
tgggttcctgggaaaggcttgtctttgtcaactgaggaaggtggggtgggatcagggaggagttaactctgcgcttaaaactatggaaaggctgtcccaaaggtacatgctgctacctgactcccaacagctattgaggccagcagggcagaggtgactctgcccatttccccggtgaggaacttggagtactctgatcctagatgaaaatagaaagttgaaagtcaggcttggtagctcgtgcctgtaaaaagcggcacttcaggactgaggcagtaacactgccttgagttcaaggttacagactgagagacttgagagtctgtctttaaagggggggggggggcgcgagggttaaaaagttgaacgaataaagaaaggtttcatatcacatggctgccctttcccaccacttccaggtgaactggtcagtcaccactagggggcaggattttctctccttgatggacatgtctgcgttgtctggtgagtccgagctaggtcacccaccgcactaatgcatctccgttattgttttccagccaagaaaggaaaaggaaaggactaagtcaggaggccagagagcctccggcctcgcctggagcctgaacggagccctcctctcccacaggcccaagatataacccaccagtgccttttgtcttcctgtcagctctgtcaatcacgcctgtcctctcacgcccacaccaagtgcccaaagtggggagggacaagagattctggaaagtgagcctccccataccctcttttgttctccccaccctgatacttgttattaagaaatgaataaaataaactcacttttttccaataaaagcttcttttttaatatataaaagccccttcccagtttgccatggagctctgtcggaggtgggaagatggggaaagatggactgaggggagctgagggctatgaaggaagtgctccctacagctcgtggaaaaagagcagaacatttacaaaaaaaaaaaaaaaaaaaaaaaaagtctcccagggacccacagggctggggttagggaaggggacctaggtgactcacttgaactctgtcccagctcatcaagagtttctggtccaggctactgcaagtctggaattttctcattggggatccatgagggtgcttgcttgtgtcattcgccactgtgggctgtatggatcaccaagttccccaccatcacctttccctccttggacccatacctccctccgctcagaggtagagaggaacactgcccactgctgttcatt

SEQ ID NO: 26892 - DNA, 1307 bp, Mus musculus
gccactacattgtggaagccggggcctccctcatgaagacagatctgcaggtgagttgcctggcagagcacaaactcaccctttcccagacttgggggcagggctagggaatttcaagctcttctgagccaacacagtccaggccctgagaaacctgagccagcagggggaaagcttgtgacctctgaggataccctccccctctggctccgtagaagaacccctgccctttcctaaggccttgggggcccttccacccttttccagggcgacactccccggcagcgcgctgagaaggctcaagacacagagctcgctgcctacctggagaacagacagcattaccagatgatccagcgtgaggaccaggagacagctgtgtagttaaggggaccatggatcaacaagggacactaccagaggactctccttgcccatctcactgccacattcctgtcagatggctatggggggaccctgccacagggaaggagccccgtgccaccccctgagaagctgttcagatctagggctggactctaaggagctggactctcacctgtccctggtttcatggggaacaggaaacaggctgggctggctggttccctcccttcagggcagcctccagctcaccacagcagatggaagggctggacagagctcagcatcgatgtcagggaggcctgcactcagcaggactttcaaaagccacctgatcctttgggctctctggagggttctgggtacctaaccctcctctctgatccacccaccctgggcatcccagaaactcaagagcctgctgtattcacttgcccgctgccctgcttggcacctaccctggtcttcctcctcatgtatccagccatttcatttcggactgtatggcctggggtggggggtggggctcccacggtgacttgtttacagctgggtgtgactcagtaaagtgaattttttttcctttcttgttttctttttttcttgttgtgggggactcacatgagcaatggtgtgtgctgggtaatccttggggtcggggaaatggccaccaacatctcagatcacttcgggagatgggtctgccccgatcctgacctctgcctagggccttaggctcacagcgcctggggcggagctgattttcccgctcctgcagggatgataacaatgaaagtaaaagaggtggggcgggggccaggcttgggttctttggtcttttggccctgtgccctggagcagtcccctccccctggcttgtactggggggggggggggggatctgcttgaggtgagcctgaggc

SEQ ID NO: 26893 - DNA, 1182 bp, Mus musculus
tctctcttcgctcgctctcttttttttcctacctcctcttcctcccttgaccacgctcgcaatggtgggtagctgcaaggtggccctggcaggggaggggtttgatgtggacactggggcaccgggcgagagaggtctcctttcaactttgtcttgtggcttgcaccccgggaggaggccacatgccgattgtggggtgtagatgtgccgggagtgatttctaagtagttgagttgttgagatgagggtacgacggctagtggtagacaggttttgttttcgtgggtgaattcggtgtcatcatattccggtcatatgttgaaatattctttgtttaggtcttgaagtagaggatctccctctgcacgtccacattgtgttgtttttaaatgatgtttccgggagtatggatttctagaatcacaaatgtgattttaaggtctcggcatgtgtgggcctcagcactggccttgacagtgaactttatggctgtgtttttggacttctaagattttatcccatggctgggatgctcgttatgctttttcttaatggtagataatcaggaatgtagagtcttgagctgaggaagttagagagggaagggcatttatttattaataattgatagctgagtgttagaatcagattcatttgggctggttgaaggtttttggttgttgtttttcctcccttttttctttaaagttgtcctgtactccagggagccttttggcaggcattctttctggtggctctttgggggcacggagagggtgggtatcaccttttagagaggccgtcaccatcatctgtagttttactgaaggcaggcctgctcaggaggctgatattgaggctaagaagtggagggccacttttcagaaaagtatttatgatgcttgtttacatttcatgtttgctcacatttgggcagtagaaataaataggtcagcatttctattggtctttgaaggttagcccccccccaccccctcaaagttttaccatctacttggtttacagccttgtaggaaagaattactgatttttccctgggaatactgttacttattttaatttcggtaagttccttgctattttcttctgtcttcacttatatatggaatctgttgtgagcttaacattagcttaccgagggccattttaaatgtctaagaa

SEQ ID NO: 26894 - DNA, 1115 bp, Mus musculus
cttaggtgaggaaataaaacctcagacttaggtatgttctgtacatgggtagggcaagaagtactgacttacatgtcagccttgcattctgcttctcaacattactaatttgtacaaacaaaatatttatctttttttgctcactttgcatttgatagcagttaacaatcggtcttcagaagaaatacttgaagtgttggtgtacagattttaagactgctagtctgagaggaatttgctttcctgcgtgtctgagtctccttgagggttgatgatatgtggacctgcttccctgaagctacacctctgctcacacatgcagaatccgcttgtgggtatctttaagcataaaggatattgaattctcaaacttgccctaagtagcttacatgtgatttttctttaaaactttgctcaaagtatttctccatgtttgatattgctcatttcttagaagagcaaaggagtttgccctgcttcagagcaatgctggctggtggagaaatatgctcagtcactggggcatctggcctgtggattcttctctcctgtaccctttgctttgctttcctgtgtggtttctgtagtccttgtaagcagttttataatcagtgtcatgatattatcacttcatgcttttttctctttattagcttaggattgactctgctcctgaattttggaggaaatgcctgggcaacagatatacatgcacacattgtaccgtcttcccattggcttctcagaagagtttattccttagactttcctcagtgctggattaaatagacgttaagtcccatcctgccctgactgtgttctagtgtcaatgagttttatatatcctgggtgtatgtatttgtttacttttttaaagttaatttatgtctgtggacatgcgtgccagagcatgattttcagaaatggtccacagtatgaacaagttgtggggatcaaacacgggttttcagacttgactgtaagcaccgtgacccactgagctgtctttctggcatccatgcaccatgtagtatttcattttgtttttcagttgaacacaagttcttaattttagtttagtcctatttattagtctttttttcattatattttaa

SEQ ID NO: 26895 - DNA, 1135 bp, Mus musculus
ggctgcatagacttaggctagccttgaatacacagagatctgcctattgagtgctgagattaaaggcatgcaccactaccgtgcccagtggagttttggttttgtggtccttctagtatctctcttactttagagactgggttttgaacataaaatggagactcttgaaccagagaacctcagatcttgctaccatttaattctattgcctttctctcatggaaccttgtaaagtaagaatcacgattctctaccttatggtcttatagaatcatggaatctgtcctaattggcagtttctttgcctacatccctgactggttgttacttattcgggtgcacattgaatactatgttttaaaaaaatgtaggctttgttttctgtaatgaatatgttttgagaaattctgattccacagaaattgagattgggtctggggtgggaaatgggttctgtggtcaaataacttgggaaatgctgcattaaacaaagttaaacaggtctctttactgcaggacttctcagaacctttaatatgctaatgtgcattgtgaatctccaagatggggatatgatatgcagcattcttgaatacttctaatgacagggagcccactacctcataaggtaacccattccttttttatacagctctaatccttagtccttctttatattaatctgaactctatctcccaggactttgctactgctaagtatgatattgattggttatgctgggacatgttcccatgtcactctttctgtggtctatatttattataagcttcttgccaggctctcctgaacagccctccacccccaaatcatcccacgacctttcagtacatgtggcagccagttctgaagtcccagacactgcatcgctgtgcttttgtgcaccactctccaatcttcatttcagatttctataaactctaaattttacttcagtgttccccttgttgggcgaagttggggttttaataggcgtgcttcctttccctgcaggaagatagggagtagaagagtgggagtgtgcaggtagcctgtgtcccagaagctgagtttgacctgtactttgggatgatggtgggaagaggtgcagcctctgaggagaatgttgtgggaatt

SEQ ID NO: 26896 - DNA, 1211 bp, Mus musculus
gaaggtgagactgggtgtcccaattatgactataaattcagacttttgacatctccacatacagttacacatacgtgtgtaagtaagagtgtaatcaaattcaaatgcaccccccacgatgggagactgggaactccccagtccactctagtttaaaaatgcttgacatgttttgtgtctcagtgttcctgacagtgtcagtctcccctgctagttctcatctggatggaagcggtccttcagctccctgtcctcagtgtgagcacacagtgggtgttcatgtgttcccttgactgtctcttttgctgttgtattccttttcttagttatttgaagtgtgctatagaggaatgcccaaaagagcaaaacccagaaagttttggtactgaattgttttttttttttaaaagtcctttgggggatacagtttttgtgtatgtgtgttacaaaatataatatttctaatttaattataaaagtttcttcattcccaacacaatgattctaaacattttatgatctctacagctgcagcaacaagaggagcttgtaattttaaacggaggctgaagacactgtagaattagcagacataagagagcgtggagaaggcagaggatggagttgcagactctacaggaggctcttaaagtggaaattcaggttcaccaggtatgtgtgtgacagactaccgatgcacactgcgtcactaagcaaaacaggcccagctctgcgttttggtcaagttatgcagtcattctactacttaccacatgactggcgtttgtccagattcactctccacagctgtactttgtatactgcctttaagaactttaataagatggccctgacatcttttcctgaaaagaggactggaaatatctttttcatgtcctaaaggtatttgaaaaaaagaattctattttgctatatttctggccagtttgaaggccttctatatacaagataccttctttgcatgttctgtgtttttatttacttttgctcttttgacagggcctcaggttggccctgaactctccatggaaactacattgacattgaagttgtgttggtccccgtgcctctgcttccccagtgctgcctttcctcacttgactgtggtgagaatgcgatgtgtgcttactgcacacaccaatgcctgtgctcacccctcactctctctgcctcctcgctctctttaactt

SEQ ID NO: 26897 - DNA, 1181 bp, Mus musculus
agaaacaacacttccttccctcgtttcttttcttcttttccttctttttttttctcttggcagtgccgagctttgtaaatgataagcaagtgactattataactgcactcctggcccaacaagcagtcttaacattccaaagtgttccttgcccctaggaggatttaggcccttgttggtattcattcaagctggtattccctgcctcagtttgccagcctgtctccctggtttcatctcactttctccctgttgcatccatccactgagcagcgaaccctaaagccccttcctctttcatgaccttattgaagccttttattttctttgtagttaatgttatttacagtcaggtttgtctgtgaacggctgaaacccccacatacaggtggcttaagcagccatacttggacttctctgccatccgagagctcagcagtcgactaggctggaaggagtatttgtccagtgtcagtgaccaggcacctcctgttctgctgctctgcaattcccagcctgaagcttcgcatcagagtccaaaatagtagctccatctggtgagggggtcagcacagagggagccctttagttttaaggatgtttactggaagctttatgtgccacttccagttaaatctccttgatttgaacatagtcacatggcctcactagttgcagggaagactgggaagtgtagtttatttctggaggccgtggccagataaatttaggcactgtatactgaagcaaaatacagttttacccactgtagcataccacagtttgtgattacatatctgcttataattactattttaaaaatgtcttactaaatggtttcaagagcacagggtgctgacagtgggactgggggtgtttctgactcttgcctgctcttgggaccctttttctcctattgggttgtctcacccaaccttgatatgagggaatatgcctggtcttattgctgtgccgggtcttattgatgtctctgggaggcctcctctattcttgggggtagatggggtagtgtggggctgggggagaggggagaattggaggacccgggaagagggaagctgcagttggcatgttttatatgagactaaattaaaacaaattaagacagggaatttgtttcatttccttcttcatttctagtataatacttcctgtaatat

SEQ ID NO: 26898 - DNA, 1178 bp, Mus musculus
tatatacatgctttagagaactgatagtggtttgaagaagttaagactcctgccttctgtcattgagctcagtgttgcagaaataatccttacgtctagtaaccctttttaaaaaatactttgtgatacttcgaatccttcttgtagttctgtttattacaactaagaacaaactgcttatttaagcgattctgaataattttactttccagcttgggtaaatcatattaggaactcataatagggtttttaaatatgtcagtggttaaacagactactcactgcattataaaagttaacatgtgcacagaacaggacactgcatattaaagagttagcatgtgcacagagaacagacatgataaagcgtgtgtgcagtggagaaggagtgagaacccaagtgggagagtcagagacaatagagatctgtatagcccagatttacctcacacgcctgatcttcgtgcctcttcttcccaagtgcttggattgcaaacacatgtctccatgccccactcaactgatgacactctaagtcagtagtcctatgaaccaagacgggtagacacaaacacaattgtgaatacacataaaaagtgttgattaagaaaatagacgtggacagttatggcagggcctctacctgttacttgacttgtttgatggcttcggtcagtgcctgttgcttaagtgggactctttcacatctggagggtaagtaagcttgtattttgaggaaataagtctttattggcctgaataaattcagaggattaaatcagttctctctcttgtagacagatgtcagatctatagttataagagaacagaaatttcccttataattagaatcatgttttctgattgtgagatctaaggttatttgccttcaaataaaatgtttaagaacatgagcacagagctatgcatggtgatggacgctttcaatctcagcataggagaggcgactttgaggctagcctgctctttctagcatgttccaggacagccgtggctatagcagtgagagcttctgttgaaagttaaaactgtagatttggacaagatcagctgaccctaaaattcctacttgcgtcttgtttgtttgtttggtttggtttggttgtttgagacagggtttctctgtgtagccctggctgtcctggaactcactttgt

SEQ ID NO: 26899 - DNA, 1148 bp, Mus musculus
gcacttcttttcacattgatgccaggagggatatttactgaatatccctaccccatatccttggtctgcccataactctattcatagctctaacatcgttcaagattaaggtgagagggtgattagtaaaatacatgcaggacagcaagcaaattaatagttgtggatgattcacaagacgttctaagaaccttttctaaattgcattaaatgtgtgggtgaacatcacagatagaaactcacagaagactgtatggtttgtattgtggttcatcctcttgtcttctgggatttagcaatcttttcagcctctctcctcatgtgcatgtatatcactgggtaacaggctgattgctgctgatggtactaaaatgttttgatagtagcaagactgcactgccttcttcctcatgagcccagtgccgtgatgacctgtttgcacatgggcccgtggtgtatcattttcccttgtataggaacaatagaataaggtctgactctagttgattgaagtggtagttttagattccagtaagaggacctattgccggtgagggaggttgaaattgcagaatgagtttcagcgtgaggcaggtctgcccagctgcaggttgatttgctctgtgagacaaggagcacacataaacagatggcccaacagtgagtcaaagcgatagatcccgaacagacacgctatcttttgcctgattcttaacatgactgtaaagagtggaattttatcctgccacctgaaggctaaaaccaagcatttagtgaaagaaattccatttgtgaagaaatgcgttgttaggcagaggagaagcctaaatatcactgggtctggacactgagaagccagtagttgcaggaacaggcatgagctggctttacttttggtgtgtgcacattcagcatcattctgctgtgaacacaccaacatgtggcacagtaagacgagagtgaattgatgtctctgacactgggttttaaagacacacaagccttttgttgtaaaaacgtatctcatattgaggttaaggagagatttttttcaaaaaaaatacctttgtggtaagcattataaaaatataccacaacctaagtttgtaaaggtttaagcaaggaaaagttcatggaaaaaaaacaga

SEQ ID NO: 26900 - DNA, 1578 bp, Mus musculus
cagggccgggtccgccccctcctcgctcctccctactcagacttgctgtctccttggtacagggatctcatctcctgtttgaagccaaaatggaatgtgcatagtgtcagggcgttcccacggtctcagaccttgctagaacgcaggctggtgcccacctagcccttcccttggtgctgctctgtcttacagccaccagcattacttatgcctcgggggccccttgggggactgaccagtgaggctcctcactgcctgtatacttggcctccaggagggtataggatgcaggctggctgcatcagggaggaaatgctttgagagtccgtatgtctctaagagcccaggtagccttcaagtccatcttgcgttaaagagagaaatctgaagctctagggggtctctgcctgcccgccccaaggtcagagttcactcccattccactcactcacatgcttcctgggtgttcctgggctagaatcactatgcttgccttgtgtggcctagtgtagacttttcttcttggaaaaatggggttctgaaaggctctctactcatctccccgacaataccatagggaacataactctacgagacgcatgctcccagtggaaatctttatctgatccatgtccttgagtgaagggacagagacctaggctctacccccaggtctgaaagcagcatctctctgagcccgccaggctcccaagtctaggagtagcaggaaagacccctttgcttcttccttgcccagttaggtccatggaaaatgagctggatcctgactgaaactacagcagacaagaggtgcttgtgagagtgagccaggcccatccacaccagccacccattcacttcccagcgtttgagaagagggcaggtagtctggccacacaggcctcagcttcaggcctctggcttcaggttgactgaggggagcagagaaaagccctcttttcttatttaggaactaaggtgctgtctagttagcgggcgttggagatgcctggactagttggatctttggcagaggatcagagaccagctgcaggctgatatcctgtctcagctcccccaacctgccaaccccctgttggacttgtctgggcccataggctggggcttggcacatactacctacctgtgatgggaagaggttgacaagccatcaacaatcactacaggcctttgctccagaagagctgctggtggcagcacgagacccgagcagcatagactcccatcttctgatgtttggaaatgagttgctttgagtcaactggagtgaagtaaaaaaatgtagccctgctccaagcctccactgtgggtcctgccccttccgtctacttgcccttacctctgtcagcacaaagctcttctctgtccctttagacctgtgcgtacctgggaccacctgggacatacacacacactgccccttcagagccgcttccaagctcccatcctccctcccctacctgcgtgtgttgctcttgtagccacatgtgtaaggctcgctagcatggcagtcactttggagggccttggactgggagtccccttgtccccagggtc

SEQ ID NO: 26901 - DNA, 1189 bp, Mus musculus
ctgggatgaggctcctggtcacccccatgtcccccacttcccaggcgtgcatttcagcagttctacaagcagtttgtggagtatacctgtcctacagaagatatctacttggagtagcagcacccccactctctgcagcccctcagccccaagccagtgcaaggacagctggctgctgacaggatgtggtactgccacaaaagaatgggggaatgagggctgttgggtcgggggggccggggtttggggagaggcagatgcagtttattgtaatatatggggttagattaatctatggaggacagtacaggctctctggggactggggaagggtggggctggggggtggggggtcaggcccctggccacagagggactccctaggaacagaggcactgtcccatcctgggcctgtttcatgctaggggccctggctttctggctcttggctcctgccttgacaaagcccatgccacctggaagtgtccagcttcccttgtccccaccttgaccggagccctgagctcaggctgagcccacgcacctccaaaggactttccagtaaggaaatggcaacgtgtgaccgtggagaccctgttctcatctgtggggcctctgggcagctccaacctccagcctggctagcacacaggtcctcgcaaggttgtgtgtgcaaggagagggccacagtaagccccatctgccaggaaaaggaggcctcttagctggccccagccagccggtcactgtcttgtcacctggctactattaaagtgccatttcttgtctggatcagagtgggtgtatttacttggacccctgctgggccttcttgcgccacacaagctatggagccaagcacttgctgcccagaatagctttatgcggggttcccatcacaggttcacatcatagtaatagtcagccatgttgggcccgtcccgcttgcgctgctgggcctgggagagaaggggtcggggcccacctggcctcgggtgcttgggtctgagcccatagtctaaagagagaagagagaagggtggaaagaaatactgctgactgggaatggggctatagccagctctcaagaggcagtctgggagtagaagtagggcttagccctagcggacctctaagggcacctgctatggaaggtgggggaggggagagaaatactaccctaccatcc

SEQ ID NO: 26902 - DNA, 1888 bp, Mus musculus
cctcgctcctgcctcaggaccccatctcctcacagacacagactttggtctgggacaattttattgaaaattgaataggccgaggtgggttcagagtagggatgggtggcaaggctggtctctcatgggcagcctgtaggcataaaccgtggcctgggcccttccttcttgccaacagttgccttacatctgtccttcccagtgcatggggctccctcacccaggaagggagctctcccagatggtcctaagccagacatgtaaaaccaggactgaccgttccctcccaaggagctatagctgagtgaactcaggtcctcatccatagagacaggttctgccaggccaagccattgttacctgagtctcctcaagatacccaggatcagtggacctgtcttgaggcctagaagaatgagctgttctggcagtatcatgtggcttcagagtcacccattccttggtcctctgtctcctcaaccccacctctgtcctctgctgcaatgacctctgcctcagagccactgagaagctgagctctacacgtgtcttctgctcagtctccgaaactctgggtgctggtgactgtgcagccaagcagggctgtgacagatgcaccatgggccactttgcctcgggatattgaatgactaagggacactgaggttgaaccccttgtagtcagcttggatgttccctgggagggtcagggcttctgcccagtgagttccatttgtgatgccctgtgatttcagacctgttcttatcctcctcttggagaagggcttgggtctgcccacccttcatgtctggcccgagaaccatatgcctggctcaccccatatcttggctgggttaacagactgtgggaaggtagggcttagagtgtatatgcagtcatttctgatgggacagggactgtaattcagtctctggagtagaactggtagtcacgggcatagaatgaaatgtatctgaggggctgagacttattctctctgggctggtagtggctttcattggttcacgttggtgagagtaagaagtgaggcagtgttgaagactgaggcttgtggccattgtgccaaatgggtaccttgctgaaacacagggttacagtgtgcccccccccccagcaaaggaaaacaatgaccactgagacaggtggaccactcagctgcgtgggcagctcctgcccagttagaatccctccagagacatcagagtgcgggcatcagaggtgccagagctattgttttataatgtctgcttgtggcatctccagctgccttaccccctcctcactggggaaggagagtgcactcagctccgggactctgtgtagttaagttctgcctggagccctgaatctgaggtcccagagcttctgccctctgctctggctgtgtgttcccagcctgcgttgttttgctgaggtttctgtttgacttgttcaagtcagatctttgattttgagcaaggaccttggagtgacttgaagcaccttttaaatgcctttcatttgtgtgaagggggaggggatgggggaaggtgtggagagggtgggtgtggccgaagagaggaagaaatggactttaagatgttacccagcctgagctggcggtcctttgctgcccacctggagccaggtgatgggggccaggagatgccggatgggttgaagtcttctagaacactcctttgttttttcatttctgcccccttggaaggcatcccaacctgttttcagtggatagtctgggttaaattctaacccggatttgtgcttttttttttctttttgtgatccatgcacctcatttggctgcaggccccaggttcactggagctcatgtgtgccctggatctcctctaagaagcagcccag

SEQ ID NO: 26903 - DNA, 1153 bp, Mus musculus
ggacatgtcatgaatgatctccacagtcatttcagtgtggattaagatgggggaggtgtgtcagaggggacatgcgaagtatgtgctgatgtctctgtccttcaaggagggttggctgggccgggctctgcacccttgtgtggtgtccagtctgtctggagtcaggagaaagtggtggcctgggttggggatttgggccccacttgaaatggtgtgactgaaaggacatccctgcgtccccttagaggtgctgagtgcctctttatggggcttaggcagttgtcgcatcctgtctcccgccatcaggtacaggaaggaaaacagccactcatttcacacatgaagagtaagactgtgtgtcagaacctggggcccaggtctcactcgcccttcagccccagtggtgactgggtttgtggtgttgtcatttggaacaaaacctcaggacctcttctatgtacctcccctccccctggcatccacaccggctgtgcccctctgctggtgtgtttgttgggatgctctatttcattctaagactctgggcgtttgagaaggaacctgggctatctggggacatttcctggggctgcaagacatcagggacatggcgctgggcagcaggtggaaggaggaacttctaagctgtgccttggaatgagtttgctggagtgaacgcgagatgctggggtaccaggaccctgggcactggccgggtgagcaggttggtggggatgcagggctgggatgctgttcttgtgttcagtgggactatgtacatcctggtggagctctgtggaatggtctacatttgctcccatccttcagggcatccttgagatgcagagactggagctgcctggggtcagccagagcctcacttggttcccctccgcgccctgtgttctttcctaggttgtgaggactgagcacaagagagggcccctcatctcagactccagtgtgcatctcagcatctagctcattgcccatctcagtacgtgccctgtggtatggggtggcatgactcggggctgtggaagatggtgggcagatggaggctggggtagaggctgtggatgctaatggccaggagtggttcacgtccaggcagtgtggccactactatggaaagcctcattttctgggctta

SEQ ID NO: 26904 - DNA, 2224 bp, Mus musculus
ctggaggtcgtcagcctgcagtcccactcaccacagggatggtcgagggtattcagcctagcctagcgtcatgatgggagaggctcaagcacgtgtctgctcctgacctttgcctcccccgacttccttcacagtggtcactgccacgcttgctgagacgggcctcatgtccctggggaccgtgctgctcctggccagccgcctcctctttgttattgtcagcatctactactattaccaagtcggccggaaacccaaaaaagtgtagcaggctgggacctgcctgggcctggacctgggcccgagcagctggggacttcactgtccatgggtcctagacaggcctgcaggcaggcagggtgcacacgccttccttccctcccaggcactccacggagtcatcttgggtctcctgggattctaggagtgacagaccaggctgtggcctctgcaccccacccctcacccttgtgcagggacaactccttgccctgtgtttcttggcctctagactctaacaggcagagtctagagtaagttttagggtctgggctgagtcaaggtgagttcctctgccaggaagccctttctaggaggttgtgtcggccccagcaggggctctcagcttctccccatccagaaacccgatgtgtgagtccctcatcacacacgcacacacacacacacacacacacacacacacacacacacacacacacacacggtgtttctagagatccagttgaggacatctagcaaggggagtgactgcctcccttgggccaagttccccagcctcagcctgcacatctctctctttggcctgctggagggtactctgattctctggctggccgcctgcgtcccagagcaccagagtcccttcccgacaggctagggttaggcaatgtaccacaggcctgatagtccctggctcctagctgcccataggctcctagtgcatgaggaattctgaggagaggacaagtggggacatttcctcggcatggcctccaaggcctgcatggctacacacctggctcagtgcctcctccagatcccctcctgaggctgccccaaggcctacgggttaaagccaatagctgctcacatgcaacaacggaaggagattcaagagtctgccatcccttagcagcccctaagtgggcctctagagctgaagacacacccctggtgccaccagcctgtgtggcccctccccttggccctagctcccagcacctccctacccttcagcagcaagcacactaagagatttggcccgaggcttctcccttctgcaagggggtggtcccctatacccgaggaatctttctctagggcacctgggctcacagcctccctgggctcggttgttcctgctgccaagtgctctgtgaccatggcctttgcctagtggagggaactcagtggaggatgtgcccagcagtggccggggctgcttctgtaaccaaggtctggcagagtagcgattccctgcgtgttcaggaagggcccattgtgtatacctgcctcttgtcactggcttggtgccagtccctcagtcccacctctttactcggaccatggaccctgccactgccagctcttagtacagtcccaactaccgtagaccaggtgacatttgttgacaccattctcagaggtgttgaagatttatcatcttgaatcctccacaaatacagatacagtcccaagggaggtagtcgtagaaatggaagacgccagccctgcgcagcctgcagggacatccgccaggcttcccctcagcagcaggagcccaggtcaccctggttaaactgcagtgatacatttaggtgggtggggtcaaggcatatgtggcctccgggagacacctgcttggaaggaggcagtgatggagatagagccccactctgagtctgggctcagagtgccctgactgctctcccccaccccatccccagctcctcttgtcatgcttctgcctggcccccaagactgcctctgtcatggtcactatttattcttggtccctttttctttttgtaagaaacagtcacaagaaaacaacaacaacaacaaaaaacaaccaatgagaaacaatctgcgtggtgtcctgttttatattacaaaatttctcttaatatagaatataaaaaggggagacttgggagatacaatgataaattagctctgtttcctactgcaagggacatttaca

SEQ ID NO: 26905 - DNA, 1138 bp, Mus musculus
gcggtccctgctcccgctggctgagggtggctgtgtgtggacactggatcagaaggtggccctttcatttccgtccagtcacacagcatgtgcatgacaaggtcatctccaggctgctgtcgctccagccaggactccaccccgatgtaaactggccaggaactgcctgcatccagctctacagtccgtactgtgtccactctgccctgcttgtacctctgtcagagatccaactgtgatacatcacctgtccccgtgggccatgccccacccctgttctcccaggtggaagacaccccagtattgttcatttctctctttctacccagagctgaggcttgaatgtgttcttcaaggtccctgccaagaattcacccctgcatccctccacatacggatggatctcactacctcccaactcagcctcctgccttcagatgctctgatgtcaccatcacctccgcagacagaaggggtttccatttttccgtctgtgtaccccttcactctctctcctttctagaggttaaggtcatgcctcttgtctgcagacttaaccccacagcatctcctaccgtgacaccttctgaccttttgctgaacatttattttgttagtctctctaggctcagattacccagactaataggttcacaaccaaccaaccaaccaacagacacacacacacacacacacacacacacacacacacacacaaacaccccagactaataggttcacaaccaaccaaccaaccaacagacacacacacacacacacacacacacacacacaaacaaacaccccagactaataggttcacaaccaaccaaccaaccaacacccccccacacacacacacacacacacacaaacttgaactgcaggctaggttagcaactagttgcaagatgcctgaccctgccaggaccgtgttgaatccattagtgttgtctgtcaggatctcaaatttgattaattatgtctgccaagggcacaaaaggggaacagtggtggaaggaacagctaggtgtctgctctcctctctcagatggaagagcctgacctgaactccagccttcctttgcccttctgccacctgggagtcatagccatagcctgttctattctgctgtct

SEQ ID NO: 26906 - DNA, 1196 bp, Mus musculus
agagcagtgcaggtcccgacagttcttacaataacacttccccagcctctgccccagccgtgcaccctgctcagcctgtgaatatttcacattcttccaaattgaaatggtcggtccctatttcagctaaaatgcaacctaaactcaactccctaagccaccactacccactggctttcaccggtctctcgcattactggatgtaagtactattaaaaattatccaaaataatttttaatgctgcctagttagtgctttattttattttattttattttattttattttattttattttatttttatgttttgtaactgaggaaagttgtattcaggtctagggagactccaggctggctatcgaccgtcacagcagatgtgtgtggttctgtcgccgacatgaatggaaaagcacttggctgtggagtgggggcttgggtctgctctaagatgcatacacaattcataatgatgcgtttgattaatggtgaatgagcatggaatttggagggccagcccatgtgacggccacattaacaccagatgaaattgtcatgtggggtggtgggacaaaaaaaaaaaaaaaaaaaaaaaaaaaaagagccaagtgacggtgtctgtctgtgcagctagctacgtgcaacataggagacagaaagcaacctttcaacaagtctgtgtggtgtgtgtgtgtgtgtgtgtgtgtgtgtgtgtgtgtgtgtgtgtgtgtgttgcatgcagagaacagatgttgacatctgttaatgtcttcctcaatctggctccaccttgtttttgaggcagagcctctcaccgaccctggagcttagcaagtcagctggtctgagcggcctgtgagcctgcgatcctcatccttcccagggccggacgggatctcgaaaacatattactgctgcttccaacttcgtacgagggtactgggaacccatgattgggtcctggggcttgtgtgacaagcattttaataatggggcagtcttcctcccccagccctttcaatgacttctttcttcatgagtaagaaggggaagaagaatccacatgtgccaaaacaggatgataataaagagtgaggcctcccttgcacggtccacacaggccagtgagcccataaacacacaagagatcaggctgggaacgtggtgttttgtgattctctgataagcttggccac

SEQ ID NO: 26907 - DNA, 1239 bp, Mus musculus
caaaataactcacttccctcaaaaaaaaaaaaaacccaccaaattgtaaccaaataaaagctcatatgtatacacacacacacacacacacacacacacacacacacactgtggagtccgttatatgatcgtcacctatatcggaggggttgatagactcagtgtcactccattggagaaaactgatttttttccgtctcccagaaggtatacacaacagttcagttattaacctttaccctagccagcacgctaattttgattattaattttttggctttaagtgctgaagctggactcctattctagacaataaaggaaaattcttccaaggtctgtagccacacttaccagctcagaatgacaaacctaaggttggagactctggctatctgtcaataaggccccctcacctggggcccctgaagccaagcccacatttgtcctctggggatctggtttattggccctggtccagatctccagggtccttccccaacccagctacagggaccatggttcacagctcctctgtctgaagtatgccatctatctagcttaaaggctcccgctagactccttatgtgatcctcagtagtcggggtctgtttggattaggtagggtccagagatgagggaagcatgtggggccctgagtgaagccagcccaaagttccagaggagctggctagggaagtagcctgggcaaggccttcctcgtgctgacaatcctcatcaataagatgggtctgaatccctggctccacaaagagagtctgattgctcctgtctaaaggaggccattgtcctccggcattccctgcagccctcgcctcctaccacctgctcagaaaatcctgccttctaggtgcctgcatctgggactgagggaaagtggttggggaaaagaagccaggatggaccttaagggacatttctcttcacacagcaagcaggaccagcggcagcggcgggacagggggcgcggcatctaaaccagtggttctcaccttcctaacgctgtgaccctttaatacaggtcttcatgttgtggtgacccccaaaccataaaattattttccttgctacttcagagctgtaattttgctactgtcatgaattgttaatgtaaatatctgatatgcaggatatctgatatgcaacccctgtaaaaggatcgattgaccctcaaaggggtcaagacctataggttaagaactgctgatccaaaccatcatc

SEQ ID NO: 26908 - DNA, 1244 bp, Mus musculus
agagtcaccagtccctttgttcctttgccttgcatggacaggaccctttctcctaagtcatcagctttagccagcagcgtcggtctcctttctatcatcctccttccctatggctggcagagatagggttaagggttgttggagctaatccacctaggtttgaggcctgctagggctggaaaaatgactggaatttgagggggaagggcagaagtcctgacctgcagacagcagccagcagacagacagcagcccctattcactttctccctcagactgggtcaggagccttgggtcaccttgcttgccatcccagccctttgcagagccaagcgaggggctgggcgccctttcagcaccttcagtttcttgtggatagtggctgctttgggctctgctgccttgcagtcgctaaccacttccgttctgctcatccccccccccccctctcgttcacctcacagatctgagtgcatcaacaagtttgcttccgtcttcggaacgatgcccctcaaggtggtggagcaccgagcggaccctgtcctctacaaagatgacttccccgagaaactgaagagcttccccaacattggcagcttatgaagcttgctgcacctcccggggctccggggtggggccagggaggccagcctgggtccgacttcccaaacacactggagctcgttgagctggctgcgcagcctgctttgtcctcccatctccgtggactctgtgaaaatgccaaaggaaggaagcctcagggacaggctgcaacttggagcccagcgcatcactctcggcttgctggtgcagttcaccatctcactggccctacaactgccttagaggagtcagctgtccagttttagatcccaggagtcacagcagagccttgcagtcatttcacatgcgcagactctggagagagcaaacctgccatgggctacagatcccaatacctctgagggtcagaactgtgcttgggacctgagtcatgagcccagatccacagcagagcacaggctgccaagatgtctactgaaagtccctgatcaactctttgttttggctttttgatatgattaaaattattttttactgttttcttctgtctagaatgctggttcttggttatccaaggatccttccttgttttgtgcatatacccctaacctctctactaagaaccatccagaaagatgaagccaagaggacccagctccatttgcatcaagtgtaagaag

SEQ ID NO: 26909 - DNA, 1786 bp, Mus musculus
aaacagtaggtttgcagacccgaaccactggatatgtgatccactctctcatggtatgtacatttccaaatcttaaacatattttccagtttgggcttttctttctatatgatttcttagcatcaagacatatactttgacaaagtggtacacatctttaatcctaaaaaagatatttatatttcaaactatatacctaagaatttttaaatctctgtaaataataatgtagagaattagaaggtggcagataggcttttcttaagttttactcagttgtgagctgtgcttatatatctcccccatttctttccctagggctcaataaactcaatcatgcctcgttggatgtattttaaaataatcatgggtttcagcaagtctttgcggaatcgctacctgaagaaaaggaagaagaactaagtgctgctgagttattgggccccttggccaggtgtttgacctgtgcctatacactgggcacctgcctgtccccagagtcttcactgttgtctcagtaattactaacatggcatagttggcagaaaacaaattccttttagaggctcctaacatatattctggatacaaccaggagtaatttgaagtttaatgtaaatgttcttggcaaatgtatgttcctttgacaaaaaggaacaaatcccagaatgacagcggtagacacagacccatctggcccacagtgccaatgaccacattatatttggtctggaagctactataaagtgcattttttattttagcattagagggaacagggctcgattaatttgttatgggcagattcagtgtagtttacatcgagttctgtgagcttttctaagtgtatgtcccagcttcgtatttatgtggcactggtcttctcaaaggtggctaagacataaaaagagaattgaaacatggagttctttctaacacgtaagtccacaaaatgttattcttggaccacacatcatgtctgctctgttcaaatgtatgtaaatactgaatgctatatagtgtgcccggaatgtagaggtaagtgggccaaagtgtacatcaagaccaacaacatcctgtggtaccgcaggatccaggaaagcagcctgtgtggacacacagcattcgttgtgtctgcactgcacccggatacttgcctaggatggcagactccttctggggtgggtggtggggtcatggaaacatgttctttctaagatggtgtctcatatttagaattcatatatctgcttttaataaaagatgatgtaactgtggtgttgaaatgaaagtgtatttttgatagtggaaaactaaagccccagtcacactgccttaaagtaagctaagtctgactataggtgtcaaagcatgcacaaagaagaactagttctgtgaaatgttcatttggacagtcattgtgtgcataggtttcaatcaattcctaatttgaaagaccaccaaatctacttaaaattttaattgatggaagtaagtatttaaatatttctaactactggtttcacaagctagtaaaacagctcccccacccaaacatgtgcacacaaaatgctatctgctcccaaaatcattatgtaggactcttctattagtccccaactaggagccatttaagttgtatacatttagctctctgaaaagcacttgtttgctccttcccccgactcccatcgttttgctatagaactggtagcctgggtggtatctcttctgtgtgcttccactctggctggtctgatagttttggttgagatgtggtgggttc

SEQ ID NO: 26910 - DNA, 1160 bp, Mus musculus
tcagtttatgactttgttatttagactgtatttccaaggggcagccccaaatctaatcatcatatctttagttactcttggggaccccagttaatgtcttagcaattattggcttgaggggccacccagtgtgtcctgtgtcatggcagaagatgagagttagatcttatacgttgttgggaagaggtggcatcctaatcacagtgagcaggctcaacacctgcatcttgtgctcttggcactgtttcccagttaatgaaccaggacgagagagagagagagagagagagagagagagagagagagagagagagagagagagagagattgagagagagattgagagagagattgctactttccatgctaggataagaagaacctggaatatctcattatgacaaaaaacagtaaaggaaatccaaagaatgatgacaatgtatcagaaagacacagcttgaaggggaccccaccagccaagtctggacaaattgagcattaaaatggaaatgatagagcaaattataattcatcagataagcaagtgaaatcattaaccatatactaataactttttacctctctaaaggtgggtgggacctgggggaatggagcctaaaaatgaggcagactatgaagtctcatgtcataaccaattttactcagagcatcagacaatttatattctgagggttaaatagagtcacataaataaagtatactatcataagagcaagccacatgcagcaagtacttggtttccatagagatataaaaccaaatagcaaactctaaagaaactcatttctatctgctacaactgggagaggtatgaaagcacatctcaagaacaactaactctgtttttgttttgtttttaaaaaactgaggtcacaagaactcttaccttgttttcttggagttttctcacaagcactaagaattccccttgtacaactctatttgtggacgtgttttgacaaataatgagttgaaattttaaggcagaattagacttcagacagtggcaaatcccacaaaatgtcaaaattcttgtgaattaaaaagagaaaaccaacaagtttgcagtgggaagaagatgacaagcctccctttataagagggtagagtaatgaatgggacaagttaaaattccatgt

SEQ ID NO: 26911 - DNA, 2198 bp, Mus musculus
taaaaccacaacaatatttttggatgctttgtctgcagccttgacttgttttcacaatatcctcactatccagacttcatcttgtgaatcttgcttttacacatcttgatggtttgtcactgagatctgactctattggaaaagtcagtctagcctgtgatctggtgaagatcatcactcttgaaacgttactgttctcctccccattccgttaggtttctgcccaacacatggagaagagttaagagcagtcttaaccttctgctttcattgttttctaaggaagctgctaggcagtgttgtcgcattcctgccaagtcatagaaatgaagcaccagcttctcacagtgtacaggcgatgccagccttttagaaagaacttgctttgcattgccccttcagtcttctccatattttgggatacagctttgaacacagggtcttattatttgaataggagtacatgtgcataatatacgtacagacataagcatatgttgtgtgtgtatatatgcatgctatggaacttgagtgtacaaccaatcaatacattaaattctcggaaggggtcctctgacatagcgattatccctttgaggctgaatccattactgacttggtatctaggttttcactccagtagggaggaatttcagtcagctgaacttacagattattattgttgtttaaaactaaaaaacaaaggctgtttttacagagacaaatttaaagacccttgttggtgaaatacagccagatctggtgtacatacaggttcccacaggatctgctagtgtaatgtaggatttggagacttaataaccagggctacccaggagtgtgacttggtgacatagtaccataaaagttgctcactccgcttgcttttgccactttcaaattttaacttctcaggttattaatcagattattgtgtaagttagccaatagtctttagattaaggcaacagacgggaggttcgtggagtgtctcatgttgggcatttttagtagcccagactctgttcttcatttgaatgtttcacacatttttgttcacagttaatcttccaagtttactattcaagtcagaaattcagatgacatttctagtggtttgctgttttggttttttatgttttttggttttttttgaggtttcatttcttacacaggtgtcttcatcaccatcacttctacactgggggaaaaacaatctcctttgtgagaatcactgcatgtatttatggcgaaaatatttctgaaagtctagagtgatacaagtgagcacaagaagttggtcagcttgcctatggagtgctggcaataaactctgaacattccacaagcctgagctgaacctaggctcccttggaagctgaacagacataggaacatgggattgccagctgaatcctgtgaccatctagttatggacctcagagatagatcagcgtggcctaaagccatttcaagtacaaaaatgaattggactatagcaacataaatttgaacacagtaacttttcctctttgcctgagggcatttgtaaactcggcagaagtaacttgacctcatgtctactgcagagctcactgcattcacccctcctcatcctttgcttccttccccttgcctagtcagtagttcataacttagtgttccttttgcttcagaaatctgaaagaaaatcttcatgccatgaatctttttcttccgcaaggacacctgtgtctcccttgtttaaataaatgtaaatgctcccttatgcttttgaaataaatttccttttgtaattttgttttgtgtcttaatgtgttataattataacttaggattcttgagttttagatattagcatttattgattgcttctcatatggtatgctctgttgtcaaggtcagtcttaaaagccatctggtttggatatatttttatacgtaaatacagtcttctggaaaagattccattctgacaaaacagcatcaggagagctgaagcatgcatggtgtcctgtgcctataactatcagggtaccaaggtaggaggatcacaagtgatgtaggctatatagtgaggatggaagaaaataacagattcagtgacatacatctgcaatcccagtaagcaggaggctgaggcaggaggttcaagtttgaagcaagcataagctaataaaaaggtctattaaaaataa

SEQ ID NO: 26912 - DNA, 1237 bp, Mus musculus
tatgttggcaatgccttgtatgtcaaaaacaatttttttacatcaagattttcttaaaaataactctggtcctcttagagaatacagcttttcctttgaacttaaatctggccttttggcaaacagaagcatcagtctgtagcagaagtagtgctgctctggataatgagctctgcctctcattcaaatgctgttcttctcgattgcgttttctaggtcctagaagacgtgactggtgaagagtttgttttgttcatgaagatactgtctgggttgaaaagcttacagacagtgagtggacgacagcagctggtggagctggtggcggaacaggctgacctggagcaggccttcagcccctcagaccccgactgtgtggacagactactgcagtgcacgcggcaggctgtgcctctcttctccgtgagctctttgttccatgttgatgatacttgggtcactcttgagtctgcctgtattcatttacttgaacactcctcagaccttcccgtaaaagcatccttagcatagtggggcaaacagaaagcagagcggcactggaagaacccaaggcagcaagacatttctctaagggcttgcttaggagctttgcaaaaattgtaagaacttgcattctgtctccgtgtttgccctacgtgagttttctgaaatagatgtgccctagtttgaaaaacatgaaggatgtatacttttgggaaatatgcagtgtgtaaatagtacactgacatgtcactaaattttacctgagagtcaaaaaaggcattcaagatctgtcgatgtccggatgttcccaataaccttgcaaggaaggccacagaatgttaagatactaagtccatgctttttgatggcagtctgctattgatctttgaaaaaagacttgtgacttttatttcttgcattcttttttacagaaaaatgtgcattctacaagatttgtgacgtatttctgtgagcaagttctccctaacctcagcaccctgaccaccccagtggaaggcctcgatatacagctggaggtaagagaccattcctgctttaaaaagcatagcaaagctaggcccagtttttaggagaaatgggagtcactgacttagatctggtttccaggagtgtaactgaaaggtctagcagtggctagccagtaatctcctaaggcaagaattaattgcatagaaatgatttatgagttccattgcagctgctgtgacagggc

SEQ ID NO: 26913 - DNA, 2266 bp, Mus musculus
tgtgcatgcgcctgcatcttcagttaccgacagctcagcgctgtgcaaactatatatccctttttgtccacacaatgcaaggagaatatgacagccacctcccctggcccttccagggtacaatacgccttacaattctcgaccagtctgaagcacttataaggcaaaaccacgaagaggtcatggacgccaaaccagaactgcttgcctttcagcgacccacaatcccacggaaccccaaaggttttggctatgtaacatttatgcacctggaagccttaagacagggaaccttcattaaggatgatacattactagtgcgctgtgaagtctctacccgctttgacatgggtggccttcggaaggagggtttccagccacgaagtactgatgcgggggtgtagcgtccatgtacttgtgttcaaaaactaggaaccatatgggaaaaccgtgccttccatgcctggccccagtaaacaatgttcaaacaagcagtgggagaggtgtaaggcctagcagcagatgtcatcagtgaggtcacgagccacttcttactgttaacaaatacctgaggcagttcccatgggaacctacatgtcccctgtatcttcaaaacgtcaacatttgaagggcctgtggctcatctgtctgtcagggtaccccttcactgtgcttccatgggctattttgtccgtgtactttactgtaaaaaaggccagacttagcgtgctgcagctcaatcgtttaataagaccggtgccttaaaaacttgaggggtttttaggacactgattactatattaaacatgaaaatcaccactgcctgtgctggtgccagtagagaagttaccgctctggtgttgagttctcatttagttgactcctgtgaatttcagaggctttgaaccatgatccctggaaggcttaagttctcaagtactccctcctctatagttcactaaggatccagggactggtttaacccttacttagtgtgaatgtattgtccactgaacaccaagcatcccccactactttcctgttttgaaatatgctccaggcggcctcttcccagtctgtaagaccgcggtcatgtgcttgccaactgctgagtgttactgccatggaacctttcttgtctgtcccgtgcagcttggtttccacagccggttgcatatcttctgttgcttgcaaacacaaaatcaccagcccaaacgagtgatttagctcactagccattaaatggcatctcgtggatgatgacagcaactcttacagccaggaaacttcagcccctcttaactagcttttgatttagcttataaggttaattgaaataaaattgatttttctcaaggggttggagaattggctcagtggttaagagccttggctgctcttccagaggatccccagtctgtaactccagttccagggcatctgacaccctcatacagacactcatgcaggcaaaacaccagtgcacataaaattaaacaaacaaataaataaataaattgatttcctcaaaacagaatttattggaacttgggaaattgtaggtacctgagagatgcctaaaccaaggttggctatcacggttgtgtggacactcagcttgagtggtggctttgtccagctcagtagaggttctgatctgtgaccctaatgtggagaggtgactgtcgtgctgctgtgtatttgttaatgtcctgtacatatacagtactttggagtctagttctcagggagccctacgactagttagagcctttgtaaggaagcagaggggatcctctcctgctgtttacacaagatcagctatgtgttctggtggtaagaaaggcatccgtgccttcagctgaatcagagacccgagcagtgctctgacctgccctgttcccagagaacgctcagagcctccaccaaggagtctgtttctcagctgtagccagccagggccactttgacctcttcattttcccctgcttccatccttcccctataaaggtgaggggaagaccttgtcccctaccattatcacaagctcatcacaggtctcttctgttggatccaggaaatgtgtgtcccttagctgtgcctccagcagccctgagctgcttgtagcaacttctgcctaaggagcactgcatggtcttatactgtagttgtttcccagtggagtaataaatgtgggcttgtttgttgtttctttaaagcaagcagtagctgtgtctatatttatttagaaattgcctgaagaaga

SEQ ID NO: 26914 - DNA, 1142 bp, Mus musculus
cttttaaatttcacattagtattatcaccaccaccactactactgttactattgatgttatgatagaagcaggttgctaaagaatgcagaaacacccgagtagaaagtgaagtacttaaagtatatgtcaactaagacaaaaataaaatgggaacagagtaggctaataggaaggggaggaggagagaaaaagaagtgggtgtcaggtggaatatgtttaatatatatgcatacaatggtgaccttaggttatacactaccatatacaatgaataataacagtgggacaatgagaattacacgtgtgtttgatttgcaaagaggaaaggtggttgcgtaagagcatgccgagtgactgccctcgcactcactttgagccagtcacagagcctgaggtctctgtcagtgtagactcagacagcccttccagcaaccctacagtccaggcttccagatgcggaagcaggctccggggctagacaagtaagggccttgcttctaggaaacaaagattctagcgccattgttgaagttgtccttcctctacaactcaggccgtggctgcatctctaccttgtgtcacttgtcattctgtcccaactcctagagtgccagtgtctggagatgcacccactgggagtcggtgctaaggacaggtgacaccaagccgtgtgtaaggcacaacttgtaggtctcaggtcctccctgtctctttctgagccttgcctgcagtcaaacgtattgtgtgtgtacacattccttatagccacctgtcatcaaatcaaagcttggggagacaggtagtatatagcctctgacccaagctgtcccctccacagtctctctgccacgcctggtggacctggactggagagtggacatcaaaacctcctctgacaacatcagccgcatggctgtccccacctgcctgctccagatgaaggtatgctcagtgtcgcactcctcaggaggcaagaggggatgatagtgagttggcctccccctccccaggcatctaaaacaccagcaaagtaaaaaggatgataatgctccctcccaaatgtggtactccttcacagattacacctgtaggaccattggtcatcataaatagttgttaaaagcagaagtttcggaggaca

SEQ ID NO: 26915 - DNA, 3085 bp, Mus musculus
gaaatggacagctgttcatgctgggtctacatcacctgcctcggcttgactctaacgtgttctctctgctgccctcctgccttctccattacagacctgcatggtacgaccttcctccaccaccctattcatctgacaccgagtctctgaaccaagctgacctgcctccttaccgctcccggtcaggaagtgcctacagtgccagctcccaggcagccagcagcctcctgagtgtggaagccagcagccacaacccagagcagcctggctctccagagggctctgctgagcccagagactctgtgcccagtcagggcaccgaagaagtataaaatccagcgattccaaagtccatatgggtagatcctctccaacttgttgaattctatcagactgtgctcatgggacactctttgagctccttttgaggatgtctccagttgaaattttggggtgctcactataccttctcctccagatttcagggatgttctttggaatgacctggcactcctccagccacttagttaacaggatgcattgccgtctttctctgcacagtcactgttccttcagggcctgtgattaacagactcctacttcagatgactgtgcgattgttggtccattccagtagtcttatgactggacaggcggccgggtgaagccatgtatgtaaatagtctttggcagggttctagggccatgtcacacattcaggaggtcagaagacatcagaccagagtctctactgagctgccaacttatagatacatttggagacttagtttggaggattcttacaaaaaggccattactggatggccactcaaaaaagtgtccaggagaacatcaaatcccgttttgtactctcctatgcatcgatcttactccagcagaggccaaagaaaatctctggcatgagcaacagctttcaactctccaaactctagtttggttttatgaaagactcagaaacctccaccctggccttacagacttgcccaagagtcctcattctgagatctttctagaagggcagagcctcagcaacgtccttgaataagtaggaagcccctggcatgagttcctagctgctaatgtgtaggttaccagagtctgctcctgccttggccccatcatccttttcctgccttctggattgtccccttccaagatgacctgccatagctaaggataaggacccaaattaagccggtcaaaattctgatctaaccgtttgccccaggaaaacagacccagtctggcatgttcatccatgcaacttccttgataggctcctaagttctatgaacacttgggagcctattgtccatgtgcatttggacataaggacacgtttttctctaacttacatgagaaccacattcaataccatccatgagaattctcaggtccctgtactacacacacaacccccaggacagtgcaccaagtcagggttagggttagagtgagggtcaggcctggccagacatctggcagtttctcctgagagaagtgggcaacagataaatcttggagtcaagatttcccattggattttgtttttttaaagtctcttagaaatgcatttgaaacagtgtgtttgtcttttcccttctagttaagggactatttatatgtgtataggaaagctatctctttgcttttcttatttctctttcagtgaggtccaaagaaagatgcaaaaagaaatgctgcctttcccatcccatcccataatgtcacctcagactcacatacacgctgagcatctacactgggtcatcgtggagtcattatttattgagttactgagacacgcagagacaagtccaccatccactgtttgtttggattacctttcctcctccttgatgcccagccagtcctagtgcatgccaccaccacgcacccccaccaaccaggcaataatgggtaaaccatactaactagggacaaaactggaaccagatggtgccacctcaggcagctgccacccattcaaagcatttttccactgctaacaaaagtttcaataacctgttcgatgctaattaaaagggagcctgcagggagcagggatgaagtggccttcagtgatgttgtactgacttcctttttaaccaaatccaaagtagactgcaggaaaggtaactagccacttggggttttgtttggttttggttttgtgtaaataagcctagctgtttgcttttttcattgttaaaatagaaattgagttggtgtgtgtgtgtgtgtgtgtgtgtgtgtgtgtgtgtgtgtgtaacccaatgaagaaagaacctgggtggcagacagagcttttctggctgcacatctcatcccagtgagtcagagtcgctcttcccttcctttgatgggtccccgcttctttttggtgctctgaaagttgtctggaggaaaggattctaattttaattaattgtgcagtgagctaatctcaggagcttttctgcttcaaggcattttagggaaaacaaatggttttagtagataaggagagcctattaatgttggggttttgttttgtttccaaacaaacacaggaacatttttttactatagatttggtttttaatggatttttttaaaataataatcataagatagcaaagctcggggacatggggttttttccccctgattttttcaagataccaagtaagtggctaacaatattttttttaattcgttccagtcaggattttttaaatactatattgcctaatttacaccagccaaaaaactgcctcttctccattgtctctcctcctgtaagatcaacacttcatttttaacactacactagattcactgtggttggaactcactgcctaacttaactccctctaccttgtaattgatgattgtttttgaaatgcaactaagatattaataaatagcgtgtgatattcaaagttatataaactggaaggttgtatgtggttgcttcttgtttttttgtttgttttgttttttgaattggcccattttttaaaaaaaattttatactctcaaataaactttcagtttcattctttctgtcgtgtgaatggtt

SEQ ID NO: 26916 - DNA, 1172 bp, Mus musculus
ttggggttgctgtctgagctgggtgtttccaggttcatggaattttatttgggagtagagtaaaaggtcacagagattgtagggtagccaagaaactttgcttaaagcagagcaagagaaaagatgggaatgcactgcaggagaccatcagacgcatgagtggagacagtcaagttcctgctctggtgtggggaggggacagctttctcttatgggatcggagggacagaagaatttgtttactaaggtggttctttgttttgattgacagattagatcatttaatcacttttctattgtgtatatccctttccaaaatatatctgatttttaatcttgtgctgcccaattatgcataggtataagatggtaaatataggattttgcctaaaagttcctttgaggacacaattttgccttattgcacatggcaatgcacagccacttcaggctagctcatcctttccccctaccccatacctggacataactgagaatgtatctgagtggagtctgtgtaagtttgatactcctcagggcaaggaaagcagattccacttttcagaaaagagattttgtgcgaagccagatgcagcaggttgggccgtggttggtaggcatattgtttgcagagggctgtgtgcagcctgacacaggtgggtgctcacagttgctaggcacattgtttggagatgttatgcgtgcctgctacatagtagtgaaggttctaggcagccaagtgcatcattagaagatgtggtaattcatgacccaatccatgcagagccccatattgctaagctattccctgtgcttgcctaggtcacctccagcctaaactttccaagaaaatatatttgcttctggtgtctcttaaaattctatggttagtttattttaaaatcactatttttttaactattaaagtaataaatacccaagactaaaaatgtcctgggaattctaggaccaaggtgaataaagaagtcttccttgccttcctgctctgctggggctatcagtgttaaaatcaggttaggcgtttccttggccaccggttttttcctgtgtgatatgttgtgctgggctctgtattatgaagtgctggataagcatcgcctcacagtactcagcttacagacctctgagatataggcaacctgtttctccac

SEQ ID NO: 26917 - DNA, 1238 bp, Mus musculus
tctgatcccagggaaatttgcaactaaaattgtgtttcattaacagtcagaacagtttgtccctttgaagctcagacagggtgagattaatatgaacccgatattaagctattaagcatcaatttggcaaacctatttataaaagagctggagatagaaaataaagaaagtcacattaagaggcttgtctgccaaatccactctctattctgaaagatgtgacttagtaaccagtctctgtgtgagaaagaaaattgtgtgcgtgggtgtgtgtgcgtgtggggtgggtgggggtgcttgtgtgggtgtatcgactgagcatggcttttgatgacaggcacttactctgatactgccattgcccctaaatggtgtcccagccaatgtagactgactccgtattgcagccttgctgtgaaacagctggaaagtgactgaaaatgtcttgccaccacagtgaagacacagccaccccaatgtcacagcacggtgcattgttcacgtgcttgtgaggatgttgacagggttaggtgtagaaacacgtggcaccatgcaatagtgtgccagtcagtgacaataataaacaactgctactggcttctgtctgtgttggctctacttctgtttcagggcgaattcctgctcctcacacagtttattgtggagcaggatgttgttgggccagcagcagcagcctcatacggcctgtgtgtgccatgccttttgaatgcatcattttctcctgtgcctgatttaatcccttggtgttgtgttcactgtgcctgtagaaggaagacgctgtgccacatatcaatgatatgcagcccagatgccagaggactccaccatctgggtgtgcgcagaggcacagtatcatgttcacaggacaatgcagttcttgtaatgaactgtcattaagccttggagtagtaaaataattaactattcattatggctcgtctgttatacagtgtcatgtgcccaagtactggatactttgcatttaatccacacaatggtccaaaagagtacatgtttttattccccactttacagggaacagaggcaatgaatggtcaaggattttaccacaagttgcaagcccactgttaatattctgtccagatgatggtgtttgcaccttctgtcctttatccttggagcttcctgctgcagctgcagttttgtcacagttgtatgtcatatttagctctcagtacccacctccccatgaacag

SEQ ID NO: 26918 - DNA, 1227 bp, Mus musculus
ccgagacacgtggaagcaacacgtcacctcaggctaatttatggcctgttttctactagaattgcaaagtcttcacagttggaaggtgttaaaatatgactgcacatcatattaaatacatactatatttaaactgggatgtgaactgaaacacgaagcaaattagactaatttgctgaattctaaagtaatcttggttccgcctttggcttgcctgcctgcctgcctgcctgcctgcctgcctgcctgcctgcctgcctgcctgccttccttccttccttccttccttccttccttccttccttccttccttccttccttccttccttccttcctccctccctccctccctccctccctccctccctccctctctccctccctccctcctcccttccttccttcttggttttgtttgtttggctgtttttgtttggtttgggttggggtgtgtgtgcctctaacatcggaactataccatgaggttttaaaattattcaaccattcaattattcaatacttctgcagatctaagacttaagtagcaatgtctgagtgcccgtttcccacccatcctgatgggtagaggccatggtggtctgtggccaagttctgccgtgctggctctgtctgttagctaactttctatcactgtgaccgacatctgaagggagggaagctgtgtcttggcttatcgtctcagatgcagttcatggtcacttggtctcgtgcacatgggcaggccttcatggtagtgaggtacctttggcctaggaaagccgccaaccccatagtagatagaaagcagaggaaaaggaagagacaagaccacacactatcacagtgactattttctcttccaccaagacccacttcctaacaattccatccagtatgaattcttctcagacaaattctctcgttaggtcaagagctccagtgaccacttagtttctgcaatggccttcatagacactccttgagctgcacttcccttgttccctaggactgggtggctgtgaatccagtcaagttggcagcgtagatgaaccatcccaagggcagtttctggtatgagtggaaatgcccaggaccgtgaggctttcttttctgtcagccctgcagctcctgatcagaaggttctagaggatgtttgtgttctttcggaaaagacttgaaaggtggaaattggtgtgctcagagtttctagagatgacattcgttaaa

SEQ ID NO: 26919 - DNA, 1198 bp, Mus musculus
ttctcgaatgtggtttttgtttctgtgaggagtaaggagatcagacttgaacttctaggaaggaagcttttgggtagcagaagcccttctgtgtgcgctgagagaaaaacttcctgtgtgaccctagcattgtcctcactgcctttaatcctcttgggtcaggactcaagaagtttgaactgtgtctccataaaagatatgtccaagccctagctggtcatacttggacctgtaaatgtgaaatttacacgaagggcatgttcactgctataatctaatcagttaaggtgatcttactggatcagggtcaaccctcatctctgtgatttgtgagtttgcttgtgtgtgtgtgtgtgtgtgtgtgtgtgtgtgtgtgtgtgtgtatgtgtgtggtggaatgggtgcacatgtgtgtacatttggagccagatgtcgaccctagggcctgcctccatgggtgtgtgcatggtgtggtgtgtgcacccatggaggcccgaggaggacagcgggtgtcccactctaatccctttactagcgcctttactaaatgtagacataggctgacgctagcaagccccacaaagccctctgtttccgctctccatggcaatggaattaaggtgtgcacccggctgcatccagcttcttatgttcgtgctggggttggattgagggccttatgcttgtacaacaaaccttacccactgagccatctctccagtctccaccttgtattttgagacaaggcctctgattgacctccagctcactggttggagtaggctgcctggttagcaggagctaaggatccttgtctctgcctccctggtgctggggttgcaagtcatgtgactctttctttttaactgtgggccttagggattgggctcagatcttaatgagtttactttgttgactgagccatctctctagtccctgatctgtgtcctgtttccctccaccacacttagaaaacaaacacacacacacacacacacacacacacacacacacacacgaaaactggggtgatgttcatttaaaccaagggatgcctgggattttcagcagctactaaaagctagaagtacacgagagagttttccctggaagcagccattcaacattctgcctttaaaactcttgactcttgtgtcaacccactcggctgcttttagttgttgaacagcctgtgaga

SEQ ID NO: 26920 - DNA, 1128 bp, Mus musculus
tggggaatcactgtgagtttcaaactggtctacagagtgagctcccggtcaggcagggctacatagtggaacatagtgttctctctttagatagaaaattctctcctcctgaattttggagcacggggattgtgtttcttgaggagccctggaggacgttctgtctcacaactggactaattcctgggggctgggtttatagtttggggtgggtcctgagacgtcagtatggagtgagtgtgcctctgcagctctgttacggctcagctcaggatgctctccttattgaaggtccttccatccctcagtctggtccttccatccctgtgaggccatgctaaggaggcattggctagtgaccgtttctcccatgttggtctgtgctggcttttagaggcacaatagctgcttctgaaaaacctcctgagttccgggggccctttgcgccccatacatgaacgcgtccttgcaatcgaccagagacaatcagagtgttgacttggagataaacatacgttaaaggagtcatgcagactgtgtgacttttctgttttaatttcaggtgagggctgaggacggagtgggatggaaagggatgaaaatctctttagacttgagctgtttgtgtgcacaggatgcatccgctattgaaaggacgtttatatgtgtatatgaggaaataaaactgtaaaagattggctttgcaaaataaatatccacatcactggaagtgctactggaaagatagagaaaacatggtagagattcaactaaaactagatgtgatcaaatcactaataagatggagatggagcaaaggggaaactaaagcgactgggtgagaactctgtgtgtgtgtgtgtgtgtgtgtgtgtgtgtgtgtgtgtgtgtgtgtgtgtgtgtttaagcccagactttaaggggagtagtttaaatcctatgggatttgatttctaattatgctctaccttacagcctgagattttaggctgcatatatatttgtgtgctcgtgtgtgtatgtgtatgtgtgtgcacacgaacataaatataaatattattacctgttgtccctgggagaatctagcattggataaagttgttcattccccgtctgctaactttaaag

SEQ ID NO: 26921 - DNA, 2081 bp, Mus musculus
gaggttagtctatggtggtcagtgcactgtgaggggaatccttgtccctccctggcagctagcaaacattcctctatttactataattggaatcctcccttcccctgcagcaggccgtcagctcacctcacacagcccagttttctcttcatgtagcatgtccaggcatgctccagagctgggtttcctggccttcccacactcccagatcacagtctcttacaaccatgcttttcaggatccaggaagtagtaagtgtgctgggagatacccaactaactgcaagctcacaagcaccacatcttcttgagacatcagtttttctttccaaatgatttgaagtcaagagatgaccatattttttaatggaacaaatgcttatgttatacaagagaatgttcatacacctaaagtgctaaactaaaataggaaacttggaaggaaactcatatttgtaagtggacagtgattctatctcctctgcttgtgtggtatttccatgttcactttgagattttgtctgaactggattcaggcagccttggggttgctgttgatcaaggtctagacttccagatccaaggagtccaccttggagtagtacatctcccttttcctgtcagccagcttgcctgtgtacttatcacaaagctttaggggcagctaacatgtgtatgtacaggatagttctgaggcagaaacagcatagacttattgtaggagtcctatttatgtcattgttcagccctgtgcatgctagaaaatgatttatccctttgaggccaggaaactgccaagccactctgctgtaggctaggattactgaaactcaccacacatacaaggatattggggcagagcggagtgtgagatctaaaaatatgtatactttccccagctggtggctagtagatggcttagacaattttggtgtcttaccatctgtctgcaaagactggagaatttaatacatcttgagttgacaacctccagtgatatcctgttctgccaaaattttaaaagaagggccactgtagaaagagtgtaaactatcacaagattgaaaagacttgacagtttggaagcttgtcttgtctttctcagtaatcattgatctttacatgttgaccttatattagcaatgaacagatcattgcctctccacccaatcatgctatttctttaaatcagtatttggggaatgcaagcatttatgcagtggttataaacagaaatataagatttgccaacctgtctctttaaattaccatctctctgaaatcctcaaggaaagcattttccctttacttagtaagggtttcagattcactttatgggctcctgctgtcttcaacactgataaaactttaaccagaaaagcattaaacacagcacagcagcccctagcccagatccctaagttcctagtggcagcatttatcaatgtaagaacaagaatactttctgtactggtatcagcttcgtcctcaaagctatgacctcttacttggccttgtgccccatagtgaacgaagcttcttgcctttccaggtcagtgtgagttaagattgtcagagttgtatgtgtcctgacagactgtggacagcagggtttgcccaaatcatcaagtgatacaggtaatgaatgtctctaaaataagttgggtcctccaaacaagtcctggataccttctgaatgttaagtttctgagtgctgagagtaatttgttcattggtttggtttgataccgttatatctatctagggcagttccaagaagtgcttgacttctcagctctaacagccagtaagagtaagtaaccttagtacaggcaatgagcctctgtagatgtgcagaggacaagtcacttgtctgtagttgctaacaaacaatggaaccagttttgagcacagcactccctgctctgcagtcagccctctgccccacaccatgactcacctacagattgagagagagaaaggctttcagttcccccagtgtagtatgcccattcacactcggaattctttttcaaagacatcaagatggccttagtactctgctctagtagatgttgtaag

SEQ ID NO: 26922 - DNA, 1187 bp, Mus musculus
aacctgcaccgaggaccaggaggggcgttggtctttctggacaatgaggcgggcttggtgcacggctaccgggtagccggcatgtgggacaagtataacgaaccgctgctacagtcggtgtgtgtattccgagagcggactgctaggcgcgtcttggagctgcaccggggtcaggacgcggcggcccggttgctgcgcctctacagtcgccacgaaccgcgtttcccagagctggcggagctctcagaaccccacgctcagctgctacagcgccgccttgacttcctcgccaaacacattttgcactgcaaggccaagtacggccgccggcccggggacttaataacactccgaggaagagagggactggggtatgaatgatgggggttagggctgtcttctctgccacgggcaacgaccaaccagccaacgcccacccaatggtctgatcgccaagctgtctaaaaaaaaaaattgtgtgttacccacttgcccctttcttttcatgccaggctgtttcctttccaagttctggaagggcaaactcaccgaggcgagaagtgtaacattccctccacctagcttataaaaagagttctgtgcttgtgtggagattggatccgaagaaactggctgctggggtttggcccgggaatggcagtctctttgggagatgcagtccatttttgtcgccccctccaccccttcccaaaaaggaaaacttccgtttgagctaattcctctatttcctactaaacacagcgctggtggccccagagcaggctgtgacaagggctggtgaaacccccttcctgtgttcgccctttgttccggcgcgcgatggtgagataactgttccaagctgagggacagctctggataggacaaagagagcaagacttccccgcccctgggagccctccagaccctgacagtttgtctcacccattcctgaactcctatcattttggcctgaaggctatgaattcaggactagttataagcagagtcaataatgaatttcttcctgcgtctcccaattgaccaaaattgacaatgatgatgttcaccagagggggaaaaaaatcagtttcatgcactttactttttttaattttaattttttagtaagaaaacttttttatttgacagaatttgccttctgtgtgtatatatgtgcataaatt

SEQ ID NO: 26923 - DNA, 1192 bp, Mus musculus
tctttgtgaattcagtgatcagtaaatggtctgattcccattccctgttttaattcagaagaaccacggagtgtatttttctgttcataagtatttctgtacactgaatgtaaaacactgaaacatgcgatggcagttgtggtgatgggcctggtaaaggcgctggctttgaaaatggtgattttggtggtgggactgttggtgtggcatttcatcaaatgcggtggtcttttctccaaggaacaaagcggtctctctgcaatagttatgtgcaactacaagcaagtttgcctctcctaagcagggaatcacataccgtgcatttcactgtattctttttctaggcacccttgtaatgatctgtaccaacttttggaacccctgttgtctgtgtatattgtttcccatatgatttgatcgtataatttggatttaaaattagtcacttgagtttgtctctacctagagctttctggtgatgggtatttgagaaggttagaccattgtgagacaggttagttttaccctactgatgatgtgttgttgccatggtaatcctgctcagtatgagaggaaccgcaggttcagacatttgtatgtccttggctgaggagccaatggggcgaagctaccatcatctgcagacagctattctccctttgaaaaacagctcttggtctgctattgggccttagtggaaactgaaagtttgacaataggacaccaagttactatgtgacctgaattatcaatggttgctgatcatgtgggcttaacctttttttttttttaaatatgaactgagacttctgatgcccagctgcctgtcactcacaccatttcactggttcttaatacacttagggttgacctttctcctctctggataaatagtttgattttccctttgagcttttgcctcgttcattcctaagattcttttgtttcagattcagagaaatctctttttatgctggatggtctgagccacattgcacccatttaagtgatcacattccagtatcacaatccttatccaagctatgaagtatctcattcaaaactcagccctgtgaaagcatcatcatatttttctcagaatagcctttagctctgttcttggatttctacccgcacggtatttttagtgctcatctgggatgacctgtgctgcctgagtttccttcatgtt

SEQ ID NO: 26924 - DNA, 1407 bp, Mus musculus
tcccatgcgacttgggtagccttcagagaccaggcgcttgattgggtgttcagtatggagtagatgaagtgcgtatttatttaaggcgaaagctttgacctgagctgtcttcctctcccctgtacatgtactgtagaaatgtgtgatgacaaacggactaataaagaacatttggttggtcagatccacttttaacctctggtgctgtacagaaggcattaaactaatgtaaactacatcctatgtttggttcatttgaaattttggaataattgtgaatgtatgatattgtaaaattaaaaaaatatatagaactgtcccttaatcatattgacgttataactgggcttcaaagagatgtctgtctatattggggcctctcattttttataagctcttgatatacttgaacaatttaatatgtacagttagtttgctctggattagtatataagtacattttattaggggttgtgacaacattattaaacttttgtgtatataaagccaggtgtcttagctagatatatttccagtcttttaactttgacactgtgaagctctaaggatacaataggaatgaagacagaggaagaaaaactaaagagtcgtttgttcagagacctgaccttataaagttgggggagcagctgggtttgtacctataacctcagcctttgagagagattgagaaaggaggcccgctttgaggctagctgggctacgcggtgaggccctgtctcacagaggcagggagagtgttttactggaaaagctgcagttgatctcaaattgagcagcgagctttcatgctcagttggaatctaatgaaataaattctcttagcatacattgtaaatttgtattgttttaaatacagtattgtttgctgaagcattgtaatcaagtttgtattgtacagtcaaatgtaagaaaataaaaaaattctagtctactttgatatgacatgcaaaatagaagagtggcaaacaagctcaccatggtggtttgcgcctataatcttagtacttggaagactaaggcagggttcccatgagttcaagactagccagagctacagagtgagatcctgtttcacaagagaggagacctaggaaggagaacagatgggaagtagtgctcatctactccatcagctgagccaaattgtccctcattatcagtaacattagaactgcttctttctgttggcagctctggcaagataacgatatttaaatgagatggtaatgaatggtaatttaattcaccagttgcagaaagtttctccttagtgtcagttgacataaatcaccagaaaaaagactccatggtacaagttgtattgagtatgacatgatgaactatagccctaacaaaggagccttcagaaataattagtgcccc

SEQ ID NO: 26925 - DNA, 1124 bp, Mus musculus
gtagaagtaagctgattaaaagccttaaaggtccaccaatcattccctgggacacatgtccccttcactccctcagccactctgtcaccatctccagcctgaagcccaccctttgagaagcaatactgcctccagctattctgtgactttttgtatggtgagtaaagggcccttgtcagaaggcccacaggagctgtaggttaggcatatcccgttccttgttgagtcccagcattctgctcatcgtgcattaatccttagctagtctgttcttaggagaaagttgctttcactttatttgatttgcatagcatgtgcacagctactagaaaggtagaaagcacagactttgcaaccagctctgaacctcagtgtaccccagtgttcttagccctggctgtactcagctgcctgcctctccaccctgctcactacacttctattctggccttctttttcttagaaacctcatcttggaagttatatgttttctacctagatagacctttctcccagccctttgacttgccctccacaccattctgtgtaatgcccaaatgcccaggcctcccccagctgttctgtcttctcactcattgctctctagctcattactttgctgtattcctttttaaagatgaaatcccatcactctagtttgtgtgactgatgggtgactcctagagtggtgtgtaatgttttctcttggcacctggagtgcagtgagtgcttaagacggacttagatactgagcttaacttttttgagtccatgtgtgtctaacttaggagtaatagtaacacctcttctacctggatgatgtgagttattaacacatgacatttggtaggctcttttcttctctcccctcctcttcagcattgggaatccagactcttgtaacatttctattgttttgtcagtttgttttctaaaatattccaagaacacatgttcagaaacacctgtacaggaaaggtgccactacagtgggctgggcgctcctatgtcaatcaattaacaatcaagacagtagcccgtaaacatgcccattggccaatccaacctggacagtacttaaagactcccttctcagatgactctaggctaagtaaagttgatag

SEQ ID NO: 26926 - DNA, 1216 bp, Mus musculus
gaggagacctctcgtgaagccgagcctgaggatcacctgtaatcaacgctggatggattctcccactccggagcgcagactcacgctgatgactttaaaacgataatccgggcttctagagtgaatgataaccatgcttttgatgccgtttcctgaagggaaatgaaaggttagggcttagcaatcatttaacagaaacatggatctaataggacttctgtttggattattcatttaaatgactacatttaaaatgattacaagaaaggtgttctagccagaaacatgacttgattagacaagataaaaatcttggcgagaatagtgtattctcctattacctcatggtctggtatatatacaatacaacacacataccacacacacacacacatgcaatacacacactacacacacatacacacactcacacacactcatacacacacatgaagagatgataaagatggcccactcagaatttttttttttatttttctaaggtccttataagcaaaaccatacttgcatcatgtcttccaaaagtaactttagcactgttgaaacttaatgtttattcctgtgctgtgcggtgctgtgctgtgctgtgctgtgcagctaatcagattcttgttttttcccacttggattatgttgatgttaatacgcagtgatttcacataggatgatttgtacttgcttacatttttacaataaaatgatctacatggaaggaccgtgtttggttgctttcagctctgtataatgtggaatgtgaagtagagattaccagctctctctgcagtaacaataaaagcgccagcggccagagcctccatggtgtctgtctttggatggcctgctggcgcactgagacagcagtcaacgtcctgactttggaggttcttatatcctttgctccttagcttgcttttcaggagaattaaacccccttgggactggagcgagtgcttcagacgttaactacctgtgctgttcttacagaggacctgactttggtacccagtgcctgcgttgtgagctcacagctgcctgtaccttcagaggactctgaggtccctggctgatagatacgaactgtctctttaccaccacttacccctgtatctgagcagacctgaaactggtctgtctgtagacacagaaagtgggtctacccgtttacacccaactcctcttggagaaggtgcttata

SEQ ID NO: 26927 - DNA, 1183 bp, Mus musculus
tatgatggagttagctggaacaggagaatatggctgtgagcagaattagagggctgtgaggaatggcttgactgttttgaaggtgtcaccaaaaggaggtactagaaagtcagggttgggtgagaaaatggagggtatgtttaacccagagttggacagttaaactccggtggggaggctagtaggtagaactgttttacatcagcttaacgtctgagatgtctgtgtgtaaatggatcttataggaatcctacctaagggtatgacaagtgtgtgtgtgggggggtggtctacagtggagatagaaacttgagagctttgagggtactttgggtcttgacaaagctgaggagccgaccaaggcatgagaaacataggcaccaagcagggctttctggcctgtaggaactaataccctttttgttatcctcaacgtcagcctaacctctccacgactggtgataagagccaaccccatagcctttctggacattcgcataatgttatctttgtacaggccaaagctgtcttgaaattcattgaggggatctcggagaagactctaaggagtactgtagccctcaccgctgcccgaggaaggggcaagtctgcggccctgggcctggctatcgctggagcagtggcattcgggtaagggttccacatgggagtgtgcaggatttgagtcaggcacctggtggagttgtctctggttcctcatcagggctgtccaccatgtaacttctgtcaggatcatgggtatttgtctggaagctgcagcactgctcccctgggccactaggaggcactgtaggcagtaccagagctcttttgtttgcttcttaagttgaacagacacaaatgcaaagaaaacctctcatcgtgagagtgtctgactagctttggtgattgcacaaatacaggtgaaatacattatgaccttggttggtgatgggtcttatttgttttcagtaaggtattattttctggcctgtgtgtgctttgccaactcagatgatggacctacaactttgtcctccctgtgccgtcttccctggtgatgcttacagagtctgtgggcactttgtatgtggatgaaccaaggcccaggggattacccaagatcctcctgcaggttgctgctggcagagatttggccttggccccagcaccacatagctcc

SEQ ID NO: 26928 - DNA, 1157 bp, Mus musculus
cagaagagggcatcagatcttattatgggtggttgcgagccaccatgtggttcctgggatttgaactcagatcctctggaagagcagtcagtgctcttacccaccaagccatctcgccagccctgtttgttgttttcaagacagagtttttctctgtagtcctggctgtcctggaactcgcactgtagaccatggtgaccttgaactccaatattcatctgcctctgcctcctgagttctgggattaagggcgtgtgcctccaccatccgactgaggagaaaggtttctgcttataacgtatatagaagtgcggggagcttgaggtttgtttttactaaagccccgtctagtgtgaggctgacttgtgagagtactaatagtgtgagtggaaacaccaacgtgtatttctgtgctggctaatgtggccagctgctggtttatggagcttctgggccatgatggtttgctgattagcatgcctgaggcctctaagctgctatacatgcagagttccacccagccttggtcacatgaggagcactggactcttccctcctgataacagttttagtgataacttccaccagtcagaatgaagtcccaataggctgtcttaccttttaattctggaagcacaattaattataagctctttgtgctggctagttgcagcctccaggttgttttgaaccacttctggtctagtgaaagagagggagtgtcaggatttgagagaaactgtatttcttgaatcagcattatcacaaaggaagcttactcaggacaccgaagcaggaaggttgccagtagtttaggccaggctgggctatatagtaaaatcatttctccaaaacagggaaggaggctcagttagtagagtgcttgcatagtgtgcataaagtcctgggatcaattcccagcaatgcataaactgggcatggtggtgcctgcctgaaatccttctgctccagaggtggagacaggaggtttagaagttcaaggtcatgctgggctatcttaagttgcaggctaccttgggatacatgagaccctgtctttagggaaaggtgaaggaagccatgcaaagcagccagctagtgcaggatgaaagcatacacatcagcagaacaggaagtgcatccgggttgattccaac

SEQ ID NO: 26929 - DNA, 2057 bp, Mus musculus
actggccagtgtaccataatatgttaccagaagagttattatctatttgttctccctttcaggaaacttattgtaaagggactgttttcatcccataaagacaggactgcaattgtcagctttacattacctggatatggaaggaaactatttttattctgcatgttctgtcctaagcgtcatcttgagccttgcacacaatacaatactcagattcctcacccttgcttaggagtaaaacattatatacttatggggtgataatatctccatagttagttgaagtggcttggaaaaaaaatgcaagattgaatttttgaccttggataaaatctacaatcagccctagaactattcagtggtaattgacaaagttaaagcattttctttgaaaggaagatggaaggagtggagtgtggtttagcaaaactgcatttcatagctttcccattaaattggagcaccgacagattaaaagcataccaaattatgcatgggtccttactcacacaagtgaggctggctaccagccttgacatagcactcactagtcttctggccaaacgactgtgattaaaacacatgtaaattgctctttagtagtggatactgtgtaagacaaagccaaattgcaaatcaggctttgattggctcttctggaaaatatgcatcaaatatgggggataatctggatgggctgctgctgtgctcaatgtgaactatttagatacctttggaacacttaacagtttctctgaacaatgacttacatggggattggtcctgtttgtcattcctcaccataattgcattgtcatcactaatccttggatcttgctgtattgttactcaaattggtaataggtactgatggaaatcgctaatggatggataatcataacacttttggtcacatgttttctcctgcagcctgaaagttcttaaagaaaaagatatcaaatgcctgctgctaccacccttttaaattgctatctttagaaaagcaccggtatgtgttttagattcatttccctgttttagggaaatgacaggcagtagtttcagttctgatggcaaaacaaataaaaacatgtttctaaaagttgtatcttgaaacactggtgttcaacagctagcagctaaagtaattcaacccatgcattgctagtgtcacagcctttggttatgtctagtagctgtttctgaagtattttcatttatcttttgtcaaatttaaccctgtttgaattctctcctttcctcaaggagacacttatgttcaaagtgttgattctttgccttaggtgcatagagagtagacagtttggagatggaaaggttagcagtgacttagccatatgttctgtgttggaatttgtgctagcagtttgagcactagctctgcgtgcctatgaactgaatgctgcttgtcccattccattttatgtcatggagaaataattccacttggtaacacaaaggctaagttaatgttattttctgtacagaaattaaattttacttttagccttttgtaaactttttttttttttttccaagccggtatcagctactcaaaacaattctcagatattcatcattagacaactggagtttttgctggttttgtagcctactaaaactgctgaggctgttgaacattccacattcaaaagttttgtagggtggtggataatggggaagcttcaatgtttattttaaaataaataaaataagttcttgacttttctcatgtgtggttatggtacatcatattggaagggttatctgtttacttttgccaagactattttgccagcacctacacttgtgtgctttaaaagacaactacctgggatgtaccacaaccatatgttaattgtattttattgggatggataaaatgtttgtggtttattggataatccctagatggtgtgttacgtgtgtagaatataattttatgatagtaagaaagcaaaattgaagaaaataagtttagtattgaatttgagttctgaagtgaattcagggaatgtctcacgtttcgggcttct

SEQ ID NO: 26930 - DNA, 1200 bp, Mus musculus
aattatttgtgtgtgttgtgtgtgtgtatctatatgaatatacatatattgtgtgtgttgtgtgtgtgtgtatctatatgaatatacatgtgagtacaggtatctgagaagaccgttagagagcatcagatcccttggatctgcagttagatgtttgggagccaacccatgtgaactttgctcttctaatccctgaacctcttctctagtgcccaccacatgctaacacatacagtatgctcaacacaagtttttattgagtgaataatcttaggtttattccctccttatttgcttagtatagtagtttagatagattcctttttcattcctatcatattgtaatttgttttatgtatgtgtgtgtgtggttgttttactaacatgactacgttttcttactgcttttgtagaatattaatttttttcaaatttttattaaaattttttttcaaatcaaattgtcagtgtaacattgtattctccatttttttagataaagctctaaaggaaattgttgagcgtgttttccagtcaaactactttgatagcactcacaatcatcaaaatgggttgtgtgaggaggaagaggcggcttcagcgcccacagtggaggaccaggtagctgaagctggtgagtatttgggtggatataaggattagttttggttctggccttagtttctttttcctttctcattcatatgtatgtatatatgtaaaatctgtatactcaaataccctttgaacatggcaaagtacattcagcaatctgaagtattcagaacccatcatgtatcttacaggccttgatcacaggtaaattagtaactctcttgcctacttagtattgttggataaggagtatgggttaggggcagttgtaaggatttttgtctgacttgttttacttctcaccataccaacatatagtatgataactatattggaagcatatatatggaacttctagagatctgtctgcctctgcctactgagtgttaagttacatttcttctttaaggctgtgtatagaactctatggcttgaactgtaaactccttatccgctagggagttttgcagttgatgtttagcatcttaatgaaacacaggtgtgactagacagcctgagtactttcataattaataagttgatgaataaaattgaaaacagatactacaaaaattttgtgatatt

SEQ ID NO: 26931 - DNA, 1153 bp, Mus musculus
agccttttaagggaaaagatgggggaactgaggggaaaaaaagacatccttcattgaacttacatggtctccttttctttgtcagtattcttcattcatgaagaccttttttttttttttttttttttttggtttttcgagacagggtttctctgtatagccctggctgccctgaaactcactttgtagaccaggctagcctcgaactcagaaatccgcctgcctctacctcccgagtgctaggattaaaggcgtgtgccaccacgcccggcttatgaagacaattttatttattatttttcaagttctgaactcctttctgatgtcatgagtgatgtttgccgcaaggagtcagtggtggatgtttggcttgttcttgcatagaatgttcttaagttggacactgtcttgggtttatgttctttgacagattcagaaaacaataaagaagacagcacgtcgggaacagcttatgagagaagaagcagaacagaagcgcttaaaaactgtacttgagttacagtatgtattggataagctgggagatgatgatgtgagaacagatctgaaacaaggtttgagtggagtgccaatattgtctgaggaggagttgtcattgctggatgagttctacaagctcgtagatcctgagcgtgacatgagtttaaggtatgatggtgtctgggaacagaatcttaagaaatattgctcattggcagttggaaggtagttaatgttttctttgttattgcaaggttaaatgagcagtatgaacatgcctcaattcacttgtgggatttgctggaagggaaagaaaagcctgtgtgtggaacaacctgtgagtatcacagataattctgagtttatagctaggaatctttaaaatacttttctgtttaaggcattttgcaagtatataaacaacagtttgcatttatttttatgcattctttttttggcatgccttagtgacattctttgttgctttttatacttgataccttcttgggacaagatttgtagatggcttttcttctgccatgaaatacttattgcttatcctgtcagcttgtacagcagttataccagggaagttatagagcctcagcctaagtccagtctgttacgttttattgtgtaattttgttaattt

SEQ ID NO: 26932 - DNA, 1143 bp, Mus musculus
ggcatagatgaatggtagatgctggggactcagccacaagaggagagacacttactgtgagggactgaaggaagtcatctgtagcttttgtagtgacagtggttagaaatgggaaggattgctgcaggatggatcattttctttttcctgtaaagtagaggtgatagttatttgctggaaatgacagggggtgggggaattagaatgaagctttgtgagaaggataaagcctgaaaggctggcctagaagttacctggggaaggctgctggtccaccattctatctccagggaacagttcagagacaagaagtgttccttgcaattgatttgttacagagctgagaatcaaaatccacgggtttataagtatttgattaagttctccaccacttagccacattcgcagcctgagaacagcactctctgagaacagagaaagactctgggtatctctctagcccaacacttcacctcccagctggaccccagcagaattctcttcactgtgcctaggcctcacccaagtgccctcatactgtgttttctacacagccctcctgttctctctctctctctccctccctccctccctccctccctctctttctttctttctttctttctttctttcttttttttctttttgagacagggtttctctgtgtagccctggctgtcctggaactcactctgtataccaggctggccttgaactcagaaatccacctgcttctgcctcccaaatgctgggattaaaggtgtgtgccaccatgcccggctggtaacctattttcttttcttttctttctttctttctttctttctttctttctttctttctttctttctttctttctttctttctttctttctttctgtttgttttttcgagacagggtttctctgtatagccctggctgtcctggagctcactttgtagaccaggctggctttgaattcagaaatctgcctgcctgtgcctccagagtgctgggattaaaggcgtgtgccaccgtgttgagaatgaaatgtcagagtgtgcatatgcaggtcagaaagcaactttgagcggttggctttccatccactttgaggtgggttctaggaatcaaacccaggatgtcagacttgattagcaaga

SEQ ID NO: 26933 - DNA, 1156 bp, Mus musculus
cttttaaaggtagaagtgtagattattgattgtagacctttcctgtttctaagcactgttctagctgtattgtacaaattttgatatattttggttaatatttagttcaaaatactcaagatttcccttgtaactgacttacgactgcatagaaatatgttaattttcaagtgtttggaagattttagttatcttttgcttactgagttttaatattattgtggttagagaacttactttgtattgctaatattttttaatgttttatgaccccaaattatgtgaagaatttctatatcttgataaatgatctttgtgtctttgaaaagaatgtatattctaccatgtgagaatttattctatgacaggccaagctgactgattgtttgacaatgtttgccaagtcatctgtatatttattgttcttttttttaaacttttgttacttcagccattgaagagattattgttgaaatctttagttaatggctttgtccattgattactttattcttgttatatatctgcctcatgcattttgaagtgatataattgtgtgccagtgcttaggattgttgtctgtttatggaagtagttctttgattcttattcagctttacttacattccttgtcctaagttaagagcattgaggtaatgcatgggcaggcaggcagccgagcagggtcagcttgatgcttttgttgcttgtctttactgtttgtttcagtggatgtaaagtacgggctttactaaaaggcagtggttctcaagcctttgggtttcctcacctccttagatgtataaaaaccattgatgcctaagaacctgtttacatggtcatgtcagtatgtaccatatcagaaattcaaataggacatttataaaagtatcagttccttttaaaactacaataaataaaccctttacatgttcaaccctctcaactgtatttatttatttatttaaagctttagtttctgctcagctacaagaaaaagtagttgacctgttttacagaaagtgttcttctaaaaaatggagagtcattagaaaaaatgagaattgtgacttatgttactgaacgtaaaaaagacagtagggttgtatttattgaccttctattatcctccttgatatggagataatagaattgt

SEQ ID NO: 26934 - DNA, 1183 bp, Mus musculus
tgatgaatatgaagagatggaggaggaagctgaggaggaggaggaggaagaaaatgatgactctgcagacatggatgaatccgatgagtcagatgcggatgagaatgagtcagatgagggtgaaggggaggcgagacggaggagggtctttgatgttcccattcgcagacgccgctgctctcgtctgttttagctgctgctgaaggaagctctgggatgacactgttctgttaaacagttttgtcaataatgtaaataattgtgctcagcatatagccggaagctcgcatgaaatgttgttccagacctaggcgctacatgacactacattaggcgttggatcgctttgcttgactttgtgcttgtaggtagaggaacaaatgggaattgtttgttttctcttccaggggtcaatgggagagcagctctctagctaaagaacaggagttcctttgtttaaaaatattttctacttaaaaacaaaacagaggtgaaggggaaattgttttggatgaggattttatatgtaacaaaaacacccacccaagggcagaaagagactgcaggaaggactgactgtgcaaagacccctctcagttgtttagacactaacaaaatttatacttagcttaatccacttcatggttgttaacattttatactcattgggcaactaaatggctaagttcaatagggatagtttgcccttacttagacaatctctccttgcattagtctttgtcacaccgacctgagttgcaaatttttatcattacttttaatttaaagtcttcaacataactttgggctttaaaagttaaagttcttacgctatgaccgttctcacattatttatagattcatcattttaaatgtagtttgtgaaagtacgtagggtgttgctaaagattcttcatgatgtctcatgtagtctaaatttgtaaatatgctttctgttttgtttctttatacatttgtctaactttgtggtaagtgatctgaattttatgttagggttaggatatttttgtgaaacatggatattttttttttggtaattatataattgagagtttggaatgaaatccttcaagtgtcaaaaactcctattttgaaaacatttttgtgtaagtgcctatttcccatagatagtattgagcttttgttcttaagctggaagatg

SEQ ID NO: 26935 - DNA, 1181 bp, Mus musculus
agtttctttggtctttactgaaggaagagagaggagagtaggattggaactgattagaatgggagattcaaactgtcaaagcacagaactttcccaagaagctgtttttatttccctatggcaaactgtcctttctggaatgttcagagatgataatgttgtggaatccccagacaagtctcttgtggggatgatgttaggtagcgagcgcccttttagtatgctggttgatctttcatagtcttagtcttttgttacttaataagaaatcagctataaataaaatgtatttttgtaatttccatgtgtatatatggtatatttctaccaatggccagttgtagtccaaatccgaaatcagcttgcagaacactgtggccagtgcaagattttactgacagactaatacgatgcctaaacctagccacacgggcatttgatgcacatgaatgagcaaagagccaaagaaactcagccttttcatgcaaatggtgtaagactgatatcgccagctacatcgctccactttatcaataatatcagctttccatccatgcggcgtatcaacttgggactttgtggacttggcaaatgcttggaatgtgagaaagaagtttctagactgtatgcttcaaaaagacagtgtctaagctttgggctccagtaacttccagaaagatcatgaatccagagttaacagtggtgtagctccagatttctaggaagatgaagctgccgcttgctggagtcttggcagaacccatgaaatgtttagttcatcgggacaattaaaatagagcctggtaaatcagctgcccttttcagctagacaccatgggttccagaagtctatgcaaagaaaagcttaaattaatgaaaacattgctatgctcatgtttttctaccatgattaaagtctcctgggactaagatgttgttctttccctaaagagtctcctaatggtatagaggtgataggtccccagataggagactctgagaagttcagatggttaaaatcatttgatataaaaaatgagatgaggtcccaagggagcccagaggaggcagcagtgagctcagatcatcatgaccttccagacagtcacagaagccattgaggatctcagtggtttgcaaggaggaagccaaactccagacaagtggagggtggagcccca

SEQ ID NO: 26936 - DNA, 1149 bp, Mus musculus
taggcctctgttcccaatcactttcttttaatggatgcatggcaagagttctttctgtgtctttgagttctagttctagatatgagccacttagcagacagatgattcacaatcctgtggcatctctcattctgttatgagtgttttgtgatgggtgaagttcttgcttttgagggagtccaatgtgtttgtttctcccggttctatgacgtctctggtggcgtccagcacacacaggcctgtgagctctttcctctatgctctgattcctttggctttagtgcttacatgcatgtctttgatccactttgagagattttggtcgatgaagtaggtatatcttcaccttccttcttttgtaatgtggatatcaactattataaagattaccgttttccctatagcccagccttggtaaaaattgtttcaccctatacaagtaggtttttttttttttctggcctctatctataccattgatctctatgtttggcataagagttgaagcacactgttttggttatattcactttttaaaaataaacttttgaaacaagaaactgtgacacacaattcattcttgtcaagattgcttttgttgttcaaggtcttttggggctctatttgaacttcagggtagatttcttggtttctatctttcattaagggttttaaaattttttcttaaaaggtgtgtgtgtgtgtgtgtgtgtgtgtgtgtgtgtagtagtagtagtagtagtagtagtagtagtagtagtagtagcagcagcagcagtagtagtagtatatacaggtgcccacagaggtcagaacggtgcatcagaacccctggagcaggagttccagatggctgtgagctgcctgatgtgggtactgggaactgaacttaggtcttctgtaagagcagcaaacactctctctagtccctgcccctccattctcggttttctgagacaggactacgtactctgactggtcttgaacttgctatgcaagcaacactccccttgcatttacagcaatcctgtctctgactctagaatgggattttggtaggtatcagattcaatacacaattcccattggggaatattgagctctttatagcttaagatctttcaagcaataaacacagctccattccca

SEQ ID NO: 26937 - DNA, 1144 bp, Mus musculus
tttatacagctggtgtgaggtagttggactgggaactccaaaccccacactctgagctgtgacactgagctaccttcatatgaagatcatagctacctaatcgtcatgacagagatcgtcatgacagagatcacattatatatctttcaatgtgtaataataaatgattaaaatgattggagagctgaggatggtgggtggtgcacatttggaattccaggattcaggaggctgcagcaggaagatcatgaatttatccaccctgggctccatagtgataactttgtctcaagagtacaatgctgtggtttgaatgtgataggtctctgtcgctgtgtgtgtctgaacacttggtctctaactggggtgctgttgggtaagattgtggagcctcaccagagaaagtggatccatgggttaccagtgccctaggtacccactgcatagagtggtgttgaaacctcaggaaaagaggcttatttatagaactgataaacaagcttagtgtgatagctgttgggatcgataactaaagtgtaattccgtggctttggggaataatatacagcccctctccgtgggttaaagtgaagaaaagaatgtggacagagttggatgtgcaatgtgctcacagtctgggttgtgaaccacagcctttccaagaacagagtcaggaagtagggtccttgtggaatgacatgggaggtggtgagggaagcgggagtggcaggacccttctttttcttctacctgcctagattgattctaagttttctttcatggtcattgacttagttaccttcttcatctctgtgaccaaaatacctggcagcagcaactcaaggaaaggagggtgtattggctttgagtggttacatgctcagtggggtgtggggtgggcgtccatggtggaacacatggtaccaagaagcagagagaacacgttggaactgtgaacaggtatatcagacagtcaggacctgctggccttattccactaaccaggttccatcccaaagggtcctcaacttcctaaaacagagccaccagctgggaccaaacacatgaacctatggcgaccgttttccatttaaaccatggccatcatataacccaggggaaggtgaaattatatcactcttct

SEQ ID NO: 26938 - DNA, 2098 bp, Mus musculus
cgagggaccacagccagctattccaggttgctgggcatgagcaatggtcctcgcccttgtgcgcagctgttcctactgctgcactgcctcccgagctcctggttcagaaattatattttgatgagagaatattttccacatgtgtgccatttgtttagggagttgtatttttcctttcacagggaaaatggtccgtacagtttctactgcacatcctggctatttagatggtcactaagtatttctccaaattactaaaatattgaagaactaatgtagagttattgaagatattacctcctcccaggggaaaaatcctaatgaaatttaaaaattattattattttagcatattgtgaatttgaccctgaaagttttcttcctacagttcaaagctgaaggaaaaacttggttttctggctaacattcctttcttttttgcaggtatggcctcacaagtcttggtctacccaccgtatgtttatcaaactcagtcaagtgccttttgtagtgtgaagaaactcaaagtagagccaagcggttgtgttttccaggaaagaacctatcctcagatccatgtgaatggtagaaactttggcaattctcatccttccacgaaaggtagtgctttccagacaaagataccatttactaaacctcgaggacacagcttttcattgcaggcaggtgccattgttgtcaaagacactgccggtgctacaaaggtcctagcagctcaggcgcagcaggctggagtggaggcaccgcgggccgtggtgtggagaaacaggttacatttcctagaagggccccagcgatgcgggttaaagcgcaagagtgaggagttggagaatcacagcggcgcgatgcagattgttgatgaactgtccatacttcctgcaatgttgcaaaccaacatgggaaacccagtgacagttgtgacagcgaccacaggatcgaagcagaactgcaccagcggggaaggcgactatcagttagtgcagcatgaagtcctttgctctatgaaaaacacgtatgaagtcctggattttcttggtcgtggcacttttggccaggttgtcaaatgctggaagagagggacaaatgaaattgtagccattaaaattttgaagaatcacccttcgtatgcacgtcaagggcagatagaagtgagcatcttggcaaggctgagtacagagaacgctgatgagtataactttgtgcgagcctatgagtgcttccagcaccgtaaccacacctgcctagtctttgagatgctggagcagaacctgtatgacttcctgaaacagaataaattcagtcccctgcccctgaaggtgatccggcctgttcttcagcaagtggccactgcactgaagaaattaaaaagtcttggtttaattcatgctgacctcaaaccagagaatattatgttggtggatcctgttcgccagccgtacagggttaaagtgatagactttggatcggccagtcatgtatcaaagactgtttgctcaacgtatcttcaatctcgctactacaggtaggcagcaaataatttttggctacctaacaaacgctgagtttctgctaagtgaagtttgataagtgcatgtgatgagagagactgcttctttggttaaataaggaaatcaataaaatctctttaggtttgaggctataaaaggatgtgaaaaatccaggcataaaaaaattactttaaggccaatagaaatctccactagtttcatgctaagatagctgttcttttttagttttctgcgacaggatttctctgtgtatccctggctgtcctgaagctcactctttagtagatcaggttggcttcaaacctgcctgtctctgtctcccaggtgctaggactaaaggtgtgggccaccaccacctggagatgtctggttatttttattattaatgggagataggagagaatgatgtacaaataatatgaaacacgagtcttttaaatgttggaaagtatttttgaaagtagtttctgtatatttcttggagcgtttcagtgcttggaagaagtaatttttaatttttaaagttttattttttacatttatacatt

SEQ ID NO: 26939 - DNA, 1127 bp, Mus musculus
gagacagtgtcagttagtccaggttggtctcctgaatttgacacttaatgaagactgctctggggctccggactctcctgcccctaccttccaaatactgggattataggcatatactactaggtcaagtctcaatagtgttttgtttgttcatttcaatttatttattaagtgtgtgcctctgtgtgtgtttgcatgtgtgtctatgtgtatgtgtctatgtccatatgtatgtgactgtgtgtttgtctatgtgtatgtgtgtctttgtgtatgtgtctgtgtgtatatgtgcgtatgtgtttgtgtgtatatatatgtgtgtgtctatgtttatgtgtgtctgtatgtgtgtctttgtgtatgtgtatatgtgtatatgttcgtatgtgcttgcgtgtgtgtttctgtttgtctatgtgtatgtgtgtctgtatgtgtgtctataagtgtgtatctgtgtatgagggtctatgtgtatgtgtgcatgtgtgtgtctatgtctgtgtgttggtttgtgtgtgtatgtgtgtctctatgtgtgtgtgtgtatgtatgtctctatgtgtgtgtgtgtgtgtgtgtgtatgtgtgtgtctgtgtgtgtgtgcgtgcgtgtgtgtcattggacccacactgaggtcagaggacaatttaaaggagtcagttctctctctctatcatgtgggttcctgggactgaactcaggtgcttaagcttggcagcagagtccttacccagtctcccatctcaccagcccctaataatgatcttttagtgctaactaggaggatatatgtgaatcggttacttgttttaaaattaacttttctcctggaggtggtggcacatgcttttgatcccagcactcagaaggcagagacaggcagatctctgaattccaggccagcttgggtctacagagtgagttccaggaaagccagggctacatagtgagaccctgtcttgaacaacaacaacaaaataacttttcatctgtttaacatttttgtgtttttaatgtgtcagacactgcgctaaatgcattactaatcctaattgatttaatctccgttatagccataggaagtaagacgcttgatctaatttctctgttggatccaaag

SEQ ID NO: 26940 - DNA, 1957 bp, Mus musculus
tagtagcccaggttggccaggaactaagttgaagccaagggtaaccctgaagccctgacgcccctgcttgcacctctggggctgtgtgattacagggtttatttggtgttagtgatcccacacaggacccctgcagggtgggccagcacttttttttgtttgtttgttttcaagacagagcctcacaatcagctcaagatggcccaaaactcactgtcctcctgtctcagcctcccaagtaccaggattataggcagcatattttattttttcttgttattttattattaatgtgtgtttgtgggcacccatgctaccacatgctctgccatcagacaacgattatgtggagtctattcttcctttatgggggtcctggggctcaaactcagaacttttcagtcatcagtctttcaagagcctttactgaggcgtctcaccatctcctgtaactccactggacaccgttcaacaccctgttgcttgttctgtcactaatagtttcgtatctcaactgtgtgttgcaggtgacacccattctacggaatataagtaccagctaaagaggacacacacttgaagaaaaaggagacaatgaggtcttgtgaatgctctaatttttcaaagcttacttttaatgatggttcttaaacgctttaacctcccttctagtccaccacccaccaaaggtagtgaaaagaaaggtgattaggatacaggcgaagtgaacctgttcagacatggttctttggtgcacaacctagcaggaacatccaggtctcagtggaatcagctcaaatcagcatgaagaattaggaccattaggagttccaggagaagctctcagctctgcctctctggacaaatcgatgatcaggaaagacaaaagcgcgagaagcgttgcagagttagctgtacaagctagcctctctcacggtctgttgagtcctatttatactccctccaaacatcacatgtcctccatgggtcttgcctcaccgtgtgtcttacctcagcacatgaatctgtctcagctgatatcgctctgctaagcgaccaagtcggcagaagaggcaagaagccaccagccatcaccagaaggtttttggtgcatttctctctgtggagtgtcaacaaatgaagatcaactacacaatgtaaggtggaccaagtcatgcgtattgttagcaaagaatccatcatgtatcctttcacatgcttgctttgccaaaacatcctctcatttgtgtatgcttcagtgaagtttcttcccgtatctgccttattgaaacatctcttcacttgtctctgtttcaggaaaacactccttcctgtgtgtgccccagcaaagcacaattcaatgaaactgactttctaaagaaaccaaaagttggggctggagagatggctcagtggttaagagcactgactgctcttcaagatgtcctgagttcaattcccagcaaccacatggtggctcacaacgatccataatgagatccaatgcccccttctggtgtatctgaagacagctacagtgtactcacatacataaaataaataaaatcttgaaaaaagaaaaaagaaagaaagaagctagaagtttccacttgaattttgctgtgttaatgtcattttttaatttttgagactcactatgtagccaaggctggccttggactcttgatcctcctacttctgactccatagtactgatattacaggtttgtgccaccacatctggccatattggtttgattccttatcgattctaaggagacgtcaggcacacaagggtaaactgaccctaaaggctgtctttgaaacagtggagatgtctggactgtaggttccttctggtgctttgcttccttggtatagaaatagccttcgtgttttattttcagtgacagaaaggaagggcgggggtcatttgagcagactgaaccagaccata

SEQ ID NO: 26941 - DNA, 1281 bp, Mus musculus
cccataaatttattgttatgtcagtcacataaggccctaactttcctatttgattttctggccctacacatttaacccatcacacaatttgttttatctgagataacttcccaatttctagaaactgggtataaatctgttgaagtggccattctgagtggcagggttttttgtgaaatgattgttggggttttgtgcactttgtattcagaagctgaattgacctggcccgtgtgtcagtcagtggggtctgcaagggaaagagtggggatagaggggcaagagatgtgaagaatggagacaagacaggttatttcaagccgggcatggtggcgcacacctttaatcccagcccttgggaggcagaggcaggtggatttctgagttcgaggccagcctggtctacaaagtgagttccaggacagccagggctacacagagaaaccctgtctcgggggggggggggggaagacaggctatttcaagtctcgtttattgaaaggcaactatgggtgtataagcgcagctggggagtgccgctggagacacggaaccacaagtccaggatgtgcaggagaaaaacagggtgttaccagagtgtgtttagctgtggtgggctgcttgcaaaaacatgataggaagacaagtctcttgtcagggtggaacgtcagggtggaaaagtactaatctgtaagtaaataacccaagatggatgcagagatgatagccactttctgctaagagtcggctcccaacactgaattctgagaccctaaccagactgtaacctgacattggggcactgtatcaatgtactgtaagtaatgctccctgataatcccctgttggttggggcttgtgactgggcagaatggaggtcaggactgagagttgagtatgagctcttgagagagaagccggaggtaagagtcaccattacatgggatggaccataagaagcctgtggccaagagaagtgagtcctgaggaagggctggtggagcagaagcagcctgagacacaccaggttggcaggtgattggcatttgtgtgggttttacaagtggaagggttagaatagctcaatgtgcccagcataatgcctacaacttattaataaagtataatgtttttgtgttgtttacttgagaatgcatgggcaagaagtgaggtagaaactaccaatagatgctacggagtaaaagggggtgtaataatactccagaaaatgatagcatttaataaatggttgttacatcagctactgtatccacaaaatct

SEQ ID NO: 26942 - DNA, 1168 bp, Mus musculus
attattatacataagtacactgtagctgactttagacgtaccagaagagggtgtcagatctcagtatgggtggttgtgagtcaccatatggttgctgggatttgaactctaagcaagacttcaaaaagcaagttcacagtggaactacttactctttgttcacgtcctcctgtactttgtgcacacactgaaatctgaccatatccctagatcacaagatccaggaactcagacctaggctagaatgaaatgccttctttgatcattaacttgtcccaagcctgttcttttctcccaattatgtgcttgtaattcatgaaagctcctattccaacccatgcagccctcacgatcctacaagggaaggggcacattctactcttagttctaagttattatatctttttggcaaaacaacttaaaccatttccttaaattttctatcaactattcaacttcttaaagctatttaagtcatgaattccacaaagttattaattcatataaaatatgttatgaaagttcatcttcatattgatctgcagaaaaattgcccagtagagtgggtagtcgcccaagaagcaatcacaccagactgtggacagtgagggtctcctcacgcccattcacaccatgctagatacaggaggagcacagcaatgacaagcatgaggaggcacagtggcagcaagaagcaatccagagacagaaccccctcccccccccccccccccggggctgtgcctctgcaggaagctcacttgcctgatgcagttcctcctgcatggcaggagggccattgctctatccatacgggcttggtcagccattttaagggcagaaacgtaggggtgttggtataacatcagcagtgcctcctttcccccacccctgccccaaaacaaaccttacaaatttagaaactcaatccatgtaatgtctggttttggataacctgcgtagtctatggttcttttttgtttctctctctctctctctctctctctctctctctctctctctctctctctgtttttggagaccgggtttctctgtgtagccctgactatcctggaactcactctgtagaccaggctggcctcgaactcccaagcaccaccacactcggtatagtctgtgattctttttttttttttctttattagat

SEQ ID NO: 26943 - DNA, 1160 bp, Mus musculus
aacatatattttccaggacttccaaaccctcctgttcattgtactggaatagtctttgatgtagggaaactaacagcagagcgtcctgtcacctgtgttaaattgtatctcttttcacataggctggaattttaacttctattttgaaatctgatctataattcctggatgcacaatgaatctttgggaggtcaaacctcgcctttgcaagaccctctctaccgttcctgatggcaaaggaccgtaaactccagtagttgctatgtaacacttgagtttttcaggagagtgagaggtttgcctgtggccttttctagagcagcactgcctacagtactgcttagtgaacatctaatgcctagtggaggtttctttgctcagcatgctgccccttagctgagatggcttgtcatttctgctgccagaccccaaaggccctttcccaactgtaagaatattcccaccttggatatctcttttggatctgcatttctgaaccctgtggcagcttttgccaccttgcttatacaccctgggacgtgtaggccttctttctgcttgagatttaagaaaaccattgcccctagaaactgctcgctctgcttcccagtgcaaagtactgtatttctcaaagttaatggactggccattatgagatctgaggcttttggtttggtcacagtctctgcaaatgaccgtatttaccacagttgaagcacagggcattttgattattggagaccactagctagagcttgacctatcaacatgctgtacattagaaccaatatgggtcatatcccttatcagttcatcctcaggcactgcccatgtctttaatggtctactgtagcttttgtttatttttgctactttgtgtgggatctgtgtgggttctttctccaaacggtatcttctctggctaggagcagcttctccgactcaccctcctctccagccctactcagtcttctctcttctgcatcacctgtcttctgtgatctttctctttccctctactcccattctctctctccaatcctactcctgtctcctggactccttcccagcctttgctggctttttatatcctcttctgttcccagaagtacaggaggacaccaacactaacagccaagcagttctaacaggtaagcatt

SEQ ID NO: 26944 - DNA, 1201 bp, Mus musculus
acactgggttaaaatgaatatctgagttaggcttacatatttatttccggtgattgtcttattaaaagcaatatccttagcatttttacctgctgtttggctctgtggtaccaagtcatgggaatttctctcggggtcaaatgttccatttctgaaggtttagaagcctactttgtgaacagaagtgacctaataggcttattttatgtaacagcaatgctgttggcaagagaatcctgagatttcattttataagcagaggagaacaggacacagccatgttccagtcttatagcattgaccctgaacaccgtgtctttctaacatggagctgacacgcctatatatctttacctgtatcttgaattaaaatatacagagcatgtttgaacttctttttcatgaataaatctctcaaggataagcttattaagaaatacccatttctttattggttttgttgtttaaagcagggtctcacactctagcccaggctggtctagaactcaatattagtccattggctccaaattcatggcagcccacctgtctcagcctccaaaatgctgggatcatagacgtgagccaccatgcctagctttctgttcccttgtgaactgcagttgccctcggcctgttcatagctgagtcctgttgtaaaccatttcacaagtgaaggccaggtcctgtgagcttccctcaagaccctgctgctcagaggaattgcacctctcgtttattcttacagcataggaaatatcagcctcaggccgtagaggaaagtgggactattctatagccacacaccagtcctttctctataggaagctaaagaaatgtttagttggttagtgtttaccagggaatttgaaatgtatgatataggaaaacatttacgttgtagacaaagaggtgaagcacacgttgccataagctaggaaaatgttaagaaagattggattttcctacttatagagatctggagggtggggatgtggctcagtgctttacactggctagcatgtctgagaccctgggcttcctccacaaccctcatccctcaagcacacatagagagctggggtaatttcatgtaaaagttattctgtgttgatatttattactaccccagaaaactggttgccaaaggggcctccttgccattttgatataacctagttactacttgatctctaataaa

SEQ ID NO: 26945 - DNA, 1149 bp, Mus musculus
gaaaaatgtaaagtgggtggaggacctatttgaaaaatttggagaacttctaaatcatgtacaacagaaatgttcctaacatgtccacagaatcccacgtttttatagcactaatgaagtgtggaaggctagtgtcacagataatgcagccctctagcagaggcctcttgtagcattcccctgccgtggggaactgtgaccagacctttgctgccatggaaaccagtccttttatcctaatgaatggtttttctattttataaactgtggggtgactgtcaaatgataaagcatgcactaagtataattttattgctagagaaataacattgacgtgatctgacttttcccccatgacatgtcagaagtaaagagacagcagaaagcatttgtgtctggccacagtgcagaaagtattgtaagttgtggaaagtgatctggtgtgtggcatcctgtgtaaaaatgtcttcaatttagaacatgaagctcagcagctgcaccctgccctgtggactccttttgcatgtccgggaaatggtgtggagctgtgcaattctgtgactgctttttgtgtcgagttacattgtgatggaaaaaaaatgacatattattttccctgtttcaaagaaaagtatttttgtttatagtgtgtttttactttggaaatttttcaactgtacattttcttttactgatagttgtatttttcacaagaaaatgtggttttaattgttctttctgtgcttcattgttttcagtaagccctgtgtaggtacatgtcatttgcagcatagattctgtcttgaagtggacatttttgttcatacccttttgccatgttattactcagaagattcattcggtgctagaattagtttagctttataaatgggactgtgtgaaacactgcatttaatttcatatttcataaaataaatttcttaccaaactagcacttgatttataactgatttttcaacataaaaattattgccaggcatagtagtgcatgcctttaatcccagcacttgggaagcagaggcagtcagatctcttgagttcaggccaacctagtctacatagctccaggacagccagagcttcatactgagaccttgtccccctagtaccccccaccccaccccacaa

SEQ ID NO: 26946 - DNA, 1456 bp, Mus musculus
cttcatgcttcatggccaacactttactgactgagccatctcccacaccctgcctgggttgtctgtaaacaaagaatcagaattaaattagaagaaactgtgtcttcagtctaatttttaggctactgatatgaaaaacaatattaaaattgtcagaaagggaaaatttagtgtcccgtctcttattcatcctaggctttgagcctccagccccctctgtcactcgttttctgaacacaagagcaatgaaggaaactttcaagagttacatggaattgcttgttagcattgctctggatcctgacaccatgcaagccctagaaaagagcaacggtatggcctgctgagaagctcattcaaaactttttgtttaaataaattttctcactgttgtcacttttgttttattttgttgtttattcttggggtttttattgtttgttttagaacaatgtctcattgtatagacaaggctggtctggaactcacagatccccaggcctctgccttgtaagtgctggaactaaaggtatgcactaccacgcttggccttctttatttctataattaaaattattacagaactctagtgacatgtactaaatttttaatgcaaacatagcctttgcatatataaaatttcatttaaattcaatggcaagactgcaggattaaatgggattggggcatgactgtaatctcagcacttgagttgcagaggcatgtggatctctgtgtatgtcaccctgcttgacatttttttccctaatgcttgctgttacttatatacttattgtggtatatgtaatgtatgccaatactgtgctggtaaattaacagctatttaatatgttaccaaaaactattaatttgtttctgtcatattgttactctccccttttctaacgtaaccattgtgactcaatttttgacaataggtaacaattatttttcttcctctactttgtctttgcctcagattccagtgaattaagaatatctcacctaggtgttgtggtaaatacctttaatcacagcattcaggagtcagaggcaggtgtatctgagttctaggccagctagaattacatagtgagaccagtgtcaaacaaactcttttagtgggattaaagttaatgataaggtccttacataactaatatgtgcaagccctggctccatctccagtgcttgctagccagaaaaacaagtcttgttcatattcaataacttagaatgttaaaccagtttgtattttgtagcattacttttgttaaataataaatgagatttagaaaaattaatcatccttctagtggtcattgttttgttttagttaagatacagtgctaggcatggaggtgcatgcatttaatcacagcacttgagaggcagaagcaagtggatcaaagctaacctgatctatctaccatgttctgtaccagtcagaactggc

SEQ ID NO: 26947 - DNA, 1167 bp, Mus musculus
tttggggtttttgacttagcatgttttcacagttcatttgtgttaacagcacatgcgatactgtgtacatggaggttaaaggacaaattggggaagtcggctctccttccacagtgtgtgtcctgggtattgaactcaggtatcaggcttgcacccagtgcttttactggtgttgcttttttgctggacttgattgtgtttgtgacttgcatttacctgactaactgtgaatgcttactggacagttatatatcttctttgcaggaatgtctctttagtccttacttgctttggggtgcagtttctagacagggtttctctgtgtagtcctggctctcctagagctcatctgtagactaggctggtcttgaactcagagatcctacctctgcctcccacgtgctggcattaaaggcatgcgccaccactgctgggctgcagtactagcttattagtggttccttgtccttttgggattaaatttaggatttcttgatttttgtctctgggttgaatttgttttatgagacagagtctctgtagcccaaattagctttcaattctgtacagctcaagatggctttgaattcctgactcccctgcctctgcctgctcaggactgagatgattgtgtgcctcatttcaactggctgtattccgggctttaaactttattatatgcatgatttgaaaatattaatatagtattactattaatactatatggtgtctttctaaatgttttacattctgatggagcccaacttactgattctgttttttgtgcttttgttgtggttaaaatcaaatccaaggacatcaatgcttaaaattttaagagttttatatataattattattttcttcttaagactcttctttggtcctgttttatcttagaatatttaaaaaataacatttagagttggggtgtggcttagtagtaggagatttgtctgtcgtgcatgggaccatgtgttcagtcatcaatacagacaaataattccgtaatgctactactgatatcatcagtgagcctttaaatattgtgttcagcttacaatagtgggtacaagttttctagaattctaaattatacatggaatcagctacatcttatcattgataaatactgtcaggttttttgttttgttttggtttttggtt

SEQ ID NO: 26948 - DNA, 1550 bp, Mus musculus
caacagcatgatcaaataatgagtgcctcatctcagatacagattccaaatcctgctttagggcagagtcatcaggctcttcctcatacatcagtccttttagactctgcctgtgacttacagattcttcaacaggctggaattctccaggctagcctgggacaagcaaaggcatccttgcaagtacagcgtgttcagagtccgcaacagatagtccatcctttcctacagatggatggtcatatcatccagagcaacggtgaacatcctcaacagcagctccatcctcacaattctgatattatgaaactagacctccctgaaccttcaaaaccattgcaacagctaacaacaaagggccccttcagtgaagccaatccacatgactcaaagaatcagtttgtttctcttggatcaatatgcttctcagaggcaatgcttctcagtgatgaaagaaatattttatcaaatgtagatgacatcttagcagctacagcagcagcttgtggggttacaccttctgacttttccaagtcagctgcaaatgaaaccatgcaagatattgaaagtagtgattctaagtctcattatcagcagtcattaaatgtcaggcatgtgaattcagattttaactccatagcagcttcagtaggaaagccacagagtattaatgatatttccttaaatggaaatcaggttagtgtgagtctttcatcagtgcccacccttcagtcagaaacagttcttgatcaaccgcatatggaaacacctagtcaaactataccaactaaagtaccttctgccatggttggactgggtcaggaaatccaggaacaaagttctgacccattcaagaaacagttgactataaaccatgagtctaaagaagacagggaaattgctgttgacagtgcactgagtaataacagaaatcaagagtttgtctctaatagtcggagcataagtggagacagtgtagtatcagagcgtgactttaccctagtaggtgatgacactggtgtgttggtgaaccctagaaggagtacacttgcactgctggccatgccccagccaggggatgcagccagtggcaagactgaagatgaaaaacaagatgtaacatattttaaccttccaaaggaaaaagctaaaggaaaagaacaaggtaaagaggaagaagataatcaaaaacagctgaaaaggtctgctcaatgcaagcgacagaaccccagagggacagatgtgtatgtaccatacacttccccttccttggaaagctgcgatgaaggttttcagcatcaagaaaagatgaggcagaaaatcaaggaagtggaggaaaagcagccagaggtcaaaacaggatttattgcttcttttttagacttcctgaagtgtgggcccaagcagcagttctccactcttgctgttcgagtacctaacagaaccagacgatcaggaatccaaaccacccgtacgttctgtcccccaccttttgcaaagacatcacctgcagcacaagcaccatctgaaacaggaggggtcagtctgtc

SEQ ID NO: 26949 - DNA, 1132 bp, Mus musculus
ccttgccaaccactgggacacttccaccaccaactttgtctgcctatcagcattcatctacctttagcaatagaaactttgcgaccacctcacctttggtgcttcaagattcatcttttaacactacatccaatggaattttaagccctcatgaccctttgctacaaattaagacttcccagggaactgttccgactgctttggcatttgagcgcctgggcagttctgcattaagtaacagcgtaccacctcagtcttcaacatatcgctcagctcaagagtcagcaccccatcttttacaacctcaatttagtttgttgccttcaacacttgggggagcccagcaaacccctcaagcctataattcagctctttttcctagttctgctgcttccattgaaagagcccttcttcgagaatgtagcgttattaaacaccaccagcggccttcagttacccagtctattcaggcacaactgactggttcacagcatcccttacatagctacctatcaagtgcaagtattggtaattttcaggaaccatccaggcagtcgtctttatcctgtagttcagttcgagattctactcaggtgagcaatggagtattgccgcagaagacccctcaggtctcagcagaacttgctcagtcttactcatctgtaattccatcatcagggtatcttccttctgctacaaaagtagacagctgttctacaaaacaaccactaacatcaactacaattccgaagcctcaaagtgtaattcctcctgtgcaaacactaaactattctaaacctttacataaccagagttctgtaatatcaggtcaagcacaaatttattctacagcacagctaccaagccttttatcagtcagtcagtcccaaaattatggtttagtacagccacataatgtgccatctattgttcattcacaggtttataggtccagcagggttgagaaattgccatccttatataaaacattgactttttctgggtcatctcagcctgtaacctctgaaaaccagacacttagttattcatccaatcagcaagaagtattatccttagttacaaatgagaattatcctgctcaaacaagagacctgccatcagtcagtgagtc

SEQ ID NO: 26950 - DNA, 4259 bp, Mus musculus
ttttttggtttttgttttttttttgtttttggttttttaattactattcatggactaaggggatgcttcacttggagagtgctggtcatacaaatagaaggacctgagttcaatcctcaatacccatgtttgaaacaaaccaaccaacaacaacaaacaaaatgaacaaacaaacaaacaaacaaaacaactttgagtacttgggtgcacacctgtaatctcagcactgtggggaggactcaggaggacccctgagcctggtggctagccacaggaactgaaccaggaacctctaaattcagtctcaaaatttaagataggtgggtgaatgcctttaatcccggcactcgatacgcagagatctctctgtgagttcaaggtcagcctattctacattttaagttctgggacagctacaaagcctgcctgagaaaaaacaaacaaacaaacaaacaaaaagcaaaaaacaaggcttcgaggtaggggtatatgtctttaatcacagcactcagaagacagaggcagaaggatctctgagttcgaagccaccttggtttatatagctagttccaggacacccagggctacacaaagaaaccctgtctcaaataccatttaaaaaaattaaggtggagagcagttgaagaagataccaatgtcaacttctggcctctacatgcacaagcttgcatgcatgagcatacatgcacatacaatattgagctagaagtttagtaatagaatggtagaggcaagtggttgaacatttacttcatgtccatgaggccctggctttgaggtcctcagcagtaccaaccagaaagcctttgcatcttagatgcatgggtaggctttgttttttttttctcattctgtttgttggtgtgtgtgtgtgtgtgtgagtgtgtgtgtgtgtgtgtgtgtctgtgtgctcatgcgtgagcatgctggagatagaagcaaagcatcatatgtgctaagcacatgctgtacaattaagccaaactctgtctcccttgattctccgagtacattttaacacacagaaaacacatcatagtcttatcagatacttgtcataatcatataaatggccagttcttccctaataatgtagaagagctcagtgaaaaaccccatgctcagcatacgtgcaagaacctgggtcagacccccagcaccaaaacaaaacaaaaacgtagcagagtgtgacgcgcaagtgtggggcacatactcactaacatatatgcttgtatatttgaggtccattgcttgttagcagtcgaggaaccatacatgctgaggtcaaggaagcacacactcttgaagactcaactgaaaaaaatattgggatttctttgtctgtttctgccagacgtttccctattctttaagatcctttataaattggtactgtgttttatgtttatagagtgagattgcaatcctgcttgcatttgatgatttcgtccaaattaagtatctagaaagttacattgtatggcagtatttgtggatgtgagggtatgagtcttttatggcattgtagtctgttggacctggtataacataccagcagtctcaacacttaggaggcagaggcacgaggatcacaagtttggagccagcctgggctacatacttagttcaagggtcatctggaataattggtgagttcctgtctcagataaaacaaagcacagacagcactatctttacgaaggcataaaaggaagacattagttgttagagactgggaaagctttatccttttacattttcagacttgttggctgcttgtcacaaataggtcatctaccaacacttctatgtaactagaagcatttttaagtcacccatattgcccctcaagttctgttgttctccaccgcatcgtttccactataactataggctttgcatgtatttcaattctctttttaaaaggttactagaaccgactgcttgctttgtaataatcagagttacaccatgacttgcctgaactcccccaggtttgtaaaagctgggtttgccgtgagtgagcccaggtcccacccatctcacacagaattatacttaggacaagtagagatataaaaagatgggagaaatagagagatttttctgtggttgaaagcacatgctgctcttccaagggaccctttgtacccaagctctcacattgggctcctccaaccacctacaactccatctccaggggatccaatgccttcttctggtctttgcaggcacctgcattcatgtggcatacactcacacagacgtgcactcgcgtgcacacacacacacacacacacacacacacacacatataaattaaaaacatagtttttaaatttttattttgttttattttagttttttaaagcagtgtttttccatgcagccctggctgtcctagaactcactatataaaccaggttagcctcaaactcagagatccatctgtcttgcctcccaagtgctggcattaaaggtatgcacacctggcacatatatgtatgtgtgtgtatgtgtatatatataaaatttagtttgtcttcttttacatttacagtgctggggatcagagctagggccttgctcatggtaggaaagagctctacccctgggctacacacacttccataccccatatcttttaccaaatcctaatttgaaatgttgtattgactctctgagtctaagcacaaagttagcttcaggacctgtgacaacctcacattgtcccactagtaaccttaccttggtcatctaccctaacttgaaggaatctcaaatccaccactaaaactgtgaagtcactggctggtcttcctacagcaccagtattggtgtcacgatactttgaacacaaaaagaaaactataatagaaccattgttaccaagcacctggtaactgaaggggaatttctcagtgtgaagccactgacatggattctgttttgctaacctttttcttacctgtggtgttttgggtgctgagttgtttcacgtgatttctgtagggctttttagtatgttgttttgtttttgcttctccgggggatgggtggatgctaaacattaaatctgttctcatgtaggttttatacatgactagaccaggttttctttccgtttcgattgggaaatgaatggaatgtggctcaaagaagatttgaaagaaaaaaaaaaggcacggttataaaagtctgcatttggtaggacaaaatggctgtgggagttttgcatctgttaataatatgctcctgaggaaggagagtgggagggacgcactaagaacaattcacagctgtagagaaacatggtcttctgtttgtcgccagacttttttctttcgtgtgaaaaaggtggtggtgggcatcaaacccaaggccttgcccctgccagatgctcaccgagcagtgatttgtgttaacagtctcttcctcttgcattagtctccaaatttctaaccagattttttttttggtttctcagatcatttatttgtgtatactcctcctaagtgaacaagagaattttaatgctaaaagatttacttgtgcttagcaaaagctcatattattcataacattttgttttaatttaatgtgacttaaattttactgtttgtttgatctgaaatgttatgtatgacacatatgctattagaggaatttagtctagtatttacatcatttttttttaaagattagggctggtgagatggctcagtgggtaggagcatccgactgctcttctgaaggtctggagttcaaattctagcaaccacatagtggctcacaaccatccataacgagatctgactccctcttctggagtgtctgaagacagctagagtgtacttacatataataaataaataaataaatttttaaaaaaagattagattgttggagacaggcatgataacatatacccagaataccaggaaactgagacagattcaagaccagccttagctacagaataagaccctgtctcaaaaacaagaaaggaaggaaggaaggaaggaaggaaggaagggagggaggaagagagggaggaagagagggagggaggaagggggtgggagagggaaagaaagaaacaaagaaaaccaaagccaaacaaacaaacgattatattgggttgaacagtggtaaaatgcacacttagtttacacaggcacctgggtttgatccccaacaccaagtgaaaaagtttaataacgtgctgaagagctagc

SEQ ID NO: 26951 - DNA, 1099 bp, Mus musculus
catatgaagggtaatattccatgacatgaacattatatggaatccaagtttgagcatatgagaacttgttggtgtacatctattggtgttcgtgtgcacattctcaagctaggttggccaggaactgaatggatagaacagagacccattagcttgccaaacatttaaaaacatttactctctcagcctttgcaagaagctgcctattccattcagaatggtctgctttttaagaggattttattgttgttgttgttgtttatgtgtgtgtgggtattttgcctgcatgtatgtctgtgtaccatgtgcctgtctaaattttaaagagtgatgctagttagctaagcccttatatgacatatgccatactatacagtttaaatggagtacttgatttttagtaaaaagacttgtagttgtactagattaaaatatactgtggtttctaagactagaaggcatagtgtgcctggaatggagaatagataaactatagtggtacgtgggtttcttaatgctttcctttggatttttataattatagatagcactgtgttttagactctgtgtgtgtgtgtgtgtgtgtgtgtatacatacacaaacacatatatacacatatgcattcacacatacatacatacatacatacatacatacatacatacatacatacatacatacatgtttgacaatccaggttatctggcttggcagcaaatgccttaaacctgaaccacctcacatggctatgtttaacatttcgcatacatatataatatacatacatcattgaacttaaggcaaacacaattcctactgtgtttcttaggttgagtgtagttaggaagggaagaaatctctagaaaaagaaaaggggaaaccccagtgtttctcagcttagcaacagtgtctgaactagctgaaagtccatccattaaagggagtaagaaagggcaaaggtaaatgctgggcttggttgcttagtttttggaggtactggggctagaatccagagcctttcacacagttggcaagtactttaccattgagctacatccccagccaggataagcatgtgagcctccaaagtgaatgaat

SEQ ID NO: 26952 - DNA, 2180 bp, Mus musculus
tatctttttatattggtatctcccaaaatgcttgtctcaaatggttctcaagttattagcaaatgaatagactattgtccggatgatgactgtgattttagtagtgctatttatatatacatttgacagctataaaattttcacttactgggggaaaaaaacctcttcaactttgccaagtcagattgatgtatctttagtccccatccctcccagtggagaccgcttaaatgaaataagtaaagcatttgctatagactggaagtccagtggatacaggtggcaggaaactgaatatgatctttgtgaactatgtgtctgcgtggactttgtagagggagggagggaatcaacacaattggagggtagttagttagcacttgcatgttactttggaagcagggcagatgagtttgatatttgtgttttatcataacttgatttttacaagtggatctagagatttagcaaccctgtttgattcataggctgctgaacttcgagcttatctgaaatcaaaaggagctgagctctcagaagaaaactcggaaggtggacttcatgtagatttagctcagattattgaagcctgtgatgtgtgtctgaaggaagatgataaaggtttgttttaattcattctacaaaatatttcttacaagttctctaccttaaagtttttcttgtcagttatatgctttggtttgagacttaagatttttaagcaatgtagaagggaaagaatacaatcaaaaataattatgaagatatttttcaattaaatattttcagttagttttaaatgtaatattttcatataatttcagggtttttttctgttagacctataaagtaagccgttctgggggaaccttttaaaaaaacggaaaaagtgtgtgtgtttgtacatatacttgatgttgatggttttaaaatgaactgaagcgtttggatggacatcaaagagggtgttatttcaagtaatatttaatttaatatttaattgttcagctgctgcccattgagatacagcttctcaatagtcagtatagtttctgtactgtgaactctgaaatatttgttaaagtttaaatattaaatttttagagcgattaatatctctaatacttgaaaatgagttaagcagcaggaatataacagccattcacttctaaataattctctacatgaggtacaaagttttcttcagttgttgagacctcctgacctaaaatccagctagtaatttcaagatgattgtgtattatgccaatggaaatcataaagaaaacgtggatgtgtaaatgctggcgctacagtggtgctggtgaggtgagagttcatggatgctgtagtcttaaagctctccctgaaatcaaggtgttctctaactttcacagtaggcaagctatgtattttaagcatctttgtattgaaatactagaaatgtgtgccagattggacgcgctgaaggttgtgtctgctgactgtgctcttgatgcctatgtagatgttgaaagtgtgatgaacagtgtggtgtccctcctgttgatcctggaaccagacaagcaagaagcattgattgaaagtctgtgtgaaaagctggtcaagtttcgggaaggcgaacgcccatctctgagactacagttgtaagttttagactgcaagacctaggtggagaaatggctctgcagagtgcctgagtttagttcccaacactcgtgtcagatggctcagcttcccctaactccagctcttggagatccagtacttctggtctctgctggcacctgtgcacctacacacacacacacatatacaaaattttaaataataaaagtacattttttttttaaagatacagcattcagagggatgtttgtatggtataaattatgattgttagaagcaggaattctggaattggactgtcagcagctttctgtcttgggcagtcactcaacctttctgtgccccagttccctctttagatgaagttattattagtgctgccttgtatttgtggtgagagcaaataacctcaattagtactttggttgtttgttaaccaggctcagcaaccttttccatgggatggacaagaatactcctgtgaggtacacagtgtactgcagcctcatcaaagtggcggcatcatgtggggccatccagtacatcccaac

SEQ ID NO: 26953 - DNA, 1187 bp, Mus musculus
cgttatgggctttttgtgtctgggacctagctctccctctgggcatttagtgcctttctgttgagtaaatgaacataaaatattacttgacagggcttgaatactggatattcaaataattcatgtattgagtactttaaaaatatttaatcatctgagtgcattaaaaatgtttccccaacgctttctaaaaaattactactttcactattaacaggatttcagaaccaaccagccctgcacagacagacatagtaatcacctccaaacccagatttgtgagacttaaccatatttgtagagatgtagaatagactctggtctttcttatttttgccgtgtgcctttttaagggaatccagcgaagggtgtttgctaattacactaagttactccttaatccttctgaccctgagtggactccagaaataacaggcctgacatcatggaaagtcgtactgtgcccgcacaatccctctctctcctttcttcactcagcctctttgctgcatttgaaaagcatttgagtctggttgcccagctaaacgattcactctgctcatgtgatgccatcttctcagactgccttagctttagatatatattctccagaccattgtctaaaccctcaccctaccctacctaacctacccttccctgtagagcttatcaaaccctttcctagtgccctctggcctttaaagggacaaagtcaatcagtcatttgaaaagtgttaagtctttgatttgctttttcatccactcaaggtcatgtatgtaaactaatttcttcagatctctcttcacccaagtcttgctttttccctcaaaatatagttttatgacttcactagtgtgacatgttcattttcaaaaactaaataaggtatagaaaagtataaagagaaaagttattttttgtcattaagctagagtcatctgggaagagggaacctcaactgagaaaaaatctccatcagattaattagcctggaggcaagtcctcgggttttgttttgtttttggtcttttccttttttttttgtttttgattaatgattgatgaggactcggcctactgtgggtggtatcaatcacaggcaagcaaccctgagttgtgggaaaaaaaaatttaaaaaaagcaaaccgagcaagccatgagcaacccagtcaacagtgtcctccaa

SEQ ID NO: 26954 - DNA, 2010 bp, Mus musculus
gcacttggctgtcaggcgtcaggctttgggttcagtccctagtactgtagtaataataatttgttacaattcaaatgaggaaataaataagattgagaaaaaaatgcctgcctcacctgactttaatggccctaaactctgagctctgcagacctacatgtgacacagtgaggctgtgagaggggagtgggggctgggctgttttgagaacacccacattgcttgtagagtctgtctcctgagttcccaggtcctccctgcagtgctccagcacagcttccacaggcagccggatttcattctggggtggagctttgcactgtagtcacaggagatgagaaaggaacactgctggacgtttagatgtagagtttgaaacccctcagattggtgaaacgaagtggacagtgcgctgacccgcgggagcccccagccacccctgacggctcttctgtttccctcaggacgagatgctgaccaaggaggagattctggacaactggaacatgtttgtgggaagccaagctaccaactacggggaagacctgaccaaaaatcatgatgaactttgaaagacactggttctggtgtggccaactgtcgcaggctgtctgcaggtgtagtgggtgattgctatagttgtcaagggtatagcagttgtgtcccttaacagtgggattatacctcagattggggttaaaaattatttttcactccatatttactgggaaataaccatcattatttattccagtaggatttcccgtgaagcacattaaactcctggcaaattgcagtcctctgaggggatacattgctacagcatgatttttctagactcctctcccccacttaactcattaatggggaagagaccatgaaagggctctgtaactcaaggtgggtgggtgggacactgtacagagtaaccgctgtgtatttgaactattaaattttggggtttttagttgccactgttaaacggtggtgaaggtaaaggctgaaggaatcaatttgtattgtccttggagcaggcatggtatttcaaatcttctatacttggagctgtcttgtaaatggtatataaacttttgtgcgttttcctgtatagacctgctaatgtgcacaataaacccacatcctggggtttttgttttgtttttaacactaagaagcaatcaaaaaaagataatgtgaacaaaaacggaattttagggataggaaaaagatggatgctaggtatttgaaaaactgtatgaccatggtcaacaccttaatatacttgagaattttttttacatgttaatgaggtgggtctgtttttttaaatagtgaatggaaatgcagtccctccctggctgtgaggctagggatcagatgtagtggatttattatttgttgagtcctgaatctctgagcctgcttctagcacagcttatgccaaggaaacagggcaaggtgaacatctcagccattgaccaaactagctggagtaacacttacaggtgaaattccaccctgtagatgggaggaaagtgaataaaggatgcctttgaggatctatccatgtgtcttgtggtgtttgactccatagcaagtgtggtttcttcctctggaatcaaacaatcaaaagagtccgtggtccagatcggaatggactcagtaattactgacaagttcagaatacatgtgtagttgctgatttcatccctctggacttcacgcccttctctgcagttagagaactcaaagtcgtgttttcacagtagtcctgagacatttaactggaaaattcaggtcttagcattgcctgtggagcctgcctaacaggatgtggctctgcttcccttctgagaactgcctacctctttactcactcttcttttgtctccacctcttcccacccctttacctcgtcctccaccctcactgactttgttgctaagatgaactccttgggtgagatagaaacaatgtcctaatgagaaaccaaagtacagtgacactgag

SEQ ID NO: 26955 - DNA, 1165 bp, Mus musculus
ccgagtataagatagtaggatttaaaaacaaacagctcccttatcttctgattaacatagaatttcctgttgttgcactgtacccaaagctaaagagtatgtgctcaacacagttatacctaatagatcttcctgccaggtctcatcaggtggtcatggcgatctccagagtcctgagctgagaagaattcagagttcctatctgggtttcagaatgtagaggcgtggtactttagtgatctctgccactggccatggtttcccagaggagaaggcatatcatctttggaaggaagattggctgaatctgtcttagaattttataatgtttaagactgcaaattgctggacatgttgctgggccaagacaagtcttgattgtggccttgagggacttattgtttcattttattattattttaactacaggaaaattgtggatcgaattgacagtgatggtgatggccttgttactactgaggagctgaaactttggatcaaacgggtacagaaaagatacatctatgataatgtcgctaaagtctggaaggattatgatagggacaaagacgaaaagatctcctgggaagaatacaagcaggccacctatggctactacctgggtaagaggccatggtggagattgcactgtggagaacaaggtcactggagactcatcatggccacctccttcacccagctgtcacaaccttccgagtaaaacccattgtgcaacattctcctccacctacgaagaatgtgccaagttgcttttcctgactgacataggggaaggcatcttaggtcagggccctgcttgaacttagctctcagaagtacacacagagaagagaaaaaaaaatgcttctgacagtttctaattgctgctgaagttgggtggtaaggatgaaacaggcccaaaacatcatcaggaaacaaaattcaatgaagggcttcactggggaagagagtggaaactgggccttgaagcatggatttccatttggagagactgaaagaatgtggggaggggggccgaggcacagaaatacatacatggtgggtggggcttgggttagtcattagagaacggagggaggggtgtgctgcagaccctccaagtgcctggtggacagcagggagacaggcttggggagaaaggaag

SEQ ID NO: 26956 - DNA, 1178 bp, Mus musculus
ttttaaaaaaagcttttaaaaaataattcaaagtgtttgaaagtatcatcattatttgtagttttagggctacaaatgtaatttttaagaaaaaaaaaagctctctacagtaagttctcgtaccattgaaggtatatttttgtgttatagacccatgcagatgcaaaagtccaggtgctggacaatgaaaacgtaagcttgtcattgtttaatgcatacttaaacaattttatttttgtcttgaaattattaataatgtggttttctgtccaattccctaatgcaggtatccaacggttgtgtgagtaaaattctgggcaggtattacgagactggctccatcagacccagggcaatcggagggagtaagccaagagtggcgactccagaagttgtaagcaaaatagcccagtataaacgggagtgcccttccatctttgcttgggaaatccgagacagattattatccgagggggtctgtaccaacgataacatacccagtgtaagtttattgtgaacatcgtgtgtctaccttgccccaaggcccatctctggcgcgtctttatctcctcctgctcttttctctccccaggccttgccatctctctccctctcttccctgatttgtctccagggtacctgggggtatggagaggtgggctttgactttttgaccatctggaaaatgggggtgaagtgtgaggagtagttcccttcatttggataccacagaccaggggtcaaaggaactagggaaaggcacttggaaatgaaaatgaaaaccagattctaaattcccctcaaagcattttcctgaagcttctttcaggcaacatgcatccatttctgctctccgataaagtagatctctaaagtaagtcttttatcactgagtcttggatcaaagcggagcagcccagtgagcggttattcgtgatatctacagaggtgaaggactgctccctcctttacacccaacttcatttccaggaacaaaatgatagctgccattctttccacaaaataagttaaaaatccacagactgttccaggatggctgggagcttttgcatgtgtagtggggtcattctttaaagcttgggagagctgagatggggacctaagatggggtgactacgtgtctttcggagacactaccatttggtttgatttgcagg

SEQ ID NO: 26957 - DNA, 1152 bp, Mus musculus
ttaaagtgaattacacactgtagctcattaggaaaaaagaaaacaacttgcatttttgtaagagaagtcctaataagatattaacttgaatgtcaaaagtcatttagtttatccctattgatagtatcatcaggactgttcaaaggttccaagaattgggattttcataaacataagatttttttaaataaaaggattttttttaattaggtattttcttcatttacatttccagtgctatcccaaaagccccccataccctcccccccactccctagatttataattttgagtgacattttcctgaattagcagaagaagagcattgcttagatcatttttccagaaaacaaccttcctcccttgtcaggtgtatatgctgctttgcttagcgagttccttggttactgctacagtcatcacgacttaccaaataataatacatactgagtggtgtgttctgctgtgaaaataattgcagaaatagcaaaagcatctcttactgagcatgctgtgttttccatgctacttcattgcattgggaaaactgcctcatcccaccatgaaccttaaaaccaaccttcccaagaactctgtcttcagttgtccaacagctttgaatacatttagaattatacaacaaatatatttgtaggaattctttggatatctttttaaagtgtatttgttagtttttgagtcattaattccaagaattaattcttttacaaatgagacgaacagcaatatattcatagtgtactcccttacctctttagcatagttccagtatcttaaaagttaattttaatgactcaccgtttgaagtatatattcatgatattagcctagttcaaatacttaaaagaacacattctaatattgatgaaaatatattttttttatttttcctttttatttgaattagcaaaaattaattttatatttaaccatttctagactttggctataactttttctaaaaaataattagaattcttcttagttcctatgagacttaactcaatttgaaagtagaacttttagcattctctgtacacatgacatggtcttgtctattgagttaatttactagcaagtgttaaatacaatattgtggtgtttattcacagctgtattgagtgcctcctg

SEQ ID NO: 26958 - DNA, 1142 bp, Mus musculus
gagagtgatggaaagttggagacgctggggcatgtgggatagaaacagggcttctgggtactgatgaaggccgctgagaagtcagaatggaagcagccccagcacttcttactaaagccttcggcaggctcccggagcctccaagctgctgctgttccgagtcttagcagcttagagtgcttggaagcatgaaagccagttggaattttccagtaaaatagcatttttgtttagtaggttattctacacttgcttgcttttctttgataaaatgtcattttcaacttgaaattaaatgtgctttcatttagggtttttctttggcccaagtgtcagaaacctaatgagcaaatcactagatctgaatgtcagctaattggtatcaaaacagtttttaactatatttttaaattaaaaggtagaattgtttactttttctaatttaaggaaatgttttgcagggctaaactctagttttatctgaatccttagaatcctttggttttagtcatttttttattgtctctttttgttcctttgtgtgagttagggctgcacattgcttggactcttgagagaaaacttttatttgttttctatcattctgtttccttgctgcagggccttgcactgtagcccaggctggccctggacctctgcaggcttcgcaccacagccttttcacgctgggcaacatgcatgtgttaccaggctgctaaatttaaagtttgggccatttatttttacttacaatgggagtatatttctagtggggaaaaggctttgtataaaaatggctatattaattattccttcaaacgtatctgttctttttgtaaagagaataacgttttccaaggggaagagtctcaacagttgctgtgtgttctttgtatgtattcggagaccaaacataccgtagagtttatagacaaaagtatatctgatcttgagtaaactaataaagactgtattttagaaataaacaatgcaggcttactgtttaatttttaagtatgtatgtgagagagagagagatcttaagtacactaataaagacttttagaaataataatgcagacttactgtttattatttttaagtgtgtgtgattttgagtaaactaatgaggacagaatttt

SEQ ID NO: 26959 - DNA, 1580 bp, Mus musculus
cagtactgtattttaaaaatccctcaagcaaggtatggtggcacgcatctctactcccaggcagaggcagatggatggctgtcagctcgagttcagcctgctttccagaacagccagggctatatagggagaccctgtctcaaaaatcaaaaaataaaaaattaacttaaaaataaatttaaaaatcccttgatatgttgctggtatagtctctgaagcttgcctctgaaaacgttgagctttgagaccaggagttcgagactgaacaggctctttctattatatcattagctcatgagatgtctgttgcatattactttgaatacaaatatcttacatatcaaaaatggatctcatgttaaatggatttggaagtactataccccttctttctacttctgcacttaacatagcttaatgtgctctgctttgttttgttatatcttcctgctaaagtaagaattgaacagagctaatgtcatctttaatattagaaaataagtggactaagacattatagaattaaataattttcaaatgttaaataattgtattgactgataaatttatagcctctgaaaaatgagaaaaaattgtgaacaggacagatgaagtataaatttaaaactacatggttaattttgctctgaaatcctataggtggttttcacctgttatactaaatcatacactataatttgtttagttagaaatagtaaactgtttgcaagtcactagtaattctcaaaaaaatattgttggccatagtgaataatttttaaattagaactaagtgtgtacctatttttggcacttatttttcagataattaagctcaatcaagtatattttaaggatctataaaagtaacaggaaagggtttcagcacctgcatcctcagtgcttggggcagctgtagccgaaagcaaagacccacaggaaatgcagagtctgaggatctttgataagtagacaagcttttgaagttctgggttagaatctggctggcagaatctttggaaaagttttatatacagatatttgtattattaaatttggagccatagtcagaagactcagatcataattggcttatttttctatttccttaactactgtaatttccacttttataataattttgatttgaaaaataaatttatttatatttttaacagtcaaaatctttgctgttgtagtctgcagcctttaatgattgtgttgcttttatgattgaaagaagcactccacaaattgaagagagcgtgatgcagcgaggtgtaagtcgtggttagtgacatgtatggctcctgtgctcatcgctgtctctgctggcatctggctccgctggcatctggctgcatccataaggacattcgttccaaatgaaaatttgcttttctggcagttttcataatggaaaaaaaatctcctttgtctgagtatagaagttttaagatgtatcatgggtatcggtgcttgtataacacacaatgaattgtaactagcatgttgttaagaaaacacattgttagtttttttcagcttgctttcttatagaaaacaaaactaccagccca

SEQ ID NO: 26960 - DNA, 1158 bp, Mus musculus
agtataatgatctctagtttcatcttcattgttgcatatataactggattttgcttcttttatataactaagtagcattcatgatatgtatgtacattttatttatattatttttgtttttatgcctactgtatttgaattatctttcatgttaaataaatctttgaaagaatgtcatgttctacttttcttttactcataaatttaagaaacttttagaaaaaaaagaatgaaatacctagtctgacaaaagaatatttctaatttgtaaatatatatgttcttatagtataatggtaatcaagtacttgatactttgtgtatttattttgggtatgtcatctgatgatagaatgtgttcactaatacaatcgaagtatctttatctcctggattttttcacaggacacagatccaagctctgttgggccagttcagccaagcggaggcattgctaatgaaagctggagtgcagccaggaacgattgatggaatccttatggacctggggtgttcttccatgcaacttgatgctcctgaacgaggtttctcccttcggaaagatggccccttggacatgaggatggatggagacaggttagcattgaaaagacattgcttcttaccacaagaaaatcaatttcttaaatcttcgattgtaattcccttgaagactgaaatattgccagcacactcccacatccaaaactgcccatgcatagtaactcagctgtgtttggtactctttatagtcttcagtatttctttagctttgaaattctaaacagaaaatatttgctgttttttttttagtgagatattcagaatgagggaaatacacttttaggtaatttttttcactaattacaacatggctttttagtagtaatgtagaaaaaatagatgctgaaacaatacttcatttttgtgcttgcatacacacatctctttgaagacagaagcttatttaattgataatattttataatgctgccaaaaatagggtaggagctcagtggtcaccagttatatttctgtcctatttcttctgcagtcacctagtagaacctttcacagaagatctgcaatatatgacaccacaccataccttactatatatccatacatatctgtacagaattatcatcatgactcctc

SEQ ID NO: 26961 - DNA, 1189 bp, Mus musculus
ttagagtaattattttaaaattattaggaagatttttcttaagagggcaagtgaccattgaaaaagcaacatgcaattaattcaatatatgtatctatcagacattattcatctagaaatagattccctaaatgtatctcaaatctctgtacagttttgtcacgtaccattttaacattcactttggaaaagtaagcccatttcagtttttactagaaaaaaaagagaaaaggcaagatgctttatattcagtgttgaaaattgaaacatgcacgtgatatactgctatttcataaagtcacttttgtttctgggagtttgtttcattgatgttgttttttggttgtttgtttgagaaatacaatcttgctttgccctcggtcacaggcacatgttgcccgccacccttgttttcagacaaacttaacatgtcaccttgatagctgtttggttgtaaagtttgtacttcgagatgtcaggtttagaattgtatttccttgtgtgtacatgtgaatgcacactgacatcagagtgatgtcactctagagccagtgactctaaggattgccctcaggcctggaggcggccatctttccttatctggtaaaccatgctgcagatgggattttcaaatattcactggatagtaaagataagttcacatcatgtcagatacgttatatcattgggcattgcgtacattctcctactgaaatagtactcacttcttatttatatgtggaaatgaaataagtattcttttgttctttcagagaagaaatcagcatattccttacagaaatagtaagcttactcgtttgctgaaggattctcttggaggaaactgtcaaactataatgatagctgctgttagtccttcctctttattttatgatgacacatataacactcttaagtatgctaatcgtgcaaaggaaattaaatcttctgtaagtgcatttactttgactttattgtgaaaatattgtgtatatgttattttcataactaattaaaatcttaattatggtggagtttctgtcaaggaatttgccagttcaggttagaaatgtcctccctagctgctgaaggtaacttagtctcactttctgtatcttgatcccctctgcagtagatactgttactcattcttatgggtgctggactactttatactttagtgcctttt

SEQ ID NO: 26962 - DNA, 1208 bp, Mus musculus
aggaccctttcctgccattaaaacttggacttaacagacctttctttatagactctgtctaccaatagacatacttgttataattgtaggtttgtaaagataactaattactttccaaatcagaaaaaaagcttgtgagaaaaatagcattgatttacatatgaaactgcctggtacatgacagctgtattctttcatctactccttttatattctgtactttacctctgttagctcctggaacactcttgacctgatgtatcattggaatgaagaaggctggctagagagctgtctcagtggttgagagcacttgttgctcctcagaggacctggtttcagtttttagctccaagtgttagaaacttgcaatggcttgcaaccatctgtaactcagttgttagttacctcatgatcttttctgacctctgtcagaagcgggaatgcacatgatgtacattctcccatcagagcaaactgctcacacattaaaataaatcattgttttgaaaaaagaatgtcgactacttaaaaggctaatgaactcttaagtgttataaaaatcagtttgacccagtgactcccctggaaggcccccataccttcatgtgaagactacagatgcttctaccaaagttagaaccttagctgtgtagcacctgttatgttagcattttgtagtctgtcctttgttcccattttgggagaaaatgggtattttgtttgtttaagcagctgttttgttttggtaaggttttctgtgagaggaataaaaagtgatttaggatataattagagaagtgacaataaagaagttatgaaacctgataggaatgacactacttaccagccatgttctctgaacatttgaccataacctgtaagtcaccttttccttggccatttaattttccctgaagggaagttagggaaacgatagatatctagaatctgactctaacttaatggcaggcacatttgctgggcactgaatacttgcaagctaaaatcctctaccaagatgaagattttcctatgcctgaaaaaataatgattaatttatttatagatagatagatagatagatagacagacagacagacagggtttctctgtgtagcccttgctgtcctggaactcactttgtagaccaggctggcctcgaacactgaaatccacgtgcctctgcctcccaagtcctgggatta

SEQ ID NO: 26963 - DNA, 1176 bp, Mus musculus
cagataacagctctccaatatttccttttgcttactgcagtttctttgtgaaatttcatttttccaagaaatgaaacatcgcagtctcgctcgtggcagttcatcacgttatgagtattggcgtctctgctgccttttgtacttggaacataacatatctataatcagtggtaaatcatagctatcatggaacctttttatttttatttaaacaatgtataatgtattcatttatactgatttataaaagtttttaaacactgaagcaatcattgctaaaatatgtttttcataatatttaagcagtgaggctggaggatgtaatctgattattagcattaccaattaaatctttatttatatataacagtatgtcataaattatacatgcaaacaagctcagatttcaacttttcaagttttttatgctgttcatttgaatttaaatatatttctcataatttggttctttcatgcctagagatgagtcagtgctggggagaatggaagtaagacaaggtggtgacttctaactctggagcctgaagagccatgcatgcattcttactatcctagcctcagcaccggctggaggtggcaagggcaggagggatgtgtctaagatacagagacaggtggcttcataagtctcaccgtgggtggggctcgggacgatttctgtcttgatgattcaaatagtaatgggagtttggaacaatactttttaccatttgtccactggatgtcaccggtttcctaaaaggcagctattgataaatgattgggactatggtctactaaaagctgaaatcaaagtgattaattttcagtcacagattataggaacatttgtaaagggtgtaagtgatggtgttaaaaagaaaccgttgggttgaaaatggaggaatttgtcataattatgactattacctttatttttaaaaaatgggcattttgtaacattccttcaggaagaatggaagtgtgtatgtttttctgcatggtgtgagcattgtgagtcttacaagattactgcagttttcagagtaaaagtcaatcaacatgttatttatcacttaggaattgaacactggattgtgcatggttgaatgtctttagtccactgcaaatgtgcttgacattgataagatcatgctgaactgtatattttcagaa

SEQ ID NO: 26964 - DNA, 1759 bp, Mus musculus
tttatgtttcagctgttgcagaatttcagccaagttactttttttttttcttaagttatgttgaaaaagcttttttttttctttttcttcagtaacccacagtctgttctttgtgtgggccggcacctatttataactcttaaaataaaaacaacttaaaggagccaaatacatagctgttcttggtactgttgcgcatgagtagcaatactttgctttcatcgatgcgattctcctatctcagaattttaaatactgaccataggaaagtcagtgacaagtgtacagtagtctgcttgtgtacttaggaaggggatgaattctaattaatatatggatgatttgtgaataaagctaggcagtaaatatataaagggtgttcgtttgacttgtagcttacaaatgtaaatttcccttagccccagttttccatctattttcttatacagttcacagtgagttgaggcgacttggcgattcttggccttagccgttgttagatgccctgcagatgtacaactcacccaggtcccttcccgtgcagctgatttgtgacgcgtttatccattgtctgtagaggctcgtctgcacacccaggcttcaggggtaccagctcatggactttctggttatgctggactctgtttgcaagtacttttagtctgatgtgattctatttctcagtacctctttatggacttaagaggtatttggcattccttattaacaaaataattacaatctactttttttttaagctctggctgtcctggaacactctgtaaaccatgctagcttccttttgttttcccatttttgttttccaaaataaaacctactagtaattcaattgtaaaatcttagtgttttctccttctgtcccctttacctttaaaaaaacctataaaggttcttatttgaagagcatgtttaagtgttgccgatgtgagcgcactgtgagggtgagtctggcttgttagatggggctcctttgcctttactgtactgctatactacatggatgtagtcctgttctttagggtctcgctttttaagatcatcttcctgttgtaaaagtttaaggcattttgctcaagtactttgtttacagttaaaatgaatagaatttaatagaaaatacggttatggcttacctggaaagcgtcagcatgacttggcatagacgtaaaagagtacatgtgattatactgtggaatgatactgataaggactctcgtaattgtacctcctgaataagtctgtgcattttctaacttacagttcattgtctgttctagcaacaatctcattttgtagtttttattctccaaaacttatgagtaatgtttcctcaaaggttgttgaaataataatagttacataatgggggaaagtcatttgattattaattttcaagaagttttaaactaatttgtaactggacatggtttttaaaaatattggcaaagatttgatacacttgtactctttagtttgagaaaattatttggaatgtgaaacagtgctttttcaaatagatgaatcatttagcaattaaattctgattctaaggcttatttaaaatgtatttgtatgagtcgtgcttgtcctttgcatttgacaaaattgatacaattacaaatcgatgtatttctgaacgccgtgtgtaaaacaacctttacatagagtaaaaaccaaaatccgtggtggttcctgacatgaaacttcagatgtctgtattttgtttgcctttcgtaaa

SEQ ID NO: 26965 - DNA, 1149 bp, Mus musculus
gctaggcaagcactctactacagagctgtatgcgttagctttgaattttaattgtttatacatttcttgagtcaattctgtaaagagatgtgatggggactctcattaacgcaatagctcctacagttatccagttccactggggttcttctatggaatagagcatcaatatctccccaggcagtgatgtcttagatgttgcctggacagtgctgagaatttataccagggatttactctgccctccttaagacttgctgtaaccagtaatagttgacgatttccagtttagctgaatactgtgccagttttggtgtcacaagtatttactgtccaagtacttggctcctagcattagaattgtaaggtaacatttgacagcttaatctctcaggaaagatcaaagatctgtcttagtaggtggatccggacaagtttaggcattttctcggcctctgcctttgtcaatctgtctctcatatttgtattttagtcatctttataatggtagaaagcactgacagcctgccagttgggatttttttttctggtctccgtgattgtgcttattgtattcctctctctctctctctctctgtgtgtgtgtgtgtgtgtgtgtttagtaatgggtattagagtagatggttgcttctgcctctacttcagatttctttgaatccttgtagaacataaagtctaagaatcatttggtgaatcatagaatctgagaccaactcacttttgtctccatcaacacatgtatatatattatgcaggtgttatacttgggaacaaatttatgttaacaaaaatacttcattgcattgttgatataatattttaaaagttaaatcccactaaataatgccttcaactttgaaaaatgacagtaagccaacatatgtcttcatgatatgacatcattgctctttccatttgtaaaagtagatattaaagaattaagtttataaatatattatccaagttgctttttaaagttcatagatggcccattttgggcagtgtcggagattgttttcaatgcatagaaaaaggttttgttttgtttttgtatttctgttcagtgaattatggtttttgtaaaaccttgactgaaggtgataaaatgctccaatcttaaatactggc

SEQ ID NO: 26966 - DNA, 1115 bp, Mus musculus
ttcgacactcttgtacagcaaacctacttcagctgtttccgccatggtcacatttggactctgcaagtcttgtaactgctaaccacttctgacctcaataatttttttctcttcttcatctcttcattattctaaattcatgaaatttttcaacattatgaaaccttcaatctctgagtcctcatataccctacccattccatcactggtcagattagagcctgctgagtttcctttctcctgtctcaccaggattcgtatccttcttaccctgttgttctttcaaagctgactttttattgaacaacgatgaatccttttagtaatctatgccgctgtttgtgaaatgcctcactgcccagcttcttacactgtgtgaccatatggggtcaaataactgaatgtgggactcatgaaatatgtgtcagctgtaaaaggtttctggatgggtgacaagcaaacattaattcaaaatcaaatgtgtaatgtatccaaaatatttgcacagcttcactatagctatggtttccggctatgcagcacaaagaatgctagctaaaataccttgcttagctcagacttgtgactgtcacttgtgtgttatgagctgcagtgttttttttttttcctgtatttacaaatatctcagttctgacagaggcataatggatgtaattttgtaaagactacacattttctatcattattcatcttggtataaacattaaattaggagccgggcatggtggcacatgcctttaatcccagcactcgggaggcagaggcaggcagatttctgagtgattttcgaggccaggctggtctacaaagtgagttccaggacagccagggctatacagagaaaccctgtctcgaactctcccaccaaaaaagaatattaaattagtgtatctttgagttgcattatatacagtttgaacttaaaactactgaaataaatagtttcattaggaaaaaaatcattaaatgagtattggcataggattaggatagaatccagcagtttaatggccataagtatacttcttcccgattggactacatgtttatctcagcattgataattataaaattaaaatatcgaccaactctaa

SEQ ID NO: 26967 - DNA, 1194 bp, Mus musculus
ttccccctcttcttactttattcctaaatgttttataaccatagatcagatagtgtgagggaaaacatttataaaagctaggctttttgtgtaaaatctattacaaaatcagaactcttcttcctgacccgggacttagaaacaaaacctccctacatgtttaacatacattagtttgtaaatacagagtcttgctaattgcaattacagctcacagcaaactacctgttgtgtcctgttactttgagtgggaggggaaggtgtgtgtgtgtgtgtgtgtgtgtgtgtgtgtgtctgagtgtctatgtctgtgtgagtatgtatgtgtgtatataagtgtgtgtttatgtttctgtgtgtatgtgtgtgcctgtgtaagtatgtgtgtgtgtgtgtctgtgtgtgagtgcatgttttacaaaatgctgaatgtagacaagattgttggaataaatgttttctaattatattacattccccacctttgatgtgaaattaattagttcactgcagaccttttctgatgaagcaattcatcggtttttctgatactgtggtccttaagtgagccttgcttattttcaacaacaacgaaagtgctcctgcatgataaacaaatttagagcaacaggtgaaagaaacagtatgatgtcaggctaggaagctacacaaaccagttagcaaactgcttcattttgagagaagcccagggtcaactgtttgggtgtcaggtgtcagttctctgttccctattttgatggtatttcaccagtcttttgacaagtgattgttttttaaaatttaactttattgtgtgtgtgtataggtcttttgcctacatatatttctattcaccatttgcctggtgcctgcagagtctgaagagggcactggatcccttagaactggagttacagagggttagaaacggccacgcgggtgctgggaactaaactgggatcatctgaaagatgcaagtgtcgttgctcactgagttatttctctggctctttgccaaagtctttatgggaaaggggtccttccgtttcctcactgatgactgcggccttaggtagtattgggagctgggtttaaaaataatacttcctggagaaagatacaatgtcttctaagttatctctagtaggatttgtgtcatttttcagtgatagaaaaaagtttggaatatttgtg

SEQ ID NO: 26968 - DNA, 1111 bp, Mus musculus
agatgaaggcctcatgtgctctattttctcccaagaaacaaagccaccgagtagtgtgccccctgggaggcattatcacccacccaccacactcacagtgtttatttcagttctccagctcgctggcttgggtttcaggataagcctcgtgcgagcacacagctcattgtgtccgttctattaacggtaagctgaggcgaaatggagtgctttttgaaaccaggctactttagcatttacatggtttataaagaggcagagatttgggggaaaaggaagcaaatattttgactactgtggttaaacagtcttttttgttgacatgttaagataatcaggtgttgtgttttgccacttgtttggttacttaataaagcactctttctcatggtcatgccatagacagttaaattctccaaggaagcccattgataccaggatgggaaaagccagtgttggagacaaggggtaaaaacccctggaaagctgtgtttataggattttggtcttggcggatgcttttagctcaggttttaaggacagctggaggagcagggttacaggactatgtgaggcactcgggcaaagacggctactgccaattaaggcccttatggtgcaatctgagctttgaaaaatgtggtctttgaaatctggtgttccaattgtgagcattcttcattgactttgctgagggagtttgagtggagcaaatcctttcattgctcatgtgaagcttgcacagagtgggccactggaagctgtgtactggtactgggggtatttgcaaagacctcttttatttgctctgttggccctgtagagatcgactccaaggccttgcccgttttaagcaagctctcagctacatctccagtgcagggaggaccaccacaggacacgtagctggtaaactcctagctgagaagtttccagcgaatgatgtggtgtactgatgggcggaaatgaagtgtgggatgtccgctccatcctaagcagcatttgtacttggcccgtgagattaatgtgcagtaagtggccagacggtagccttgagcatgtttaattttgtgctgtagttatttatgggtttccttcaagggagaagcgg

SEQ ID NO: 26969 - DNA, 1150 bp, Mus musculus
gaaatagttaggacttagtatccaggtttccagacagagacttaaacataaataatcctgttgataaggtactgcctaactgcagaattttctgaaaaaggtgaacctttaaagccacagtagcatttattggaggagtgaatcttcccaggaatgacctggataaacgctctagccgacctggtaaggcaccagcaaattactgaaatggctttgttgctctttaaaaaattgtaaacatactcttggtatcaactcagagtggcagttaaattcgttctctaatacacctatactgtaacactggatactgtagtacttgtgtgcacacataatcattgctaagcccatcgtctgtatctctggttggtgtatattctgaaacataaatttccaacttgagttttgtgagttttcttttaagtgtgcctttctgcaatgaagttagccaggaaagagctgtaatgtactggccttggaagaattttagagttgttgttattgttcaggacttgtgttacagttaaataaagataggcttctatggctctggctagttttatgggtcccttctgtttggaaactcaggagcagtgttctttggtgtgactccttccaataaaactcattactcgctgtgggtgtttctgtttcccagacgcttagatgccaaccatattacctcagtcccggaggacagttttgaagggctcgttcagttgcggcatctgtggctggatgacaacatcttgacggaagtgcctgtgcgtccgctcagcaacctgccaaccctgcaggcgctgaccttggctctcaacaacatctcaagcatccccgacttcgcattcaccaacctttcaagcttggtagtgctgtacgtgcttaacctttttactcctgcatatttgtgttactttgagggcaaaatgggtttcatgtgacaagttactacaaaagtgtcccccatgatcctgctgttggacgattagtatttgggggaggtgcctttgataagatcaaacatactgatttcttgaataatatctagtagtagctattgagttttttaaaaacaagtagccacatttttaaaataattgggtcatttatcaaatactttttttataacttgcttttgtataacttctgt

SEQ ID NO: 26970 - DNA, 1886 bp, Mus musculus
gtttatttttcaagtcagaagtctgtgaagaatgggagcctaaagtataaattgttgaaaaacattgtgatgccccagcagtgtatgctctattggaaataaatgcgacttaaaaatgatttgatgtatggcatagcaatataaaattagttgttttttttttttcttttctgatccatcaggtgcaaagttcaaattatttctgaattaagcacaaaataaaggacagctgttaatatattttaagtgaaaatgtgaatttataaaactaagaaaatgtcttgctaattttacctaatgattcatcattaatctcaggatgacttacttcagggccaaaaaagggactatctcccagcaagagctaggaagagttcaaacaggcattaccttcacatgttttctgtgtccataaattgaaaggttttgttcaaatgatttataaatctaaaacctgaagatggttttgagaaggatgttaacagctgttagatttttttttttaatagcagaacatttgtttttgttcattgcacattgctctgatgaaatcccagtgattcccctctcagtgtttgacaatcgcagcacagagcacagggacacagcaaaaggctgattgccacgtgggtttaagtagaggtgactgagtagtaagtaccactgagcttttcatagtatccaagggatttgatggctctaagtaatgtcctcatctggactggcaatgtcctaatgtcactggctgctctgacatttccaaatttgttgaagttatctatcattctgattatacaggaagcacacttgagtcttttttttttttttttttttttgcaattgtaagataataatgactcaaagcacttaaattgattttttagtgagctgttgtatgagaacttccatacattgtttgcatgctgtaatttaaaaaaacaacaaaaccattcagtagctcagctgcggtgtgctgtggttcaacgagacacatactaggagtgggggagtcaaaccttgtcctatgtctttacattttctaaatttacttgactcttacctataggcttctgatgtggaagacttaacactgtgctaagtcagtagcaaacccactgccatcttagttatactggttgaacaaaaacttaagctagattgcagtttgattaaactgtacatactgtgcatatgatgaagtttatcttgtgtaaattatttttagaacacgagttgggcaatgaggcttctgttcactgtttaattaaagctacctcctaaactctagtggctgccagtagcacaatggttaattgtggtttagatacatgttcttggttttgattttttttttatccttgccttgtaaatagtcttggttgtacattgtcagtggaataaaaacagaatctttgtatatcaaaatcacgtagtttgtataaaatgtgggagggatttatttactgtgcttgtaattttgtaaggtcatctatttacaacataaatataatgtttgtatatttacacatctgataaatattaaatcataacttggtaagaaaatcccaattaaaggctttcttcctaaaattcaagttattgaaaactgtttttttttttgttttttttttttcctttaagaaatagattgggggctggaaagatggctcatcggttaagagcactggctgcttgctcttctagaggtcctgagttcaattcccagcaaccatatggtggctcacaaccatctgtaataagatctgatgctctcttctggtgtttgaagacataaagacagtggcattgaactcatataaatgaaataaataaatctttaaaaaaaaaagaaagagagagagaaagaaaagaaagaaaggaagaga

SEQ ID NO: 26971 - DNA, 1147 bp, Mus musculus
ttttgatagacaggcttagtcccttagctgacctctggcttttcacccttgctgttactgcaaggtgtccttaggctgtggaaaaaacagagatgaggagaaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcattatgggcatcgcttggtgcagaggtactgcaagggaaggtccggcttgaccatttctgagtttcctgtgagataaacccggtttaaaagaggttggtatcatattttggttaaaaatcaaaaatattttccggctctgcctcgcctccccaaaagatacccagagccacatgtgtgggttttatcaatacccacgggaggaatcgggtccatgtccacccaagccatggttaaaagcccactcatctacggatgagaaaatcatttgatcacctcagttaagcattgccttattttaacttaattaataggggggagagagattggagacgtactattgaaggggcaagcccttcactgcctcccacccaaataaaaaagccaattggccttgtactacaagagccggtcgaactccttctccctgtttcccacctatcatccaaaaaagcggagaaatatcaacttagtgttattatagtgtatttcacatttgttcagtcaaacttagccagagttccaatgccctacttaaaattcaactagaaagttacctaggaagtactaattagcattataaagtcagagcctacagctccaggcttttcagttagttgttcactaagataagaaaggacagtcttagccttatacagtttaccataagaaaagttaaggaatcccatgaaagcaagttttttctttagccctagattccaggcagaactattgagcatagataattttcccccctcaggccagctttttctttttttaaattttgttaataaaagggaggagatgtagtctcccctcccctagcctgaaacctgcttgctcaggggtggagcttcctgctcattcgttctgccacgcccactgctggaacctg

SEQ ID NO: 26972 - DNA, 1348 bp, Mus musculus
tcaccctgccatcactggaaagagaggcccattggacacacaaactttatatgccccagtacaggggaatgccagggccaaaaagtgggaatgggtgggtaggggagtgggggggggagggcatgggggacttttgggctagcattggaaatgtaattgaggaaaatatgtaataaaaaatataaaaaaagaaagtcaccctgaccattgaaagtctaatgattggatagttctcctaccctttgtgctcttaagagttagaaacacccctggacagtttagactgaccccctccactggtaaaaatagcctctgtacatagtgctgacatgctgctttcccagcctttgttctctaggctcaaggagctcgagtgggtgagatagcgagcgaaaaggcagctccagaaggcctactcaagagaaaaagactgcaagccccacatcagttcaaagttagagattcgttctacattagacgtctccacgcagaaaaccttgagactcggtggaaagacccttatcttgtactcttgaccaccctacttcctatttttatgggacccccttttgattttgcttctgcttttaattataggtccatgtgtgttaaataggcaagtcacctttattagaacaagaattagtgcagtgcggcttttagttttgagacaacagtaccatgccctaaaggatcaagtatgtcagggaaaagatagtgtctagttctaagattagaactactaacaagtagaagggggaaatgaaagtataacaaagtaaaaacaaaattctaggcctttaggcccaggcttgggaatgtgacctctctgactcattgctccaaggtatgctaatcataaaacagatagtgacattcctccacccacctgcttcctgggttcaaagagtgttcattcaaagaaagtcaccctgaccattgaaagtcaccctgaccattgctggaaccctatgcagatgtggtattgttaagggctcctagaaactgtcttgagagataacctgcacaattggtattccttgggactcttgtgactttgcacttccttgggactcttaactggtatctttggtattttccaacaacgccctccccacttccctgagttgtggtttctccctttaaatacccccttatccagctactcggggcaccacagtcctctacccctgcatggtgtatgaacgtgggcctgagagtgctcttgaataaaaatcctcttgcagtttgcagcaagaccatttcttgtgggtgatttggggtgtcacctctcctgagtcagaacatgggggagtcctcacattgtgggtcttttacaccctctccc

SEQ ID NO: 26973 - DNA, 1197 bp, Mus musculus
cgcactcggagtaaacgcggctggcggtagtacgtgtgtctttttgctgagggcagttatgtttctccaatattacctcaacgagcagggcgatcgcgtttatacgctgaaggtaaggggaggaggaaacagctatatatcaaaaggacgagaaatttagatgggaggaacagttggaaccggcctgcgcagcccactgagtggagccatgtcggagccaaaacgtggtagataggcagtggcttctttttctgaccacgcgatctcctggcctcaggtcacccattttcttgtttctttctatcacaccactcatattgagatattttttatttttccttgagcagaaatttgaccctatgggacaacagacttgctccgcccatcctgctcggttctccccagatgacaaatattcaagacaccgaatcaccatcaagaaacgcttcaaggtgctcatgacccagcaaccgcgtcctgtcctctgagggctcgttaatcttttacgctgctcatgcctcggcctattatcagcaaccaaacgcgtcaatctgtaagccttgaagccttcccatgctgtttggaatcctatctcactcaccacgtgaatgagtctatactgatgggcctcgcctgtaaaaggaacaatatttttctttctttttttcatgccaggttattaaagatatagtgaactgaaagttcattttgtgtgttgttggaggaagagatgggggaagggtagtaccgttggtagtacaaggccacttgagaacattcgtaagccctcattgtagcaatagaactgtgtgccatcgacgatagggtgttggggggaaaaaggctgtgaaagactcctacaaaggtcagcattccctggaaaactactgtctaattgtgggccctttaaaaaatattctgaattcctcaaagagtaaaaaaaaatgtatgtgtgttttagtattttaccgacatgtgtctatgcctatatgtgccagtaaccatcaagaccagaagagggagtcagatccctggtgactagagactgatagctagtctttctgtgactgcaggggatagacacaggtcctctgggaagcacccctctctccagtcctaccactacattttgagttctgagataacaagtatgcccaaccctggaagttttctttttctctctttagacagagtctc

SEQ ID NO: 26974 - DNA, 1099 bp, Mus musculus
gaaagaaagttaaaaaaaaaaaaaaaaaaaaaaggaagcatgctgaaagctgggttggaaaaaaaaaaaaggaaaaaaggaagcatgctgaaagctgggttggaaagcaatgagagggttggaatatattcaaaatacatcctatgaaattatcaaagaattttttaaaaagcatcaaagatgaagtcacctattataagtgacaaagcgtcaggaaggaggccagcaacactgttctgcaagcacttggcacgcaaccctgacagcctgcattccataccttacacaggtggaagtagagaatcagctctaccagcttgtgctccgacttgtgcactattctacacacacacacacacacacacacacacacacacacacacaccacatgcacatacatacacatgccttggaaacagctttttctcccattatcagcattaacaatttgtaaagtagcccatgtcaagagcagtataacacaccaagaaagaaatacttgtgggttagttcaagggtagggcccccagcggtctctgtattaagaaaagaactttgtgttgattcctttggtttcctgatttgcttttgcctgaccatcacattcttcaagctctgctaactgaggtctaccactcaagctgaacttgaatctgaagtggtttctgctaacacagaggcaacatcgttgttggtgctgctgtcttagtacccatgaaaaactaatgttttcctttcttttcagatgacggccataaaaaagcccgaaatgcttatctcaataattccaactatgaagaaggagacgaatattttgataaaaatttggcactctttgaggtaatattttaattatatatgtatgtgtctgtgtgggagtagaagagggcatcatatttccctggagatggagttaggagagttgtgagcctcccaatgtgggtgctggtaactgaactcaggactctggaagagtagcacggactctttcccactgactgagctgtctctccaacctgcacaatgcaattcatcagctactaggaaatatgaaatcatcacatttccagagaaatgtttggaagcatcaatcatcatg

SEQ ID NO: 26975 - DNA, 2900 bp, Mus musculus
agcaggtctatgatcaaataaacttagattactgatgccaggttataaagtgcactactgatcatcctatttccttgacaacttctgaagacatggaatttctagaagtgctcactgagggattagaacgagtccttcttgtccggggtggtggcagtgaggtcatcaccatttactcataatcagctgtgggagattctgcgtggtccgacttccctaagactcatcgtccatggagatgatagctctttcctaccactcccactctattcttgcagagctgagccccatctatgctcttggctgcaacatgatctgccatcccagcagaaacaaataatccctcaacagaagaatggtcaagtcctaaaagctatttctatggcaggagaaggcaagtcaaaattaacaagctaagccaaagggaaccttttggcacacagaaggtaatgagttagtaaaacatatgctagaaatgtaactggcaacagaaagcaatgttcatatctaacattcaggacgagtttcagaagacacgggtcagtgagcaccagaaagttaacaggcagttaagcttcaccttagtaaaaaatgagttcccattatagagacagcctgcagcagccaggatggaaacaggatactgatatataaaacctgagacatagctgcagccactacttcttcctcatggtttattgtctgtactgtaccactgtacattttaactgtctttgttttaaaacccattctgtggttataatgcagacagtagtgttactatagaaatgtttttttgaaaggctagaaatgttttttcaggttttcaaatgctgaactaaggggattccaaagagtgcgtattaaaatatatagaaacacagtggttagctatgcaacataaagcacacaagctattatcttaacaaatgtgggttgttatgtagttaaccagaagggtctcttctactcttagtaggcattggtcttaaaaaccaaacaaaccaaacctgtaaggaagagacgccagggctgtgtgatgccacctccaaggccccagggttcagaggttcagcagtggaactgggggtgtgaaagccataccctttccactgtgccaaaatcgtctgcctacactggcagacaggtttgcagtggcctgacacaagcaccttttctttcacaagaaatccatctgtggcctcttcaccaaagccatagtgcagatttgaggcactcgacctccatgcccagagcttttcccgtctcaatattattattattcattctgacttcggaaacttggctctgaaacaaatggttcactaagctaatgatctgctgtattggttttgctttcaaaaagctctaactgtgccaaggaaatacttgtgtaagatcagattttttttttttttttaatttactgatcacaaacacttggcttaccagcataggcagcctttgtggctgagcagtattcccagggtgtgaaacctccataccctttccaagatagttactgaagaaactgtcttcttgcttagattcacggctgcttttacatttcctttcactgacagtaaattgtgccactctccataccctgtaggacaatgaacacccagaattcaacccaagacagaagaaaaccctcaaatatggcttaagaagctgagtcatatggtttgttcttcctcctcccaggcccacttgagtagcaaaggatccagcatgttttcctttgcttcctgcagagggtagaaactactcgtagttctctttccaacactccattgcatacttgagtataatcccctaggctccaaggcattggagcgcccattctgtaaaagccagcctgcccaggaactgcctaacacatccacccctgaccaaagtgacacatactttttccatatcaaacaaacatgggaagagaataaggtttctttaagaaaggctgtttgtggttagagctacataagaatctgttaaagggtagagtatagtcttcattccccaagataaaaatcactgttacatggacaaatggttattaggccagatttgtactcatctctgtctagaacatttcatgtctatgtgttgcttatgttgtctgtctgcaaagtgtcttagctcttttaatcactgcaaataaagcaatactgaaaacttgagagagaaaatgcaccttaggggaaggggccaaatgtttctagagggaagaggaagaccttctcctgccttcttataagacccagcttgtgtcttacccatgagtttattagcagggcaggctgtaacattcgttctcccccaactggtcctcagccttccgtagctaccttaaaagctggagtttgaattgcagggcctggttgacaggtgccagcttcctcgtggcagagcaaaagctgctgcttttcatattctgttgcctccttttcttgtggccccaaggatcccaccaatcctcattccccctaaatgttaaaagaaaattccttattgtggatattaagttacactgtaagcatatttacatgctctttttcccccctggtttttcttttcatcatgtataatttgaatccagtgatagtctcacatcttccaaaaaagtctgcttatgtgatatagaagagaaatattaaagtagactgaaggggaacttgtgaaacattaagcattgttctcaaccgtttaatttattgaaaggagaagctgctactgagcagctgctattcttttgtttacatagagtctggttttgtttgttttgctctgtgctgggaacataaataaagttttctacattattttcagtcataagttgtgctgtagtttcttttctgctgtaacatgctgcacactggcctcaccacaggaggctc

SEQ ID NO: 26976 - DNA, 1107 bp, Mus musculus
tcttttaactaattaaacatacttttaaacagacttgtaacataagcattcacagggtacacgtgctattttaatgcatgtacacattttgtgttgttgaatcaggttgcacatatctccttgaacacttacccatttccttagggtgaaaatattccgaatctcttctgcttgacttttgagatacacagtacataattgttacctacggtcactctgctatcccagaacttcgtatctcatatttacctacaacttagagcctattgatcagcccaggtcttccttctgctctcagcctctgtaaggtcagcttcagtagattccacataggaaattacaagttatttgtccttttgtctctggtttatttcacttacaaaatctctgtttttatacaggtggcataagttgtaagacttcatcctctgtggtattccattgcttatatttaccacattttctttattcattcactaataaatagattatttccatttcctggctattgtgaatagtgctacagtaaacagagagaagtacagttttctatggcaaactgaactgtttcttttggataagtacccactgttggaactgcagaatcatctgagcattttttattattttgaagaatttttgtacttttttttttttttttttttttttggtttttcgagacagggtttctctgtatatccctggctgtcctggaactcactctgtagaccaggctggcctcgaactcagaaatccgcctgcctctgcctcccgagtgctgggagtgctgggattaaaggcgtgagccaccacgccctgcttgtacttttttaataatgattatgcaatatacagtcccatcattggtgtgcaacaatctcttttattttgtaaaatttttatttatttagtgtgtgtgtgtgtgtgtgtgtgtgtgtgtgtgtgtgtgtgtaggaggttggggttgagtgcatgtgtgtcttagtcagaggacaactcttgagggattggttctttcctaactttacgtggattctgaggctacatcatggaggtaggtcatcaggtttgtgtagcaagatccttactacttagctatctcaccac

SEQ ID NO: 26977 - DNA, 1346 bp, Mus musculus
gtgttctgaaaagttccacacaatgtttcagaattgtttacagttaatgctgacattgtactttaagttccaacacagtgcatcactacctcctctaatggttagtaggaaattccagcaaaccatatgcaagcgtttttgtgttttgttttgttttttttttaatatggccatttgaagtatcagtgtactcaattctaggaagtcataacagtttgaatcgtacctgtcttagttggaattgcagttagctaccactcctgctggcccattcatcatctttctttagtaaggcttgcaagcttccagaaaagataaattgacttcctcttcatattccaatgtacattttaaaacttaaagcagtgactactgagacccccagcccccctgccctccagtgttattttttaactgaattctgttttgtatagctattattccagatatctatgtacaccacagaatgaatatccgttgtagtaattgattattatatcctcagattagagtcacatccaaatgactacagttttgtgatttcgaggtgaggtatgtaagaagtcattcttcagaacgtgggggtgtcatgaacctccattcccctgaagccttcagctgggaactacagcctttctttcttcttagcctgcagttttcactgtcttattgaaccatttgggcaggttgatgtggtttggttggagtgtgatgctagtgagactaagggtttgagtctgatccttttaaattcattaacttctcacgtgcacaaagaaattctgtagttcctgattgcatatttctttcagtatccacttaataaattcagtttgtgatctcaaagaatgtggtgtgcatagtttacttctcaaagagaaatagaatgattgatttgtataacagtatagatttccagtttgaagagaaaatattcaaaataagacctaacatactttataatttttttttgtttgtttttgttttaagacagggtttctctgtatagctctggctgtcctggaactcactttgtagaccaggctagcctcaaactcagaaatccgcctgcctctgcctcccgagtgctgggattaaaggcgtgcgccaccacgcccagctatactttataattttttagttgcacaatatcaaatactatggatcagattattgactaaacagtatctttttaaaaaaaaatcaaagttcaagtaaatatcaataaaaattgagtatagtaaaaagcaatactattgttttaacagaattcttattcctaaatatgcttgttgacattgaataagatggcatgctccattttttatgctctgggcaatgaaaga

SEQ ID NO: 26978 - DNA, 1121 bp, Mus musculus
agcatgagaggtcctggattcaatccctaagactggatgtagagaaagtcagtcatgtatatcaaactccaggacagagagactgcggtcagaccaacttgtgcttgaatcttgaaacctattggttgcagccaataccaagtaacaaggcaaggtggggctgaggctgcagcaatggtagagcacatctagaacctgctgggccatagtctcaggctccagtgcccaaatgacaataaacaattcaaaaaagaaaaacttcgagataatgagaagaaaaacgtaggcctcccattccttgcctacttctgcctcagattcaaatctcccatccaagtattaaccaggccaaagcctgcttagcttctaagatcagatgagattggggacattcagggtggtattggctataagcctagctttaaatctttgacaaggcccagaaaaggccagtagcatagagacagcttttctttatatcatctttagaataggttgtaaagaatattcctggtagatagcccttctacctattctgatagatagctcccaccttgacaagctttcctgtttttattgcttcaagttgtatgtctataaaggcatgtttgactgtatgcatttacttttgaaggcattcttgctgaatctacaggcaactcttcatctctgtaatgctacctgacttctcttgtgaggagctggtgaggaagttggtaggtctctgcagacactagggccagcaaagtgttgtggagtcctgtgaggcaagaaagaaatctggcttaacatgactcatagctgatgttggttcaaacttgtagtgtctgacaccaggcagtttattttaggcatatttaagtatagtacaatttggaaaaaaaaaagtttcttagtgcaacacaatcctgtgtgcacaatgaggcatgattacactgaaactcttctcagatacaggtctgctcttccatacagtcatacagatagcacagaagtcatcttgactattagctacctctggtcctggttgtgggagcttggggaagccctgcccatacaaataatgcactggtcatttagacgattagctacctcaggtcctccttgtgggagctcagggg

SEQ ID NO: 26979 - DNA, 1150 bp, Mus musculus
agacctagctattcattatttcagttctgattccctcttagctaacaacccaatgaaagaagctaaagccgatcttgactcttcttcgatgctgtaatgatatctttcctacaggcttgtgctgaggtgagtggttcaaacctctgattcagtattctcctttctatcttattttaagaaatttcttcttaacccctctgctttccatataactaaattagataacattggctactgagatgtgtgaattggatatttactttgttaaaataatccagtgtacagagaacgacaagggtgtaggaacgcctgggcaaagggtaggatagttgtatgctttattttatttatttatttatttttttgtttttgttttttgttttttttgatttttttttattgtgttaaaaaaaaaaaaccctcattggcttctcacttcactcataattctgtttccagtaactgcaaactaaatcagacaagtgcatggaaaacataattaaaaaaaaagtatagtctacggccatatcaccctgaatgtgcctgatcttggaagctaagcagggtcgggcctggttagtacttggatgggagatgggtgctgtaggattttttaaaaaataaaatacaatagattggcttttgatttttttaatgaaaggaggtttcttttagggggagggtatttagtcttcgtattttactaagtgccaatacctttcatttcttacattgtgagtggaaaatgtgtaaggcgaacatgatcaccaccatgtcagaaacaagtggaaaacttacatgggtgaactgttttatctatgccagcttcagcccctgtctcccaatccacagagttttgaaaatgacagtgggtctacctattagttcctttggctgttcctgtgataacatctcttgacaaaagtcaactgcagggagaaaggttttgttctgactcacagttcaaggtttcagtctgtcatggtaggacatcatagtggcaggaacttgagggcgcttgtgttgtagccagagtaaagaagcagaaagcaatgactgtttaagtgcagctcatccctctcttttatacagcggagaatcccagcctaggtagagggtggtgccatccacagtgggcacatcttcttat

SEQ ID NO: 26980 - DNA, 1147 bp, Mus musculus
aagtgtgttctctgagctgctgaaagcctggctccctccccggtcctgtcgctccctgtcctgtaagtcaagagcagatggagcggataaactgagagagcagggcaggtaacacaaggcagaacttgtgtcaagggcactgcggggacatggaggaggttggtaactctctcagcagcagagatgtgctggaaccagacaaatccgaagccggacttgagatggctcagtcgatcctgagtaaattctctatgaaatccctgtttggatttacaaataaattggactccttggagcctgaagaggaagatgctgtgctgaaggcatttcgcagtttagagggggatcccgctcctgagcgaggtgatcccagcaaaggctcagatcagccacaggcagaggctccagttccacctgatcttaaaaatgatggaaagtcagcaagggcggagacaggatctgagggaagtcaggggaaaggcagatcaaacacctcttcccctggttatgagctttcgcctgctacagtgagcgtggacaatgaggaagtcatttgggtccgtgggaccctggttcacaccaccagtgattctgactctgaagatggagaccaggaggcagaagaagaaagtagccttgatacccaaaagcccaccactgttgttttatgtgaaccttctcaagagcccaaagacagagcaggggattccgaagaaaatacagacactgggaacactgatgatacagaactctgtgctgaagagtctcagagaactttacctgagacaagtagcaaactggaacttggtggtgatggtagccatccggcagagcacagccccaggcaggaccaggctgcagaagaagggtctcaaatcccacccgcagcaacagaccagactgtaggtgcccttgcgagcactgtttctaaaagagaagctccggaagagaagcccttccagcttccagctttcttcagtgggctccgtgtgctgaagaagggggctaccgcagaggcaggggagaccatcactgaaatcaaacccaaggacggggacctggctttgctcaagttgacccagcgtgttcagaagtctctgggacagggaggcccacagacagtgaagagcccaggtagagcaactga

SEQ ID NO: 26981 - DNA, 1315 bp, Mus musculus
catatttgaacacgtttttgacatttttcttccaaagaaataggcaaagagaaagaggaactcactctcttcacatttcttaaccctgatctcaacgctcgctgtgctttcggctttgccggaaccttttagacaggcagctcctggccaccccaaagggtcctcattttgaaaacaggagcgggccaatcggatgcggagcgctgtttggcgctggcatttgagccactgctcaggtgcggtcgcgtcgggtctgatgtgtgccgagaaggtggggcgctggcggagccgagtcactaagctttagcgggccggggccacaggcaaggctgatgggctaggggaaaggctgcgtgtgagacggggtgacggcggggaccagcccgggcagggaccgggactggggatccctgagcagccggctggcccggctggagggagtagcttaaggttgcatttccatctcaagaaatcagagcggggaaggccaccctgcggggaagaggataagtggaagtgtccggaagcgagaaactagctgcaggcgttagtctggggaaacggaagagtcagaaaaaagggaagtttgtggaagtaactgacagggctgagcgacccggaaagaaggctggtggaagtgaaacaagagtgaagagaggcgcgagagaagaaggtctgtgtaagtggatcgagggaaagtggaggaagagtgccagaggtggctggaaggcagcggagcagagcgagcctgagggcgtttggcaagtggaagagttggttggtggcaaagaaagtcaggacccggagtcggcctcggagagtaggcgacgtgttcgggatgtgggatcagagactggtcagattggccctgctgcagcagcttcgagctgtctatggcattaaggtcaagggtggccgcggtcagtgcgatcgcaggagacatgaaactgcagctacggaaataaaggtaagttacaacgtgttgggacaagggcatacccattttattctggataagaaagacacgtggttagaatgcagtctcggtggtgatgatcagacgtgcctccctatgttgccgtgggtttttgttttgttttacagtgctaggaataggataccaggctccctacttaaatactgtgccaccgatctggtaatctgtcgtgttttaaacaagcagtatgtgggggaggggaacacactatcctgtcaggctggggtgggcagtcagaacatttcaaacgaatcattagggagacagtcaggccaagtttagaaataggcttcataggatccttctgtatccagcaat

SEQ ID NO: 26982 - DNA, 1548 bp, Mus musculus
agttaacagtgacccagaggatccatgatagtagaagactgtgtgagaaaaaggggtgataggttgaaggcagaaggacacatagtaacttttaatggctttgggtaatctcattgccatgattctggtgatacaataatagatagacaactatttcaaagtgtattaagttttacacttggtttatgtttattgtatggcaatcagtacttccaggcagtttttgaagtcacacggtgcctcaaattctaagagtatgggttttgctttttactatatttttctttagcgttcaaataaagtcgacatcctattctttcaactcccacctttattaatcacattcaacacatctttcagccccctctctccctatgacccaatcctacacgctgtatgttatctttcttccttccactagggggcaataaagagacaggtaaaggcagcctactttctagctcaagcttaactcttgccttgacttccgggcccactagttctgcttccggggaacgccgggacttctcaggttccgggaggaaccgtgggagcccagcgtgtctgtgccgggcgctctggcacctcggggctgggtcgccgccgctgcttgaaagctttcgagagtcgccgctacgagcctctggtcagcttcagtggcgatcgctgcgatggcggctcctgcgcagcccaagaaaatcgtggcccccacggtgtcccagatcaacgcggagttcgtcactcaggtgagccccggcgtgcccgcttgtgtaaggagggatgccgaggacctaaagcccgggattgggattgattttgatatcttgtgtacgtgcaagttgctagttaaacattggaaaagctgcagtgaaagaggccgctcctcgttagaccacaaagcgtgcttctgaattgtattactctgacaagactctgtctacaagtagatcgctctatggcagttaattgtcattataacctttcatttaggagacaacagagccaattccgggcctgtagcctttcacatccttgttaattcttaggaaattattgagagtgtaagtgcgggaaaatttaagccctcccgcgcctcttctggctccgcagatttgtcagggcagaagcctagaaactgtttccattcgcttagccccagcatgtctacacagtgtttgtctgtatttctggacctctctcgcccaaagatgccttccccactaagacttgttgatctgtcatatttcctcttgccctcctgcagcctgttcttcagattgctccagagtgctcactggtgcaaacctgctcacattacttgtcttcctacagtgtcccgtaaacaattctgattgtccctgggataatgactggaatctttgaaagtgctgtgatctggcctatgcttttacccaaagtgcccttcctttcttctttcctcccttcctttctctctgtacctgtctgtctgtctctccctcctttcccccctaattttatgcttttatggctatagctgcggttacttgaatatgccatggtaactaa

SEQ ID NO: 26983 - DNA, 1699 bp, Mus musculus
catgttgatgagacttcatgggtgcagctccggagactcctgaaagaagcaaactccctgatcctctgactctcaccatcctctatctccactttactttcatgttgtaaggagtctcgagtctcgtggcctttgtgtcacatgcccctgtattgccctttgatttcgctccagctctctgtctaacgtttccttgtctgactcttttcttccctctcttccacatcccatgtcacgaaaagaggcatcagaaaaagaagactctgatctagacaatcaagctcgttgtaatcaggtgtcagtgcagcgattgaccctttttgttttttatatattcattgtttgaaacattcaacagcattggataatcagaaatattatcataaatagctgagtatgttatgattggttttaaagaatttttaaatatcacttatgtataacttatatattaaaaagactagaataattttatgttcacttcaaaactgaatggaaaagcacaaagtgcccatgtatgtgttttgttccattggagcactgtctgccttatatcagtgtactactccagagagaggtattttgtaactgatagactcacattggtagatccttatcaaaggtccgcctttaaccagaagtggtggctcccctataattccagaacttgagagattgaggcaggagcagtgttatgaggggtggcctagattaccttggctcaaaacaaaaaagtcatagtttatataagatctcacaattgtggttttacattccacgggatttaacaaatgttcaaagacatatatgcatcattacactcctataacacaatagttttactgtcttaagaatcatgcgtagccaggcagtggtgtacacctttaatcccagcacttgggaggcagaggcaggtggatttctgagttcgaggccagcctggtctactgagtgcgttccaggacagccagggctatacagagaaaccctgtctcgaaaaaccaaaaaaaaaaaaaaaaaagaatcatgcgtgctccacctatccatcctcggtctgctctgactcctgacaactactatctctctgctctctagttttgcattcttcagaatattgtgtggtagcaatccttcacttactaatatgtgtttcgattccctcacttcttgttatggctgtttctactttttggcaagtatgaataaagctgctatcaacattcatgtacaagttttgtgtgaatgtcagttcctttgtatgactaccaaagagcataaatatgctatcatcagtgtgctaggtttatttgcattgctatgatatatattctaacaaaaacaaaaaaggaataaacaaacaaacaaacaaaaaaaacaacctagtggaggaagggttgtttggcttacagttctggactagcatctatcattaaaggcaaatgagctgacactcaagcagctaatcccattgtatccacagtaaggagcaacgatctcctttctatttcacttccatatatctcttacgtatctcatagtcctgtccatcaccccttttaaagttgtatctgcccaagctccttcattttccatttataggagtggttttcaacctgcctaacactgcaacctttaatacagttaattctaaatgttgtggtgacctccaaccatagaattgtttttgttgctgccttat

SEQ ID NO: 26984 - DNA, 1166 bp, Mus musculus
tctgaatgttaggccacagtttgtgcaaagacagagtgcaggcaagatggtgacattctgttcgtattatcatcaagaggctgaggcaggaggatacagtgtgtgaggctagcctgagacatggacacacacacacacacacacacacacacacacacacacagagagagagaagcttaatataaaatagggctctctacacgtgggctttgctttgttttgttgtagtttaactgaacgttctgtcgtctgtagcatacactacacactgcttcaataccactcagccttctgctgttttgcatcctcttcacaccttattttgaacctttgaacaaactatttgaggacttttggttttgtgagttttgttttgttttgttttgttttgcttgtttatttgtcgtttttttctcagtagaataaagaagaaatacttgcaaaggaaacaaacatttatagtattgcagaatacacatttgctttctaggtcatatcttctgctgttcgtatctgcttttgcagtttacctttaggactctgccacaaaactgagtggtgcctggcagcgaggaggctgcgggaaggaagggcacccgagaactcaggcttatgagcctttgagtatacagcaccacgggatttatgcttgcaataatcagggctctctgaaagggccatccttggtaccagtgccattattgtagacatgagaaacctggtaaagctcagggcatgttaattcgtaaactttactctctgattcatgagcttattttatagtatttacaatatgatggtaatttgtacataaaccctttgccttgaagacaagcctgactttttactttttttttctttctttacttttgtgcagtcaattatttaagcagagatttcttgtagaagatagagttatttattcactagaaccttaaaaaagaaagacatatctttattcacagttaagtaaaatatctccttgtatggctacattttagacatactgattaaggttgtgctaccatatttgccatgataatatatcagtttatacccaagaatatgttgccttgggctgttaaagaagaggtctgccctttctctcagcagctgtgttaagtcacagccatcttcagcctcagtgcaggaatggccagctccac

SEQ ID NO: 26985 - DNA, 1984 bp, Mus musculus
ctggtgaggtaatgctgaataaataagatttgattatctgatatttcagtaaatatcagaaacttgccttttatattttagtgtttcctagttgatttatgacactgaacaactttttggctttgattcactgatttttaggaatttcagtgaagtattacaatgtattattaatactcttagggattggtttacataactgaaatagtatttctgttggccttgtttcttgaaattgagctgagcggtggttcttaatttgtggttggttttttacactctgatgatgttgtggtgagcctgacttcccgaataaaaggtgacaatggctcataaagggagaaaaaggcttttattgaacctgaaatgttgtttatggctctgccaaaggattacaattaattggcaagagattaaaaagtagtattaattcatgtattctgcaactatctagatctatctaggtaggcttctgtagcaattatcgattaggatgggctgtctgagaagtagtgaatatgattgtttgctgtatcgttaatagtcttctaaagtgatttttttttatcattctgtaagatttcaggttctgattttgctgtcatattgtaggttaagtctctgttttcctgagaggtcattttgcttctgtatggcctccttgctttctaaagtaagtttagctgcagaggtgagatgagtgtggattcgtggtaaaggaatacttaggaaaaccctttgatagcatcatttgatagatgcaggcacaggaggattgtttttcttattacttttgtagggaggatgtttatattactagaatactagatgcatgttaagtcagtgttcaggcatcagacctcagctttttcagcaaaagcctgtatgagaatggcaaaggagaactgcatatttccttaggaaaaacagattgatggaagtatgaggcaataatattttattatttaactttccataaatgtgggcacgaatttactattgtgtttattactctttgccatactgattaaactttctttaaagacagagccatatgtaagtaatatgttacagttagttaagtctgaaaagttaccttcataataaaagtcatgaaggttacaggagcagggtaaacactagtttttgatgttgttgttgttgttgttgttgttgttgttttaattgtattattgaaggtaaatactatcaagcatttgatggacctggctttctctttcctactgataaaatgtgacaccttgtgctgttttatagagcacacagtggctgataagaagccctaactgaaagagactagggacagagatgactggatgtaagaccgtgggcttcttgtcaccagaggagaatgatctgtgccgcaggcattggagatggttattgtatagtgagctggtttgtggggacacagcaacaaagctgggtgcatgtagatcacagagccaccctttcctgatcaggaaactaacaccaactccacctttcctttctttccactcctctgtcctcacgaggctcatagctaacagtccctcagaatccaaatcatgtcaaggggtcctaacatggtttcctacacagaaacttacgtgtttaaaatgtaggttagatgccagatatgtttaaaactattcaacttagctccctaaatttaaggacataagagtaaatattttcaaacaattaaattcatgtagagagatagtaaagtagattcatgtcttttggtgccattgttcagtcaaatattgcgctgttgtctttctccagctaagtgctgggtccgagtctttttctgtgattgtcctgggagcagaagtcatcatgtctaagccccagacttaaaatacccggtgcattgcctctgctctgtgtccttttcctcttaacttacttacatttattttttttaaaaaatgtcattgttatgacctaggctttgctcttggaacaagaaaga

SEQ ID NO: 26986 - DNA, 1121 bp, Mus musculus
aattaggtttaaggcctaaaatgctgtgtgtgtatagctataaaaagtaagtaatgtgacctaggactgacagtacagctgtatcgaagggaagaaaatcctatggaaggctgaaattgaacatggtaactgcaattatctaaaaggaagtctattaccttctgataaaactgtcaaaataatgatttggtactcccacaaattgttcagagaatcaataaagccaatatttcgtcacagtttgagaatttaggaattccactttctcctaagtcacaagagaatgctaatatagtttaagaatgagataattttactgttttgttcctgtttcatcttgtaactcctattagagtaaatatatttgcttgggaaacctgatgaacaccattcttggaaagcataaatagtatttatattcagtagttctgcacaggatttatacaaatatactactttgctttgcaggaatacaaaatgcacgattttgagtagagtatagataattcctactgcagtcactgcttttcttagggtcgggtgtaacatttggaccaatgttggtctttgatatcattggatacaaaccaaggagaatgacaatttgagcttgggtcactcaaacctacatgcttcccgacctgctcttggatatacctgtcaatacaagtgaacatttgtgttttaatacaggttaacagactcattcaagactcctgaatgctgattggtgaatatagattcatggtttgccctcttaactaagtcatctaaagttagtttttcacttttggtttgtaatttgggccatttcctataactagtacagaagtactttttgttgggattagcatccgtccatagtcatggctcttgacttggtgctctatccataaatatccactgacatggagagacgattcctcgatggcctgcctaccacttccttgtagacagaagactgaggggctgctaaggaaggaattttaggtaacataaacattagctacaatgtgacaattaatgggagatttgggtcttctttagttgacccattcagaagtttttctataaagacaggtgctaatattgttggctcctaagtattaaagtacagttta

SEQ ID NO: 26987 - DNA, 1237 bp, Mus musculus
taccaggaagtattagaagaccagattcccagagctaggcattcccggcccatcacttcttcacttttagtcgaagccttccaaagctgggattaggagtgaatctagtactgatgggctcctgcaaagaaaggaaacagatctgtcacagtagcaacagttggattaagtgagcacttcagtttgtacccagctgcctcagtcatcgtgctagcagccaaagcaagccggtttgcttatactcacttaaactgtcttttctctgtgcctccaagaggtctgttttctggactctgttgccatgggcatgcatgacatgttctgttgtttttgcaggtttggaccaggcctggtcatctattggtatggatttatccaggaactggactgcaaccgggaaagaggcatcctgctcaaagcctcgttccccacagacatcgtcaccttatgccatagcacagcttgaccccgaagatcctggaagagaagccggaagcaatgttactttcctgcagtataaactgctggcagcatctgccctgaacttgagatgaacccttgctgccgtcgcagccctacctctagacaaacatatcaggagtttctgttttccttcatccctgggtgatgtgaatagccaagaactgcagacacaacccactcattatcagcatttctgtctctgacaaacagttagtttatagatagtcataatcttgcttccttccgaatgctttctccttgtatactgaacagaagagaaagtatggagactgcaagatgtgagttttcacttctcctccctgtgatcaaatattttttcttctaaccctccattcatattctctctctctctctctctctccctctctctctctctctctctctcatattctctctccccctccccaccccacccccggtctcttggcgggtacactggtactgagtgttgcattaccggggaataacctagcacaatcctagaaaagctggagacaggaagtccgtaagtaaatgttccttctcacctggggctcagcagaggccgcccggagtctttctgtggagcctggtggcctcctgacttctgtggcattcagccaagctgcacaagtccccctcgatgagaatttcctcttttcataaagttgatgtgaacaccaaacccttcacaaggctgacctcctcttcaagtatgagttgccgctgtgtctggaaaaccatgctcctctag

SEQ ID NO: 26988 - DNA, 1174 bp, Mus musculus
aatctataatacatttaaaacatccaaatcatatatttcaaatgaatgccttgaatggtacttagttatgtataagaacactggcaaaccagacttactaactgtttacataagctcaatattaccacagggcttctgatatctttccttttctgatttgttcttcagataggaaagaaataagccaaaacaataatgatctcttaaaaatctaggcaaataacagatattgtgcacagctcagacactgaaaattatttatctactgtgattaattatttctataccagctctattggctaatttgctgtttggcaaaattaaattttgtaccagcaatttcacaaagtgtagatgtgtttattcacttacctggcaggtttaaattttaattcaaatgttatttcagtgggagtgtctgaaaaatgaaattgtcccattttcaaggagtctgtagcctcccgcagggcactagcaagtaaaccaacctactattctctagcagatttgcaatgggacattcaggaagtccctggcggccactgaacaaacatcactaaaccaccagctgaacagtattgtgactatggcctccaacaatgaggtcagtggagatagcagcacacagagtggagagttccatcaatctagttaggcccatggtgacttcatttctacttggaagaattcaagaagagtttctatgacttaggacaagtaaggaaacactgggcagctatgctccagccctcagcatggtacaatcagggttgactctggatggaaggtcaggggagctgtgaggaaattgatactgaataaacggtccagaacttaaatccagcatgccaggtctcttttgattggactttctaaataccaacatgaatgagtttgtaaatgcaggcagtacatttgcctgtatgggacaaagtagatgactataacagtgttggcccatgatatactggagtggaagttaaatggtaactggtgaggcctatttccttctgtccccatgggtctctaattggtcctgacacatgtcaggtactgattttccttcatgctggtttgtttaactctcagttcacagaattctaagtgttcagtgatcattaaggagtacataactggaggaagtatcaggcatgaaagataacaagaaatttgg

SEQ ID NO: 26989 - DNA, 1128 bp, Mus musculus
cgcctcgcgccctgcctgcggcccctcagctggagcgcgtccgaggcagcccctgagggccgaccaggcgcgccgcgcgggcagccggcggccaggcgggagatggtgcgcggcacctcggcgggaccgcgccgcctcccgcagccagcgctcggctgccccccgccggctcccgccgcccgcccgtcgccgcgcccctgagagcagcaccgcctcagccaccggccgcgtccccctcagcgcccgcagtcgcccgcgccgtctcggcttcgcactcgacctcggcgcggcaaaccgctggggtcgccacggccgcgcttgctgccgccgcccccctgcgggggtggccgggctgcccggctcgcggggcaccgctccgagtgaggcatccaccatggtgaggcccccgagccgctgcccgcgcgccccgccggccgtcgtcgcccgccgcccctcggtgccgccgctgccgctgcttccctgcctgctgttgctcctccatctcctgatcggatcacggtgagggaaagatgagcgaggagacggcgacttctgacaacgagtaagcgagccctggcctggttgagcccggggggcagccccctccccccagcccgtcccgcccgggaggtgatagatgcccgatgtgtcgggccattttctttaatggcagcaccccttttcattcgtgcattttcgcctctctgcttggggaagggtatcgagtgcagtgcagaggcggcgtagcagtcggacgtctccgagacagagtaataatgtgggtagctcaaagtggagtagaaactaccctttgcctgcccttcactccggcgtcaaacccgccccccctccccaaacaccttgaacatccagccaccctgcctctacagctatttcgctcggaaactaatgtgtgggagcacctccagccgcaaactgctcttgaatcctaattcgatgactcagtgactcctaaataccgattaagccttcgccccccgccccactttttaaacttatgacctatactattctagtaaaaagatagggttagggaaacattttaagaattaaataggattaaggacacctggagtgtgggcgatgttgagctattgtgttttttta

SEQ ID NO: 26990 - DNA, 2719 bp, Mus musculus
gccttttttttttaatggattaaagtttctgaagtgataaaaatgaaaatcacactaccatttgaagtccattctccaggttttcagtgtcatttctgtgcagtcagttttatgtgtcacacttcggcttgtgttggctttcttcttttgccccagattaaactgaacaatgtatatatatataacactatctgtctgtaaaatactttttttaagaaagcatttatatttatatgacagcttgaactgacaacattatgtatatagatcatcttgaagtattatttcacattgaaaagaagaaaaatatattgataactatagatgttatgaagaagaggctatttctagttttgtactaaaaatcaattggatgaactaaatccaaaaccagacactgtcgcagcaattttcagtcttatttttactgtttctacattggaggctgctgcacagatagatgatcttcgtccttgctgttttcagaggagcttggtttcctagagcagactgttacctttcaggattcctttttcttgctgaagtagagtcctggttttccttatgagtgattatccatatttgtaagttctgggtttgtaattcaggttggagcaaggtgtgaataactaaagaaaataacttgctggcaatataggaaatgccatggaaataaactgtgtatatacttctgagaagaacaaaattaatcattttttttttctgttaagcactagtcactatagtgcatctcctggttctgtactgtattttatacgcaacgtacatgctttaatattttaatgtttgtgcattaatattttcagtttgtttaaccactttgctgctaagattttgccatcccgttcccattttttcctttacaattttaaacatttctcttcattaaaaactatgataatgaaattgttttttttttaaccttggatttttgtaattagcacacatgaattcaagccagtccagaaaagaaactgatgatataatgttaatgagtctctttgtgaattagatggacagtttaatccaattcccaacatgtacgtgtaggtggattcaagaatgatttcttgttcactgtacagattgggcgctgccattgggcattttctttaaaacttctcttttgtctagaatgtaagcagatagctcaacaaaactggtgaagtaaaagtaaatattgaaaatgaaatcatctgaatagcgtgacccaaaaattctccagctggggggcctgtttgctcctgatctgtagttctcagaggatgcttgcagcctgtggggaagccttagatttcctgagcagtgcttgcggagctgcagtgccacctgctggatggctttagaccagcgctgaaagatggaaatggtgtctccagtaaaggagggctgtgggctgttcagggtggccagtgcccaccagagaaatcgggggtgaggaaaagcgctaaggagtgtaagtaagtctttccccaaatgcatatggttgctggaagaattgaagcactttttccttacacatcctgttttaaaatatttattgaaacttggaactggcaatcaaacttatgtatgtactgaagcatttatacaaccagtttcttcaactcagaagccattaccaaaatggtattcctattttcttcccagtaccagtcagggagaattaaaaaaaaaataaacataattacctgtattttatcatgacaactccagagagtgtgtatgtttctgagtagatgttgatgaggcaggacttaaaatttaaagagaaaaacttgaaactacctattttcattggttattcagcagtgcctaaaatgagcttctgaactattacaaatgcactttggattcatgtgtacagtgccatctggttctctgggtcaaacttgcttctcctctccctctttcttctcccgtaactaagtggcacacaggcatttcttagtgttcgtgtcggtcttcaaagtgcagagaacgtggtggagagaattttatggatcttttttttctgttaaaattgaatgtctgattatatttgcaacatgtaacttggattaatgtgttttaaagtaattttaattgtagtccagcagcacattgagcaagtgtagcttttctgaaaagtaacttggagaacttcagttaaccgataaaaccaactcatcactaaatgtcgctgctcttcctcttgatttgatctagatcccacttctgcgtcttacagggaacaccaaaaagttgctagtaaatgatagtagagaaatagagggagtcaaacagaaaatattaaaaatatgcgcacacagacaaacagaggtgatttatacaaaccagaatgaaggtggggagggaaggaaaattacagggggctttaaaaggtaccagttacctagcagctgggcaattagaaacctttcagttgctttggtacactgtcatccattgttcccaaaagctaaatttgcaaaagcaattagttttatttcattttttcaagaatttcctagtcgaaagcctttgtattaaagatgcacaggtttttgtgtgaacaggtttttttgtgaacaagtatgttgtacatttttgctgttatcttgacctcagaagtgcctcacttgtatattacccaccccacccccacccccactaggagcctgcctgcatctttctaataagcaatggaagcccgctt

SEQ ID NO: 26991 - DNA, 1192 bp, Mus musculus
aactttatttgctaaccttcttcccaacacatttcaaattttataagacattacacttgctgttttgaacagccaatatttatctcactttgctctttctaggagtacttttcagcacttttttacactctcatattctcatctgtcagtattttctttccactcaaacaaccctgagatttcttttgacatgaatttttggaaataatttatgttactcagaagatgtctttatttttttaaatttctttctcttttttctttcctttctttcttgtctttcccccttacctcctgtagtggctattcctggttgtcaacttgactatatctagaatgaactacagtccagaattggaaggctcaccagtgaccctaatctggaggctgggagatagaagtttctgacctggatctgggtatggagatcttgaggcatagtggctatggattccagaagattaaggcagggaaatcatacttacctggcaggggagataccatgatcacgaaggtggttttcccagggcgaggtgtatccattgcactccggatgtgctgaccactgcgatttccccaaatgcgggaaactcgactgcataatttgtggtagtgggggactgcgtttgtgctctcccctttaaacaaacaaacaaacaaaaagacagggagatctgagttcaaggtatggtggcacacacctttaatctgggctacaccttctgatggagaccatttaaggacattgaaagaagggagtctcactttctctccttcgcgcctgcttgccatgtgggactgagcaactgctaggtccttggacttccattcacagctgttactgaccattgttgggagttggactgtagactgtaagtcatcaataaattcctttactatatagagactacccataagttctgtgactcaagagaaccctgactaatacaccttccccttccttctctccctcttcctctccttccatctttctttctttctttctttctctctccctccctccctccctccctccctccctccctccctccctcctctctctctctctctctctctctctctctctctctctttctttctttctttctttctttctttctttctttcttcttttgctgtttgttttgtgagccagtgtcttactttgtagctctggctggcctggagctca

SEQ ID NO: 26992 - DNA, 1260 bp, Mus musculus
gggggtggaagaggtggatggggtggtgggggagggtggggagggggaggaggaagtggaggagggtggggaggaagtggtgggggagggggtggccgaggaggtttccaaggcaggggcgattatggtgggaggggagattatggtggaagagggggctatggtgggagagggggctatggtgggagaggttatggagatccatatggaggaggaggtggtggtggtggtgggtatagaagatattaaagactgcagatgttagagagcactgcttcttactagatacggtagatatagtgttctgaggagcatacttgaacatccccctgaggtagatcgtgtcagtgccctgaggaaggcatcctgaatacagaaggcccttttatgccaccggttgatgatcctgcaacgcgactctttccatagtctgggtactaaagcatgctgcgtctttttcaaaagcaaaaacacaaaacctatttttagaaatgtaaatatttattaccagcaacttggaaaatggaatgtattttattgtcatgtttgaatttagactgtaaactggtattttgtttaggattgaaacataatgacacccgccagtaacaaaaaggaatctagactctcatgtcatttgtatacctgtggatctgccctgtattgttaattctattttacaaaatagaggaagtgtctaatatatgtgcatagtcagttgtcctttttgaaaaataggttgaaattcctctggtcaggtttttattaaatttctgttgacatcttctttatttcactgtgtcatggcttatttgccagttggatttgaacctgtgtgactgactgaatggctaagtgaaaggttgtaggacccaggggtggtgggtaactacaatgaaactgttttctagacacagcagggaagttgcacacacacactcacagcagctgtgaccgaatgcagaagacacatatctttgcaagatcaggccagataaaatcctaccccctccctgaggaactactgctggccattgattcctgctgggggaggctgagtcgggatgtgggatgtgggacatgagaggttacccatggtctctctggtagacgtcccatgcaggcagacacagcactaagtgcactcagctaaaaccagaagcacatgaagttgagaatgaaaagtgtgtgtgtgtgtgtgtgtgtgtgtgtgtgtgtgtgtgtgtgtgtgtgtgtgtgtagatgggagactccagccag

SEQ ID NO: 26993 - DNA, 1119 bp, Mus musculus
acagaggaatatgaactgtacatggtgctgccccctaaaggactcaaatcatttaagatattcctttgatgaaagaccactgcctgtttgcacacctctttggagcatttcagtgacaaagagctggcttgtggtgagtgtctctctaaactttaatgaactactttacacacagttatccttcttctacatcccatctcagaaacgtgaaaagcatagcacctggtactacgcctctggcaggtgtctatattatgtggaaacttttatggagtgataggactaatggaagacctcaaaatttgtattttcactctgttatgcactagtacaagtgtagagcttgattctttagacaatgcctttttcttatttctcatccccaataaagatctcccagtgagattttgtgtaaataatctgtaatataggaattcagagggcctcagtcatttatcacagctagatgaccttacagacagcagaaaggacaggaaagatagtgggagacagtagttttcctcacaaattcttacattccagccaagacaaaggatgtgtgaagtctgagttggtactgttcctgcagaatggtaggagcaggtgggatctcctgatacaatctggaacaaagtttggcctgtcacatgaggttttgtttaccaggctgtcttgaaatgtctgggcagatgggtgtctgccaaagcaaggactgatcctgtctgtgaacagcaatgtctctgctcttcttctctgtggagtgactcacccatttactgaccacttgtgaaattgtctaaagatgtatactgtaaaagcttcgaaagaactgtacaaactgtaagatattttatacctattttatgttttctgtgtctcatatttatatcataaaaacattggatccctataacttcaaagtcgtgtgcttcttcactttatacatatgtaggcattttgttaaactttttactggaattcaaaccaaaaatgctcctccagtctattaaaaagggttttctggggggggacccctagcttatttgggttaaaatgttcttccttttttacaggatgaggaagtaacaatgcagatatgtccaccttataatgacctct

SEQ ID NO: 26994 - DNA, 1567 bp, Mus musculus
tctcagtgagctctagctgcctccgcaggaggggcagtgcgcctttactttatggttagaaaggcacaaaatttctatcaacctaactaaaacattccttttctttctttctttctttctttctttcttcctttttctctcagttaccatggatttttccaaatctcttttggtttttgtttaacaaatgctttaacaatgtaatatatttattttgttcccctattctggagggttcgtcggaaggattgttactgaaacaggaagcgtgggactatctgaatcatcttcgtagtgagtctttatgactgtaagattgtaaatacagattatttattaaccctgttctacctggaattagactgcatatagcaaatgtttgcaagcaggtagctgaggcggatcagcaaatctctccaaaaccagtgtgtggaaaggcagcagaggcagctgcttttcatctggggctcacagtgaatgatttggactcctttggcttcccctttgttttctctgtagtttcaagtggaattaggtggcggccgcttgcattcactcctccttgtaatggaagccaggagtactctaaggcccacaccaccccttgtgcctatttccagggagaagaaagaaaacacaatcaccttttctttatttcattttttccccaaaagagacaaaggtggaacttctatacaaatattacctcatttgttgtgtgactgagtaaagaattttggattaagaagaaagagtttaagtgtcaataaacttaaaactactgttgtgtctaaaaagtcggtgttgtacatagcataaaaatcctttgccgaggatgatcccaagaaagaaacagctttgtaatgttaagtacaacttctcaaagttctggttttgttctatcatcttttacaccgttgcttttatttttataaattattttctcgttgccattggaatagagatctcagactatgtagatatgctatttaaataatttatcaggaaatactgcctgtagagttagtatttctggtttttatatgttgcacactgaattgaagaaatgttggtttttcttgtttcgttttagtttgtttctttggttttgtttttgtttttgctttttacttcccagttttgactctttgccaataccctttttcctaggaacgtgcttttttttttattttgtacacatttttatccattttacattctaaagcagtgtaacttgtatattactgtttcttatgtacaaggaacaacaataaatcatatggaagtttatatttatacttacggtgtctgtgtttgttttgttctttactgtctggctatcatggggtatgggcaaaagccattcctaaccaatagcacacacacagcagggcaggaaataacgttcgtgattcctgtattattgacaggcgctagacttagatgatatatttactacaattttggaagaagaaaatacaagtctgccacatgacaaacaaaataaaaatgacccttgtgtcacaagccactccccctcaaagatttttcatcattttattaatat

SEQ ID NO: 26995 - DNA, 1196 bp, Mus musculus
ctgtgtagccctagctgtcctggtcctcactctgtagaccaggctgccttgatttctttccctttaagactagttctttcttaaacttcagatatgctctatgatattgttgagtaggaagttgtctgaagttttccctttttgcttggggagtgcacggcctgcagctccctggggagtatgtctcagctgctgaaggagtgaagactttgatggcataccagttgccaggacaggtgtcccagaaggctttctcatgccagctactccaagtctgtgtgaaagtcacctgcttccccagttggtaccttttcttgttctggctttcaggcctattcaaatctactgagagccaacatggacgggctgaagaagagggacaagaagaacaagagtaagaagagcaaaccagcacagtgacaggcgtggctgctaccaaccagctgcacaagtgcatttttcctctgtttgctgctttcagcacctctgtatgtaactgtttccacggaagggtcctttaagagagaaggactgggatgggcttgggctagttgtggtaagacgccagtttttgatttgtgctgtgtggctggatattcttagattccagccgtaaggtttctagtcatctttgaggagctatgcatcattaatctccaggctagctgctttttttcctaccctatttatgacagtaactactaactctagatggtacagttactcaagtgatttttaccttgtcatgagattactgtaatagttttattaaaagttgtgttatcctacaggtggtttgtttttcttggttgtatcatttaaaacaacaaaaaatgcatctagttattttgtatgtctgttgcacatttgctctgtgccacagcaacaacctgtacgattggttttctcgtactatgtgtgtctgggactgaactcaggtatttgggctgggcagcaagcatctttaatgccgagccatctgtcttcctggaccttatctaatcttatacgattccttcagctagtctgagttctcatagccaaacaggagtttgcttaaggacattaagataaatattggagaatcatcaagaataaagatcctgcctggcgtggtggcataacctgtaatctccgtggtctggaggcaggctggttttgagtttgaggccagcctgggatgcatagtgagaccc

SEQ ID NO: 26996 - DNA, 2098 bp, Mus musculus
tgcgtgcccctccccatacagaaccttgtacttcagttatctttaacataacttagtagactttccatctgtcctaaggcatgactgtcagcttcagcaaccttgctaggtgcaggctgggtaccctgtggcctgagaactgagcccagagtttgacctgaacattgagcctggaccaggcagaagctggtcagaatgtactgtctccattttgggccaagccgggaccaaacttactaactcaggcaagccagggtgaaacttaaaccctcttttatctttaacctgaatccaggctggagttgaagctcaatgataaagggcttgcctgtcggtcaagagaccctcggatggatcccaggactgtaaaatataaataaataaaaatatgccccctctctccaacctcttggaggcagctggcagcccagctcaaggaggcaagaggttccccctggctgcttgctttaattggccggtgatctctgcctggtgaattggttttatagtctctgagtccagcccctggacaacccctcccctttgcctctccagaactccaggagcttggctgtctctagtgaagagtggagattcagattctgagggagggagggagggtctgacctgtgtggtgacctgtaaccagctgaaggcaacaggcttttgtggtgtgctgaggatggggggtgggagaagagctggaaaactctgtagaaatgccctagaggaacagaagccctgtattcaggggccaaactgctctactaattcacaatccccaggaggcatttctaaaagccagtgaacagatctggagaggaacatcccccagtcccgtcactgactcccccagggagactggggtggtacgcaggagagtggggggagggtgggcactttgcctggccctgtctctctgtttcaaagtttggctgtgctgttcagttgtccccagtggccttgtcttgctcaatcagaggtggaaaaagatcacctcccggtgacctccttcaggccccaggggatgggctgtgtccagagctatgtggcagagcttgtttccagagcccagagaggccccgctggcctgccttgctgccccagtggcgaaacgcaagcccaacactgagcatggcagggagtgggtgttggggacagtctagccaaggcccctgtctgtcccaagctttccaggaactaagcagtgaggtcactgtgacagtcctgcctggtcagcgaggagaatattctgagctttcccgctctgggacttactggggagggggcgggtaccagtgtatggagtaacaagacatcagccttcgtggctctgcaggatttgggggaatcagtacagtggccactgtggctgctatgaagataaggccttttggagacaggctatcctggcctgataccctggttggacctagagggatacagggtggagccacagtcatttcaagttccctggggttcctgtgggctgcagacctaggggacagagcctcaaggaagacagcagaacaaagctgagctcttccatatatgccagctttggccaaggtgctatgaggtctgtgaccccaggcttgcactgcccctttctctacagttgtctgatgtccaccccatctctgggttcacagaaactgacacggggagacccagcgagatgtagcatttccttcatccccagtctggttggcccggggtctgggcatcctgccttaaggaaaggaatggggaccattattttttaacctgtatataatatttgacctttttttggttctttatatgtatacatgtgtaaatatcctctcatccatcaagtggtacagtttttaataaaaccatttaaagcagatctgttctttattttttctaaggtgtgttaaaagtacaagagggagcatcaaacagccttaacgtgtttctcccatgatagccagagttaccgacaggggtgttgcactcttgtcatggtctttcacttcttggagttgagaagaacagtctggctgcatagtagtagagccaccgaagcccagtgcctcgggacagaggggctttggaggggtcagcctgggtt

SEQ ID NO: 26997 - DNA, 1477 bp, Mus musculus
gatcatggctttaacccaccaggaccctgtctgggagcctcctggctaagatcaactgtgccttggctagcccgattcacgtctgggttcccacttggcacagccagcgcccaccgcatgggctcagggattcttactcagacgctgtcaacttccggaagacctcagggagggtcggacttctccaagaacccctcaaaggtgccacaaaatgaatcaaacttgagaggcttcaagtctgactcggtcctacatggaagccccttgattggtccccaagggtgcaaactactgccacctttgctggagccaagtagccagtcaccatgccgttgtacccagcggcctgtgcctttgtcagctctgttttcagaagaccctgccaatgactggactggatctgtctgcatccatctcagcagaagcacttggagatggggtgggcttgctgggggcgtgggaacccagcagccatcccactgataagttggtcccgggggaatcctagacctcttggtttccttggaaacgtgtacctcctcccccttacccccattccttttctgtacctagcgggatacaggaagaagctaggactgaggctttgtcagctgaaaagtgactttggaagtaacagacaatgtttagaccatggaaactgcagagctgacacatcttgaatctccctttagctttcagctaggccagaaaggagagttctagaacccagcaggaccttagctgcctgggagctccttccttctctccccgctgcagtgctcagggagggaacgaaaagcagctgatcttagaaattaagtcctaagtgttatgtatgtaaggaaagacattggtgctataatgaagatgagccaaggctcaaagaaagatggcttccctagacaaagaagaacacaggattattcaaggactttggaggagaaactcagagtagactcaaattgaacaagcccagtgactccccattctgcagaagtggggggggggggcggatttcagtaccataaaagggcaccggatctcctgggtgtccagttgggcaggtttctccctgccaaggctaccgacagagggggctcatagaggctgaggtccagcctgtgccctgctctctaggctgcacatcctgatgtgggcagggtctgcccagagtaaggaatgtctttcctaatttgcacaaaggtactgtgtgcactctcagtggtcctgaggaggaccttaaggcatgtgtataagcctttgtgtttttctgctcagatgacctggagatattacctcttcttggccacaatcatttttctcagggtctataccatagttcgtctgctaagaaagtgggtttctgtttgcaaggagaggggacccaagtaatgaatatgaagactggttctgagggtgggcttgattatttgtgaagcccagccttcctacatcccaccctccctgcagtttagat

SEQ ID NO: 26998 - DNA, 1162 bp, Mus musculus
acacttcctctaacaaaggtcacaccttctaatccttctcaagtagtgccactctctggtgattaagcattcagatatatgagcctataggggtgattgtcttccttccttccttcctttcttttttccccctcaggtgcactactttttttttttccaaatactatgatgattatactttctggtatttttccatactatttcttttttttttctttttcttttcttttttagttcactttacatcccgatgacagccgcctccctcctttcttcacagtcccacccttatgaatccctcccccattacctcctccccttctcctcagaaaagaggagtcacccttgggtaccactccatcttggatgatctactcccaacaggactaagtacttcatctcctactgaggccctatcaggctgtccaggtcaggggaaggatatccaatggccaggaacagaggccaagatagcccccactccatttgttaggggacccacaggaagaccaagctgcacatttgctatggatgtgtagggggtctaggtccagctcctgcatgctccctagttggtggcccaggctctggaattcccccatggtcctatgttagttgtctctgtgggtcttcttgtagtgtccttgagctctgacttgctcacttctatcccccactcctccacaagactccctgggctctgcctgatgtttggctgtgggtctctgcatctgcctccatctgctgctggataagcctctctcaggagacagttatgctaggttcctgtctgcaagcatagcaggatatcattaatagtgtcctacctggctataggaggtggccgcttcagtctctatatcctcctctggtaggaatctcagctagggtcacccctatagactccctgtatcctctcctgtctcaggcctagtcaccagaaatgccccgctgccaacttctattctcactcccagccctctcctccacccctaccaagttccttctctccatacactttaatgactatttagtttctccctctgagtgagatttgcacatcctcccttgggatctccttatcacccagtgtgtagattgtagcatggttgtgctgcacttcatggataacattcacttgtaagtgagtacatgctacaca

SEQ ID NO: 26999 - DNA, 1115 bp, Mus musculus
tggtcttactggttggagggctcctcggtccctcctattccactgctctgctgcccacagaatggacaccagctgaggaaggccaggctcatgcctgccatcctgctctatctcctgcccctgcccagggggaatggaaaagatgcattaaagaacaccatgatgtttgaactactgctcactgcctgggtccatccgtagacaggcagtgctggagagtcaggcaaattgcttgtacccgtggtcttatcaggggtaggattcttctggctgcaaagaacacttctctccaatgtcatatgccaaagaaccccaacctagctatgtgtctcagagtgttagagggtatttgttagaggatatttctacttgttatggaatacagaaagcacactgggctttgacagaatgtattgcaaagtggaagataattccatacaataccaaaatgtactatacaaaatgtcaacatcagggtcaaaaagaaggcttagtgattaagagcactggtctcttccagaggactcgggtttgattcccatcacccatatggcggcttacaactgtctaattccaattccagggcatctgacaccatcacacacatacatgcaagcaaaacaccaatggacataaaaattataagaataaaataattttaaaaaaagagctaaccattaaaaaatgtcagcatccccctgccacatccacacactaagaaacactatatgggggatgtaaggcaatgggctatgtacagacggccttgtctccagtcaagctgaggtcgtgaaccctggtgaaacccagtggtagtaattttcacctacataggactacggaaggtatcccctcatgtctctggacccctggctcctattgaagttaccgccccatagcccccacaggagaggctcgcagacaatgtcccaagcttctgaccttcaggctagactcctcccagttacctagcaacagcaagataacaagcccactataagaggggctacttggccccacctccctctctcctcttactctctctctgtcttactctcttagcttttacctctcactaagccttcacctttcttactctctaactctctctcttt

SEQ ID NO: 27000 - DNA, 1170 bp, Mus musculus
taaaggcgtgtgctaccatcacccggcttgttttgtttagttatgttttgttttataaatacattttttttttaaaaaagagctaatcatgtacgtatttagaaacaggagtggatgctgctactggtgtctcattgtcagtgggaacccatgtcagacataaagctgctagttttctgttttttgtttttttctaaatttaagttaacttcgctaaacttaagatgcttttaaaaattatttttcctagctttaactttatttgtacaatactgtcaccaacacccttgccatgttctctcttgtgttgagcatttacttgtagagcgtgggataggctctgaagctgaagagaatgatgatgctcctggcgaaccagctgcgtccaaccccaaagagccagaaatcccctctctgaagatgtcatcacagtactgtgctgtaacactgttggcgtgggcttcatttctgtttccttcttcccagtgaagccatgtgcctggagggagcagagtgggagctgagtaaagaaaacatacagcccttacggcacgggcgggtcatgtccacacttcagggagctttggcaaagcaagagtcagccggccacactgctctgcagcagcagaaacggtatgtagtggaatgctttgtgttcagcttgtaagtccctggtgtgataggcagcatgggggtgaagctgccgaaggcctacaggcagtggctctcaaccttcctaacgctgtgaccctttaatacagttcctcatgttgtggtgacaacccttcccccccaaccatagcatactttgctgcttcataactgtaattttgctactgttacgtatctgttgtataagagatctgatatgcaaccctgtgtgaaggtcctttgactcccaaagcagttgcagcccacaggctgagaaccactgccctaaggaatactcttcagtgagagtatggaaatctgttcttccggttttctgattgcaagctttcaatagcatgagatagtatttatttcaggctaaaatgtaaagtgtaaccatactcattgaattagatctttgagaaccgtgcttttatggttttgttgtagatggtagcattctgtttttgtttttgtgagactggctctttctggcttagaactcactgtgaagttcca

SEQ ID NO: 27001 - DNA, 1113 bp, Mus musculus
agagaagactgaagtgttaggacaaagggaaaagtaaagaaaacgtataaaaatgttactagttgaatcactgagaacttattactatttcttactaagatttatttatttttagtgattagtatgtttgtgggtctgtgtatagatatgtgcatgtgagtgcaggtgcccctggaggccagaggagggcttctgggatttcaagagttgtgagccactccatgtgggtgctgggagctcagctcaggccttctgcaagaacagtatgtgctctgagctacctctctgccttaaggtttaaaaaaaaacaaaaaaacttttaaatctcattgcgaggaggtatccctcttaattcagagcagagagtgtgtatcttatatggcatctatgttaataattaaagcttttacatgacattgtcatcacctttctctcctagctccaggtcagagcagagggttcctaaatgcagttccccagccagtacacggtaatcgcaggatcaccgtttttgatgaaaatgccgataccgcgtctagaacggagttatctaagcctgtagcccagccatggatggcaccccctgtgcccagggccaaagagaacgaacttcagccaggcccatggagcacagacaggccggcgggacgcagggtgaggactcaggggatctgccagtctgatttggagttggttggtctcttggtttgttcttgtttgagttgcttgctttgtgtgtttgatatgggctctcactatttagcttagtctagccttgaacttgctgggcagcccaggctggccttcaactctccatgctcctgcttcagctttccttgtgctagcattatacttgtgcaccaccccgcctggctgtgttctaacactgcttaactcctagactatttagaggttgtctgcatacattttaactttttttctccattcttagcctcatgacaatccagcctctgtgacgtcgattcccagcgtgcttcccagctttacgccgtacgtggaagagagcgcccagcagacagtcatgtgagtgcttccagatcatgtgcagaggagagggcgctaaggatgcctgagagtcccagcgcatctcgg

SEQ ID NO: 27002 - DNA, 1579 bp, Mus musculus
acacatgtaaaagcaaatagatctttattaagaggatatataaagttctgacagaagttggagtatactgtcctgaggatggcttcactcttgtttcttgcagcccaattattgaagagagccgtgaggccacccactcatctggcttctccaggtcttcttcctcagctcccagtacatcctccatcaaaggctttcagcttctggaaaagctggagctgactaatgacggggcaggtagagtgttccagccaacagcaagcttccgagtctgctcagtggccgtttagtccctccgcaggctgaccctgccccagttgtactatttcccaaataaaccagcactaattcaacgtatttcatatgcccaaagcaaatgaatgtggtcaggttagcagtgttgattttgtaatgttggagttccctcccccctcacctgtttttttttgttttgttttgtattgtttttctgagacagggtttctctgtgtagccctggctgtcctggaactcacttatagaccaggctggcctcgaactcagaaatccgcctgcctctgcctcccaagtgctggggttaaagatatgtgccactactgcctggccctcgccccctttctctccgtgtgtgtgtgtgtgtgtgtgtgtgtgtgtgtgtgtgtgtgtgtgtgtgtgtgtgtgtgtgtgtgtatgtgtgtgttgtgagagaggcagagacagacagacagatcatacaaaggctataaagggcatcagatctcctagagctggggttataggcagttgtgagctctgagacataagccaaactcagctcctctggaagatgaagaagtgctcttaactatctgtccagccctttactactgtgttttaaacattaatttatatatattttcaacttcttttctccacagaagatgctattcagtcaccctggtgttcacagtatcgcctacaactgttaaaatccctactagaattaagtgcttttgcggagttttctgtggaagaccgaccgatgcctgtgctggaaatagggaaggagattgagttaggtaagtagtgtgtgtgagtccttgtccttttgcacatacacataagtgatttgaatgccacaggcccttgaacactaagtgctcctaggttgtagtagatagcattagagaggttaacacattgataattcatgccacaggaacaatactacttcttcttttttttttttgcctcttttagtatttttcttagatttatgtattttacttactgttttgcctgcatgtatgtaatgcctgttgcatccctttactgcgtttacagatggttgtgaggcggcatgtgggtgctgggaattaaccctgagtcctctacaagactgctaagtcctcttaactgccatctgcctggggctcctttggatttttatataaataactttgaagagtattttagatgccacttaatggcaaaaacactagcacttctcacacttaagccaggaggtaaagtgtaaggacctacatatattcacagtgactttaaaatggaaccaaaccttctcaacaggtcctgagga

SEQ ID NO: 27003 - DNA, 1104 bp, Mus musculus
tcagtcctgtcaccttcatacccctgccacgacacacgcacacagtaaatgtcctgtcaccttcatacccctgccacgacacacacacacagtaaatgtcctgtcaccttcatacccctgccacaacatatgcacacacacacacacacacacacacacgcacacacacacacacaaagtaaatgtctttatttttcctttctgccttttcctcctgggacccagaggtctcacctgtaccacccacccagcaacaattagctcccagccttctctactgacaaatcaagaaccaattagagaactagaccatagtatcagcacctccccttacagtactgtagagagagttctaggccatccagggctacattgtgagatcttgtctccaacagtgcttccaatctgccagcctaatcaatccgcatgttctaattgcccttccattttaaatattctgtcttacaggcatcatctcagcctatcccgtgggatttttatatcaacctcaagttgaaggagcgtctgaatgaggactatgaccagctttgcagctgctgtcagtaccaagatggccatgttgtttggtaccagtatataaactgctccacccttcaggtttgtgatactactgcacacactccatctatgctaggcatttcatccagcgctgcagagatggcttgacactggctgccaggtccaatggcctgagcgggatccccagaaccccaatgggaatattgtgacaagaattaaacctgataaattgttctcttctttccacttccacatcatggcatgtacacacacacacataaaaataaatgtagttaaaattttaagatacttaatacaaaattcctttcaagcatctagaaatagaccagccaggtggtggtggcgcacacctttaatgccaacactggggaggcagaggcaggaggatctctgagttcaaagccagtctccagagcaagttccaggacagtcagagctacacaaagagaaaccttgtctcaggaaaaaaaaacaagtagtctagttttaatgtttatttatttaacactgtgtgtgtgtgtgtgtgcgcgcgtgtgtgtgtgt

SEQ ID NO: 27004 - DNA, 1193 bp, Mus musculus
tgtgaggacaccaggatgggtgtgcagtgtctcacatgactgtgtcgtgtgcaaacatatctgctgactggatacatggtgtatacctgaagcggttatgtgggccacagtagatcacagctggagtctgcaaatgcactaggtgtcctgatgcctggtaatccaggtaatccacaaagacagtctgttgttgttggctcttaaaaataacccattaaattggacagtggtggtgcacgcctttaatcccagcactcgggaggcagaggcaggcggatttctgggttcattgccagcctggtctacagagtgagttccaggacacccagggctacacagagaaatcttgtctcaaaaaggccaagtcataatagtaatccttaaatgatctggtcacttcttctccctgtcctgtacagataaggacatctactaaggtctagagctgtcagtgctttcagccctgtgtaaatcagttgctaatggaagcagaggccactttacactttagctcatgaagcgttttgtgatttcaggtagatctgttgggtatagcagacctagcgcacttactcctgttcaaggagcacctccatgtcttctgggatggactcctctggaaacttagccagagcacctctgagtgagtactgggtcctccagggttcctccatatcccaatagtttgccctctctcttcagcggactctgctgtggtaggcaacctgagttttttaaaccaagtgctgtctctgcgttcacttcagtgtctgcagagcacctaggacagggaaaggaatggccagctgaaaataagacatagacctgctcagactttagggcatttcttagcttagaaatagaaacactttagaggaataagttttctaaccaattggtgttagtctttttaacagctgtgtttatcaaaagtcggttgtcttttgaagagttaagtttccacatggtatactgagtttagattattatctattaaatgataaggtagaaccaaaccaccgagcagtctcctggtgcagaaataagtgatctctcaggtctgcttgggaatttgtcagacaccttacatagcgccaatggcttcccagcataggctcaccaagtagtgacgcactgcatgccagttctaaagttggttttcattttagatcagtgttgaagactgaatgtcc

SEQ ID NO: 27005 - DNA, 1578 bp, Mus musculus
gattggcaagtgttttctctcattccttttccggctcctcaactatcttaccggttccagatcttgtcttatttcatttcttgcccttctagatcttgtcttactcgtgtttgcatttcctagtttttgagcctaacacagcagcttgccgttagaaccaaatcagttgcaaaaccagagctttgatgtggttctgagttgctttatagggtgagaaagagcagaaggtagaattcaagttcaggagtgtgcctggctagccagtgaagagaccagctcttggaagattgaactggcagctcatctttctcattccttataagcttccacttaaatgcagccaacgattttctagaggtggtctcacacacgcgcacacacactctcggggcagcaggaattattcttcagtttggattccatttccccctgccacttgctgttaggcagttgagtgtgggtagtgacagcgatcaaaccccttagtgtttcctttttgggaaataagcaatttaaaagagaaacaaaataggaaacttgtataccttagtcctgaaactgtctatccacttttctggcctaccttgtagtcagctctgattcaggtttacaggacaatagtcttgatttaagccatgtcctgacctgggcaagaaaatagcaactaagctggcagcctcccagcaggctgctaacacccaaggtgtctgggcttggagagttcttcacagctgatgaggacttaagtcattaggaggcccatggggactttttaaatttttgatgagagactggggggaagaaacataaaatgccactttgtatcttcaatgatagcctgtcatttatatttatggtgtgaatttttagtcctatattttaataatttgtaaattgatctcttattccaagaaccctctggactcgtgggagagtgtctgggagtccactcctcttcccctcctgaccctgctttatggactgtttaaatccactttggatcaaagagttcagcaagaccactcgtggtccagctggcctcctgactctataagccttcactggaatcgggacattttctccagccctagctgtgaacatgaccagagacattatttataattcagccattcaagatatacctgtactttaaaagtcctgtatattttttaaaagttttatttttcaggtgaacagaaatacattctaagaactctgcctaagcctgtgtaagttggtcatttctcttactgacttggggaagtaggagcagaggtggtctcaggtgcaaggacgctgtgatgaataggttcaggaagaaaaggcaatcgccttgctgttctcagtgcctgccactgaagagattagagaggggtggcaggatccgtcttagtcagggaggcccctggtcggaaaatgatgtcagcttttgccaataaaagttctactctacagaccctcaagcggataccttaaggactagtaagtgcgaatattgagttttagtcacaaacatttagctgtctgaggtgaagacacagctgtctgctggcatcaccctctcaccttaaactgttg

SEQ ID NO: 27006 - DNA, 2173 bp, Mus musculus
tagggaaattccccgagccagcacagataaattttaaggtgggaaataagatgctgtctggtactggggtcgcccccctctatgtagcacgggtataacggtctggtccgggtgctgtctttgttgtaagagttgtgttatgggtttccctctgggatgatttccctttcaggccttgaaggtgaagttgaagctgaaagaagaggagagtgtccagttcctggaacagcagaccttatgtaaggacgaagccagtgacttcacaataatcctagaggaaatggagcagctcttagaaatgtagctcaaggcaggtggccggacggcttcttcctggataaaccctcggcagaggctacttaggatatcttcaaggactcaccatcccttaggtaaagaccttctgcagcagttgatccgataaggccagttgatgctggggttcctcctttaagcagattgccccaccttcagatggctcagctctcctgcaagagaggaacctgggagtttgactccatttcctgtgcagcagagagagcagcagcccttagaactaggatactaaaccagctgccttggagactctagagactcggaaacatgggaagaaggcccacaccacaacagcacgagtgctgtgcgagagatgtgactgtgagccatgctgtccccttgtctctctggttgagttaagttttatgaacttgaaattcttgaagtttttttggcttaataaatgggggtggaggtatacaaagtagcacctacctaaaactacaactagagctttggaaataaatgtttctatgaatattaatattctgactaacactagggaatgaaagtagcctctttaacccagtgtggtggctcatatctataacaatcataggacttgggaggctgaggcaggagaattgtcttgagttagaggatagcctaggctgcagaaatactgtctcagaaaagcaaggaagatgttggggattaggaaattgccacacaaaccatatgtacaccaatctcagttaagcaagaatagtttagtgaacgcacatcataatatggaagtccgggtccacgagaaggaaaagctcaactgtggcaccagtctgctctcggagtaggctttctataggaaaaaccaggtttaaaggtcaaggagaggagcagctggcttactaggtaaagtattgttagccaacctttaagccaattggtcctgagtgaggtaagaaagatggtggtcaggcggtgaacaagggaatttcagaacactgagataactaggaacaagtgatttaatcacgttgtttttgcttgttagtagcatttttcagtgtcagttacactaatcactatgaccttaatttcaccttgtgactaacattgagcctgaatacaaatggctacagttgtgttaaaaggaacaggcctcaacatgaggaggaggaggaggtaggattaagcggtgtttggtctggatctgtgagttgagcatactggcataagtccaaggtactgtgactgcctttccctccatccgctccgtgcctgtgacaaggcctcctgccttccaggattgtcagttcttccacattcgtagctgtgtgtgccatgctctattcaccgtgttggtggccagatgcctgtgttctgtctgtatgtctgcagcttgtctgtcagagccaacctagagcctggtgcaacaggccctccccattgggatcaccaaaatgcagccatgttctcccccttagctgaaacacagcagcctttgctttggccattcccattgcttttgagctttctgttttctttaccaaacttgcctaatgtctccttcaaaatcactaagactgaccagagtcccgatccccaacgaagctgagtaatgtcccatacttaactttttctttctttctttactttttcaaatgtataaaatggtttataaggtttataaggtacaactaaagaccatcgcacagcaggtgaagcatacctactttatataggttcaccatacacagaatgggactccaggaagagtcctatagaacactgcattctggcttcctgtgtgatccacatctgctcctttgacgtgtgattcttcgaagatgaagtcctagcagaagtcatatgagggagttcacagtctcatgga

SEQ ID NO: 27007 - DNA, 1127 bp, Mus musculus
tggggaggctacagggcctcccaactggcaagagcagcccaatgagcgttggccgtctgctcctcctcatgggccacccacccagccatctcaccaggccccaggcaaggctctggagaacccgttgcgccccaacctgcctctgctgatgggtgggcaggcagccctgaagccagagcctgggcgtccaggagaggagtcacctgcccccaagcaggaactgcatcagccctccttccctgcgcctcagctgtctccgctgccgatgcctggcaacccagccgactacagtggtccatgtggtgggcctgagctcacagcgctgggcagcttctacctgtactgtggccaagatgggctgcaatgtggggcttactccccttgccccatgctcccagaaggcaagctgtctccggtggcagcccccaatgaggggctgctcatggcccccagctcagtgccctctggcgtccctttccagcaccctccttggagcgcacctcgctactgctccagtgaggacactggagcgaatggctacagcatctgtggagtgttgcctctgtctctcacacacattggcactacctgtggtggctgcccctacaaaatgccttttaccgcaggtaagccttgtggggacacatggtatgctgggggggggggttaagacatggtattccaggaggctctggacaggggctctgttggttctgtgtactacctgggaggcaggaaccttggaggagggaacctcttctcatttaggcaatgttttcagcctaggaactgtcccaggagtgtcccacggttagctcttagggcctgttttgcctagactgtcagtgagatttctcagcttggaagttaataacattgccacggaacaggacaagaaggttttcctcccatattggaattccccttagactcctaggcacaggagttagggccttctgtaagccctgtggtacaagtctataagctcagctacgtagaaggctgagtcacacttcaaggccagctagggttacagaaagagaccccgtctctaacaaaaatagaaaaggcttggggcttagccatgataggaatgtcagcttagtgtgtatgcatggggttcaacc

SEQ ID NO: 27008 - DNA, 1099 bp, Mus musculus
ccccaagctacccaacacttattcttttctgtttgttctactgatcatctctctcctagtgcatgtgatataatttctcacagtggaatatactctttttgttgtgttgtttattatttattctggacataaaatcttaacaaaagaattaacagcccaattacaaaatatccaaaaatgattctggttctctctctctctctctctctctctctctctctctctctctttctctctctctcacacacacacacacatacacacacacacacacacacacacacacacacggtctggttaagagcactcattgctctttgagtggctcacaaccacctgacaccccagcattaggggacccttcccctcttctggcctctgccagggctacatagtgagactcatgtctcaaaataacaaagacggaagcagtgcagttaacaaaactaacatgttttagaatggcagatttcctggagtcaggactgttaccaccagagcactgactctgttatgatgccttgccttccacaggtaagcactgtgcgtgatcacggctgtctttccactccaaatgagctcttctctcatgtgaagcgcattcttattttcaaaaccacattttatcagccattagccacatcaaaataattggaaaatgtctgtctattgctaaagctgcctctgtgtgtatgtggggcggggggggggggtggagtgggagaggggagtgtactgagaccctgtgtcaaacaaagaaaataacacacacagacatttttgtaagccttgaatctggggtaactcctctcctcctccatctttcctgctctctctctctgtttttcttgagagggtcttgttatgtagccaggatagcctcagaatcactaagtatcccagctggcctcacactcagtttctactttcttaagctttccaattgcttgagttatagacagccatgtacaagcttgccttgaagtttttgtttttgtttttaaatcccaaatggtagaattaaacacatgcactgccactcaggattttgaagatttcttgtgtataataaaacatagactataagcaaacaaacata

SEQ ID NO: 27009 - DNA, 1211 bp, Mus musculus
agggctgagattacagatgtgccaccacacccagatccttttttattaaagtctaatggcaggtctaataatgaccatagtttttgtttgtttgtttttctgggttttttgttttgttttggtttggtttggttttttcgagacagggtttctctgtatagccctggctgtcctggaactcactacatagctcaggctggcctggaactcagaaatccgcctgcctctgcctaaaggtgtgcaccaccacgcccggcatgaccatagttttaaagtagtgaatactgtaataggctgctttctgttactacaatagaatacgcgaaactgaatgatttatatagaatataaatttcgctggccatggcatggtggcacactcctgtactttctggactgaagaggctgaagcaggatgtatgattagcctaagctaaagagtgagtctcaggctgctcataaacagaggcatctgtgggaggcacttgctctcagttctgggggctggaaaatctgagagatggatgctctgtctgctgctctagatcaaatttctttttgctttgttttgattctccagtcggggcttccctgtgatgcctctggctctgtagaccaggctagccttggagctcagcaatctgcctactgctgcctcctgagtgccaagattaaaggcttgtgtcactacccagtttggatcaaatttctgacacacaaaatttgacagacactctcaaaccataggaattctaaagcagtcagagtaatataaaatacacgatttcaatcagaggcaaagtcacaggcaatatcactgaagctcattgccttatttaaaagtgtttttgatgagagattatgaaaatgattgtcgctgcccactcttcacccacaaaaaattggctactaaattgtctgcaaggcccctgaagggatgtatgtcccaccaggacagaaaacggacagtaagacatggctgaagagaactggccaaaagtgcccagactgtgaaggtagcaacattcccaagggatttggacctaaaatggaggaaccaggagagaggcgtctgactgccttccaatcatcagtgccacaaatcttgctgaagcacctgcccctggtgctgggctcttgaacactgagcatgcccagtgagaggaatgtaaaatcaccactccaggggatcattaagaactcttcatgat

SEQ ID NO: 27010 - DNA, 1145 bp, Mus musculus
cgaacccatgcgtgcagagcacaatggattagcagtccatcgccttaaccactcggccacctcgtcccagaagctagtttcttcctggtagctatagggagtagacacagagcgctgtgacgcaataccatggaagtcgccattttgtacggaagccaacagtgcgattgtttactctgcaaacactcgaaagaagatggccgttctcagaataacagagacgaagaaaattctgtagaaaagaagaaaaacccgagggaacttaagtcagagcagaggaggacagagaagtttatgtcttaggggcggggccggtctggagccgaaggggtggggtctgcgcggcgcgcagcactgagcatgcgcatcactagggcggttagatttgaatacttcagggacgttgagaggtgacgtccgactccaaggagcgcgaggaccccagacaagtcaagcaggtggtcggtggcgggtcagaatgctcctttccgttctgggctcctgagagggctcgggttctgtttgagtgctgaagggcgggcgcgggttgctgaggtcgctcggtcgtcggggcgatctcggaaaggccctgcagccgaccggaccgcgcgagcgccaacggcccgctctccttctcctggagcgccgcgtttcgcttctcctttcccaaagccgctccattcccggggtcgtgtcgtctgcgcggtgcgccgtgggcctccgggttcgccccgcccatcatctttggtcagggctccgggatccggtcccaccgtctctcgccaactccttgtggtatgtgtttctgaccgacgttccctgcttccgtggtctgaaggcgacgagtgaactttaaattgtaggctccgtccgagcacaataatagagtttcgggtttctgcaggtccaacattagtaaagacaaatcggtgtgttagattacataaatttcctttcccatccaaaagactttggattccctttgggaagaaaaatattgcctactgcaatttttaaaatgtactagacgttgtagtttgatttatgctcatatatttgaatgccgagtcaactgagagtggcactgtttgaaaggattaggaggaggggtggccttgttggaggagatgtgttaatgagggatg

SEQ ID NO: 27011 - DNA, 1103 bp, Mus musculus
ttctcatgttttagagctcacaatgtagtctttgcttcttatttttagtcttctaaagtcatatccatgctcctaatctaccataggttatatttttcatctttttttacttgttaatactatgtgccttttttttttttttaacagaaaaaagttttcaaaaatggatggggtatattcagaagctaatgaagagaagtaagttgattcggtgctgctgaaatgttattttctattacagaaaggccacttcaaattagttaagaactatcagtaatgtctgaagttgttttctattttgttccaagtaaaagaagtcagtattacaaagcaatagcttttctgccatgtctgtataagttcattagagtaagaacttaagacttgaaggactttcatagagaccacctcccatctcattaaggtcttatgagatgaattgatttctccaaaattggtaccataaactagtgatccgtttgcagcctaaaaaacaatgttgtttgagacagtcttactatgaggctcttggctggcttaaaactcataagtagaccaggctagcctcaaactcagagaatcacctgactccaccttcattaaaggcatgtgccaccacatctgttcctaatttttaatatatatgacacttaatttttcagataattaccaaaattgaaaaaatctcaagatttcatacaataattaggttttcagtttttcttgaaacaccatgttggcaacaaatctcatattctcccttggaacaggtaactagtagaatgtaatggcagtgatctttagactaggcaagaactaacactaaactatactctcaacttcttctaggcccacctctttggtactagaaattgaatttcagatttcatacctgctaggtgagcgctctaccactgagcctcaaccctcagtcttcttctatgttttggtttgagacagggtctcactaaattgcaaagactggtcttgaacttacttggtatctgaggcaggcccaaatttgtgacccttctgcgtcagcctctaaacagctgattacaggctgtaccaccaggcttgaccacaatgtgcctttaaaacat

SEQ ID NO: 27012 - DNA, 1985 bp, Mus musculus
acaaactaaacctgaaagctgtctgttaaatataacagatggaaaaaatgtggattttacaagcagttatacagctgatgtttgtagatccagtgacaagtattcctctttaccaaatatttcttcttctgataattcgggtggtaatactatgtccttgtgtgataaaaataaggagaaagcttataattgccaagtgccaaatgaatttacttatgcagctatcttaccaagtacatatcacatggattctaaaaaactgtctgtctttccaccttgtccttcaaaagaagtcactcaaactgaaagtgccatagcgctgcttaaagatgaagatccggtagaagagcctctgggggagatggctacatttaactcaaagcatgtatctcttaacctggcaaaggatcaaacagaggcctttgttgatgttagtgttgcttctcagcctcatctctcagcccaacaaagtccatcaactcaaaaagggcaggatgttgcccgtagagatgaaggaatattagctaaagctgggaagaaggctttaccttttcttctagaaaatgtcgctgcatccacatgggaaaatgagtccaaaatacccactaatgtggaacactttgctgtaacctatgaaaaagaactgagtataagtattcaaacagataaatgtaatacaaatgtacagagccctagtaactcggccctgacaacacaagtcattcagacgcatgcaaatgctgaaggagcactagactttttagttccatctactgtttcatgttttagtagtaccaaaccaagtctgagtaatttgaatagaaaaactgaggaggtcttagactttcagactgttaatttattacctcctgccgaacagttacttgaagaaggaagtcaggcacatagtatgagtatagtacaagctacagaaatatatagactaggttccaggaatgatagagatgaagaaagtaaaactttctgtaatgaggctgaaactacatctgtaccactaaaaacagctgttaaagacaaaacaagaagatgttcattggggatatttttacccaaattaccaagcaagagaagttgtagtatcactggtgttgatgacctggaacagattctagcagatgcagctgacttaactcaactagaaactcagccagtctgtagtaaagatccaggcattggatctgttgcagccaaactgaatttgagtccatctcagtttataaatgaggaaaatctccctgtatatcctggtgagatactttcatcagattctgttagcctggacattgaggaaagtgttctgattgacacatctcagagagagagtttaccgtctgaaaacaaaaccgaaaactgcagggcccaaaaaagaacccgggttgaagaaaatgatgttacaaatgagaaaaaaatcagaacacatgacagtgcacaagatcaagaggtaagctgtcttgagccaaaaaatgttcttgaattttaagtatctaagcaatagaaactatttctacttactataggttagtgaaatattcctgtgtagaattattagaggtcagttggtaaaggatttaccatgacacgatggcctatacctgtaatcccagcactctgaaggctaaggaaaggggactgctgtgactttgaggctagccaaggctacgtaacagaatcttatctcaaaacaataatttgttgtggcaaatacccacaaaaatggaattaaaattgtatagataccaaatattataattgtgtcttgtgacttgtatcaggtgcctcataattgcttgtaaccccaggggacccagtatcctctcctgtactcttcagatacctgcatcacacacatatacctccatacaggtataaacacttgtacataattaaaaatgaaaataagtccttagcaaaacaatcacataaatagccaaatatgatagcctaatattccagtactcaggaaa

SEQ ID NO: 27013 - DNA, 1213 bp, Mus musculus
gcacagttagacttgactcaaaaaaaaaaaaaccccacaaacaaacaagcaaacaaaaagcacaagactgtgtagtcatattttcttttccaagattttgttttaggttatttatcctcaaaaggtatctattagtcataaagcttccactggtgatcactctgtgtgtgtgtaatgtttcacaaatttttgtgttatctttgtacaaggcttaacttgttcttattttactctatgtgcctattttagtatatgtgctgccaaagttgttgtatcatgttttgagacaccatctcactgtgtgacacaggccagcctaaaactcaaggggacctgcctgcttcagcctctcacgggctaggatggaaaatgtgtgtcgttcttccaacttggccattcaaattatttaaatagataatttcccaatccggtgctcctattggtactatatgaatgatatcacaaattcttcatttgggcttgtaatttcttggcttgaacccccagcattgggaaggaaggaagaaagggtagacttacttgttcttgtttgtcattctctagtttgtctgagtgggatgtcattgagtggagtgatgatcaagctgtatttacctttgtctatgattcaatagaactcatcatcacctttggagagccactaggtaagtagcaaagctaaaatgacctctacagaaaaataaatgactgtattctctaaagataaaaacctacattttattataataataacttttaacaaaatggcaatactgctgagaatctcagaagaataagggactttaataataatactttggggaagtttgctagagatcaaacccaggaactcctacatgctaagtttatgctctactgctatctcactatgaaagaattgtatgttgtagaacaaagaatatagtagaatggaacatggtggcatggctggacaggatcatctgctacctggtgagaccctgtctcagaagacaacaaacaataagaataaaaagatagttggtttgagttcttttagataatgaaattatctctatccaaataatgtttttttctcgcgtgcgcacacatgtgtgtgtgtgtgtgtgtgtgtgtgtgtgtgtgtgtgtgtgttctgttagagaatttacttgaatcgctgttctctttttttttaagatttatttatttattacatgtaagtacactgtag

SEQ ID NO: 27014 - DNA, 1115 bp, Mus musculus
aacaaagtggtagaatgcttgcctagcatgtacaaaggcctatgtttaatctctagccctataggcaaacaacaacaacaaaacaactatatcagtatactttacaattatatatatatatatttagccttattttagaatacagtttcaagtaaagttctgcttatttccagaaatatatatttgtgcttcctaagaacttgagatagtatccaaggacatgagtagccctgaaggggagagaggtataagtttttcagggaaagtaataaaaaatacccttttgtcttttctagccatgatgaaattgctgcaattatctctaaagtgcccttagaggaaaactacctgaagaatgtagtcaagcaaatttaccaagatctacttaaggactgaaagttttcccgtaagacccacagatcacagctataacaacaaaggaaaaaaaaatccatttacccaggccccatatagaggcaaacgcttataatctcaggattccagtgagagaagatcaaggctagcctgggctgtctaggagacctggttgaaaaacaaaatacttaaatgatatatcggggtcaatattgatatttatcttttgtcttaacatcatataaaagtagcaaaattctgccaggtggtggtggtacacgcctttaatcccagcacttgggaggcagaggcaggcggatttctgagttcgaggccagcctggtctacagagtgagttccagatcagcccaggctatacagagaaaccctgtcttgaaaaacaaaaacaaaacaaacaaaaatgcaaaattcctcctgatgatatcataattaatttgtatcattagttttaaaatacctagttgaaaatgatgaggtctcaaatagcatgttatctgcttgctattatccttatacccaagattaaatgatcaaacatgtgagaaaattttcctaaagtagcttgttgatagaccacttaccttgtgtgtataaagccctattttttaaaaagtctaaagttgtgctcttctcttaatacaagctctaaggggtaacatttataaggaggtagtgcacaaagattaagcctttcctctttttgggttttttttgggggg

SEQ ID NO: 27015 - DNA, 1602 bp, Mus musculus
ctacatgacaagttccataacagcctggatacaaaagttgctgtctcaaaaatcaaataattaagaattaaaagctagatggagctagtgatttaacttatttgttagaatgcacacatgcctacactggctaaaacactcatatacatgaaataaaaatgagtctttttttgtttttgttttgttttttggtttttcgaaacagggtttctctgtatagccttggctgtcctggaacttactttgtagaccaggctggcctcaaactcagaaatccgcctgcctctgcctcctaagtgctgggattaaaggcctatgccaccaccacaccagcttacagaaagtatatgtagaccatgctgtccacaaattcagagacccatctccctctacctcccaaaatgcttcctgcctataatcccagcacttgaaaagtggacacagatgatcaggagtttaaaatcaatatctcctgtaagtattccttggatggaaggatatcctgggagggaagggatgaatccaggagtggttgcctctgctcctgggagaggatagaagggcactagacaaggcggttgggggcagcttatataggatttcatagagggtggggcttttcagggcagaggtttttatttttatttttttggtttttcgagacagggtttctctatgaagccctggctgtcctggaactcactttgtagaccaggctggcctggaactcagaaatctgcctgcctctgccacccgagtgctgggattaaaggcatgcgccaccaacgcccagctcagggcagagattttgatttgacagttggtaagacttcaagtcctgcgtttggggagctcagggactggtgggcttccctgtccttggtttggtgggtttttgtgagaagtacagagattggtaggttttttggctcaaggattggtggcttttttttttccaccctctcttttctgcatcaggttcatgggttaggaatggctttggctgaggtaccacctctgtggagctactggagaggagacattgccaccgcggacagctcctgtggtgctaattcatgaagttcataggctgaggcaggaaaggtgccaccaccatggacagctcctacgactgcacctctagctagtagcaggcagaattgggaaaggatgtgttgccacagtggaaagctactcgtgacagtatcagggtaagacatggctgtttggcaggtactggcattttaacagctcatgttgaggcatcttatgggtaggttggagcaggaagaaggagccagcaactgctttgacagcttgcccagagtctacatctactacacaccaagtcgaaggccagcctgggctacaggagatcctatttcaaaaacagagaccgaggatttcattcaggagagtgttcatctagcatgcacaaaaccctgggtttgatcctaagcatctgtctaaacttaatgtggtgcaccacagtggttatactttttattgtcattcagacgccttgtcaagttcttccaggccatagccaccgccagttctccctattcacaaattgtgatatgagcaaacacagttgtacac

SEQ ID NO: 27016 - DNA, 1269 bp, Mus musculus
ccagcactctgtcaggggcttttcatcctcttctaactccatccagtaactctggtctctgacagacacatacccacatacagatacaaacacctacatgtaactaacatctctccattgtgaaaaaagatacatgaatagttgatatgcctccctaattataaaatgtttatttcgtagagcttttcaataagagagtcatggcagaaatgaattcctccattttggaggtacattgaaaaccatcctaaatcctttgaggaaattacatatgtctgaagcaattagttctattatggaatagaattgtttataacttggtgctcttgtttgtttctctgggtcaggctgtacctgagaaaaggaagaggggagaccagaatctgcaaaatctatgactctccctgtcttcctgaagctgaagctatgtttgccattaatgcagatggagtgggcgatgccaaagactgactccttaggctttctttcctgtgatgctatacggcttttctaaatgctctacagctaatggagaggactgtgtactgggcttcttcacaggctcatgttgtgactgccccgcatggcttccgggaaaacaactattgtatcagctctctggtagcagaaacacatctgatctgaaaggtttcctgtagagtctattaataactgatttctttggtgtttagaggagaagtatgaaatagcaggtgtggggcagtcttttgtcttcaggagaagtaaactggaaagatccgagtactctcacttctcaaggatggtaaactaaatgcctgaggatctgtaagtgggaatgggtggtttacacattcttttctctgtaagacagatgcaaacttagttatatgcctgaactgtcacatcattttaaaatttatttttgattaaggagtcttacatgcagcatgctagactacgatccctgcatgcttgttctctaaattactaagacttcacttaaggaaatttgttctgctgctaataaagtagttgtgtgcagtggatgtgttatttgctggagatattctagtgcaaactgaatattgcaaaacagggtttctataacagctttcggtactgtgttgttcgttatggtcagctgcagttgtaaagtgtgaacctgaaagaaagcccagcattcaggttactgcattgtagcctttggccgaagaataagaaccccaggctggtttactgtatctttcctgtggtctttgtttttattgtataagttttgtgttgcag

SEQ ID NO: 27017 - DNA, 1440 bp, Mus musculus
ggtgcctttttgtgtggagtctcttacatgctcctctcccagggcaggagacagattgcatagactctaagccatcatggggaaagtgaggaggaaggctgctaccagctcagtaaaacagaaaagggtcccttgtcaacttctagtgatttgggaaaaacttaattctgattctagtatagatttactagatttgttttcttttatcctaggattcagctttccaaaaagacctggaagaactagaagtaattttaggataataatcacacttcaatgacgtgggggctactccttaaatgtggaaaagaaatcaagttgcttttttcctctgtgactcccccatggagttcaggaagccaagcaaggtgtcctggcccctggagatctgactgctaacaccaccatccctcagctttttatgttatcagttaatttattctaatctcctaccttaatttaaattgggggaatttaaattacttgcagctaaggtttctgctttcttcctcttaagtgaattcttgaaaaatcaagacagtatagccatagggtttagtgtggacccagcccagaaggccaagagctgagaatgaagtagcagaactgtcttccagctgccagtgaggtggatggacttcagagccacacaacagagcataggacttgtaatcttttttgctaatattcaacatgtatttattgtcctttaatgtcacaccctacctacgaggacaaaaggagccagcacagcccaggtactgccctcctaccacccatcatgtatataatacgctccctgtattcctgggtgagggctggaccatggactggagacctggcagcttttgggatgacaacgctggcaaagggtctatgaatctattttgaaagtgacttatctggagaggtgcctggagtatttttggtacaaatctgaaataaactaaagttgattacaaggatatgttttgactgtttctgttatttttgacaacgtcagagaaagctgacaacgaaagcagcatatcacagtctgagcccccctgtgtgtgaatgtgtgttgtatatgcctgaaggaggccagactcagtctgaagctgaggtaaggcactccgagccgcctctcatggggactgggactcagacgcgggttatctggaagagcagcaagtgctctaagctgataagctctcgattcaggacaaagtgtttcctaccaaattctagaaaacttgggtttgagacaagaaattctaatctttatctcactactttagaagtaagtcctttgtgcaaatgtcataatttcctcacagaataaaacctttgtttacacaaaggtcccccactgcaaatgatggcctagagcagtgagtgaccccctcttcttgctatgtaggccaagctgccctggaactcagagacccacctgtctcc

SEQ ID NO: 27018 - DNA, 1225 bp, Mus musculus
tgaacagagaactaagacacttagcttcctctccggtgttggctcctagaaaccacctggcttcagcagccatggagacgatgttctagaggggtgtttgcatccacttcatgttccctagactccctctaccgccattgaggtttgattgtaaacttggccgcagctacacatttgagagagaaattggagaaatgcgtgggtgctgctcacgcctcagaggctggagccacgcaggcagctcctggcaatgtgttgtgactgagatgaagactaccaaacccctggctctaaaacagttccttccctagttttctgcagttggagtagtagctaaacagggattttatacttgaccctgaccggcacagcaccctagctgcctgtaaacttcttctccaatcatttccctagcttatagtccaagttttctcttgaagactagtttctgcccttacataagaaatgatctggctcagtggacagtgctgaatagtcctcctcctgtggctggagaacaaaccctagttttgagctaagtaatcctcctttaaccctgtcccttaattctctgccagttatacaacagccaacgcggagtctgattacgagcgggactccgacaaggagagtggagatgctgaggacgaagtgagctgcgagaccgtgaggatggggaggaaggactctctggacctggatgtggaggcggcgtccagtccggcggcggccgccttggaggaggatgactcctcaggccgagaggatgtgcagctggtcctgctgcaggccgatgagctgcaccagggcagcaagcaggacaagcgggaaggcttccagctgctgctcaacaataagctggcggtgagactgcctcctccctcgaatctgacacccacggggaatgaaaacacccacggggtttccaaccctacaaagcaacaagggaaaggcgataggggtgagagggctgcttctgcacatatcttgctaggttgcttatcctttcccagagaggtcctgaagctaccgtactgcttattgtagcttctcacttggttttctgcctcgtgtacaattccagggggccctgcctcgctagcggggtggaggggtgtgggtgggggtgggaggaaagtgcaaaggactagaatacttgtgcctccccccaactccaccacaccctgttccttcagttttccttgagagagttgaatctgcatgc

SEQ ID NO: 27019 - DNA, 1206 bp, Mus musculus
tgctaggatgaaaaataactgaaattttctttgtgtttgtgtctggatggtgtgtctgtgtgtctgtgagtctgtgtgtgtgtgtgtgtgtgtgtgtgtgtgtgtgtgtctgtgtgtgtgaagtggaggtcacaggttgatttcagatgtctttctcaattgttctcggtgttttattttctgaggcaggctctcttgctgggcctggactgtgccgatttggcaacctaaccaggcagctgcccctgggatccctagcttctccaacctgagcaccagcattccagatgggctagcatccctgcctgccttttatactcgggtactggaggtctaatctcaggccctcctgcttgcatagcaagcactgtatccactgagccattcctcagcctctggagctgacttctcagtttgcttttccttcattaaacagtcctgcgccgtaagtggtgacttgtctagtcctgcctctctgacctccccacttccctttcatctcagttagactatgtcttcctagactggcctgtgactttctgtttctgtgacgtggtctttagaggctgctctgcccaggctgagtcctatttcctggctcgcccctgtgcctgcctgtctctccactgacctctgactggttccgtggttgcaggttggagtttccttttcctggtctctccagcttccttcaggactcctgccagaaagtgactcccatacattcccagctggcttttgccccttcactttgggcgacttgaaggattggtcagcagccagagggcagggagaactgtggcttctggtccccacctgttctttagtccacattgtaccttcctcgcctgggtccacaggcgccattcctccagtcaccccagttctcgctactctcaccaggtcagaagtggggctcgcttgggaattgctcctttagaatctgcagaacttcttccagaagtgaaagccccaggtccactttgaaggagaggaaagggtcactgaggtccggagtaggtgtcctcgggaagtggggagtgtccgaaagggcctcctctgagcactggtgaagcggccctgtcagggagattgctgaaggcagggtggccgagtagccagctgtgtagcttgctgggggctccagaatgttggggcagctggagctctctcggtagaggcgtgggggcttgggtggggccagta

SEQ ID NO: 27020 - DNA, 1144 bp, Mus musculus
agagtctggaaggagcagagcagccttgagccaggagtactgtatatagaaggacctgcttatccaagagctggagaaagttggtgttttgtgtcttgttcaaagctgcccatcaccatccgatgacgctaggaccttgagtggtatcagaggccagaagccacacactgccttccacatctgtccctccactctgcaacaggctgaaggatgtgtgtctctgcacacactgaaggatgtgtctttgtagtttgtgctgtaaataattgcttttggggccccagggtcatagctcagtggtagagtgtgtgtggtcaccctgagctctctacaccgaaccacaagctacattaaattacaaaataaagtgttgtgtttgttgagctcctcccacccccaccccccaccctcttagtttccagtgctgatgtgaaacttgccatgtgcaaggcaggtgctgtgccactgagctatctcctcagccctggtttgtggggttgctgggggggggagggggcagacaactcctgtccaactggctcagcctttggccaccctgtccagcaggttttccctgtctctcctgaaactgccctggctcctcaggatagagaaaaatgtcacctttgaccaccagagtggagagccatgggggtgttggccccgctgtgcagggtttctctggttgccaacaccacacctacgcagaggggggggtgaggttcagccgtggttgggggcttgaaccctggcagtcactgccatgtcactgggcataggctatccgtgcccatctgagagcctgtggctgaggctccaagctcctccctagtggccattagctgaggcacaccactccagtcacccctctccagggctcaagccacttagaggtgccaaaagagacttgaagagattgcacagatctgtgtgccaaacactgcgggtccgtacacatttaatactgttggggtgcttctcaaatgctctacacaacacttcatttgcccaacacactgccttgtgctgttaatggcattcacaggccaggaggttgacagcaaagctggagttccccagttctaagatttatggtagaactggatctgaaccctggtagggtggcccaaaggtcccatgttcc

SEQ ID NO: 27021 - DNA, 1203 bp, Mus musculus
agaacttgaaggaggtgttcgactcggccattctcagtgcgattgagcacaaagcccgtctggagaagaaactgaacgcaaaaggtgtgcgcacgctgtctcgctgtcgctggaagaagttcttctgctttgtgtgagcagctatggcaagagataggcgggtggcctgagacttctggaccccgagacatcgggtactggcagggcctggccaacccctggaactcagttctctattgaacacagggcacatgggcctcaaagctgtacaccctggtgagccagggtgagctctgtctgtgcaggggctgccccatttggatttctttggtcaagactcacaggaaaatcccagcactttgattttcatgggatagcgccatcagcgtcagtgctgctgagcagcttgggatgtaattctcagtttcttatcctggggccacaggtcagtttggctgaatgcaggcccctcggggtcatccccctctcctagcacagtgcgaggatcaaggagaacagtggggcatcttgcagggctggcggatggtcagcttgatttggagacgtttgagatggggtatgaagaagagggcagtgagagattgagagggaaaacagaaagtgaggcgagtggtggacaggaggcagattagaggcctgggcctggaaggaggaagacaggaagggagaagggtggacagctgtggagaaggccgacacctgggctgccctcgagccccaaggccagggaggacaggactgctccctgggaagaactgggtctcagggttccccaggcactggccaaactggctgggctagcagaggggcaggaagtgagagttcaggcccagcaaagggaggggaggagctgcaggtaggagcctgaaggaggaaggggcagggaccgtccctttccccaaggtcatagcttagaaggtgagctatacagtctgcaaataaaaccttccatttctcaagctgctgtctgtggtctcctggagtggtcagcccaatgccccttcataacctttgccaaggcctgacagccttggtagatggattggaaaccgaggcttggttgaagggtgggggctggatcagatgggacaatgtgatgggaactggactagggggaacaggtgtggggctccctgcttggggcttggtttacttggttcccaggagagctagcgtgggaag

SEQ ID NO: 27022 - DNA, 1472 bp, Mus musculus
ttaagttcccctctgaacaaaggaaataatattcctgggactcctaaaagcctccacatgaccagcagcctagcctcagactccttgatccggaaacagggcaaaggcaccaacccctctggaggacggtaaccatggtaaccatctctgccctctagcttccttcaaccaaaccaggggctacagtcctgagccataggtggtctttggatggcttgcctagtgtggcatcttgcatcctatttggagagtggaaaggaccagttgtagcaggagagaacaggcaggtggttggtgtgagcacttttatcacctgtttccaaaggaatatcctgggttcggccccacagcatcttagatgtactctgcagccgtactcttaacctctttctggggacgggcctgacacagaacccttttatagatgctcaggcacactgtctccatccccatcctactcttcagctctgaccatgtccctcatgaaagctccatgggtgctgtgaagagccttccatagtggagacttgtctaaaggttatggtttcctgcaggactagggaggaagtggttccctggcatccatagtctgggaccgctcctgggtctctaaaccctgtttgccacagtgtcatcactgaagaacagaacacagtgaatgccagagaagatggtggctgtaaggatgagaggctggagcaagcagagccacaggcagttatcccagcatttcctcctgtccagcacagttcacaccagggaagctttaggtcccaccagcaacagtagcagcagctcccactcaagggacttcccagaagccagtaaagagaccaggaaccacctcaatcagcaggacatcctcaccaccctcttgcagatgcccctttgcccatcctgaatgcacagcctccccggctttgcccttcagcccctgcttggctgtatgcactgtctgtattgcactgagaaagaagggacagcaggagtgagatggggagggagctggctcagcaccacccctcccagccctgccccactcgcctgagcttgctgccctctgagaggggaaaagggcggctgggagggctttccacctgatgtccctggtggaacaggtgcttctgggcgggccagcctctaatttgcacacctgaaatcgcggaattgagtttagatagattgattttttaaacactttttttttttttggagtaggtgtaggggaatcatttaatttaaatcataaagattcccctacccaaaccctgactcctgtgtacagatgctctttagagggaatcagaaaaatgccaagcctttttttctctttgaatgtgctgtctatttttataactgaacttgtacatatgtataaagagagacacatctttcttttactaactggataaaaaaaatcttaaataaaatggagtgagataattttatgtaaatcaaagtgtctgtggtct

SEQ ID NO: 27023 - DNA, 1193 bp, Mus musculus
agatacagaaaggatgattgaagtgagaatgcaggccgtccaagtgcagtaagacaacccacacagagctgcctcccttctatgcaaagtctggcctcaggtagataatagcacacgctcagaatcccagcacccaggaggcaggttctagaccagccagagttaccctgctacaaacaaaaatctcaggtgggcttagcatagctcataagttttgggaggggagcttgtttgttaattctttttcatttttttctcatgtgcattggtgttttccctgcatgtatgtctgtgttagagtggaggagtgtctggaactggagttacagatagccatgagctgccatgtggatgctgggaattgaaccccgggtctcctggaaaagcaaccagcagccatcgagtcatctctccaatccttgtttgttaagtttttgggtagaatttaatgtatctgaagctggccttgttctcatgatgcagacagtggtaaccttttacttctgatggctagtagaattgttaaagcagggaaaggcatacttgtatagaaagtgcttggcctattgtgagtgcttagtaaaagttgattcccttctcctttctcccattgcaggatctctgctttcattattgtttcattaaggaaataagtagagtagccttccctgctgtttgttagccctttgctagctcatttgtgtccttggaaaacagtaatcactgcagtaatcaaagctgctgtgctggggctcatcggagaatgaggcagtgtgacacagcagagaagcaggaagggtacagcaggcaaggaggtagactggcctaagaaaaccaacaggtactgagagctaggaatgaaaagtgacaaggattggtccagaagtaacctgtaatcaatggtatgtgagcagagatgtctgtccaacccaacaagtaacacaggagaaacatataagccatggtggtgtacatcccaggacgtggaaggggcaggcaggagaatcaaggatttcaggttatcctctgctacatagtaagtttggaaaaaacagcttggactcctgaaaaaaacagaaaagcaaacagacagaacaaacatactagacagggctggcgaaatggctcagcagttaagcacactgactattcttctagaggtcttgagttcaattcccagcaaccacatagtg

SEQ ID NO: 27024 - DNA, 1174 bp, Mus musculus
atgcacacatacagtcagtcagtcagtcaatgagcgagccagactagaaatgggctgtcaggaaagggtatgccttcctcctcctctgcgagttttcacttccttcaagattcagggcttgagaagtggctcagtggtggagcactttccctgagtgtgagaggcctttagttcagtcctcagtacacacataacctatacacacgaaaaattaattgagcctgcatagtcatgctgtcaggaagatggagaaaatttgaggtcagcctaagctatagagcaagaccctgtctcaagtcagtgtagggtgtgtgctcatggcttagacaggacaatgaggccacaacaggaactgtaacaagtgccaggctagtcagagccatataccaagactctgcctataattgttttatttgttaatctcgcttttctctttggggcaaatactcatgtttttatgtattttctgacctttgtattcccagaagaaaaaggaagatgagttggatgggaagaggaggaaagagggtgtgaacctcgtgatcccgtttgttccctctgctgacaactccaacctctccgctgatggggatgattccttcatcagtgtcgactcagccatgcccagccctttcagtgaggtgagcctcttcctgcgttctacatcacagcagtgggactgcactctgaccttgtggcagggacatggtgggcagtgttcacttccagccttgtaggaagggttgtataaggacaggctgactctcagagccaaaggcagatgggagggagaaatgctacatgtcccccagagcatgttctcacttgagtgtgagggctgtagccattgaagttattagtaagctcagcccttctgcttccagatctcaatcagcagtgaactgcacactggctctattccccctgatgagagcagcagtgacatgttagtcatcgtggatgacccagcctcctcagcacctcagtcgagagccaccaactctcctgcttccataacaggctctgtgtcagacactgtgaatggtaagtgatgctactctttcatacagcgtcagcctgctccactgctcagtgggaagcattcctctgggggtaagtgagctctgcttccttttaggatacaggattttattgttgttgttgttgttgttgt

SEQ ID NO: 27025 - DNA, 1173 bp, Mus musculus
ccaggcttcgcagtgtctctgtaatctgagcacttggatgatggaagccagaggaccaaaaactcagggtcatcctcagctacatactaagttctagagtagccaaagatagaaggaagtatctcaaaagaggggagaaaggctattgggctgaaatcgtagctcagaggtagagtgcttgccaaatgtgttcacattcctaggtttggtgctctggagtaccgcaagaaaggcaaaacaaacaatatacatgtaatgttgtatagctgaaggtctgtttctataatgacatatttttctgtaatatctgttccatgtttctacttttattggttatcagtcagatattagtatggcagcaaaagcttatgtacagattacaaggtgactgccatcatttgagttttaaagaaagaacacctttgcacagtagtacaaacctcaagatagcatccactctctagccctagattgtaattgtagagattcctgtctatttccacattgaatctttccttttcctcctaacatgtcttcctcccctcttctttaggaacgacatctttgtgtttctgttaagcacgcgagctggaggactgggtatcaatctcacagctgcagacacagtaagtgatgaggtctctactataaatagttcattcgttgcacgttttacttttccttttgttttttcattcactttgaatgattttatacattaatttaataaattgcttactatgtgtcaagtattttcctaacagttaagatatagcatgataataagtgaacaggagatggctgctaaccaggcagtccaattggttttgtctgaggagctataactaaacaaataaaaaagagttgttttcttattagtgcctgatttcattacttgagaaggtaatggtagaagttgtggtctaaatgtcaagagctgtttggatagtgatgaataattaaataaaataaagtaaattatattcttgcaattttttgtccattcataccaagtctcctgataagactactttagcctctgaaaggaaaaagaaattttcttttgaatcttagcattattccatggattcagatgtatttagtagcagtcatagtaacatttagattgaaatgtgtagatagcagccgggcgtggtggcgcacgcctttaat

SEQ ID NO: 27026 - DNA, 1201 bp, Mus musculus
agggaaagagactggacctgacatggcctttggaaattctttgggaacctcaaaccccacccccagtgacatcttctctaacaaagccacacctgctaatctttcccaaagagttctactaactgaggagttattcatgagtctcattcaaatagtacaagcacagaattagaagaaacaagtttctagtttatttaacaaaggactagagtgtctaggttactgacaacacggttcttgtcattggcaataactctgcatccttggtgtctactcagtaagaccatacatctaaaaggtgctgtcagctgagaagctgcctccacctctcagggtgtgtcttcagtacccctggagtcaggatttagcagagctttccattccgcctctagagcacgttcctgttccaatgagacaagcatcctgataatagaaattttggctgcatacagctttgcagtgggtgatttgttgcttcaattaaatagtttcctccctccatccctccctttttttctccccaggcaaggagagcctcatcactgacagtggaaagctgtatgcccttgatgtcctgttgactcggctcaagtctcaaggacatagggtccttatctactctcagatgaccagaatgatagacctgctggaggtaggcgaaggaaccttggggacctaggagtctttgacatttaattttgataggaatctggtgtccctactaatatcagctttttgtggttttatatatcgaaggagcagagtgagtgccccccccccaataatgcagaggacttctattttttccctagccgggaagtgtagagtacttttcttttactagaaaaggaattccatagttttaaagcagatcccagccttgggagtctcttgaattctgtatagaagtcaggattggggattcagactttttatataaaaacctaggttgcagctattcaggtggagttaggtgtaatggttctcatcttgactatacattgcagacattgaaatgaggtctgagaattaactaggatatttaaaatttaaagactcctgaggtaatgttaatgtatagccatggttcaccactgcgttagccatcaaagacaacagtgtgatacatgttttgtttagttacttacatgtttagggtctctctattttcatgtctgaaaaatgactatttgtggaagcg

SEQ ID NO: 27027 - DNA, 1157 bp, Mus musculus
acactgtagtcctttctgactgctgtctgtctcaggcttcctttctgacatcactgtcataagtggccatagcacttgtaataagtgggtggtaaatgtatattgagagtagatatccagactagaatcttactttatctacatgcacctttttatatcttttgattgcaggttcatgtgattagcgattaccagtttgcccagagaagctctcaaattgagttagtctttgccttcatcttactatgctagaggatgaaatataaagccaccagtctgaggttattcacattgatctgatttcagagttgtgggcctagggatagagctcagcattcacaagcctgaaacttgctataacccccactgggtaggtgaaaggactactcaggtggcttcttgagaatttggaggccagcctgagctatatgagatcctatctcagaaggaaaaaaagttgatttccctcaaaggcttgatgtgtgtgacaaatggcagaagagccattttattgtctgcgaattttaccctgcaggtcaccgcagtgccgttggattcttactgtaatgacagaagtgcagagtatgagagaggagttctgaaggaaggagggagtctggctgccaagcagtgtttgttgaatggggctcctgagctggctacggattggctgagtcgcagatcccagttcttcccagagccagctggagggctgctgagcattagaccccagaacggctggtctttcatcagaattccaggtgagttttctgctctttggagcatgtttccagctttgacaagaggagaaagggggagaaagcccatgtgatagtttttgttgtttggtatttggagttcctgaggtttctaactctcctaacctgtaacttataggtaaaaatatgagtactttgtgtcttgagtggaaagatgatgattgaaatgtttctagatttgttcgtgagtactctcctttgataagaagagtgtaatgtcacttttttaaatgggagaaggttggggtgctcatgggtagagtgcttatctagtatgcacaaggccctcaccagatgaccccccacacacacacaccccaaaaccccacaaagtttaggaaagacttcaggtcgaatgagtgcagttgttttgtgcca

SEQ ID NO: 27028 - DNA, 1166 bp, Mus musculus
atcgtcggaagagcagtcagtcagtgctcttacctgctgagccatctctccagccctactttgtgtgtgtgtgtgtgtgtgtgtgtgtgtgtgtgtgtgtgtgtgtgtgtgtgtatgtgtgtgtgtttgtttgttagttagttatagatttgcttactattacatcaagcattctggaaaatttagctctgcgtttttgtttgcaaaatgtctttcactgattttattacattattgaatttatttataactttttaaaaaatgttgattggtgttttgcctgcatgtatgtctgtgtgagggtgttatagacaggtgtgaactgtcatgaagctgcgagaaattgaacttgggtctccaaataagcagtcagtgcttactcttaactgctgagccttctctccagtccctgttacagtgtttctaatgtactagatagctcattgggaattattgtctccccgataagatggtttttatgctaagagcttttacagtagagataaatgcttttgaatatttttgtatttgtttactttttgttgtggttttatagaacagcaaaagtatgaaattgctttatctgaatgtttgaaggaattgtttccaaaatgctcaagatctacaaaggatgtatggtaatgagatagatccttgttgtgaactcccaaagttcctaggagcactgagtgtgcacatttctctgtttgtttcaggtggttagctcttttcctatctctgaaagcctcctacaggctccaccagctgcgctcttgggcagagccggatgggacaagccatcagagctatctgagaaacaaggattttcttctcggagttgatttcccactttccttccctaacctttgcagctgccctttgttaaaggtaagccactgtctgtgcagtgtctgcttactttccttctctttgcattattcaaaatgttaaatgatgtcaagtacccagtgttctcaggagctcgtactgtgtattgagttagaacatatcatgtgtaagtttaaatcctctgtatataataacttcattgtcgtgaacaactgcttggcttgctttctctaaatgtttcctttatttttatcgtctatgttagtagttttgcctgcatgtgtctggagttgatttcccactttacacccacatta

SEQ ID NO: 27029 - DNA, 2323 bp, Mus musculus
accccaggttttggaaaaagtggatgtagaacagaagatgagcatccgatttcttcactaaagggcagagaccaaattattcttgctttctagtatttaagaactgaaacttgtgtcctccagccccaccccatcctgtcatccccttttcccagaatactacagctcttgcatgacaacctgaagtctctcctgtccatacaaacttgcctttggtgtataaacagggcgttacagaatggtaccctctgtctgcttctgttcagtatccacccaccaggtccttagttgtcagtaccatcttcccctgttagctgctgagtgccatgcatccatcctgtctggggaaatgaaccagccagcaaagctcccactggatggggactatatccatgctgccttccatccctgcatcgagcctccaccatgtttctgtgaccttgtgtccttttgtccttgtgtctgttacttcctacctctcagtcatccaaccttctctccattcagtttttcagctgccctcctgtcgttgagattccctgcattttacttgattctgggctctgggctctgctgttaagcctgtttctgatgtggcaggatagttagtggtgtggtgagttatagctaccttctaatgtgtctctgggacgttgcctatccaggagcttttcagcaagcagtactgctcttggaagcatgtgactcccttggtcccctgtattgctctgttgtcgaagggcttatgagcagacatgttcttaaaaggtggtcatggtgaggcttgtagagccatgtttcctaggtggcttcccaggtctctctacctctgactttttattttcaaacatatttatgtggcttttctgggtacagtgttgacattcattagaaaatattctaatgcctgccagtttgcttctctttggaacattgtcaccacccaagtggctcttctgacaatgtggtagagggccttcttgtagttttctgaacaaggctaggcaccctggagagctggccacatttgctctacagcatgggtcatgcctcagtgttctgtacactggaagagtcttcacatttccaaacagaaagactagtgttacagaagtgcctgacttatctcagtcctaaagaattagattgtcctcagtgtcttaaagtttcgcacaaaactctgaatgaattttatacttggcaaattttaatgctggacgatgtgcagtcagttcatagtcctggtccaggcctttagtgtattgtctcatgagcctcctgatggcgtgaccttcctagctccctgtgtatactacgcagatcccatagaagcatggggccaaggattggtggcaccaactgaggtgacatttagaggtctttgagtgacccagctcaacttctctgccaatgtcagcttgatttagatctcactgaatcaggctgcttctgtcctgtgtccctgtgaatctgctcttggctggctttctctgatgtcgcttccttgcttgcttgcttcgttgctttggaaggctatccaaggtgtgtaaacaattctttagtaaataaattgctattaacccaaacaaacaaaaacactgcaaagaggatgggtaaaggtgagcaacaggggaatggctgggatagatggctggggctacatgaactggggattctttacgaaatatctgttagactttgtgatcaaatgatgtgataaaagaattgtataaagggaataattgtctgatactgatctgtttgagaagtattgagaagcttctcaatttaaatatttaaactttctaagcttatgcccccttggctgtgtatagcaaactgtttttatccacagttgtgccttattgtcccattaaagttgtattcctcaattcatcaataaatcaattgttgttaaaacaaaagaacttggttgagttttacccggtgttttgtaacaattttatgtaactcaagtgtcctaagtttgaaataatgtagtgtctcccttgctcagattcatgcttataatatcagttgcaggtatatgtcactgctgcctggacctgtgatatacattcatctaggggttcagtttgccaagaggtacagtgtttcagctctggcctcttcgtatgaattctaaggaagatctaatatattttctgtccttttttttttgtgatatagagtcttatctgcctaactggcttggaatttgccatatagatcaggccagcttcaaaattgcaacaatccttccacgttagctttccaagtgctatgcttacaaatgtggactcaaatacctccacgggaggtg

SEQ ID NO: 27030 - DNA, 7179 bp, Mus musculus
caattttaacactattataagcacagttgaccgcagtaagttccaaatatttaatataatttgaagtgaaagaaatgttatctaaattctggctcactctttgacagttttcctggacaaaaacaagatacgataaaagcagaaaccaggtttgattttgtatgggagtgaaatcattacagttttatgggtataaatctacatttttaaacaagatttttctcttggagaagaaacctgttgtttataagaaggctttggacagtttaatagtcttaaatgttctgctttgctgttctagtccttctcaggaaggcccagctgggcctgtggctagttcagaatgggaggaaacataggctgggacaatgctcaccctgaactgccagcgtgtgggaggccaaggcaggaagagcagatgttcagggccagcttggacatcaagaggctcaaaaccagtaggaaaaaaaacagagcccagtaacaccctcttttatattccttttgtggaatcatgtagcatgtgagactgggttggaagggaactggcatatgtggtatttcagttaaggtgatgtggtggaccctgatgtgtaactggccttcacctttggacatacaggaatgaaggaaaaactaaagcttggcatataaatcttttcttctaagaaaaagaagcaaagctgtctaatgtagcattgtctgacttttcaacatttttactttatgtggttgcatttttttataaaagtataaataagttccttcaacccaaaatgggtacttggacagatttttttttctgggtgataatgtaatgttatgctgaaaatctgggactcaggtaaattttcccagtttgaattgagctgtcttaccagagaatgggcctcagaagcaatgttcccagtcctgtggttggttcactataatctcagaagaaatttggaatatgaatcaaatttcaaataagaaaagcagatccgataagaagtgtggatctagttgcaagtcactgtagatttaaaggaaatttagggcctggggtggggggataactcgagaattcattccagtgagaggtgatacgtgctctttctccctttagtagttatgttataaggaactattgtggaaatatctcttccttctcaatcaatggaagtttattatatgggatgccaggcttttacatgagagggtaccattgtttgcaacggttgccagtagagaaggagttttaagcttgttagatgagagagaaacagatgctgttagagctgacttctggaacgggctctcagtgctgcaggtgctgtgaatttgagtcataaaaatgttcaaaattagaaaatgttgaacattcatggttagtcagattgggcaacaaaattgaatttatgctaaaagcttttttcatgaatatttattataaataacctattaatgagagcaaataataataaaatactagagaaataacatgtttaaggtaacctaaatttctgggcttggttgctcaacctataaccacattttgacgactgaggcaggaggataggccacaaagatcaaggccagcctgaatgacagacactgtctcaaaatgaaacaaaaatataacccacgtttttcaagtgccccagccacttatatttttatttagaagacaaagccagctggtggttgagagcacctcctagatgctgagctgtcctgcaccttgcccttgggcaggcaggggctgtcactgctagggaagtgttccccatttgctccaggtgcttcagggaagtgcactttgtctgagccgctcccgcatcctgcatcattaacaccaaatggtgttcacagcatgggtggatcccagccctaattgcttggtgtgtgtgtgtgtgtgtgtgtgtgtgtgtgtgtgtgtgtgtgtgtgtgtgtgtgtggcacatttccatttatagtcttacttgagttttcttcttaatagcagcaaagactaccattttagagttgtgcctccatttatagctgtgcctcctcccttctccatgtaagctggcagtttttcttttgaagtttctaaacaaaaacgggatatgtgcaatatatataaatatatatataatgtatattttaatacttgtggacaagtgttacaagttgtttaagaacaacaaaatcaccaatgtcttccattttgagatgtgtatagttttgtaagcagtagtgcttgatagcatattgtagtgccatgttaggggttagtgcatgaatttagtataattttaaacttcaagatgaaatattgataataaccagtagtgtaaaaagtgtggaaaatcctagacctttactttttttgtatatgaatatttgatagtctccctgcggataggagaaaaggccaaaacaactaatgtctgaacagaagtgtggcttcccactgagagccactgcgcttgggggaatgttaggcctttcacgggggagctagaatagctacctttgtagccctttagtcctcacagcaaggcctgggttcaggcttctcttgctctctaagtttgaagctagattggtcctgtattgattttgcattgtatgttttgggttcacttttcctcttttgtgtccagaaaataattttctgttttgcatgtctgagatgccgtgctgattgctttggaatgtttactctgtggccatttcctttcctgcttgcagcatgtgtgctaactgcaaagccttgtcagcagtttggagtatcctgtactttaggctttgccccattctacatctgacttgggtgttgagtccagtctctctcatgagaactgatagctcagtggggcccatgtaggttgacaaaaagtatgttggccttcctttggtaattgttgagagctttcacattttttctactttccttatgaaaataaagtagttgctttgttctgaaaaataaagttttctataaaatggaattcctacctctaaaagctgcctaggaaacttggaagtaatcattttctgaagtgttgtagggttttgtgggttttttttatttgtttgttccttttctataatttttagaaatagagtcctgccgggtatggtggcagatgccttcccagccttgggaagttgaggcagtaagatcaggagttcaaggtcatcctcagctacgtagtgagttggaggtcagcctgggatacatgagaccctgtctcagaaaaccaaaagaaaagagagaaagaaaagcgtatgtaggatttcttaacatgtattacattagtatgataggaaatgtaaaacttccccctagaaactaggtctgagtctagtattagatatgcagggtcccaggaagagactctcttcactcaagaagatggtcagcacctgggagaatctgcttcagaaacaaaggggaaggacttgaaaaagtgatgcttataaagtagcacagtataggaaaggacatttcctactgcaaatcacaaaagccatagtgaactaataatactgtcaaagaggtggaattctgtagcaataataggtatggatggatggtaaattgtgctcacaaagctgtgtggttgagtggttactggttgagtttgtggggccctgcagtttattatagagttccacaaaaggaaaaacacatcttagttaaaaggcatttaaactatgaatgtatatgaatatatttgcgtgaaaaaataccaactttcatatatgtgttaaagatcctattttgtttccccagagtttacagctgttgaaatctttctagtacttaatctggaatcccagtgaagccaacatgtaggggtcttgcttaaattgtttgtattaatagtcatttactatatagaatgatctatgctttattcaaataatataacctttgctcattgggttcctggctactgtttcaaagggaaaagtttgtttttgtgtgtgattagtgtgtctttgggataggggagcctcaagaacttactggtatttccttgtacttagactcaaggaagttaggactaaaagtgaacaaaatgactggcagtgcccaggcagggagttatctaaacatctggtaagtgaatgtgataagcttgtggccagtgttcgaatccttatatcaaagagaacccagcagactcattcctttcttatctgagatgtaaaatggaactagggccactcctcatttcctttacctcatggcatgtggccacttagcaccttcaacatccctgaaaagatctgggtctctgttcctttgttttcccggggaagaaaagtcaaaaagtagttttgtagatctaagactcttattttattataagcctaagggtagggaaaaggctaccttgagtgtagtttctctttagatgtcctaaactacccatgttagcttttgggacaaccaagcaatattcagaacaactgcatgatcatgaagacagctaattcagttacagcagagatcacccttaacagccaagtaagtttatggttctaaatgcaaaaatatgctacaagattttgtggtctcaaaatatgtgattaattagtattcagtcttactgtagtctcttgtttactctatgtacctgtgatatgcaaaatataaaaaagaccccctagccttcaggtttacattctcatggtgctgtaggtgcaagtatactgtctctagtttattcagaacattgcttggctactaattataccattttggaagaaccccttagccaagagttttaaaatgcagagggctatgttgaatttcagggcattactgcttatgtttacactgatttagttctgctcctcaactcttccccagggagctgctcattaatacaaaccaggaaagaaaccattctgcccaagtaccctcaccaccctccagctctcagtaagtggccaagaaaacttgctccataaagactatcacctcagttcctttttcccagggctttacacttattcattatcttccaagggccaggatttctagctaagccttttagaaccaaacagaagtcctaaatttagctttttcctgtatgacttgtttgttttgaagcagcattatagtagataacggagtacctgactgcatctccgaggaatttgacttgacatattcagttgaagttttgcatgtatcattgctttttcccaagattctgaaacaaaggttttgcatgtgtgttaaaaccaggcctgattggaagtgtaagcaatagtagcaggcccataactgattctagaatgctaacattctaatgcatggttgaaaattttcattgttaggtagttattagtaattttatatatacatttatcaataatgaagcaatagatacttaaaccaatagcttggttttattgtttatttttattttttaattaaagtttgtcttacttccattgaaattggaagtacaagataaacaaggggcaaccacaagacattcaaactgttaggaaaacagcaagcagtgctcactctgtttcctagctctatttattcccaagcatgtttgcaaataaaagataaactaagcatgttgaataagctgctgttatcagggtagtgcaggatttcagaagagtagggaaataagccaagtagagtcatcttccttcagaaataacaatgttcagtgttaaataactagctgtggggcttgtctgactaggtttttgtagactaagttcgaggtttcttcaaactatagattgagccaaattcatggtctaccgtccccgaacaggcaggaactggcctgagtgtcataaacaggcgccaccatcagtgtgaagttcagtgctgactgaggacccggcaaggccctgcagcaaggtggttttgtaggatacagaagttcagactcaggctgtgctgtggctctgtttacaactgcagagctggagttgttcttcagatgagtcggtcaaaatgtgtcacttgcctgaaacttgattcctgaggaacaggagaaaactttcttcttccaaaaaatatatttatttggataaatgaatattggtttgttataatagtgaaaggaacagaagtgtaatctactggcagaacatttacctgagaaaatgggtttaattgcagcactaccaaaaaaaacctcatggtggtaacataagaatttcttgactttgaaatgcaagttacaaaatgattttgacaaatgagaagtatttataatgtctgaaaggcctaaatagatttcaaataaaactgtttcactggattcagtccaatttacctgttatatgatggaaaactagttccaaatttaactttcaccgtggtcctttgctatggatgtcaactggaatggtgactcctaaccttcagaactgaactaaagttgtcagtgtgatggttgctttccactgaaacacaggaatcaaagtatgtgttgtatcccaaatagaagtgttctttgccacttactaataaagatgtaaggtcagagttcttccttctagcattctcttcctaatagtcaccaaagtcaaagcatcaaacggcaagacttggtgtgtatttggtagactcaggctttataagatacctttaaaggggcttgagagatggctcagcaatttagagtactggctgctcttccaaaggccctgagttcaaatcccagcaaccagatggtggctcacaaccacccataatgagatctgacgccctcttctggtgtgtctgaagacagcaaaagcgtacttattttatttataataataaataaatctttgggccaaagggagcagggactgaacgagtggggccagccagagcaagtggggttaaccagagcaagcagaggacctaaaattcaattcccaacaaccacatgaaggctcacaaccatctgttcagttacagtgtactcatatgtataaaataaataaatcttttttaaaaaagatacttttaaaggcagaatacagttaggattaatggtgattttccaaacattttgacatctttggtaatggtatgctgtatccttaatttaaatgttcttttgtgcttggaacatagctcttggagaacacttggactcaggccagtcctcaacacttgacaccctatcccaaagatcagacaagaattgtgtcagtgtgtta

SEQ ID NO: 27031 - DNA, 1366 bp, Mus musculus
ctctctctgcactgccccttcagtagcttcctttcctctctctctcattagttgggcatattctattctgtcaagtctttctctgatttgtcagtttgtctgctgctcaatcagacatcactttcaaacatgggtgcttccttctataaactaactttaccttcattatttgggattaaagatgtatactaagtaagggcgtatctgtatgctgtgctccagccagagggattaaaggtgtgtgtacgcatatgtatgcatggtaagggctgagctacaccacaactataaagtttagtttttttagtttttgtttgtttgtttgtttgttttttaggaaacaacacatcttggggttaacagcatcaccaaagatcctgtaacatgtgactctattactttaaatttattttagtacatttactccataatgcctatttctgaaaatgtatttcactactaataattaattagcatgcagtgtcccttgtgtccactgttgaaaaaatgaagttggccaggataaagcgatggaggtaatagtgattgtactctgacatgccagttttatgaaaactgataaatacttgttcctttgttttgagatagggtctttctatatagctttggccgtcctggaactttctatatagaccagggtagccttaaacttacagagatccacatgcctctgcttctctgctagaattaaagaatgtcacagagaaatcatctttgcttatgtaaaatagatgtgtacattggatgctggtggtgcatgcctttaatcccaacactctggaggcagaagtgggcagatagatcagttcatgaccagcctgatctacagagtgagttctaggacagacaagtctacacagagaaaccctgtctgaacaaaacagcagcaacagcaaatgtatgtatgtatatatatatatatgtacatatatatatatatgtatgtaataagtaacagttaataaatagaatacattgtacaataaagaattcaggggccagcgagatggctcagtggttgggagcaccaactgctcttccgaaggtcccgagtttgggtcccagcaaccacatggtggctcacaaccatccctaaggaaatctgatgccctcttctagagtatctggaaacagctacagtgtacttacatataataaataaatcaatcttaaaaaaaaaaaaagaatttgtatcttttgctggtttttttttttttaatttacttactttatttacattagtatactgcaactgtcttcagacataccagaagagggcatcgaatcccattacagatggttgtgagccaccatgtggttgctgggaattgcactcaggaccttt

SEQ ID NO: 27032 - DNA, 1243 bp, Mus musculus
caggcagtttaaaatacagaaattgagccacgtgtgatggcatgcttttaatcccaatatttgggagacagagaaggtggatctctatgagctcaaggccaatgtggtatacatagtaggttctaggacagcacaggcaatagaatagagagaagaccctgtctcaaaaaacaaacaaaaaacccaacaaaataacaacaaaaatagaaaacaaaaacaactcctccctccctccccccaaaaaaaagaaaaagaagagaagttgattgatgtatagatttgggagatatgactcttaagtcaaagcatcagtaaagcgtgcttttccaagactctgggtaccttctttgcttcttgttcttgtagtggctgtgcatgtctgttgttccttggcctggtgccataccctgctctctgcctctgttatcacatgacatttatcttgttcatttggcctgtgatagattctcaaactgtaacccaggtaggcctcaaagtcccagcagtcgtcctacctcagccttaagagttctggggttgtctatggctttaccaccctgaacgtgccccatctcgtgtgatcttggaagctaagcaaggtcgggcctggttagtacttggatgggagaccacctgggaataccaggtgctgaaggctaaataaatattaaaaagagttctgggttgagtgtctaacactcttctaaggacactggtcttattggaatactacctaccgaacaacctctgtttgactaaatatcttgagaccctgttcctaagagagttgacattatggtgctagagttagggaactaactcatctttggagaatcacagttcaccatagccacacttggatttcacatgttttccaattaaagcaaagccgagaaataaatgcagaagaccactgagttttatttaacatttgttatttggtactgggaccaaacccaggagcttgagctgtcaggcaagtgctcagtgactaagccatgacttttatccagaccagaataagagatttctggagagtttgggatggtaattctcttgatgtcaaaagagcccattttgttctcattatcctttctgcagaacttggctgttataaacacttgcctgcttctttaactaggctgcttacagggaggggtgacacccactttcacatagtgagtgaatacctgtctttttcagtcttctacatccctttccctaattccagcatttaagagac

SEQ ID NO: 27033 - DNA, 1597 bp, Mus musculus
aaccctgtctcaaaacaaaaaacaaaacagaaagaaagaaaggaaggaaggaaggaaggaaggaaggaaggaaggaaggaagacagtccagtacccagtacccagtacccagtagatgccatttaactagatgttaggccagcagtacattgtttacagtgtctgtcagagagtctaggttgagcctaacatggaacatgtttgtccctcctagggaagaacgatggaagagacaagagcaagaacgaaaggagaagaaagaaaagcttttggaagctcgaagaaacctgggtgtgactaaagcccagtgaccctgtctgttcctttactctaacttgttttccttttgtatgttttttactctttctctacttcagtcaaaagctcttttctatcataacttttggtcataatttgtgtagtgtctcttctgtgctatatctgagaatatattatcaccttaaagttcataactaaagtagttttcatctaatgccctatacatctccaatttttaaaagacttgtcctcatgattcttaacagaggtttttcatgtcaaggtcctgatagttccgagggagatgacctgcacccttttctgcacaagctgtagcagaatcttagcatgagaaaataagatatcgctcataggaaaagggaggctggaagaccacatttttgttcagtagcctggaaaatctattagtcttattgaaatcttattttatcaaggtaaaaagttttagcttataagagccttgttctgacttttcatgtatttgccatctgtcattcattataatcctaaacgagaaaacctctactctctctacttgttaaataaaagccacagggcaaagggtgtgctttagttgtacaacacttgtctatcacactcctgtccctgaactgtaccaccaaaaccaaagctgagaattgctgctgtaagaattactgtcattggcagacttttttcttacaagtagtaaagagaggaaagctgcaaggggtgaccttctgatctttgctctgccttacagagattctgagatgtgtgtaatgcttacaatgttcataaataaaaattttcactgtgataggttcattgttttaagcgtaagttgctcaggatttggatggacatcagagatcagtaaacacacctcctccatccacttgtcttccacaactgttgagacagggcctcatgtagggcaaactggtcccaaactcattttgtatctgaagatgaccttgaactcctgatcccccagcctctacctcccaggtgagtgcagagttagatgtataccaccatacctggctataaagaagtgtttttgtttttccctttgttactgactacattttgaatctaaggccttgcaacttaccagaaatagtacgataacaaggttaataaccaacagttctatttgtatatactataagtcaataaagctaagctgaatgtggtagcataaatctatagttcagtactcaggaggtagaggcaggaggagcagaagctcactgtctgcctcagtctcgagaccctgcttttaaaaacaaactgtagaactgggtggtatggc

SEQ ID NO: 27034 - DNA, 1184 bp, Mus musculus
cttattgttgaagcttgttttctcagcccgggcaaatttttacattttaatacttttttcttacgatggcaatgtcttccattcacaaattactgactggcatttacattcataaaaatttcctgaggccaagggctgcattacctccatttgtgggtagtcactgtgtagactattcttccagtagtcttcagaaaaaagtgacttctgttgacagagcctcccagcagggaaagactgaagagggcttacaaggacatgaccacaaagaagttgctttggatgcaccttctcctgacaggacacctgaagttagttttgataaagcaattagagatgaagcaatagaacattttagacgtttgaaggatgaaattgtggctcatttgagaggcccagacggccgcccattacaagaggtcataatggaacaagccagggttgtctggcagtttcgtgaaaaagaagatttggataagtggatagtgacttctgataagacaattggaggtagaagtgaaatattcttgaaaatgagcaagaacaaccgaagtgccctgctttatggaactctgagctctgagcctcctcaggatggggacagtagacaaagtggatactgtgccatgatctccaggattccacgggtaggtgtggcctgttctcagtgactttgattgtagcgggagctgtaactgacacttgctcttctgtaagtgaacacatctgttttgccttataaggaggtatgtaactgcttggccttagtgtaaaagggggcattactttgggtttgagaagagtggtgcatctgagaatccagagaagatggactttgaaaggtatcccgggagattggcatctccagcttggactagagtcaccttgtagcctttattcttggttttaaggcagggtctctcatgcagctcaggctggccttgagctaactatagctgaggatgaccttgaactcctgatgctacaggggtgtgccaccacatctggtacttatattcatagttgacattattttgctgtgggttgcagagatggtccagtgagtaacgtctctgccatttaagcttgagggcccgagcttgggtctccagtacataggtaggaatctgcgtgtggcactgtgcacctaggagtaacagttgcacatgtatgtctaatggctg

SEQ ID NO: 27035 - DNA, 2243 bp, Mus musculus
aactagcacagtcccgccactcagcacactcagtattaccgtggagctgtggggttcttgctagaggccctggtggcagcagtggcagcacttcagtgtccttcaggctgccttgggcccgaccatcgaacatttggcatctaacccttgcagagagtgggactgggcggctgccatcttcttccctctcatccttctcttcttcctgtgtccatggaagagggattttcaaaaccagtttagtttccaaaaagtgtacatttatggggagggagggaaggggcctaatttgagtgagagagagagagagagagagtgtgtgtgtgtgtgtgtgtgtgtgtgtgtgtgtgtgtgtgtgtgtgtattttttatcattttttaaaatgcagtactctttgtatcagtctgtcatgggtctatagctgtttcagatttttttgagctgtacttgagcatctgaaactgcaagaaagaaactgattaaatgtgattcttcttactaaacaggcctgactgctgtagctgtgtgacttccctccctctaccctagcactgccctaccccacaggaaactcccatctagtccccttgccccataggctgtgttctagcaggtgagcaggaagctcatggcaggtcctagggagggcagccagagagtctcgctcattccacaggcacagcttcttgactgaacgtagcacatctcgtccccacccactgttcctgtctcttcctagtgactctgatgtttggcaagaataacattttctggttttttaagaaataattcaacatgaatgtggagagcaaacaaaaagatgtaggttgcaaatgttaccagcatgtgcagtggtgtgtgtgtgcctatgtgtgtctctgtgtgtgcatatatatgtggtgagcatatatatatattgtgcagctagggtgaagccagcaaagaggtgtgtatgttgttatgagacgtttgaaaagaagctgactgcttgataatcattctcaggtgtaaagctccaagtgtaaataaaagtggcatttaacaaattttttcagaacaaagtccagctgatgatctccagcaagcagtaagctaaaggaacagctgagagccgccgatctgcacacagtgcagaggggtcagctctgtgcttcactgacttggataaggaagggatgatgggaaatcatggaattaagtagtatttaaacaaaagtggacgtaatagctcttctgtttgagtaaagccttggtgttgctttatcttagtttacatttttactttttaaaaagcagcaacggatgcttttaaagaagtattgtgactgtagcactgggaaatgtggcccgtgccccagcttgttgtagctgtggcatagagttgggcaaaagagcggtgatggactcattgcaaccatacatacttgaagagtccattgaccgaagctctttatagactgttttgtaaatggggaaatcacagactgttgaacgccgcctgcactctaacggtcctagagctgctgggacctctcctatcatgtcagacttggacttttttccttcttgtttaaaggacataaaatcatagaatccatataatctgtggagtcatcctgacccacatgtagatctgtatctaatattatttggatttggacaagtgtcaatgacatggctgtgtaataaaatttttattaaaaataccacacactgtagcccctttgccactccccatctgcagctgctgaaaccctcatgctgagatgccaaaacacggggcagggaaaaaaagcccaccaaagaagattgagagttaacccagcaactgacctgcctgtctgctgattccagtcaacattcagcacctacctgcagtctcagctgaggtggggcctgagccaagatctcagccagtcaatggaaccttagctttgtcccaccaactggcttcctggtgggtcacagtttttctcctgctggtgaatgccctcagtggcctctccatcaccccaacttcacttcagtgttgaggggcgtaggacccaaagctgttttctactctttttcagttctgggaagtaagagagtccatatacctagctcatgctgtctgtagatctgttgtctggtttctgacaggcacagagaaagtctgtttttgttattttttttgtgaagtcctgacttcaatctgtaaatatatttgtaaataaactctggcattttaataagggatcag

SEQ ID NO: 27036 - DNA, 1872 bp, Mus musculus
cccttaaatactcttaagaaatcaatacttaaaccgggagtggtggcgcacgccaataatcccagcacttgggaggtagaggcaggtggatttctgagttcgaggccagcctggtctgcagagtgagtgagtttcaggacagccagggctacacagagaaacctgtcttgaaaaaacaaaacaacaacaacaacaaaaaagaaatctactttgtgtgtgtgtgtttacgtgtgtgtgtgtgtgtgtgtgtgtgcgcgcactagaaatggaacacagggcttcatgcatcctaggaaggtgcgctcaggctgtaaactatgccctaataccaaccagtctttgccctttagctttcaggcactaaagaagggaggtctttctaggacctgatttctgccctgtgatttgatggcatgtgaccaacagtcatccactgctgctactgatggacattcccacttggccctcagcatatcatttccttctgtcacagctgcctgtgcctctggagtgctacacagagcctgctgaagacagcctgcctctccttcagctctacttccgggccttggttactggtacactccgtgcacgttggtgccccatcctctacactgtagccgtggctcatgtcaacagtttcatcttctgccaagacccaaagagctcagtaagtcacctctctatgttcagagggaaggagggagctggtggaccagttggggatgggctgagggttaagtgagtccctgggtgggtaccagtcctcggctttgtgtcatatctctcttccgtccactcccaggatgaggtaaagactgcccgaaggagtatgctgcagagaacgtggctgctgacagatgaggtagtattgtgggtgtcgggacggaaaagatacaggacattaaggtaccaaacctcaacaaactgaccacccacttcatgggttttgtcttctctgcaggggctgcggcagcatctcctccactataagcttcccaactccagcctcccagagggctttgagctgtattcccagttacctcgcctgaggcagcagtgccttcagacactgcccacagaggggctccagaatggaggagtcaagacatagggcacttgcccccagctaaagatgactactctactctcctgggactgagcagtgagcctcccgagagaaggcaacacaagacttgccttcctgtgagcacattgtttgagccttttttagaacagaagggactcgtattacatcatgatactggagctcaggatctgggggctgagggctgtgccaggcgtggaaggagggtggcttcagtgtttaccctgcggtgcccaggacagtctgagcacagctctcctcactcacctccagtcttcaccagaccaggatgtgcaattactgtgctacactctgaaataaattcttttctagtctgactgatctggactgttttgtcacattcagagttggtagcaaggatggattttcccgaggagagagatgggagaaaatgtcacaatgggaggtaaacacattaccatctgggggtggcagaggtgtgtgtcctgggagtcagtgacagtgcgcctggagtgggtgtggtcctggaggactcagcatgccctggaagtgctgaggtcagagaacccaaatgtcagcctggtgtagttctcctatgccgttctcagtgggcttttttttataatgtgtgttcatctgtatgtgagtatggcatgtgtacagagaccaggagatgattttggatccccctggagctgtgtggttttgagctccctgctgtgggtatagagaccagacttggctgcgctgaccactgagctatcctccagccctggtacttt

SEQ ID NO: 27037 - DNA, 1202 bp, Mus musculus
agcagtggggaccctcagtgtagacgaggggccctcctcgttcaagcttgccgggatctccccagcatccgcagctgctacctggcccattgttcaccagcccgagccagtctgctgagctcccaagccttgtactgtggagagctactgcgagtctcaagtctgctactgcctgtacctaaggagccactgctggccactgactggcccttccagccgttgatacatctctaccaccgagcttcagatactccctctgggccacctgctgctgacactgtaggcgttgccatgcgggtcctacaatgggtgctagttctggagagctggcgccccgaggtcctctgggctgtgccccctgctgcccgcctagcacgtctcatgtgtgtgtacctggtggatagcgagctgtttcgagagactcccatacagcgactggtggcagctcttttagctcggctctgtcggccccaagtcttgccaaacctcaagctggactgccccctccctggcctgacctcttttcctgacctttatgccagcttcttagaccattttgaggctgtctcttttggggaccacttgtttggggccctggtcctccttcctctgcagcgtaggttcagtgttaccttgcgcctcgccctctttggggagcacgtgggagtgttgcgagcacttggcctgcctctgactcaggtatgtcctacactatcaaggccttcctaggacccttcactagacactaggggcagtcttgagcagtgtggcacttcggtgggcaccattacctcattacctctttgaaagcatcaagctgtaggaatagaagggtttttatcatggcatctggcagagagcaggtatacatattattactattgggttttttcaagtcagggtttgtctttgtagctatggctgttctggaacttgttctggagaccaggctggcctgaaactcacagagctgcctctgtctcctgagtgttggggttaaaggtgtggatcaccactgtctggcagggtttgtgttattaacaggtttggtttctgcttgtgaactcctacagtttagaagaagatatgctaagatcaaaaaacaaaaacatacttgttaattactcagatctttggtgtgttaagtcagaattcagagaatttttaaaagactggagtggggctggtgagatggctcagtg

SEQ ID NO: 27038 - DNA, 1182 bp, Mus musculus
attgttgtacgtgtcagcccggctgggtggggcaaggcatcccatttgggcgagaaaagggtttataagtggagggtgttgtagaaaggtacacttttaacactccacggtcaggttggaacatggttagaaccacctagactagatccaacatgggttcctgaacctagactagatccaacatgggttcctgaacccctggaatgaggatcatgggggccactggtatcgggttcagcctggagaagcctgtagacagtgcctatccatggcctctgcatctgctcctgcctccaggttcctgccctgtttggggtcctgatgtgcatcttccttactttgtgttgccacaggaacgagatacaagttcagtcactgtgactctgcctgtgcccagtggtgttgctttcccgcctgtgttccatcgctctcaggagagacaggtaagccagagttcccttaggtggactttcagttaggctttctattgctgcaccaaaacaccatgaccagaaacaacttggggatgaaaggcattatttcaattacattttcatcaggaccccaaacagggcaggaacctggaggcaggagcagatgcagaggccatggataggcactgtctactggcttgctcagcctgcttgtttatagaacccaggaccaccagctcaaggaagcacccctcacaatgggctgggccctccccatcaatcactaggaaatgccttagagctggatctcctttctcatgactctagcttgtgtcacgttgccgtaaaactatccagcacaggcgatgcttagggaatgagtggttctcagagcgcatcttccctagggagctctggacaatgataagcaagtcccttttattttcccttaaagaaaaccatatgtaagtatctatgtctgggccaggcaggcagatctctgagtttgaggccagcctggtctacagagtgagttccaggacagccaggactatacagagaaaccctgtctcaaaaaaccaaaccaagaaaagaaaagagccaggagtggtacaacgtgccatgtccgccatgcccacagagcccagaaaggtagagtgcccttggagcgtgagttacagatgcttgagctgtccaatgacagagctgcgaattcaactcaggtcctctggaagaacagcgggtgctc

SEQ ID NO: 27039 - DNA, 2255 bp, Mus musculus
taggaactgttaaatgtaggtctggcaagatggcagagcaggtaagagtgcttgctgccaagccagaaggcctaagttcgatcccatagacccacgttgtaggagagagccagtccctaaaacttgacctttgacttcgaacaagtgtgctgaggtacatgcatgaggtcatgagcatgtatgcattcacacacacatatatacatacacgaaatgcatataatttaacccgacacgtagttatccttctacagtactgttaaaagaatgagttattttcccatctcagcgtcatatggtcgggaggtcctctgctttgtggctactatgtccccgtattcttttacctcaggtatgatctcatgtaccagtgctggagcgccgaccccaagcagcgcccaagcttcacgtgtctgcgaatggaactggagaacattctgggccacctgtctgtgctgtccaccagccaggaccccttgtacatcaacattgagagagctgagcagcctactgagagtggcagccctgaggtccactgtggagagcgatccagcagcgaggcaggggacggcagtggcgtgggggcagtaggtggcatccccagtgactctcggtacatcttcagccccggagggctatccgagtcaccagggcagctggagcagcagccagaaagccccctcaatgagaaccagaggctgttgttgctgcagcaagggctactgcctcacagtagctgttaaccctcaggcagaggaaagttggggcccctggctctgctgaccgctgtgctgcctgactaggcccagtctgatcacagcccaggcagcaaggtatggaggctcctgtggtagccctcccaagctgtgctggcgcctggacggaccaaattgcccaatcccagttcttcctgcagccgctctggccagcctggcatcagttcaggccttggcttagaggaggtgagccagagctggttgcctgaatgcaggcagctggcaggaggggagggtggctatgtttccatgggtaccatgggtgtggatggcagtaagggagggtagcaacagccctgtgggcccctaccctcctggctgagctgctcctactttagtgcatgcttggagccgcctgcagcctggaactcagcactgcccaccacacttgggccgaaatgccaggtttgcccctcttaagtcacaaagagatgtccatgtattgttcccttttaggtgatgattaggaagggattggcacacttgggtccctaagccctatggcaggaaatggtgggatattctcaggtctgaatcctcatcatcttcctgattccccaccctgcaaaggcctggaactggctgtggggctctgaggcatgctgaaggacaaaaggttacagagatccgacttcaaaaggcagggtctgagtctggcaggtggagaggtgctaaggggctggtccaggagtcaggcatttcaggacccctccaagcttctacagtctgtctgagcatgctaccaagcccccagataccccaaaactaacagaggcagttttgtctgagcccagccctcccacatgatgacccttaggtctaccctcctctctaaatggacatcctcgtttgtcccaagtctccagagagactactgatggctgatgtgggtaagaaaagttccaggaaccagggctggggtggaaccagggctggggttgaggcaggctcttgggcaggctcttgctgttaggaacatttctaagctattaagttgctgtttcaaaacaaataaaattgaaacataaagaatcaaagctttgttttgttttttactgatattggttgtttggagtttttgttgttttgagacagggtcttaactaggtatccccagctggtctggaactcacaaagatggacctgccttgttctgagtgctgggattaaaggcacgtgctaccattcccaacccaaggctttgtcttttaaatgtttacttttttccccttttggatcacaaaacaatgaagcattcttgcacagagaaaagtctagaaaagacatgccggagtgtagacagttatctttacgtgatatgattaaggaaacctttttcttactgtatcttaaagttcaacccagtgtgcttctcataagcagattagatagaccccagtaattcttaccatgttcaagataatatataatctttgtagacaactaggaaagtgtagaatgtctgtaatcccaccaccc

SEQ ID NO: 27040 - DNA, 1122 bp, Mus musculus
atagaaaaagccctgtatatttacttacatttagtgcctaaagtggggcacagaatccaagcttaaacaaaaggttcaggtattaaagaagtcctaggtggaaggtggtttcctagtcgcttgggaccaggaagtttcgagaagccaagtattctccgaagacaggagacctgcagcatctccacaccttgatctcactttggggaggcagataggcatgggctcttggctggccatagagtttgtactgcacagacctgactcctatgccccctggcacctgaagatcccaccagacagcatgctttggaagatgtacaagctgtaattgagccatttgaactcaaaatgtgggcagcaaaggccctagcccctgcccttcattggctgttggagcagtgttttgtagtacataatgggtttccacctttgtagcaatccttggctttagtgaacttgatgttccaccttcacagccaggtctccctttggaatgaatttgtggtgaggtcagcactactgcctgggggcagggaatggacgcagaggatctggactcaaggggcattgagttggttgcccaggctgccctccctcaaatttccattcagtgccttgtgagaagactctgacctgattgggcaaactgtccttacaggctccagcagggaagggcccctagcctgagtgggataccctctaggggaggaggcctgcgtccctatcagagcttgtcagaagctgcagctagcagatggtgtgtgcaccttggtacagtcgtctaagtgacagggtttgaagctagtagggtgccagaaggaatctaagactaagaaaatagatgtattctccatgtatggccacttgaaggaatgctaaatccaaggaccaagtaaatagtaggttttacaggtttcatttcaagctttttctcaaaagccagcttgccttgttgaatttaaatagctttgattggcaatttatttacaccccttgttttcagaacatgtcagctgaataaagttgaggtttatttagaaaaaaaaaaaaagactaaagccaatagaagtctggtaagactaaataaagtaaggggactggagagatggctcagcggttaag

SEQ ID NO: 27041 - DNA, 1147 bp, Mus musculus
atccagaaggcacagtattgtattcctgccctctggggcactacacaggctggagctgagtacaagtggggatcattttaaactataaggtcaccaaattaaaagtcggcctctttgcctctctttctccctctttgtctctctgtgtcactcattctccctgcacctaagaaatggttgaagggcggaaaggtactgccacactcagtcttattactatagtttttaaaaaacgataatgtcttgctatgtattcttagctggcttctctgtatagaccaaggctgttagaccaaagctggtcttaaacctggaatgattctcctacctttccctcttgagtactgagatttagttgtagattttgagcttgagttctactagaaagccaggaatagctgttgagtggggagttgtttaaatttggatcccagagttgagaatggtggcacatacctttgatcccagcattcaggaggcagaggaaggcagaactctgtgaattcaaggccagactggtctactgagcaagttccaggtagccagggctatttagtgagatctctgtcttaaaaatctgtatctcagccgggcagtggtggcacacacctttcccttgctctgagagttgataattgccattatgacacagaaaggcctaaaagagggaagaaacagatggtatctaaatttctggaattaattaattaatttttgagatagatcttctctatgtaaccatggtctcaaactcagtgatctgcctgcctttgcttctaagtcctgggattaaaggtgtgcaccaccaccaccaccaccaccaccaccactaccctgtttgcttgttttttctcttcctctgtctcctcacttcttttttaagaaaatatttatttttatttatatatgtatttttaaagattaaaaaaatattttaatatttatttttgtttaatgtatatgaatacactgtagctgtctttagacacaccaaaagaaggtgttggatctcattacagttgtgagctaccaatgtggttgctgggaattgaactcaggacctgtggaagagcagtcaatgctcgtaactgttgagccatctttccagtcccatgtatttttatatgtatgtatgtatgtatatatg

SEQ ID NO: 27042 - DNA, 1116 bp, Mus musculus
agtactgctgaaaaagagattaatatccactgtaagagagagagagagagagagagagagagagagagagtgtgtgtgtgtgtgtgtgtgtgtgtgtgtgtgtgtgtgtgtgtgtgtgtgtttgtacataaacttccattctaaattttttttttggtcaaggtttcagtgtatagcctagcctgcttggagcttgctatatttagcccaactcaggatccttctgtctcctcccagccactgggattacagatgtgtactcatggttggtgtgctcgatctctctctgtctctctctctttctctctctcttaagatttatttattttatatatgagagtacactgtagctgtctgcaaacacaccaggagagggtattggatcccattacagatggttgtgagccaccatgtggttgctgggaattgaactcaggacctctagaagagcagtcagtgctcttaaccgctgagctcagtgaggctctctttttacttttcactcttcttcttttgagaggatctcactatcttggctggcctgggacttgctgtgtagacaagctggctttgaactgacaaatctgcttgccctctactactacttcttttttttttttttttactttgtttttcgagacaggttttctctgtgtagccctggctgtcctggaactcactctgtagaccaggctggcctcgaacctgcctctgcctccctagtgctgggattacaggcgtgcaccaccatgcttaacttaaagatttttatttattttttaatgtgtatgcatgtatatctgtatattatacgtgtgtgtacctgtgaaagccaggagagggtagatccccaattttgaacacataatgtaggttctctggcagagcagcaagggcttgtaaccactgaatcttctctctaagccacccagactgactccctccctccctcccttcccttccctcccttcccttctctttctctctttctctctttctcttcccttcccttcccttctctttctctctttctctctttctctctttctctctttctctctttctctctttctctctttctctctttctctctttttctctttttctctttttctc

SEQ ID NO: 27043 - DNA, 1846 bp, Mus musculus
tatatgtgatcaatatctaaagacaaacacattttataaggcactctgcattttgatttaatgataagggtaaactattcttttcctgcattttatttatacaagtggggttagtttatgtagtgttagagattgaatttaggacttttgtgttctaggcaagcagtatatcagttgagctacatgcccagccctgaaacttggctcttgaattgtatttttttgtgtgtgaaacattgataaacatgtgatgttgataatttacttttgagcactttgttaagctataatttttaagtaatgactcatgaaatctgatggatatattgattttaagaactgtttttccttctctgagtcttgttgatagatagttctgtactttttattgttttctacctttctagtcgtattgtgaacagttttgaagatgattcccagatttcctcaccatcaaacccgaatggaaactttaatgtcgtcattaaagaagagcctctagatgattatgattatgaacttggtgaatgcccagaagggataacagtgaaacaagaagagacagatgaggaaacggatgtatactcaaacagcgatgacgatcctatactagagaaacaactaaagaggcacaataaagttgataatttagaagctgaccatccatcttataaatggctaccaaatagcccaggtgttgctaaagctaaaatgtttaaattagatgctgggaaaatgccagtagtttacttggagccctgtgctgtcacgaaaagcacagtgaaaatttctgaattgcctgataatatgctctccacttctcgaaaagataaatctatgttagcagaattagaatatttgcctgcgtatattgaaaattctgatgggactgacttttgcttaagcaaggattcagaaaatagtctcagaaaacattcaccagatctcagaattgtacaaaaatatactttacttaaagagcctaattggaaatacccggacatacttgacaacagtagcacggaaagaatacatgacagttccaaaggatcaactgcagagtcattttcaggaaaagaggacttaggcaaaaagcgaacaacaatgcttaaaatggcaataccatcaaagactgtgactgctagtcatagtgcctctccaaatactcctgggaaaagaggaagaccgagaaagttgagactctctaaggcagggcgaccacctaaaaacacagggaaatctttaactgctgccaagaatattcctgtaggccctggaagcacctttcctgatgtgaaacctgatctagaagatgtggatggggtgctctttgtttcctttgaatcaaaggtatggttgtaatgatcagctttctttttaaggtctgctaatcagttttgaattgaaaattggcttaaaatttaggacctacttttattaatgtatctatttgtgagtatgtttggggctattgagtgagtgttaaacatttggtttaattaacagtaatcatctcttaagatacttgctttgaaatagactttaaagaaatgtacctttgtgtagatctcattctataatttgttcaatgtttatctgattaaaaaagatttatgtgtgtctatgtatgtgagtgcaggtgccagtggaggccagaggtgtcaggttgtcctggagctactagagttgaagctacttgtgaactataaataacatcagtgttagaaaattgagcttgagggctggtgagatggccccgttgagagcactggctgttcttccagaggtcatgagatcagttcccagcaaccacatggtgactcacaaccatttgtagggatatctg

SEQ ID NO: 27044 - DNA, 1950 bp, Mus musculus
ttttaaaactttgctttgggtggaggacagtgtttgagttattttgtgtgtgtgtgtgtgtgtgtgtgtgtgtgtgtgtgtgtgtgtgtagcaattggtacttataggtggattgtacctttaagaaattgacccaggagccgtggattaaagtgccacctttaatcctagcacttgggggtcagaggcaggcagatttctgagtttgaggccagcctggtctacagaagtgagttccaggacagccagggctatacagagaaaccctgtctcgaaccccccctcacccctcaaagaaattaacccagtgggcacaactaatgctataagcacaatcatttagtaggagggcacagtgagagaatgaagattttttacctgcaaatttttatttgcagcagcgcggccctctcctggtggtgtgttcacacagtttgtgatgagcaaagttggtgccttacagcagaagatacccggagttcgcacacctcaaccccttacagggccacagaagttcagtatcaggccttctccagtaatggtcgtcacacctgtggtttcttctgagcaagttcaggtgtgcagcactgtagctgctgctgtcactacttcccctcaagtgtttctagaaaatgttactgctgtgccatctctgactgctaattctgatatgggagctaaagaagctacatattcttctagtgcctccactgctggggttgttgagatctctgaaactaataacactacccttgtaacatctacccagtctacagccactgtgaaccttaccaaaactactgggataactactagccctgtggcttcagtttcatttgctaaaccattggtagcatctccaaccataactcttcctgttgcttccactgcctccacctccatagtcatggtgaccacagctgcatcttcctccgtggtgaccacacctacttcatcactgagttctgtacctattatactctcaggaattaatggaagtccacccgtgagccagagaccaggtaaggactagttcttttcagctgctttattataaataaagctccttaattaaattttacagttgtaataaaattaggagtttctagtttagacattgtcatctgtaaatgcattgggctgcattcatagctatcttgagatgtatgtaggccacaatttatagatatgcctgaatacattttagagtttcagccatagtatgacatgttaacattcctaaatctttaaaattctacaaaactgaaccctaaaaataacagcttatggctagttgcaagattaggaatgaccactgtctatacagttctgaagccagattccagagtacagggatcagctgtcttcaagagattatctgattgatagattaataggactaaagttgaatccaaggaatactaaaactcgaaaacaaagtggaaatgatcgctgaaggacactaaatgatgtaaataggaccagacctctgagcattagaacagccattaaagtggcatgggaggaagggcaaactgctttatgatgagagctacagctacacatctctaaggagggaatttcatacccagctgctggggcagctactcttttctcttcccccttgtccttccctcctttctaagaaaatgtttctgcatttataagaaaatacacagcagtgacattttctgaaatggtatacttaacttactttgatgtttttataaatttttattttatgtatatagtgttttgcctgtttgtgtgtctctggaggccagctggcctgcctacctacctgccttcctaaaagaaggtatcatattcattcctagctctcattattagacttagttgataaaataacctggccaaaaaagcaagtaatagagggtttatttgggctaatggttttaagggtacagtcctttgtggtcaggaaagcca

SEQ ID NO: 27045 - DNA, 1135 bp, Mus musculus
tatgggttgaaaaataaattggaactttttaaacttacgcttaaggctcagaattgagttcaatctaggtaacacaatgagactgttgttttcttaaaaagtttaatttctttgaactagtccatttttcattgtctttattaaggaacaaagttaattggtttaagttgtttcttaccttgtttttggaagtagctacactgatttaatgttacttggtaaactcatgtcttagagaaaggtgtgttcttttttattcttcagacagttcagtgtatggaccagaaaaatctgacttatcagttcaagtagattctaaaacaagaattagttttaacattacagaataaaataaataacttgaattcacaagtggaaagaaactgtggtcgagaaatttgaaggactttgttaggagtgtataagatagaaagcctgtgaatagtgtatgccctcatgtaaacttacattgtaccttttaagtcagcctctctttagagtacactgacattaactggacatttgttttactaatttttcactttctttgcagaaaatgcctcaccttctgacactccgcactcttctgccaacctggtaatgactccacaagggcagttgcttaccctaaaaggccccttattctcaggaccagtggtagcggtttctcctgctctcttagaaggtggtctgaagcctcaagttgcaagcagtactatgtctcagtctggtatgtggtggtattctatggtttgtaaatatatactatggttggtaaagaatggtccattgatagaggacgtctttaaatctgatctgtagttacctagagctgttcttttggcatttgccttgttaaaaaatggtccttctagctggccagtagtggcacacgcctttaatcccagcatttgggaggcagaagcaggtggatttctgagttcaaggacagccagggctacacagacaaaccctgccttggaaaaaagaaaagaaaagaaaaaaaaaaaagaaagaaatagtcctcctagcttgatttgattggtggttaacctggagttggaaactgttttgttaataactctagtgacatttctaagcaggggaagaattaaaatggtgttcaagtgaaatg

SEQ ID NO: 27046 - DNA, 4535 bp, Mus musculus
gccttgcgcttgcaggcaagagctctaccactgagctatagccccaacccctcagctgttattctgacaaaagtggactaagatagactgggaaggagagagagaaaaagagattttcattactgcatctaatgaactctctctttaatttttgattttcagagaatgatgacttatttatgatgccacgaattgtcaatgtgacatcattggctgcagaggaagatttgggaggtatgagtggcaacaaataccgtcacgaagttcctgatggcaagccacttgaccacctgagagacattgctgggagtgaagccagctccttaaaagatacagagagaatctcttccagaggaaaccatcgagatagcagaaaggcactgggtccaacacaggtgcttttggcaaataaagattctgggtttccacatgtagctgatgtttccactatgcaggcagcacaggaatttatacctaaaaatatgtctggtgatgtgagagggcatcggtataaatggaaggagtgtgagttgagaggagagagactaaagtcaaaggagtctcagtttcataaattaaagatgaaagatctgaaggactcaagcatagagatggaactgaggaaagtagcctcggctatcgaggaagcagccctccatcccagtgagctgctgactaacatggaagatgaggatgacactgatgagactctgacttcactgctcaatgaaattgcttttcttaatcaacagctaaatgatgactctggcctagctgaactgtcaggttctatggatacagaattctcaggagatgctcagcgagcttttatcagtaaacttgctcctgggaacagatcagctttccaagttggacacttgggagcaggtgtgaaagagttgcctgatgtccaagaggagagtgaatccatcagccccctcctcttgcacttggaagatgatgacttttctgagaatgaaaaacagcttggggacacagcctctgagccagatgtccttaagattgttattgaccctgaaataaaggattctcttgtttcccataggaaatctagtgatggagggcagagtacttctggtctccccgcagagcctgaaagtgtatcttcacctcccatcttacacatgaagactggcccggagaacagcaacacagatactttgtggaggcctatgccaaagttggccccattaggtttaaaagtagctaatccccccagtgatgccgatggtcagagtctcaaggtgatgcctgccttggcacctatagctgccaaagttgggtcaattggacacaaaatgaatttagcaggaattgaccaggaaggccgggggagcaaggtgatgcctacattggcacctgttgtacctaaattgggcaactctggagctccatcaagttcatcagggaaatgagcttgttcatcctcatacaaaagccaggctgtgaggggaaatgaatttcacctcctttctctgtaggcgtctgtttgtttgtattatggaactattatccttgacttaattatgtgtgaatattgatggagaaaggaggtgtagggtgctggtcctggtgtttgaaattctgatcatgttaaaaatgtgttacctcacttgtggtgctgggtcccctcatcttctctaagaaggtgtgattccctcttgcccaaggaattcataacaagattctggctccatcaactaccttattattttcccctgagaaaatgcttgagacttggaattactatagactaaagtataagtcatagttgttggctccaaaatctgagaattatgatacagttgtgtgggaaaaaaaaaaaaaaagaacttttagttactatttcaatagtagggcatggtaggactgggcatggtagtgcacacttgtaattccagcacttagaagactaaagcagaaggattgcaagtttgtgtctaccctggcctatcaaggggacagacacacacacacacatacacacttgtgggggccaggggagtaggaagagagaatgttatagtaggtaggatgaatattatggaataccaaagtgaagggattttgtcattcagcagactgtttcatatccagaatagttcttcccttaccctttcagtcataattaaaaacctaagctttctggtaaagtaggaatatactttttacttttactattaacatacttattttcagagactaaaaaagacatacttctcccttatttcttggggtatcacaaagattcattcataataccagagatttctactcattgttttttggaagtagacatagaggcagcccttccctttcccaaatcatgtcactcaagaaacagctaaaatgaaaagcagtttctcccctaaccagagaccgtagccaaaataaaaatttgtggggctgggtatttcccaaatgaaaccagcctctaggtgcttgaaggttttgttcactgtcacctgcacaggatgtaaagaaaaggcgagtcagagtgagcaatctttaccagggaagtaaggcagtatttgagtcacaaagtatattttttatctgctatcatggcatcaatgatctgtagagctttttcactcattggctgtcagggtatgaaggactgacaacctgtaaagatgaagatatttatatttttgtatagttgttttcatagatttctcaaaggatgaagttttcgacctagaagagatttgtattgagtatagaaatgtttcctatctagtttgtaaataatcatggtgcatttgaggggtctctcgggaactcgtgaggcaagaatcactgttctgaaaatgtatagactgagatgtagctgctgcatttgcctttcttaaataattatattttggaatgtaacccgttctgtcttcaatgacaggatttgcttgtgttgtaaaaacactttaacacaagtgcttccggtgcctgggctgtgcctgggtgattgtatttcttttacactactgcgtctttatcctaagtcccactctgtatcctctgacctaggttgtgagaccaactttggaatgaatctagccagtgaattacttctatgtttgatttcctttttagattaactctgataatcactagattgaaatgatgaaaaacttacactgcaaatggcagtggtagtaaatctttcattggttttgcgctgcttgctctagacaggtcatcagcacttaacctttcctgtttactacaaaagctgataaagtaaaaacagtattcctcagcttctcctctgtcccttctgtcctttacccaactgactttatccaatgccttagccaaggagtgcagcacctgtcgcccttgctagcagctgtcctcagagacgctagttctttagcccaggtatagtagtttccagtggtcttattgcctgtttctttcccgagtgttcttctggcttcccagagcccttttgggttttgagagtcagacaagaaacaaaacaagggagtgaataatcctcaggaaacaatggaccattgtggcttccgaatacttttttctcttttctttcctttcctttccttttctttctttctttctttctttcttttttttttaaatttgaaaaagcatagaaaaaaaacaggtcagggtttattctttattggaagatacttgcctgtgtttatgaaagatgtacaaagatagagatgagatttggttcagggaaagctgcagatgtcattacaaactcccaagatacattgttcttaagacaaatttaggagctatcaggccgaatttgaggagggtttagtctttagaacaatcatgtagtcttgacaaaaataaaaaatctccctaaactcctaccctttagcatttcattaggagaaactgatctattaaaattatatgtatgattatgaaaagtgaattcaagtgagaacattggaggaacctggaaaaagctccaccctgactaagaagcatgatctcagtcgaccaataactcgccttttatacacctgtaaatacatggaatgtttttaaggatataattatgtcagatttagcattttcttttatatattaaatatatatctttaatttctgcttttgaaagtgattatttttttagaaataacagaagtttggcagttgaaaggcaagacatgtgaacctgaaataaaccaattatactaattaaagcagaatttggtgttgggaggtttgtgcctggttgaagaattctttatgccctcagacatatttgagagagggttccattgaagagatcttttctgaagcttcttgactggaaagctttcgatctgtcatttgggaagacctttggtattctagtccttgtagcatgtctcaattggaacttcaagattatgtacaatttgatggcaaatatttgctgttccatagtgagaatagtttcataataccactgtctttatctgctgccttggggaacaacaggacagaaacacaatcttatgtctggagacaataggtgttct

SEQ ID NO: 27047 - DNA, 1115 bp, Mus musculus
gaatcttggataagttactaaaccagactaagcttcagatcccttaactgtaaaatgatgtatcagattttcccaattgttctaacaatgaaatgacataacgtaattgagagattatggcacacaggaggagctgggatcgcgggcttttccttactgggtgcatatataacagtaatgtctcctttccttactaaatgtcagacaatagctaagtcttagcactctgccttggatgccataaccctttccttcttcctgagtagacaaaaatgccccccaaagcggaagtctaattctctccctctgtcccttcaggtctaccctgagatcaaggacagtcaccaggcctgtcttccccccagttcctttattacttgctcctcagacaacaccatccgcctgtggaacacagagagctctggggtacatggctctaccctgcaccgtaacatcctcagcaatgtgagcctcccgtttcatacttatgcccccatgcttatagattttgaccttgttttcaggaactggctccccgaatcttgatcattcagcttttatttggctggactctctgagcctagggttgattttacccagcatccctctgtgcttgcagccatcctgctggtactgcctgagctgtctcctttctcctttcccaccaggatctcattaagatcatctatgtggatgggaacactcaggctttgttggacactgagctgcctggaggagacaaagctgatgggtcgctgatggacccccgagtgggcatccggtccgtgtgtattagccccaatggacagcacctggcctccggagaccgcatggggacacttaggtaaggtcaagttctgagctaggtactgactgcctctcatggtgactgtggtagttagatcctcaagagcagcgctttaggagggcttgtctccccccaaagcttagaaacaagatatttattctgtaaaatgaaagaatgagcttacagtggtgagctcagaaaaagccatcgcagacataggcacagctatcagtcacacatccgcatgaggaagctcaagataaggggttctaagaaggacataatattgtttctgtggtgttcttta

SEQ ID NO: 27048 - DNA, 1119 bp, Mus musculus
ttgggaggtaagcccatgccgggcctcccctgggctccatctctccggagatctggaccatgtcagagacgatttccctgcagacttgataaggcattccgtggacagatcccgtcctgagttttggttctggttcctgtttttagggtcagagcgcaaagttcaacttgtggttgctggggcctgtgagggcccacaggatgcctctgcgggcactggatctttccacttccattatccagcctgctgggagcaagagctgaatgttcatctgcaggtgctttgacttgctcccaggaccctagggccacagcctctcttgtctcagcctgagctgttctccccccgccccgccccctcatactgctcctgtctgtcaggtcacatgggcctttgttcctttccctgccggtcttctgtccttgccacagggagttagttggtggggtcttagcaaagaaaggagtaatgactcgcagggtcctttctctccctgtccctaaggatgacccccatgagcagctgaaggtgccactacgaactctaccctcctcgcagctggtgagacttgtcttccccacgtcccaggtacatctggtcatcgagagaagctgggttcatgcacagggctgctgctggccctggtctgcagtcagcctccttcaggtcatgcccgaggcgatcagtgggtgcaagggtggaccctgtgaaagtgcttggggcccaagggttcatggggatgttctggggtgcaccgaggccacagtggggtggaggtacccagcctttctcattaaggtactcatggtttccaggagccactgatgaggctggaactcaagaaggaagaagggtaagagcctgtctggggaacgggagggcaggctagcacccaggcagggtggtctgtcaggccaggaggatgagggggagacggagatgcagcacctcctgagcgcatagggctttgcatcaggggcttcagcatggacaggctgttcttagtgtccgcacttggattggctacagtgtcatcctgcccagtacatcatcctgggaaactgagggtcagtgtcttatctagataagcagactggaggggaggaccctgcccgaggc

SEQ ID NO: 27049 - DNA, 1193 bp, Mus musculus
ccttagttatcttttacttgacagctaaattgtggccttgaactcactcttgtagcccaggctggctttgaacttgtactcttcctgacttagtctcctgcgtagctgggattagagacctatgccaccaggtccagctcatagtggcttctaatggtgttgggacaaacacttgcctggctgacagagcttgctggatcatgagaatcaaagttgttacaccctactcatctcagagcctctagtacctgctcacacctcagctaggagcaggagggatgttcaggtatggagaggactagacaccatgtttagggagggtggttggttcctaatctctgttctccctacaggtctaaaccttaagatgaatcctcagtcaacaccaatcctcggggctaccagtggagacacacctgggaaccactcgactactgacccaaaggtaccctccccagggctgctcaggaccagtgtgcagaacacagctcctgtcagaggacaagcaactgatgtcgcaagtcactggctatgcctgagatgaaccatggcttcattgcaagatctctgggcaaagatggcaacctgtgacaggaccggaacgtccatgctcgaggcctcttgggaagggacctgctttcagagtggaagtaacagcctggtacagcagatactcttgggacagtgccacaagcacctcccgtttataagcacccctgtaacatgtcaaatgttccgtgtcacagtgtcccgtctctaacgagccccaagtccatccatggatgatggccatagcacctctgcttgcagcttccagcctagactctgtgacagggctgctgacatgttagtgtcacttgtggaagtcccagacacacctttgtggagctgtgcctggacatcagagtttccagagtctctggagcagttggtgatgctggtcttgaactcggagcagaaggggaaaggagttaaagaccaagagtgacccaggcaggagcccagccagggtagctcagctgtcactccggcctaaactgtttgcgctttctccgccgctgcacggcctggtgcatggcctcccgcagccgatcctggttgttgcagatgttgtaatgcgtcagccgtaacagcttgtccacatcttcctggctgtaggtcacttttgtgtagtggtatggggagtcagaaga

SEQ ID NO: 27050 - DNA, 1177 bp, Mus musculus
gtgttccccacccgtgggccatggcccctgggagttgaacaaccctttcacaggggtggcatatcagatatcctgcatatcagataatttacattgcgtttcataacagcaaaaattacagttacaaagtagcaatgaagataattttatgattaggggtcaccacagcattcagaaggttgagacccactgagctagagtctatatcatgatccccgaagcagagcagcgactgacatgattcctactctaaaggatctaacagtgttaccaagatgtcaacaagcatttaactggctgtggtttggcggtcttatgcaggttaggttggagtcaggatgcacctttaaggaaaagatattaaacagagacttaagacagatccaagggcaggcaatactagagaagccaactgggtcctgaagaaaggctgggaataggcccagtgaaggaggctgagaccgaggccctgagaccagtggggcagtggagaaggctgaggctgaggccctgagaccagtggggcagtggagaaggctgaggcttaagccctgagaccagtggggcagtggagaaggctgaggcctaggctgtgagcccagtagggcagaggataagcagatcctggagaggcgcgtggagcttcagagcaaggtgaagcccctggagcaaataagaccaaccaaaagggtctgtcatgacatctgttggctcttaccagatccctctgctagatagcaaggggcacagttgtggagacgagacttgatccttagtggcttgggtaggcagggacacacctgggacctctctggttgccctcccgtggggtactgtccctacaccccgaccttggcttcttcttcagcttcacaggacccgactggaggagtcaatcgccctgtttagcttttatagctcctgtagggagcttcagtcctggctggagaagcagaccgcactgttccaaacattgcagccccagggacacaacttagaggtcatacaactcaaatatgaggtaagccacggaggtaatggagaccagagtttccaccactgaggcattgcttaacggttttgtcccagccaccatatttattttggtcctctctggggagggtccaaggctgtaggtctgactctgggggctagtgactcaaagtgagcgggatgt

SEQ ID NO: 27051 - DNA, 1906 bp, Mus musculus
tcaaccagggctatggggagggggccaaggagggggccgatgaggaagagtgggtcgtggctaaagacaagccggtgtatgacgaactcttttacacgctgtcacccatcaatggcaagatatcgggtgtcaacgccaagaaggagatggtgacctccaagctgcccaacagtgtcctgggcaagatctggaagctggccgactgcgactgcgacggcatgctagacgaggaggagttcgcgctggccaagcacctcatcaagatcaagctggacggctacgagctgcccaacagcctgcccccacacctggtgcccccctcccacaggaagtccctgccaaaggctgactgagggcccacagctggggtgggaggggtggtgcctgggcctgaagtctgctctgccactgactcgctgaatgtccgtggccaaagttccgtcctctccgtgactcggttttctcatatgtagggcagggagggcagatcccggacactagatgaggtctttatgcctctaaaatcctgaagtttctatcaaaatattgagaagagcagtatatagatatggagatcaaagaataagaagaaaaaaaaattatccaaagaagaatgtaggtgtgacacaggctgtcgaagtctgggcactcagggattgagccagggactcactggagccatcagagctgtgctggacagtaagttaccatgagcctctttgtccttcagggggcactgagaggcagcaaaggacctaatttatttttcttactgtgtttcctgctctatctagagaggaaaaggaacagaacagagagtttctgccttccatagattaaaaaccaaagagaagactaatacccaggtttgaaagaggatgtgccatgtctgtgtgggcccatctgcagtccccatcagagtaggcagccaggcaaggagaacctgtcttgtcccagcacctgctgcctgaccctgccaagcctccctcagttaggaattcataattcacaaactgtcagcccctggcaagacctgtgtgcccttcaaccactgaatgtccccaaagcttttttggtaggtggcagaatttaaattcaataaagcttgtcttgatttgtgtggagtcccagagccttcggacccaggtaaagcgagagcagccccatcctgagctgtgagtggaagagaccagcgccctggtgattgatgatgttgtttgatttttaaagaaagaaatgcatttcattgtgtccaggtatgtttttctcacaagatgtagcctctctgaagaaatctctgtaataccttttcttccaagctagacacctcacatcaggagtgcctatctgggccaggattggtctacttctgcctcttcagtgttctttcccaagcccacctagtcaggcgccgcaggggctgcctcctactgtaccctgctctgtggcccagcagaagaacactgtcaccatcacttacgaagtaggaatcacagcgcagcagtgaccacatgaccaacagcagcagaaatgaatgaatctgaacagcatccctgaatcttcacaaaaacatactccaatccctaattgtctgcatctggcaacctcagggtcagaaccggggatttaagagaaaatgctaagagctcacacccatttcgcagcacttgggaggcagatgcagggggattaccatgagttcgaagccagtctgaactacatcgtttgttttatggtagtctgtgtaaaacagaatacttacgccaccattcacacttcctatcttactttctaaataatggttttaagagaaacacagtgtttgctttactctgaaagcgtgtttttattaattggacacacacaggtgaatgtttgatcccggggctgtaactgtatttgtgtc

SEQ ID NO: 27052 - DNA, 1490 bp, Mus musculus
gggcctgtaatgttttagaattaccatagatatactgttataaacatttaacatagaaaggtatttgtgaaaaagaattgtttgagccatttatatagaatttttttggaatttagacctttttaagttatgtacttaaaataaatcttttcctccttaggaacgaatgatcacacactttgaaaggtcaaagatggagtaaataatgggaaactgccatagaagatggcttgtatcagggaagagacagcttgcgtgtcagtcttctgcactgctccgtgggattaaaggaggcaatgacatctgttcctgatctctgtgcatgggagctggggagaggtgtcagccaaggagagcagcttactgaaacatatccacgggatgagaaaaacctaccggcttctttacatcatcgacaccctttccctcccaaccccatcaacagctgtttttgcaagctacatgttgtccctgaactttctattccattgtttaatctgtcaaactaggaagtttaaagtttatgaaaggactgtgtcatttacaccataatttgtcatctctaggagcaactgcctgtgattttatttatttaggaagttggtaatgggagaaattatcatttatttttgagtttcctgagaagtcaagattacatcttgcagaagtagtttgtggggaataggcccttttgagttaaggaactatagatctatcagtgaccaagagggaatggggtgggcagaaagcgagagaaacttacatgtgattcaaaatcaagtgcaattttgtttacaaatggtgtatattaaagatttttctatttcagatgtgctttaaagagaaatactaactcttctgacatctgatattatgacacatcccattgctggcaatgtggtgcacactccaaaacttttaagtaccatttagtcagcctccaagggcagcattgcagtcacaggccatgcttggtttcccttcatgccattctttgggattacaccagatgccaagaggcactctgtgtacgtgctgtgattattcgccctgcaagagggattatcatgcttcagaaggggagcttacagagaggggacaggtcccgttgctttacaagcaggtattcttgcatgaagtggtatggaggccctagactgctgctgctgctttttttttttttttttttttttttttttttttttttacagattgagggttctagtttctgatgttggcttggagacggcctataacatcaccagggatgggttcacttgaagcactgtatttcagttttgatcgttttatccagttttgccttccctaaatttttgttctacatgaaaagttcatgccactttttaatataaaaattttaacaaaactagtgtctctctcatttatttcaaattttcccttcacacccttctttcagaccctagtagagactttctttccatgacttttactacagattatcttatttt

SEQ ID NO: 27053 - DNA, 3045 bp, Mus musculus
acatttaagcagtttctaagaaacctactcttctggaacaaatgacatacagtggtttgtgctgctagtttataggtgtttattaaagatgcagattttaattagttacccagtttgaccctaatcatacatatagtttattgattcagtttgtgatttttgttttatgttcttatgatggcttataatagattttttgagatcagttttaattcctccttttgaaataactgggtatttaaatttaaagttttctttttaaaataattatgtgcagtgtctcactattgatgtagctggacaaagctggctatgagtgcgacgggaaacacagtagtgtcctgaagtgcctggctgccctgcgtactgtattttagaattcagacattgtccatgatcagaagtccctgaagacggcacttcccagtaatcactccagagtgctcagtgggtgtcccctgcgcgtctacactcctggcttcttgagtagaaggcacaaacctttattccctttctagctctggctcttggaacctcatgaagagttgacaccttttgcgttgctccgttgccagcccccatcgttcctactgtcttgctgtgcctagagcagtggcaggccaggcgtccaggctgcttccacccactgcaggcaccctagagagggagctgggagaagcagctcgagtcagttgatcggcataggtggcaggcagagctagtgaagccggtgcctgtctccatgctcatgccagccgtagagtggagtgtggtgaagggaaagctatcattgggagtacccatcttagtggatcttagtgggatggctttgttcttggatttcttaaagacttgtgggtaaaactgaacaagttttactatctaatgctttgtttctagatttcaaacctcagattcttcagagcgagtggaccctcatgccacataccctcactttctgctactgggattgtggcctctttttgtccctggcctgatcagacctccccatagactctcctaggaattgatagaggctgtaggcaggtcctccctccccgcaccccctttccaggaaaggttccagtagttcttactggattcagaaaatgttaactaatctaggagctgacactagctcatgcatggccacaagctgttcacatgtggcctattgtgtgggaaaaattttgatgaccacgtggcttagatgtgaagagaacctttgtgtgatacagaggagatactgacagcatagttatgagattaggaaccctttcccacctctcccctccacttcctgtaagggtgtgcagaggaggcacacttttgtggtctgggaagtgattgcttaggaaagttcctaacgagtttaatgctgaccctggatcattccctgggttggtatgctaaggaagctcacgttccctgttcaccaaagggaatatgcaaagtgaggaggggtaggaccttatgctgcaaggaagaaggaggtaaggtgttgaccgtggtgaggaacatgcatgcagtctgagaggattagtacagactgctctgagcttcccttggtagcattgtgggcacctgcacttggctttccttgtttcgcaggggttttcggaagcagtgtgatgatgagttcaagcacaggtgggattgttttgggcactgggtcactgttccccagatgcagtgtgttctgaaaatgaagagccctgagtgtcttggctcctcaacaggagctgcctgtaggagggagaactgtgcgtacttcttaggtcgaccgtgacgtctgttcaccatctgcctccagtgccctcagaaggggcagctctgtcttgctgacatttgtttgactttgttgaagggaggaaagtaactaatacctgacaaaatgcaagacagttcttacaagttacttaaaggtttttaatgttcatatttaaaaaaattctttatgctgattgcaacagctcaaagcaaagaaaatcttttaaaaatctcttgtgtatattttcagttctaataaaataccaggcactttcaattattttgaaagtttttactaggttcaaaacacattttgacacattctgctagtctgtatacaggagcaaaaggagcaaaaaggagcaaaaacatgtcctgacatgagcttgagacgtcatggttagcattattacactcgttgctgtcgtgaagaaaatgattttcctgggagaggttgcagttggaggtttgaattcatgaacacataacagtctgaggctacacttttatggttgaagtgattgttgccagcaaaggttttgttgttggggtttttttgttgtttgtttgtttgttttcctggtagattatcatggcacaacttgaggacatgggcatgtggctgaggtgctgagtgtaggtgcacacttaaagaatgacacagcattctatggaagataattcattgaggaggaaattgaaatatattgtaaagtggggttgaacagtaagtaggtttgcttaagttcacatacgtttacttagcaaatttgttcctgttgcttcaaggaaggttctagaattactataaagactgcacttgccatacttgtggtggtttcacccatgtcctatcattgagagccttgggtttgagggagttggcctgataggaaggaaaggaggaagctgtggtgggtctcacctggttccatatgcagatgggtaggaaacctctgtaaaccaaacctaccacttacctccgcttcaactccagccccagggacatggcccagactggcccagaccagctcagcccagaccaggagtagctcagtgggggcagagagtggagaaggaaaggctgtggggggaagtagatgcccagagctaccccgaaccttggtttttcaatatggattagaagaaatgtcaggtgacatttgactgcaaagatatttctaaacagccttcttacattttggtataaaagctgtgaacttcataactttgtaagtgagatataaagcaagtacaagaagaaaataaaatact

SEQ ID NO: 27054 - DNA, 1249 bp, Mus musculus
acatgtacacacatacaataaataaaaataaatctaaatgtgtttaagaaaacaggtacctctcagcagagaaattttgaaatgtcatgagatatatagcatatcttttagggggataaaacacaatgagaacataggcatggtgcttccagcagtatgaagactgaggcaggagaattcctgtgtttgagagtagtctggactggctatatggttcaagactcagctgggttgcatagcaagacccttttcagaaaagaaaaataacagtggaagagtcctaagtctggcagagactgtgctggagtcaggtggttgttagggtcaatacagttcaggtcaaaggtagaaaataattttccgtgtagtttgcccaactaggtcagggtagggaagtcatgaacagcaaagaaggttggagctgacatacctttgggatttaggatgggcagtagatgggagggtttatagccactttagttagctgtttttgaatttttttttttaaattgcttttatggaatgatgggttgttttttcagaacaacaagcgacaggagatctttgaatgccatggccctcgggcagtcagctgcctcgcaacagctcaggaaggtgcccgaaaactgctggttgtaggatcttacgactgcaccattagtgttcgtgatgcacggaacggactgctgctccgaaccctggagggccacagcaagactgttctgtgcatgaaggtgagggaacggatgggattgatggcgtttctgctgctgtgcggtgaggcttagaacaggcatcctgtaaagagcacagtcagggagatcatagtcctttgtgcctgggttaaagcacaaagctagcaagaagcaaatgtattttattgtggccgcactctgtgcccttctaggatagttcatagttgtcctgcataggccatgaactcagcaatgccctggcaagttcatcagtgtctggtgagtggtaaggcatgtattttcagttagaaaattgtctgggaaacattatctcatgcagtttgcattcatctcaaaataggaaggaaattcacatttaccagtgtgcttttcaagttacagaggagacagaacttccgcagaagtgactgcgccatttctctttcaggtagtgaatgaccttgtgttcagtggctccagcgaccagtcggtgcatgctcacaacatccatgtaagctgtgcggctgcagtggaagggttttacatgggagtct

SEQ ID NO: 27055 - DNA, 1102 bp, Mus musculus
gctgggtaacatatttgggtgaatacagcagtagactggaagttataacattttttttattaataattataataaaaggtattatctaatttctattgctatgatgaaatgccatgaccagggcatcttctagaaagaaatgtttatttgggcttagagttcctgagggttgtagtccataatggtgggaactgtgtggctggcaatgggcatggtggcagcattaagaagctcctcccatcttgaacctcaggaatggggcagagagtaaactagaaatactgtgaatcctaaacatcaaagcctgcccctgctgacatactttgtccacaaggctataccacctaccctcccccagacagtaccaccaactggtgagagtatgcaaatacccatgacattttagaagctgttgacatttctaatgcaaaccaccatattttcccaattttgggagtactaatctgacctgtgcttgaccttagagtcgaaagtgtgttggtgtctttgagggacacacttccaaagtgaactgccttcttgtcactcacacctctgggaagagttctgtcctctacacgggttccagtgaccacaccatccgctgctacaatattaaggtgagtggctgcagagaaatcaagtgtattaacctttcatgtatatttatcatcatcctacttgtttgacttcctcatttttgccatagtttagcatgctgatacaatcgtgggtagatgggagatttagtataaatcatattttctgtttcttcattattatctgctgattttgtgctgtaacagcataccctattggtcttactttcatgtcatatgccagaattaatcctcctgacaatgtttttaattacatttatctatttacattgtgtatgtatgtgtgtatatctatatacatgtgtgtagaggtcagaggagttttttttctctttctgccttatggtccaaagaatcgaacttggactacaggcctttatcagctgagctatctcactggcccctgttaatttctttaaagttaaattttatgggacatagggaaataagtcagttggtaaagttcttgccttgaatacctt

SEQ ID NO: 27056 - DNA, 1149 bp, Mus musculus
gctcttcagtttacccagccatccctgcagtgatagcatcagagtcaacagagaactgccaggaggttagcaaagatctgaatttttctgtggagcaaggaaattccagaagcaaaggaaactctccctcttgccagtctcctgatcttcctggcataaacagaggtgaagagacagccaaaggcagcagtggatctgaagcctgcagcagttcttttctgagattgtctttcactcccgaaacgcctgcagagaaggaaactcagtctccagctgaccagcctgagcagcaggcagaatccacactggcatcagctgaaactagaggtagcaagaagaagaagaaacttcggaagaagaagacgcttcgggccactcatgttcctgagaacagtgacacagagcaggatgtgttcacggctaagcctgcaaggaaggtcaaaactgcaaaggcagctaaaggggcgaaagtgacaaccagccagactggtcaggagcaaggaactgccagagatgagccagacagcgattcttctctggaagtcctggaagtcacaaatcctcagttagaagtagttgccattgatacttctgaatcgggagacgagaaacctgacagtccatcgaaaaaagatgcctggatcgctgcagaacagaaccccatagaaacttctcgttctggttgtgatgaggttagctctaccagtgagcttggcacccgctacaaggatggtgttcctgtgaggtgagtgtgtgctgggcagcggcttcacgactcttctttcatttactcttttaagtagaattttagaatttctttataaatcttggctcttggagtcggcttggttttcttcttttggtattgttttggttggtttgcttgcttgtttgctttgctttttctttttatcatgttgtaaatttcaagcacatttcagatagaaaaattgattttttgagttagaaattttttagttttgccatctgtcctagtcttcccagatgccaagaaaattttggtgttgtttttcagtgtggcggaaacccagacggtgatctccatcaaagcatctaagcactcttcaggtaattgttgtgttcaaagcagccacagggaaagggggttttagaatatagaagtcaaat

SEQ ID NO: 27057 - DNA, 1185 bp, Mus musculus
aaacaggccagtcatgctgacacatgcacttactcccagcactcacgacagaggcaagctgatctctgaaagttccaagtcaaacgcatagtccctgtctcccaagcaagagatacagataaatgaataaacaagcaagagtctgactattgagaactatctaaaacttaagtaaccgactagaaaaccatggccgaaaaggaagaggaagagggcaaggactgtaagcctgaagctcagtctcagccaaagccctatgtgaggagcacatagacagctgaagacaggaccaggaccaaagccatatgtgtctagggggagggcacagacctttagatccctgctggttcttattttgaatgtttttgagctttgatgtcagtaagatccttgagactctttcacatgttgagatagaaagacaggtttgtactaagcacatgtatctttgaagacactgttactaaactggccttttgttttgttttgttttgttttgacagaacgttctcaggttgaccagctattaactatttccttaagagaggaagaactgagcaagtctctgcagtgcatggacaacaagctcctgcaggcgcgggcagcactgcagacagcgtacgttgaagttcagaggctactcgtgcttaagcagcaggtaacagctgagaagtcctagggacactgagctgcggggtggaccttagaatgcttagccaagtattttactttcagataactgtggagatgagtgcactgaggactcacagaatacagattctacaaggattgcaaggtatttatttagagcatgtttgatgaactgttaatttttgttatctgtcagggctaaagcaaataagttgtaggaatgtcgtacattttcctgcaggtctccatggtttcattctgtaaaaaaacccagagacttggatgtctcaaaaattgtaacagagctgggctgagtggtccaggccagtcatctccactgcttaggaagctgacatgggagagatgggagacaaagagcgaattcaaggcccacctcatctcagagaatcggtgatggagcttggttgttgggtgcttgccttaggtgtggtttacagagtggggttccagtgacagaaggagagggaagtggcagagattgctttggtgaggaatcagaaggactgagttcaa

SEQ ID NO: 27058 - DNA, 1139 bp, Mus musculus
cttcacattccaggcagagtgccagctgtttaatttttagttaccaagctgagattggctgttccccctcctctttgctccacccccaactttcactggaagagcactttagagctggagattaaatggatgtgctgtcaccaggctttctgagtgcagctgccatcatgggtgtgccccagagcagcttgtctttgctctgagccccctgccctgcctcccctttcaccatgtttccttcggcaagattttaagtacagcaattcaagaagatttctcctaaagcctattaatttgaagtgttttacctcttgattgctggaaaagaatcttaaatttattccaaagtaatttataagcaaatatactaacagtggtgagaggagcaccgacttgattccctctaaccttccactgtggccatctgcatacagagtctttcagaggcaactagcaatctggtgagtgtgccatgccagtggggagcattgaatgtccttcatctccctctttccctagggacattagtcatgagtgccgagtgtgccgggtcacagaagtgggtctctctgcatatgcaaagcacatttctggccagttgcacaaagataatgttgatgcccaggaaagagaagatgatggaaaggaagaggaagaggaagagtattttgataaggaacttgttcagttaatacaagaaagaaaagaacaaagtcggtaagttggtttgtttttagttttgctttttgagatagaattagatgtagacaacttctctgtcctgaggatgagcctctagagctttgtgcagcaaagagtacactctactaagtaagcctaagctacactcagccttgtgatttgacattgaaagataagtaagcctgactttaagacccttaaagcttaatcttattttaaatattaagttttgtttgagtttgctatctgaggactaaggactatgaagtgcttttttgaactgttatattatctgtctttaaactcagtcttgtttttagtcctgaaaactatggtcttggttactgtgtcttgaactgttcttattatccaatttttctatgagaaagccgtagagtataagtaaaatgaatagacatttcatcttttatcatttg

SEQ ID NO: 27059 - DNA, 1167 bp, Mus musculus
gagttcaattcccagcaaccacatggtggctcacaaccatccgtaaggagatctgacgccctcttctggtgtaactaaagacagctacagtgtacttatgtataataataaatctttaaaaaaaaagatgtatttattttatgtatgagtacactgtagctgtttttagacacaacagaagagggcattggatctcattacagatggttgtgagccaccatgtggttgctgggaattgaactcaggacctctggaagaggagtcagtgagtgctcttatcttctgagccatctctccagcccttaaaataattttttcactttttatttttccccaaacatgtgtatgtgtcttatgagtttatgcaatgcatatgtgggagtgtttgttagaagagggcatgggatccccaccacaggcctcccactggatacaggcagtagtgactcggccacccgacatgggtgctgggacttgaactccagttctctggaaaagtagcaggtgctcttaaccactgagccatttctccagcttcataacccaaattgttaattgaatatctacagagaaaccccacctaccaccctcccagacctactctacccccagcaatccttttggtttaatctgccttgttttgttttgaaggagatggatgaacacatgcgaagcatgttgcatcacagggaacttgagaacctgaagggcaggtaaggacaacagctctcttccctaaacttactggcatgggggtttaagtgctgatggtgcctgttaacttgctttgtaataatccgtcatgatgattgtcgtatgatggcattgagtcattgttcataattaatagcagtagatttggggcatttaaaaaagataagctgtggtaggtttgtgcatctgaaatctacacatggatagaattcaacacaactcaggcaagttgaactggtgtgaatcagctcgtaaacggacttattcctgcagtgttggtcttgcagctgggactttccataattttactttaggaaaattaatttcttgctgaaatagcctaggaatactgaagcttatttgtgtctgcagaaccaaataaagagatcttaggtgtatttgaaaatgttctgctaatggtttaaagttttaagatgtttaaaagaggcttag

SEQ ID NO: 27060 - DNA, 1393 bp, Mus musculus
ttaatcaagtcaaattaaaaagaaaaaaaaaacataaaaacgtaagtcaaaaagtatccctgggggagggggggctggagaaatggctcaggagttaagagcactgactgttctttcagaggaccaggattcaattcctagcccccacatggcagctcccaactatccataactcctgttgcaggggatccaacaccctcacacagatatagatgcagtcaaaacaccaaactacgtaaaataaaaataaatcattgaaaaaaaaaggattcttatatttgtctacaccaaatgccatatgtataattttctttcatgtttttagtacatggagaggttcacagccaccaagaagaaatttgcatgatattctccaggatcatgggacagacttggaacctctgttgaaatctgactgagtcaaaggctcctgatgttggatacactgcagagaacattttacttaatgactttttcctttttaggactatgtcagataagctgaaggaaagggatttaggagtaggagacaggaagaacccttcatcttgagccgtgtaggtcatggccagtgttgatcttcaaaactatcattagttgggctctaaggaacctgctgttcatgaagggaggaaatgctgcttgccatagctggagactttgagtttgcgaactgtcagctttcataaagtctttcccatcacctctgtgttaatacttcatattttttatgaaattctaatttgtgggaaacgtatgactaaggatgaatgtgtttgttcctgtacactaactcaatagcagtgtttacacttggaacttaggatgtacctaaatatgtagctgtcttgaagagacctttgtcaaaggagcaccaacacaacagccaccgagaatgttccccaaggctgcagtagcaaatttttttttttttactattgcaggtgccttattggtagaaggctctgaaagagctaaaactatatgcaaaaattatacaaaatttttgtttttagacaggtttttgctatgtagcccaggctggcctcagactcaaaatctcccaacctcacacctctcccctcccccacatgctgggattgtaggcatgcgctacactcagcctacttgtaggattttaaattaattttaataatcaagattttcctgaagctttgttaaaaatcatgtgctatttctggtaactcctcccccttttgtatttataactgtactaatcagattaccttcaagaaaaccattgctacaatattttaaaataacttatgtttatcatagttactctctgaatgagagaatattctaaataaaatatttttaatgaactttgtctggaagtaatgttaatcaattaaagaacttttaacctaac

SEQ ID NO: 27061 - DNA, 2155 bp, Mus musculus
tgtccacacttgtgtcatcatatgtatgtgcctgtacacacaaaaatagaaaaatgaaagtgtgtgtgtgtgtgtgtgtgtgtgtatgtatgtatgtatgtatgtgcacgcgcacatgagagagcgagcacattggagtacatatggcttcacttctttacatgttttcactctctttcttcagtgaagcttaaaaatgataactgtggggctggtgggttggctcaggggataagagcactggccactctaccacaggtcctgagttcaattcccagcaaccacaaggttgctcaccaccatctataagggggtctgatgccctcttctggcctgcagatgtatgtgcagcagagcactcacattgaattaaaattgttttactaacaacaaaaaagattaactatatgcatgatagtttattataagtgagttgaacattcttcatacagaagattgtgtgctatgattctgcattacatcttttaaaaccatttctgaattgaatgttcctgaatctgaaactgtcgtgattattcctgtgagattgtagattagctacataccaggactgtaaccctttgaagacttcgtaaagtggtggttccttggctgacccatctagaaacttatgtaataagaggctgagaagggctcagtttgaacagactgtacagtgtagtttgtgtgggatactttctttccttctgagagcctaggatgttggtccgtaccaagtagaaagtacctttggtactggtccctggcattgcagagcacctcgtccctaacagttttgatggtagatagcattcaacaaatgtaacaaagccgggtgtggtggcgcgagcctttaatcccagcactctggaggcagaggcaggcggatttctgagttcgaggccagcctggtctacaaagtgagttccaggacagccagggctacacagagaaacactgtctcgaaaaaacaaaacaaaacaaaaaaaaccatgtaacagctgagttgctgtactgagtcactgctgtgagtgatgacaccaagtctcataactcctcttggcagatagatcactcactgaacctggctgtgttaggaaataaacgctgaggaccaacagagaagaaacggagtcttcgtgtaaaagtttagaattctttgttttggtacttcctatatgtagccaaggcagaacttgaactcactatgtttcccagggtggtctcaaacacatgattttccttgcctctgccgccctagtgctggaatcacagacatgtggtatcatatctggctaaagtttagaggtttgtaatggaaaatactaatatattttacctacttagggttatttttattttattattttagggttattcttaagatggaggcaagtatacttaaaagtagagattgtaacaattgtctcaagattttctcactcatcagtcctgtaagtacttcgccttatgtttaagctaggatctgagttcctttcaaacgtgtgcattaggatttccttactgttttattctgcactgtgggagtgtagcaaacctgctcatcatgctcttaatacaagacttggtgcatagtaaagtagatgttcacaaggaagcagggtctttaccctacccccaacctccaaaagggccctgctaaaacaatagattattgtcttgaaagtctcccgcttttacaaatgtgccatataagagtggtgttaaagttgggtgtggtgacgcacgcctttaatcccagcacttgggtggcaaaggcaggcagatttctgagttcgaggccagcctggtctacaaagtgagttccaggacagccagggctatacagagaaaccctgactccaaaacaaacaaacaaacaaaaaaaccagagaaaccctgtcttcaaaaaccaaaaaaaaaaaaaagtggtgttaaggttttgaacatcacctagccaagttagtaaaatctttatttgtatttcatctcaatttttttaactattcattttccttgtatgaattcttgtgtgttttatgtgtaaatatattcattattttgacactatcaatattctttgtggttttgtaatttttacttttattaatgactcaagctgtaaaaataaactaatttcaactaaatgtggctc

SEQ ID NO: 27062 - DNA, 1214 bp, Mus musculus
tctctgtgctgcccatgctggtctgagactccctcccaggctcctggcattactggtatgcataagtgagcacccaactcaatactctggaaacccacttagcgaccacacatatcaggattcaaagcctctccataaattattctttacatcttaacaacgcataattctctgcaaattaattgaaatctgttctactctaatggacatgaagaccagctacttcctatgctctgtaaactgtttacttatcacgttctgtactcagcattatcgaccatctttgcatgcttgcgtcaatattctgtcattacacaatcgcatacaaatgcacatgaggtgtgcttgtgctgtactaacggcagctttcctcttggtccctgcagtgcagtcctttaaccattgttaggtcttaagactgtgcgtgtgtccagaaatgagtcttggtttagcacaacctgagtgatagaagcattagtgatggttagaataaaagcctgcattcctcaggatcttgtgcaacagttccttccactcgtctgatctcggaagctaagcagggttgggcctggttagtacttgaatgggagaccacccgggaatactgggtgctgtaggctttaaaaaacaaaaacaaaaacaaacaaacaaaaaacagttccttacaccaaaaggagttatttcccccacctctggcagaaaagacatatggctctccattgacatattcctacagttgcctattagaacccatgctggcttccaggctccttcagtccctagtcacaaacccatttcaaagcccacatgatggggtcctggcccttctcatctcctgtgcaatgttatcacattctctctgctctgggcccttccagatgcctctggatggtctctttcttatccacaataataataataaaaatacaccttaaccatggagcagccattctggtggtttccctactgcatccttcggatacaatcatgttctacggaagtatggttcctctcccaggcttctccagctttctgacattctcagagtaaagttccaaagcagaaggaatctattatctcttttctctccctccctttctcctccccttcccacttcttctcccttccctctgttttctttccaatctctctcctcttcaaaggcttagagtgttgtgtggtgtttgggattcaatgtactatgaaaaccaaag

SEQ ID NO: 27063 - DNA, 1069 bp, Mus musculus
gctgggatttgaactcaggacctttggaagagcagtcgggtgctcttacctgttgagccatctcaccagcccctatacatgaagttttattgatccatttatttataatcatctgtggctgtttttgtgctaccaaagcagggatgaatagttggagcaatatttaggccttgtgactcccaagagctaaaatagtatctggccctgctccaaacaaagtagtggtcttataataaagaaatagagactagaaaacaatgcccataggtggggactataggaaggagggaaaaaggtatcaagctagactgcttctcaatatgcagaggatttctagtttgaggtctcagaggagcatcaaagaggagtattcagactctagataggacattttcccttagtattttaagacaccatctgggaattggttatgtagttttatctcagtgagtttcatcttttgagctctgtggcagcacacagtctacagccttaccactacatctacttccctctggattgtccatataattgcttatcttagctgtgctgttactgcctgagcctcagccataagaacaccttgacccagttgcttcacccccttgggctctgttttccttctgcctctctccattggctggttcccatcccaaaccaagtttctggcattctggcatgaagtttcatcactgctctctacaggatgtgctctccctggcggccgggcctcgggaccctgaggagggagtttccccagagcatctggaacagcttctaaaccagatgggccagtcactgcgatgccgccaggtgagatgtgggaagagccacattggctcaggaccaatcctcagagcagtaagaatgacgcccatgtctcctttccccccatagttcctgtgcccaactgctgagcagcatctggccaagtgctctgtagagttggcttcccttctaggtatgtatggttcctcttccaccaggtccctcatgctacattccccaaaccccaaggttgcgtacaagcagggttaggagcataggatgtgctcttctgcctccattt

SEQ ID NO: 27064 - DNA, 1219 bp, Mus musculus
atgtggtccctaagagtagtcctgccttccgggtgcacactgaagcagctggcacttgttaccaagccaaggtgtaaggtacttaattttcacttaaaaagtattttaataggggaaaattttaacaagatatgcttgtaatacaggctcaaagattactcatgttagccacatagttctgtccatatggttagagtggatagatgggcattataattatgcagctgacatcaactgttttttaaaacatttcctgaaagttgcctcttccatgtcacttttttgaagggaagtggggatgggatgtagggtaactaaaattctttctgttacattagctaaatgatgctaaaagtagccggctttcttgctgtcctctctagtcaaacatgtgctaatagtaactgggaaagctaacagggcccagcctttttctttgtgaatttctctgctggcagtcatgctgacagagatgctttctgtctgtctttcagtgtgttgcctccttttctgcatgccgttcacaaactcatcaaaatccagagacaaaacgcctcattatgtgagaatgttttattttgtatgtagggaaaagaaccaaccaaagatgtttctgctctgaagaaaaggaaatggactaattaattatatcgtatgtatcagtagttacatttattattaagtgctgtcctgatacagagatgaaaaagtagaacctggtgtgatggcacacactttgatcctagcactctggaggaaggggcaagtggatttctgagtttgaggccagcctggtctacagagtgagttccagcacagctagggccacacagagaaaccctgtcttaaaaaaacaaacaaaagattaaaaaacatagtttgtgcttttacatgttacatttctttcaggttaaaaataaaaattggcagtcttaagccagctcttcactcaggagtatgatctagagaatcaagctttcggtttggtttgggttttcagttctttgaggtttttattgatggcatatttcatatttcagtcacaaatcatccaaataaggtaaagaacatgactgtagccataatagaagtagggtgtgacagaaattatcttttgggagacaagtacctcctggcttctatctacacaggttactaactcaggcctgtcctgtgcttatttcagtggagcaaagaatgaacacttagttcctaattt

SEQ ID NO: 27065 - DNA, 1135 bp, Mus musculus
aggtagaagcacatcaggagtccgtgcctctgcacaggaagcgtcagtccagcagtgtccgaggggaagaaactcaggcctgagctcttgtttatagctgcctttgaaacagaaaattgaggataggaaatagaatgggattttaggtgattttgcctaatttgttaatcttctactcaaaaagtatatagcaaaattgtttgatatttttatttaaaacttcctaaccttggagagtcattgcgcagacattcaaatataagaagcttgttgccaggaaaccattacctgggtatatttggtttgtgtgtttatttagtgaatctacacctttctttccactcattcctagtatcttccctgaattttacattttttaaaattaatgtttttacctcttatttttaacaatacaccctaatgtgtgttttcatcagcataggataatccaattacctttatttagtcaaaccttgctattttcgtttgagcaacagttcttattcttaactcctatatttttatctcaaaaatgaaagaaatgtctatctagagctattttgggcaaaagtatctggagagggacagagtgggacaatggctttcaaaggtacaagcacctttcccctgactgcacttcctcctctcaggagcctgcggaggagacagcttccctgggttctttctagtgtcagccttcagggtgatctaggaaagaataacacttcggaatgtggcttatacttttagagatttagaaagaaaatatgttactaaggcttacaatcagattttgtattttatacatttagccaataaggaatgaatatctgggaaataaatttagactaaatagttttctttcaatgtttttattacctggttcttgtgttgtttaatgcttgggcttcttagcctgacttccacatttataagaagacgtaagtataactagctagggcaggtaggaagcacatgaggagtccgtgcctctgcacaggaagcgtcagtccagcacagtccaaggggaagaaactcaggcctgaattcttgtttatagctgctgttgacatctaaatttcagtttataaagctgtaaggatgatcatattcgttctaatcttactctcttact

SEQ ID NO: 27066 - DNA, 1200 bp, Mus musculus
aagattggtttttattttgatacacaggcttagtcccttagctgacctctggcttttcacccttgctgttactacaaggtgtccttaggctgtaaaaaaaacagggatgaaaaaaaacgacttccaactcctattttagccacaaatcatggtgttactaatgacataattattacttaggccttgctaaatctgaggttaataattctcctttaaaagctgcacagcactcagaactgtgcatactggtttgtgattatacaaattcagtatagacatcgcttggtacagaggcactgcaagaaaaggtccagcttgaccatttctgagtttcctgtgagataaacccggtttgaaagaggttggtatcatattttgactaaaaatcaaaaattttttcggctctgcctcacctccccaaaaaatacccagagccacaggtgtgggtcttatcaatacccacgagaaaaatcgggtccatgtccacccaagccaaggttaaaagcccactcatctacagatcaaaaaatcatttgatcacctcagttaagcattgccttattttaacttaattaataggggggagagagactggagacgtactattgaaagggcaagcccttcactgcctcccacccaaataaaaaagccaattggccttgtactacaagagccggtcgaactccttctccctgtttcccacctatcatccaaaaatgcggaggaatatcaacttagtgttattcttattatagtgtatttcacatttgttcagtcaaacttagccagagttccaacaccctacttaaaattcaactagaaagttacctaccaagtactaattagcattataaagtcggagcctacagctccaggcttttcagttagttgtttactaagataagaaaggacagtcttagccagatacagtttaccataagaaaagttaagaaatcccatgaaagcaagttttttctttagccctagattccaggcagaactattgagcatagaaaatttttcccccctcaggccagctttttctttttttaaattttgttaataaaagggaggagatgtagtctcccctcccccagcctgaaacctgcttgctcaggggtggagcttcctgctcattcgttctgccacgcccactgctggaacctgcggagccacacacgtgcacctttctactggacc

SEQ ID NO: 27067 - DNA, 1235 bp, Mus musculus
aaggatcaaggaccacctaatgtaagccttctgcagtgcttatgcttcacaacttctttttgaggatgttttggtagacatttgcttggctggtggcatgatgtggcatggaatggatccagtgtgtaagactagcctcctgtgtcccatgctggccttgatctatgtaaccaaggatgattttgcaccgctaatcctcttgtgtccacctcctaagtgatgggattactgatgaggactgtacctggctgaccatggcaaaaaggcagcttctctgggtagagctgacagcagcactaagctgtaaacacaaacagttgtttaaagggtggcattgactggcacatcatgtccttttagcaaaaaaacaaaaacagcttccctgctaaaacttagccacaggcttttgacctagctgacagtaccagatgtgaaatccttcctgtggagtgtgtgttaaatccaatctaaaatggtctgttactcatataacactattctatattgttattattttattttattttggtttttttgaaacatggtttctgtgtgtaacccctggttctcctggactttatagaccaggctggcctcgaattcaagattttcctgcccctgccaccctagtgctgtgattaaagaaaggcatgcaccatcacacatgcccagcttggcacagtttgttttgttttggtgttggattccctgggacaggagttatagacagttgtttgctgccacatgggctcaaggaattgaacccaggtcttctagaaaaacagccagtgctcttaaccactgagccatacctctagccccacaattcttaataaagtgataacagacttgccactgttgtatcagtgatctcagcttgcctggccagtcggtcttactgcacagggtccaccactggggaagactgttggtgacagtgctctcctagcagcctgcatagctgcttctagcactgtgaaggctacctagtagggaggaagctttccagcccagttccagcttgattactgtatgtcttgtgtccaaagataattacatctttggctataagggcttgccatctggttctagtgggcagttagcaatactggcgataacttttactatttggggggggggggcttcaggagcgtccttgaccagcaacttgccaagaggtagcctatctctggcactgggatttttatttaatgatacgtcgtttctgggaacat

SEQ ID NO: 27068 - DNA, 1135 bp, Mus musculus
gagcctgtcttaaaaaaataaaaaggctaaggatatagcttagtggtaagcccctgcctaacatgcttggggccctaggatcaaaaccgtataaaatgttgtaaattggctaccatgcctttttctctggtaatgttgtatactcaggaaaatggtcctaatgggtcaactgccatttgaccctcatgcttactctgctatttcagttatgtaaatatatgcactatgtctttgtgatggctagtcatctgtactggaaagaccatgtgaattacagagtttttctaatgtagttgcagagagtcccctatccttctgaggaagcaacatgataatgtatagaatcagtaggctcttgaggctagaatattatctgtgttaattagctctgttgcttctgtttctttggttttaggttaaatggaatccacccttgggagctagatgcctgtgtagctgttttacctcatcagggttttgcaatgagtggaggaggagagcagccagatatcctcagtgttggaatcctggtcaaagaaagatggaaagtggtaagtctagagtgaagatgggacaagggaggcaggggaagggcggaaggctaacaagcatgttgggtaagaagctttggtagtccagtgaaaaggaacattttaaaggaataacacccgtgttgcttatctgcctaaagcaggcattttgacttttattcctgtgacttgtttcatagacttgtttcaaaagttccaaattttcctgacttactgtagctaatattataaataaaagtgtatttgaggaaaaaacaaattaaagagtttgaaagtacagtgacctgccttatcttgtttccatcctcaacatgtacataattagacttaggcaacacagtttctggttaggatgtttaatcttgtttctcctcctagtatattttgaattgttcttacatcattatgtatctttaaaagaaaaagacttattttttaatgtaataaatttttaatgtaatgaattgttcatcattatgtatctttaaaagaaaaagacttacttttttaatgtgaccatctacagagtttttcctttgttttatgatacaggcaattagaaccaggctttgtttgcataattt

SEQ ID NO: 27069 - DNA, 1227 bp, Mus musculus
aagacatagattaatgttttatgttctagaacactaaagaaatgcttgttcatccaagtgtctatttctgctaatatttccagaaaactcctttcccttcataactgtcctagttcatttcatatcacccacctggttaatgaggtcacattaagcatttgtggacatttctccatctggctaacatctctgcacctttgtatttggtgtttctcgagtgtagtttagcttgggttagatctgaaaagatgctgatcacctgtgatggtctaaagaggaattgcacaactatgcagtttctttcaattaaaaatttcaaaacatgtaaacatctttcttctttaaggaaatatccttattgtaccacctacggcttcagtcagaaacagatctaaatctctctatggagagtgctagctgtgctagtctggaaagcatccttccagtatagacctcaagtagattcaggagaatgtgctcattacgcattccttatacaaaagcctgttatcctcacctgattccagggagctctgtggagtcacaagttctccatcagttacatttcttaaggcagatttctgcagtaagatctcgtctcttggggccccatcctattgtctctcagaaaactcttgttttgaagcaaactctttgtagaatgggaatcagaaaattgccccagtgaatggtcataagagatgaaattagaacactgtatttaagccagttctgcaaccttctatggcttgtaagaaacaggtccttgatttgatgtctaggtgaaacctttcataaacgactgtttatgattaatataaacaacaataacaaaaaagcaacgtaatcaggtgtgtgtcctgttataacctgctgtggttgagccatcttgcgtataaataatgcagctctcctgagtctgtgcatagacctcttgattcttggctttaccgttttatatcaagaccttgtgagtagatcagttgatacttattttagcttttgtggtattgggtaatattgcagttgaaagatgtgtttggagattgtctcttcctttgcccttggctactgctgccatgtgtgtgtctaagtgttttcctgccttctgtttagtgaagaccaggaagtaaaaatacatttgataagtgatcagtgatgcacatttggggctaaatttgttgccatttttatggaatgaaaagtgggttttgcagtaagaaattg

SEQ ID NO: 27070 - DNA, 1170 bp, Mus musculus
tcccattgaaagcaattattagccaaaagaaatactgatttggtgaattgtaggttagcacaagcctgtacatctctccaaatttgtacatcctaaggtgcaaggcatggtgacacgtgggtctacagccttctttcaggttctaggttctgaagttctggaggtaggaggtcagcttgaaattccctgtgcctgagaggttttgccttggcctttgggtaatggttatgacaagtctgaggaggtcttttactacatttatctacaggtgttgccctatgacagcctgcacagtgctactctaggttactccattaatctgaagcagattagaatttagaaagccaggcttagccttgatagtggtcttgtcatgatttcctcatcttgccagttttctatttaaataaataaataaataaatagctcactctagttctgcccagaggttctaattactgtaagaaattagaactcacaattttgatgagccaacattgtctgcatccctgagaaccttaagatcatctcagaataaagaagtgaactatttctttttctattgaaatgataggtatatcctgattagcaagcctgtcatatggacagaacgattaagagcgcagttcctggaaggtttccggtcttttctgaagattcttacctgtatgcaggtatgataattctttggtgtaccaataaaacatgttagttttaaaaaaaaatccatctccttttccctcccattttatcttattttattttgagatttattcttactttacttgtatggttatcttcactgaatatgtctatgtaccatgtgtgtgcctggtgtcctgtgtgccagaagagagtgttgaatctcctggaacttgaatttcaggttgttgtgagccaccatgtgggtgctaggaatcaaacttgggacttctagaagagcagtctgttctcttcttaagtaagtctactttaaaaagacgtaaattatggttttcatagaagaaaacttctataatgtagtagaaataagatataaacactacttgttgtgtgtatgtgtgtgtgtgtgtgtgtgtgtgtgtgtgtgtatgtgtagtcaatggtgttatagttaatgcttgttgaatgcttacacatagtaagacttcataaatatccatagcttat

SEQ ID NO: 27071 - DNA, 1193 bp, Mus musculus
tacaagagcagtatttgctcttagccaattagccatctctccagcttagttcgtcaggtccagtatcacttaaatagaagacaaatacaaaaataaaatctggttgcctatcattgcctgcctgaaggctccaagcctgaatgcgtgtctctcccattgtcagtgaggtgtgaggcagcctgccaggaagaggagagtggagaaaaagcagagaaaagagcatctgaggagagaatccttaatgattttgttttgttttctggaaacaggggatcacacaatgttatccaatctagactcaagcttgtgggtgcgagtaatccatgtctcagcctcccaagtatctgtgctagcgttccctgatggggttctacttaaaatcatgtcctggatcaatatcacaatgttatttccctagagataggaaactgcatgcgctgctttagaatatatgactttttcacttgctttattatttgaatatctaccctttttttaaatagggagaaaaatgaacgatactattgtgtccttttcaacgatgagcaccattcgtatgatcatgtgatctacagtctgcagagagctctagattgcgagcttgcagaggcacagctgcacacgactgccatcgacaaagaggtttgtgaccaccgtgcggcttctgctgctgccttacgcccactctggcattcaggtgttaactgctttttacaaagatggttcattatagacttctctgggcatgtggtaactgttgcactcttgaactcacagcaactgtgattacctgagcaggattagatatgtcagtgtagcagcatggataggggaagggagcctgtgaggctccattcctccctggggtctggcagcagttagtggttgctgggggttttcttcagtgatattgtcactactccagtaaataactccttacccttaatcactcaagcagctataattaaactcagcaaattactaaataaaaagacacaaacatatgagaggatttgtttggaagagggttttagcatgagagagggcaggataagagatgataatgggggttgaaatgactaagtttagtatatacatgaaattgtcaaaaatttaaattttttgtctgggatttgatctgggattttgtccattctggataaatacttttccactgaactacatccttagtt

SEQ ID NO: 27072 - DNA, 1125 bp, Mus musculus
gcacccacatggtggctcacaaccagctgtaactcaatcccaggacatctgatgccatcttctggtctctaagggcacaacatgcatatggcacaaagacgtaatacaggcaagacatgtcataatacacatgaaagtaaataaaatctcaaaagaaatttaaaagaaaatattaatgcgttatattaaagttattacaacagaatgttaaaaatcttgagtgtgatggtgttttcaaaatttataaaccatatacctatttcaagtatatcataaactaaaatgatttcataatccagaaaagtgtagagaaaatggctggttagaatgtcaggtagaaagactatactttcagggatcacttctatagttcgttactagagaagtttctctggctacgtagagcacccgaaaccaggaggatgagacatacctcccctcctgagcgtgaagccggctctaggtgctgcttgagtgcagctgcctcttgtcattgatggttgttcttctgtccttcaggagggtgagagggagggaatgcagtctgagtggacttaaaaaaatgtcaggtaggaaacaatgattatcaaagaagagatgccacaaagcaaaatgcttagtggtgttgagttttgtgtctcttgcttattcccataaagttgttttgtaaaatatgcaatcagactcaaactttaaattttatttttatttattttcaatgtgtgtttatatgtgtggacatatgtgccacagtgtttatttggcagtcagaggacaatctgcaagagtcagttctctccctccactatgtgggtcacaggaactgaattcaggtggccaggcttggcggcaggtggcctaacccagtaggtgaacgtgctggccaagactcagttgtaacacttctgcttctctgtccatcactccctcaggaccatggtttgttggtgagataattgatggcaaattgggttgctgcttttcatttgggatatttgttgatggacatttcctgcaaggtggtctaacatttataaatggaattatacaggtaagaggtccccagaggaacacccaggccctattggactaaccatgtgacaggagctccagatcctactctgc

SEQ ID NO: 27073 - DNA, 1208 bp, Mus musculus
cactcaataaaggagcaactgttacttttgtgcaaggaccaatctactctggattgcttaagatccgaggtgctggtcctcttttgccggaccaaaccggtatcaggtcgtcagcctccgattcacctaaaaatgttctcaaataagaggatctacacaagttttttttttccctgcagaaaatgcctgtacaaagaggtaacttgagctctccaagcgctagctgttaccgaagcagctggcgtgttcccaggaaaacgtaatttggaaagggggggtggggggggggaaggtcaaaaaacctctcgcgggttttggcagagagcggtcttctcggaagtgacgcacccagaagcggatgagcgggagctcggtaagtgttctgtgtgcagtattgctgagcaccttctcgtcatgggcccgcgaggccgccagcgccgggcgggaacggtccagagcaccaacgacagcagctccctcagcaaacgatcgcttgccgcacacggatacgtgcgcgacccctttgcggcgctgctggtcccgggacccgtgcggcgcacgccgcttatccaccgcggctattacgtgcgcgcgcgcgccgtgcgtcactgcgtgcgcgccttcctcgaactcactagcgcgctcccgtcccggaccagagcccagatcctgtccttgggctcaggctccgactcgctttattttcgtctgaaagcggcgggcctcctggcccgagctgccgtctgggaggtggacttcccggacgtgtctcggctcaaggcggagaggatcgaggagaccccggagctgcgtgcgcagaccggtcctttcaagatcggggactcggcgtcatctctgtgcttcgagagcgcggactaccgcatcctgggcgcggacctgcgggagctccagcgattaggagaggccctggatggcgccggcctggacgccacctctcccacgctgctcctggccgaggcggtgctgacctacttggagccctccagtgccacagccctcattgcctgggccgcccagcgtttccccgacgcccttttcgtgatctatgagcagatgcagccgggggatgcctttgggcagatcatgctgcagcactttcagcggttgcattcacccttgcatggcctggagctgtttcccgtcgtgaaggcccagcgccagcgcttccttcaagctggctggactgc

SEQ ID NO: 27074 - DNA, 1497 bp, Mus musculus
attctgaaccacaaaaaaaaaaaagttaatttttacaaagcatcttattttggactcttcttgtttgcattgcagactgatgataaaggtgtttttgcgacatacctttctcaagaatatcaactggcagcagaaacatttaatttgaccccatttcaggtgtgggatctgtcctatgaatccatcaactacatctttgcttgtgacaacaccagatctgaactgagaaaaaggtggactcacttgaagcagaaagtgttaaactgtaatgaggtgaactacttttgattatacattgtagccaagatcttcctgccctgtgtatcctactcagttactgcccacttgaaatgacttcccttgaatttgggtagccaagtatatatggggtctaactccagccccttcaactggtaagttcgaggttttgcatggctgcacttccatgctgcttttgctggagggttgtttagccctcatttcctagtgactcttgtttttacacttagtgctctttagacatttgtgaccgtgaaccttctgagaagttgaaactctttgtcttcagggaaatctctgttttgttaggtttaatcagactccttccacttccttttaccctttcaagtattaacttttttagactgttgatgttaggtcacagtgcacacctgaactgtttgtgtgggtgcctagttgtcaggtgactgtagtaacaaagctagaatctggctttgcccttctcctaatatctttagaaatatataacgggggttggagtaatcccttcagtttaagaaaagaaaagaacgactggcttgaagtaaaaaagacacatagctggagcttctgatttaaaatcaggttctatttggcttccttgtggaagctaccaggacctctacagtgctaggactctcttaaaagatctttgtagcaatggtagcattgtggcttctagggttcttagatcaccaataatcccatgcccacatgatagcctacaggtatagacttatataaacacacatataccatggccacattagccgactttagcagataacaaatgtcttggttggtttttttcacaagctagagtcatttgggaagagggaccctcaactgagaaaatattcccacaagattggcccaatcagtgcttgatcagttagtgggcccatgccacagagggtgataccacccttagggacatggttctgggtggaaagcaaaggaaatggaacaaggcacgaggagcaagccataggcaacactcctccatggcttcagctttagttcctgcctcaacttcccaggatgacagactacaaattataagaggaaataaccctttcctccttacattacatttggttatggtgttttgtcacagcattaaaaacactaaaacaataatgtatgcttgaattgctcttttttttttttgtatagaatagaatagagtttgtttagggcatggggaggggggttaag

SEQ ID NO: 27075 - DNA, 1907 bp, Mus musculus
ccagagttgcattttggtcttctattgttcattaaccccctcctccaaatctagtaagtgccccatgaattgttcctacctgcccagagtcccaccagcctgggtatagtatttattatagtctagccggagcagtaactgagccaaatctgagttgatctggtgattccgaacactggaaagaatcttgaacaggagtgaagactggcgactaaagccctgttgagagacccgagctgtcagtgaccaggctagggtactgggaaccaagggggtctttggaaaagctttgcttaaatgtttgcaggaccacctggccttcccatattcccatttctatcagctcctaacatgacttcttagtacatgtccgtgagatgcatgactcccatgaaagtgctttctcgttagtaggaatttaacagctcatttaagattaatatattccatcacatactgggattgcagtgatcctgctttgttacaaggagataaatatagtctgagattataattataagtgagataggaggctggttcagggaaggaagtgggatgtgagaaaatgagcacaaagccagtgcatacttggtgggctgaagaaactattcagggctgaactatttctgaacactgtgaggcagcacattatatattcaccgataccagcgcttttatctttttatctcgtcatttctatgtctgttctggaaaacgctttattgacccggagcagactgcctgctccacagctggggggagaggtatgtattttcagtggctaggcagactcaccttcacgagaatgctcagctgggccgctccgcgctcatccagtggacctaggttctgactgaccagtgaacaaaaactgtgacagagatctaggatttcattcaggcagtgaaacacctatccaaaaatatagctggcgttaagaaatgaagaaatcgctgagaaatgcaaggtttgggaaaatagtttttaacagcctactacctcccatgtctgatctcagcagagacaccgcaaccttcaaagctgtttggccctcccaagtaacacacagaatgaacatcccttcttgggacagctggcttctctgactccctgcacaaaacctctgctctagtcaccattaactcctccttccttagacccactgagaatgctcttgcctttgagctctgagtgttgttccctgagattctcttctctttactaacagttcaagcctcattctctgtgaactactccttccccactgcagcctttagcggtctccacccttcttctgttgtagtacctgtgttgttcactggtgattgtcgggccacccgtgctgttgctgacttttgtatgtacatgtcttgttgttttccaactagattgtgagctccttaagggcagagccatgacttatacctctttgtatccccagtgccttgcatacagtaagcactcaataaagacttcaattatgatgacctgttgttctaacgtgctcttcctcaaggatatacccatgctatgcaagaacagtgccaaccactgagagtggcagctgcttaagtcactccttctaggtgtagcaagtaacagccccaaataccagagttcaaagaagccccataccatttatggttggtgcccggatgagtacagcttgctcaccacagagatgaaagcataagcactccagggttatctgagttgcacgctcaccttgggattggggccagcttgtgtgcttgcagttattggtgctgagaccccaatctgcacgtttgacttaagtgatttctggccttagatttttttcacaagttccaatatgtagtcaatgttgagtagctgtcagaagagctaaatgtgtgtacttgcagatggacgtacacccagagcat

SEQ ID NO: 27076 - DNA, 1213 bp, Mus musculus
gagctttattttgtggcatcactgtcaaggttatcccaggctacctaaaatgttatacttccaaaaacagtttaaagtaggtgagggcctgggtaaacagtagtgctaaagttgagtgggactgggaacagctctgggtatcaggagtttattgacagatgacctgctactgggaacatgaacatgaccagttgttaatgaatggacagtgactataaatttgctgggacggttttctataaaataagctgtcacaactgttggaagttattccttcctcacactcatcatcatcatccctgttagcgaacggcttctcattctctaaataaagccagcggtctcattttttctatagtgccaaatagtaaatacttttaggctttgtgaccacacttgtctgtctcaacaacttgtcttgtctgtgagcaatcaccgacaatagctaaattgagtatgtgtggctgtttgaatagtactttatttacaaaaacaagcagcaggctgttatctgcttttagaggtgaggtaacaaggtgggataatcctcctgggtagttgacaagtacgggctcaggctttcatagtggttggtagacagtgtagatgaagagaggactcagtgactacagactgaggcccggatgtttcattcttgtccagcttggagggaaagatgtcagtgaagtgttttgtttatgctgatgagaacattagtatgttctcagcccgtggtggctaggctatctgaccataaaaccttaactcatgtggcaggtctaaggtgggaaaactgggttgcagtgaaaactaaattgtttctaaatctaaacaatttgacctctatcctctttagccagaattgcccttttactagtctgaaagaattagaactcactggctcaattcttcagataaaggatactcaaatcttaaattttagggaaggataaagatagtctgtgtagttacaaggtacagaaagagggaaagctcacaggctctctgaagggttttctcatttggtggtgacacagaagctgacctgttcaggagcgtgattccgttcttacatgagccaacccactgtttactgtggttatcttccataggaatatagtaagtgttcaataaaccccggttacacaaatgaacccacccaacagatgtcttcaaaatccttcgtgtggtcagcagagggatatcagacccc

SEQ ID NO: 27077 - DNA, 1356 bp, Mus musculus
gtaaccggggtttattgaacacttactatattcctatggaagataaccacagtaaacagtgggttggctcatgtaagaacggaatcacgctcctgaacaggtcagcttctgtgtcaccaccaaatgagaaaacccttcagagagcctgtgagctttccctctttctgtaccttgtaactacacagactatctttatccttccctaaaatttaagatttgagtatcctttatctgaagaattgagccagtgagttctaattctttcagactagtaaaagggcaattctggctaaagaggatagaggtcaaattgtttagatttagaaacaatttagttttcactgcaacccagttttcccaccttagacctgccacatgagttaaggttttatggtcagatagcctagccaccacgggctgagaacatactaatgttctcatcagcataaacaaaacacttcactgacatctttccctccaagctggacaagaatgaaacatccgggcctcagtctgtagtcactgagtcctctcttcatctacactgtctaccaaccactatgaaagcctgagcccgtacttgtcaactacccaggaggattatcccaccttgttacctcacctctaaaagcagataacagcctgctgcttgtttttgtaaataaagtactattcaaacagccacacatactcaatttagctattgtcggtgattgctcacagacaagacaagttgttgagacagacaagtgtggtcacaaagcctaaaagtatttactatttggcactatagaaaaaatgagaccgctggctttatttagagaatgagaagccgttcgctaacagggatgatgatgatgagtgtgaggaaggaataacttccaacagttgtgacagcttattttatagaaaaccgtcccagcaaatttatagtcactgtccattcattaacaactggtcatgttcatgttcccagtagcaggtcatctgtcaataaactcctgatacccagagctgttcccagtcccactcaactttagcactactgtttacccaggccctcacctactttaaactgtttttggaagtataacattttaggtagcctgggataaccttgacagtgatgccacaaaataaagctcactcctctatttttatctccctttgtttgctgtactgctaaagtgacaagcctgctgacaacttcagagaagatcctatgtttatcatgttctgagattaagctcaaagaaacagatgaagacatcccagttactacaaccaaagagattcaacatttattttatcataaaagtccagcaaataaaactatgtacaaggtccatgcaaaga

SEQ ID NO: 27078 - DNA, 1402 bp, Mus musculus
aacagagtgacttatgtagttgaaggcatgtttgtaatgtttggagttctggaattacagttctagctagagttctttaatttttgattaattggtttacaaatgatgaattcaaggtttagcaataaaagaaacttgatatggacagctgatagcttgattcttttcattcttccttaggacattttcattccatcaccaagtctggaagaaccatcagatgatgtgaagaaaggtggaggtttacatagctcatctcttactgttgagtgttccaagacttcagagagtgaaccaaagaatttcactgatgaccttgggctctccatgacaggggattcttgcaaactgatgctttctacaagtgagtatagtcagtcctcaaagatggagagcttgggttctcccaggactgaggaagacagagagaacacacagattgacgatactgaacctttgtctccagttagcaattctaaacttcctgctgacagtgagaatgtcctggtgactccatcgcaggacgaccaggtagaaatgagtcagaatgtagataaagcaaaagaggatgaaacggaggacagaggtgactgtaaaggcagagaagacgcggttgctgaagatgtttgcatcgacctcacttgtgattctgggagtcaggcagttccttctccagctacccgttcggaggcactttccagtgtcttagatcaggaggaagctatggacactaaagaacaccatccagaggaagggttttcgggatctgaagtagaagaagtccctgagactccctgtggaagtcacagagaggagcccaaagaagaaccgatggaaagtatcccactgcacctttctctgactgaaacccagtctgaggcattgtgtctgcagaaggaagcccccaaagaggaatgcccagaagctatggaagttgaaaccagtgtgattagtattgactccccccagaaactgcaagtacttgaccaggaattagagcataaggacccagacacctgggaagaagctacttctgaggactccagtgttgttatcgttgatgtgaaggagccctctcctcgagctgatgtttcctgtgaacctttggaggaggtggagaaatgctctgactcccagtcctgggagggtgtggctccagaggaagaaccatgtgctgagaatagattagatactccagaagaaaagcgtatagaatgtgatggagattcaaaagcagagaccacagaaaaggacgctgtaacagaagactctccacaacctcctttgccttcagtgagagacgaacctgtcagacccgatcaggagacacagcagccccaagttcaagagaaagagagcccagtgactgtagatgcagaagtggctgatgacaagcagctgg

SEQ ID NO: 27079 - DNA, 1147 bp, Mus musculus
taatgtgactgcatttagttgtttgaaaagtccccatagtccgaaacaacaccaatattgtctaaaacttaaagtatctaatgaaccatatctcctaactatgatgttctataaagctgaaaagcaggtcatatattaagagagggatgggggcagaacaagtgcgacatccagcagagcaagcaccaaaacctgtagcccatgtgactgggccctgggcttgttctctgggccccagcagccttgggtgccctgtccccccttcccgatgccctcagcacagatgacctctgttttgggttagctccactgcagtttcccttggcagatttcccatggttttggcatctctgaatgttcctggattctccattgtgacttaaatttcaccttccaaacttcatgcagtggccttgaagggccttgtttcagggagctagccactccccccccccaatgcctgcactcagccacttctgaaactttggtgtccccaatttcagtgcccctcttgtttttacatctttcatgcctacaaaaacagtgctgtgtggatgatgctcccagctctgttggctctagatgtagcttgtccctcttggatcccagttgcagtggcctctgtgtctttgagagtgcccttggagaaacacatcccttggcagccaatttgcagcagggaacccttgtggtggcaatgtcagtttagcctcttttcctttcagatgagtgggtgggttttttacctgctgttgtcccactgaagaacatgaaaggtttctcttcaatggtgtgattaacagttagagatacgttccctgtacactctatctacatctttaaactcagctgcacattttcatagttttctattcttccactgctgatatgaatcggaacagtgaacagagtgctttcctgacatgcagtctcttctgttgaacaaattagtttattactttttctgacttccttagtgacatgtttatagtcctgactgtgctggaacttgctatgtagtcctggctggcattgaacttacatagatctacctgcctctgcctctcagatgctggtgctaaaggcatgcaccaccacatccagctagtccattacttatgaattcagcctcaagttcttaggacat

SEQ ID NO: 27080 - DNA, 1173 bp, Mus musculus
gtattcatgggtacaacatgtttgtctggtacccatagaggtcagagggggaatcagatttgaactgtagtacagatgtgagccattgttgtgagtgctgggaatgaatcctgggtcctttgccagagcaagaactgccaagttatgtctctctcttttttggggtgggggtggggctttctcaagacagtgtttctcagtgtcactctggctgtcctggaactcactttgtagaccagagtcaccttgaactctgggatctgcttgcctctgccttggaagtgctgagattaaaggtgtgcaccaccatgtttggcttcccactaagttttaaagcgatccaggttaatgcatcccgagtttgcagagtaggcagtaagtacttgtcaggtgatggcttgcagattgattttttttttctaagtaggtcactgattaccttctttttgggtgataacatttttttttaaagatttttatttttaatttttaaagatttatttattgtatatgagtacactgtcactgtcttcagacacaccagagagggcatcagatcccattacaggtggttgtgagccaccatgtggttgctgggaattgaacttaggatctctggaagagcagtcagttctcttaatggctgagccatctctccagcctccttatttttgattttagtgatttatttattttacttgcattggtggttttcctgcatgtatgtttgtgtgagagttatggatcccctggaactggagatatagacagttgtgagctgacatgtgtctgctaggaattgaacccgtgtcctgtagaagagcagccatgctcttaactgctgagccatctcttcaaccccagtacttatatatttttaaaattaattttatatataaatggtgtctgtgaggccaaaagaaggtgtcacatctagagtccgaattagtggttgtaagatacttaacatgtgtgctgggaattgactgctggttctctgaaagcagcaagccctcttaatctctgaaactcagaaatccacctgcttctgcctccctagtgctgggattaaaggtgtgcaccatcactgccggctgtctccctcttcttaaataaaacaaaaacccatgctgtcccctttgtgatagctgactgttcctgagcatgtggcct

SEQ ID NO: 27081 - DNA, 1435 bp, Mus musculus
cgtcctggtcctggctagcagcagcactgtggtgatgcaggacgagtcctttccagcctgcaagattgagttctgaatgacctgcgctcccttccctaaggatccactcctacagttcatttagagaatggctactgctgagtcctctggggttgagggaaggcgagccgggcaggggccatgtcatgttattgggacttggggctaagtgggaggtcctgtccttcccctcatctcttcctggggtttcaagaccaaaggcaatgaggagatacacgattctgaaaggtcatctgaagcctgaaacccctagagcaaccccctctcctagcattgccaaatgctggtcttggtgaggatgggtttcaaacagcacactcctcccggtggaggaagattaacaacagtctctcccccagaacctcattatttatttatttggcattccagaaaggattgctgataatttagatgatgcagggaaggccactgttagtaaggtgccagagctgcgccctttcctccatctgccatgccctagccactagagtctgggttccagcagctacctggggacatgtggctgctctattgtcttactgcgtcccacaatatctgaatgtctcaatccaaaacttgaagctctttagaccaagaactagggagaggaaaaaggagctcatctctcagccccttcttcatagcatttacagccccgggctgtacccagaccaggctacctgggcagcacaaagggcaaggagagccccaaccccagttgctccaagctccccaatcacttagtcttcacctaccccattccaataagcctcatttcttctcatcccctgcttggcttctctgcatgtggtcatctgctatggcctggtgtgtaatgggttaaacaataagccactgcctgacacccacatccactttagccatgtgtgactccctaacattccaatcctctaccatcctgcagctgaaatgggaacactggctgcctctctaaacctaaactcttggatagagtttctgggaggtggaggctggactagagaactgggggaggggagatgggagggagggaggaggggaaagaagagaggaaggtgagctatagcttaactcctccagagtgaggagaggctgagcattctactacaggacaggacctcgccccaagcaagccagtgagcagcccggccagaccctgctggactgagagacccagccgctgacagtccctggggcttgccttctttgccaagccaatgggaaaccaaaaggagctcacttcctgttcttcctagctcccctccctgccgctgtgctccgctcctccccacacttccttgctacagttcccagctgctgtaacagagccacctccacctctaacaataaaccaagttcattgcagatggtgtgg

SEQ ID NO: 27082 - DNA, 1199 bp, Mus musculus
aacagcctgacatttggaaaacgtgtcgcggtgcgctcaagtgcgtgcgcgccccaatgccccggagggagggagccggacagacagctcaagctcccctccagccctttcgcgggcctcacttccgcccactcagccctgacttcacccctccgccttccgcgccggcgcccagagcttcactcctccccagcgggtggcgctcagggccgctccggcttcgctgagccccctacttcccaccgaccccccgtccaggcctccgccacagccagaccggcgggcgttcgcctaagcgtccgccccgcctcgccccgcgcgcccgccaatcggcagttaccagctgttccgcccgcccgacgctgcgtgacgcagccaatcggcggctgccacactgcgggccccgagcaggcctagggggttgggacctcggcagcgggtctgcccgggccagacgcgcgagcgcaggcaagcggctgcagattgcgggctctcccatctcatttctccggtcccggccctccgaccgcgacccgccgccatgcgcttcagctgcctagctctgctcccgggcgtggcgctgctgctcgcctcggcccgtctcgccgccgcctccgatgtgttggaactgacggacgaaaacttcgagagtcgcgtctccgacacgggctcggcggggctcatgctagtcgagttcttcgccccctggtgaggccactttgcgggatcagggccggaggaccggctgggcgcgggagcggttgggcctacgcagcgcgggcgccctccactatctagcaggcctggctgcggctgcctcattgccagtcggtggggaaccgggaggcgctccgcccggggtggggggtggggtgaggacgaggtagggtggggacgggggcagatccggaaagcagaaagcctaaactccagggtagggccacgtccttacctccgcgttcttgcagcacttcctatgtggagggttctcccatcccctccccctccggtctatctttcagtatctaggtgagtcagtgtatgtgtccccaggtctgcagacaaggctggcatcccaaagccttcagagaggaggcagaggtcctcttttaagtggtgaggttctggggttttttttttttctctttttgtctccaccccattagagccattggtttctaaccaaggtcactctgtag

SEQ ID NO: 27083 - DNA, 1149 bp, Mus musculus
cttacttgttcatgttttttatatgcattggtgttttgtctgtgagggttcagattccctggacctagagttacagacagttgtgagccaccatgtacattgtagggattagacctgggtcctgtggaagagcttaagactacttcatttattacagtggatatgtgtgtgaaagtcaggtgacagctttgaggagtcagttttctcctactatttgggatctcaggatcaaattctactgagccatcttattggcccttaactggtattctacagaaagttaaaataacttttcttttttcagggtggccgtgaattaaatgattttattagctatctacaacgagaagctacaaacccccctataattcaagaagaaaaacctaagaagaagaagaaggcacaagaggacctctaaagcaacagccaaatgcaccactttataaaaggactcttacaccagagaaggcaaaaccagagaggacagaatggatatactctgaatcctgttaaattttctctaaactgtttcttagctgcactgtttgaaaatacaaggaccagtttatgtttgtggttttgggagaaaattatttgtgttgggaagaatgttgtgggggtggggggaattgagttggggggttattttctaattttttttgtacatttggaacagtgacaataaatgtgccccctttatactgtcgtttttttcccctcatgggatggagaatcagggtctctaaactgtaatacagtaatagatagaagtgtttgagctatgctgttcaatgctgtagctaaaccagatatgttatctcctataatcgcaacacttgggaggtgcaggcaagagatctcaagttcaagatcttccatggctacatagcaggttttgaggctagcatcttaaacaggtttgatctttcaaaaacaaagaaaaccagctatgctgattcctgtaacttgagactgaataggtccagttaccatctccaaattgtataatttattagtttctttctgtagctcaagctgtccttgaacttgtgatggtctccctccctggccctgagatactgagatgacagttgtttctagcctcattcatgtcctaaaggtgaatgcttactcttgccacacagccaa

SEQ ID NO: 27084 - DNA, 1186 bp, Mus musculus
tttctacaggctatgtccgtcattggagacagacggtccagggaacaaaaggccaaacaagagcggtaagtttaaagcacaccaccagcactaccggtaggtcctcgttctccaggggaaaaaaaagtttacgtctttaaccaatttctacagatctagggattacaactttgttagtggaaggaaagattccaggataccttactgtaaaacctccaggggaaagagttggcgcgtttatttgctattttcagtaaaccttgttccacccattttcagtgagtagctgggagtgttccttctgggagtttatagcagaggcagagaatgaaaagaaatgtataaatatttacagggagaaggaactggcgaaggtcactatcaagaaggaagatctggagttgatagtgagtattaattttttaatggattcacaagagaagtgctacctaatttgggctcctgaaacaagtggagaagaggctttggtgacgtgattttcccttttgcagatgacggaaatggagatctctcgagcagcagcagaaaggagcttgagggaacacatgggcaatgtggtggaggctcttattgccctaaccaactgataatgtgcttttttagacattctggactgactgactgactgaaataaagtgttctgttttgctgttttttttttttcttcagtttcatctcagatcaaatgcattatatattctattttattgtcagtttctatgttggaccttgatgaaactgtgtgaacaatcagtataaagaagtacctaatgttcaaatgcaggctcttatattgtgtgtgtgattcctctactgccatagtgtttctaataactaccacatgggaaacaaatttaagtgcccttttctaccaagccatcttgccagctctaagcagcagatactaagtggtatgttagtatcactcacctgactagctctttcttggcaatgtagagtacatttggatcctctgcaaaagatccaaatgcatatgtttctaggatagcttatgcacttttccccttggatctgttcttgtataaaccaggctgtttccaaactgagacccctccctaacttgaaagctgcttcaactaactctccaggctagcttatgagtatcaaaggctagcatctgttttgggggcttttaagttatcaa

SEQ ID NO: 27085 - DNA, 1198 bp, Mus musculus
tgtccgtactaactctcaatgtgttcactctcccagacaggcagcaccagtaacattttataatcgtgtgcgtgcgtgtgtgttgtgtgtgtgtgtgcgcgcaacaacatgccctcatagatgccaggatgcacatatgtaaatcagaagacaccatgagtctgttcactccttccaccatgttgagttctgggttcaagcatgtgagtccactagacaagcatctttacctctgagcatctcacaggattagaaccaacaactttgtactgaaattcttcccttctgaacattcagtttaaaaatgccaatgcacagctgggcagtggtggcgcacgcctttaatcccagcacttgggaggcagaggcaggcctggtctacaaagggagttccaggacagccagggctgtacagagagaccctgtctcaggggaaaaaaaaaaaagccaggggctgttgagttgctcagtggttaagagcactgactgctcttccagaggtcctgatttctattcctagcaaccacatggtggctcacaaccatctgtaatgtcatctgatgccctcttctggtgtgtctgaagacagctacagtgtactcatataaataaaataaatttttaaaaaatgccaatgcacagccacattaattctacatgcccagctagtttcctcataacagagcccccccaaaaaagaaatacggcttctgctagcagatggctgagagaacagagtcacttgagcttattggtggcaaggggggactgataaagctagtccaggaaacatggcaacatactgcctcaaggccagtctggtctggtcaacacaccaagttccaggacatccaagaagtacactgtaggcaagcgtcctactaacagattcatcctcaacccctccattttaactaagtcagaaaattagtaatatggggagcaaatcaataaaaataggtatattttcttatatatgcataaaatcaaaagaaattctagactcagttgaaatttaaggcataaataagtgctgtgactgtagttcagttggtagagtatttgcctcgcatgctggaactctgggatgatagagacttttaagagcctacatgcatgttgatgtatctggtacagggggaagccaagaagtattgtatcctctagaacaacagttacagatgttgtgagctgccat

SEQ ID NO: 27086 - DNA, 1145 bp, Mus musculus
aattaatactgagtaatatatgaccaaactgataaaggattgagctgaggagctgtctcaccgggtaaagtgcttcctgtacaaatgtgagtacccagcacccacagaaagctgggtgtggcaccgtgtacttaattccatagtgaggtggacagcaaacagtagagaccctgtttcaaatcaagatagaaggtgggaccaccaacaccagaggctgtctgatttctacatatttctatatgggtgatgggcctgtccctccacattcactcgaacacacacgcacatacatcacacatacacaaaatgaaaaaagaggatcccttgacatagcttttttaaagaaaaaaaaaaaagtgaactcttgcagtccaaatagttcagggtgaccttgagtttctgatcctgcttccaccttcccagtgctggggtcagaggtgaaatccacagtagccggtttgtgtcaggctcactaggcaagcattctgccacatgagattcatcttaggccttccttggcattaattttggaagatgtttttctaggggattactatgtaactgaggctagcctgaaactcatgatccctgcttcatcctcttgaatgctgggattacaggtgggtaccatagtgcactgtgtgacacccaaccattttgaatgactggtgtaccacagtttctggtgctgaaaggaagtagtgacaatgaggactgagcccctagcccttctcagtttacattctaggacaaaccatggtttgccttttctttttgatagcctttgttacctcctggacccttagaaatgattcctgaaaaccaagatgacagcagtgaactgttgaaagcatctttgaagacatgggcagagatgagccaggtatcacttgggatggtttacggcttttaggatcatgtactaaggaaatttcatgtatgcatattcacttagccctttggtctcttctaatgttgtagacaagtaatgagaagaccaagaaggggctgtctagtattaaaaggtaagttaaaattccttggcttttacttttgacctttgttttatactttgagatgcttgcaatataaaaggtgtaatggatactattataggaaaccttgaaaagtgaaaaaaaatcatc

SEQ ID NO: 27087 - DNA, 1556 bp, Mus musculus
tagcctcagattctgtagccaaggatgacctagaactgagcctcctgccccgacctcctgagtgctaatgtctcaggcacgttccagtacacttggcatctttcaacacttttaattaggctgtattttgcaaaattctaacaaattataaagctttcagtggtcattattaatcttttgtgacagaatgaaactattttgatgcaatagtaatctatagatctgtgacttatttagcttggggtgaataattatttctcaacactggactaggtcctgaaagaccatctaagactaattatgaaacattattgaatcccagagactgtcacatgctagacaagtattctacaattgactcataccccacctttgaaacttaaatgtttgttttgcgtcattcttgagactggatcttgctatgtagcccaggttagctttgaacttagtccttctgcctcacttttccaagtgctgggaatataggtgtgtactaccatgcccagccagaacttagttttataagctaagaacttttttggggatccttgtatctcagctcagttttacttgaaatctcatgatattcactggagaacagttggcttctttgactctggtctgcttggagctcgctctgtcccctgcctctgggcagctcctgaaatgggccaggacagcactgtttgaccttgcgccattatcttgttttctagtgactagctgtacagactgggctccagatgaggggtttgtagtttttcacatgaaaattttggagttttgatttatttaaaaacacagaaatataagactttttgttttaatcccacaatatagggctgcttcatattgtccgcggcaggtgactgtgatttgccccatgctgtagcaggggtgtggttgtgccagctgcagacagtttctgcaaatgcgtgacatttggaattctgggaacttttcagaggttatataaatgctagagcccccagtagacggggtggggtggttgttggttgttcagggggattggctgtgatttgttagtagttgtgctcaaagaagcagcaaaaggaaagaaattagattcagggatctcccttccccctatttctttcccttctatctctatcctcctctctctgttatctagtgttggggagagtggggggcgggggggggggctgggcggcgtggataaagggtggcaagaaaaaatccacaaagtagtaaagaccagctacagccctaaggtggaatttaaaataaaaattgagtcccagtgttgggtaccacttctatccagtctaattctttttccttttgtttcttctttgatcatgactattaacaaacagtaaccaaccaaacccccccacccccagcagccaataaccgctaacaatccttcttggggcccccacatttgcataccctctgaaaagttcccagagttccaaatgacatgcaattgaagaaattatctatagctggcaaaaccacggctctgctagagcacaatgcaaatcatagtcagctgctgtggacatatccca

SEQ ID NO: 27088 - DNA, 1174 bp, Mus musculus
atgaggcagagatcgaatgataatttttccaaaatctctgtgaggttcaggttgtgctgctaggaagatgagcctctgcactctttaatatgctcaggttctagaagaattcaaataaatctacaccatttactcctacacaggggtctcatttaaatttttctttcttctccttctttcgcatcctctttttcttcctccttttccccttcctcctcttccttctcttcctcctcctctacttcttctgcttcctctgcttctttttctgcttctgctgcttctccttcttcctccctgtctcctcctctttctcctcctcctctttctcctcctcctctttctcctcctcctccttctcttcttcctccttcaactatgtggcccttgccatcctggaactcactgtgtagaacaaactgcccttgaacttcctgggatcctctgccttccttgattcctgagtgccaggattgcaggccaccatgcccagctttcatttcgacgtctgtctcttccccgttctgacttggacaactaagaagggaactcaaaggcaatgttatttctcccataaaccctctgttactacccaaaaaacacaaagcctcaaagaccctgggagaatcacacttcagacaccccagaaagagaggctgggggatggctccaatggcaaagtaattgccacacaagcataaagacctgagtttggatcacccatgtttttaaaaaatgagcacttgtaatcccagtgctgggatatggagctgagaaggaccttggtgcttggtagtcagctaggctagctgaatcagtgcctgcaggctgagtgagagactgcttcacaaataatgcaagagcaattgagaaagacatccagtgttgagcatgtgcacacacacatatgcacacacaggaacatacatactaagaaggtagggtagatgttttgagctaagatctggctgaattatccaggctggcctctgactcttaggttcaagggattatctcacctcagagtctaagaagttgggacataacggcagatggtttgcaaaaagccagatgcctttcttttcataaacattcctttcccattcctacaaaggccatatagctacctatatctagcaataattttattgaacagtttactgctctgaatgat

SEQ ID NO: 27089 - DNA, 1226 bp, Mus musculus
tgtgtataagtgtgtgtgatcatcgctgtgtaagcatgtgtatgtgtattgctgtgtaagggtatgtatgtgtgtatcactgtgtgtgtatatatgtgtatgtgtgtatcgtcatgtaagtgtatgtatgtatgagaacacttcctttataaaacagtgtacaagcagatccaatagtgaagagtaagatgtcacttgcaacagggactttgaaagatgcttggtttacagagctgagtgttgatggaacactcagttgatggtgtcatgacggatgatggcttcctactcccgtttggcctagtgtgggtagctggtgcatttggttttgtgttgctttgctgtctgccagctccctaatggcctggagcgcaaggacctggggacagatgctggcaggaggcctttaaaggcagggctgtctagcagaataagctggaggagagcaaaggcggggagagagagagagagacctgccacaagttctttattccccctgggattctactctaggaaattttattttaaatcttggtaaactgaagagaaaaactgttttttctctcagaacactttatcaagatcaggccaataataactctgagagtctgggactccaggagggtttcagccacgacgcttttcctcttctgcctgcacaccgaccagacttcacagagggaataggtgtggataacctatatggatttcttctagaaaggtttcattcggaggaagtgagtgggaagtcttaagcgtaccgatggcacacatgttcatgggtgacttggatgttcctttagagcttttagctgagtccgggaaggtgcatttgaataacattttaaacaaagggaagcggttgtagtttagagttaggatctttggggtgctctgagtcagaaagtcctttctgggtccaagacagtaaaacatctcatgtagggagggaagtagatgaggactcttctccttagtaattcactgccagggtctagcccttctgggcccctcctgcccaccctttgtttctccgtgttcctcagtgagtaagagaaaggcagggaacagtcagctcaagggttaatagcattgggctgagtcagctttacatatttacaagctattcccagagtggttcacacttgagagtatgaagaagaatttaccaaagtaatatgtccttccacttataaagtttttttttttttaagatttatttattt

SEQ ID NO: 27090 - DNA, 3280 bp, Mus musculus
gaagagcagtcagtgctcttaactgctgagccatctctccagtccataagataatgcacagcactagctcttcagtgctgtgagttcctaacattttgctagctctgtctgtctatttccccggtacctgtcagaagtgactctgttctgtttgaaagttggagatgattggtgtttctttgagatggggtttcatgtagcccaggtagacctcaagttttctatgtggtccaggctggtcttgaacttctaatccttttgcctcaggctccctagagctgggattacaggtgtgagccactatgtccagctaagaatatttgttaaaattaaatcttacaaagtaatgatagactatttacacttcagccatgtggctaaggaacagagcactgtttaagataacaagcacatatgggataatgagaaaagattgctgaaaaactggagacactttgaagctggctctttgcagcaactttggaactctattcttgatacatattattttgcttgcagatgatgaagaacgagagcttcagatggatcctgcagactatggcaaacagcgcttcagtgatgtcctttaagtctaagggattcccgaaacccaaagtgctgtgcaacagatcatctctacttgtcaattttgacttttgctgtaaagatcagttgtatcagttgtaaagatacattgagatagatttaaggaaattttaatgaaggaatgtaccaatgtacatatgtgaactttttcatattatattatcaaagcagatactttttttggttactacacagctgggccaaaaacagttaatctttgcattttaaagcaaactaatgtaaatttcacattttattgagcctaatttttttttcacaaagagacaaacaggaacaaatggttgtacaggttatatgctgcacatagtataaccacaatgagaacttattcggctgaaaagtccacattactacatttttgttcccccataggtgtcctctactacccctcagttaacactcttgaagaagttctgaatagttacacagaagtggggaggctggatgccagacagtgggcaaatgtacagaatggccttctactcctttatcttacatgggccctgatgtgagtgtgctgaggcctgatgaaaagcctaggtcaccgttacatccttaccatatctatcagtagttccttacttggttcttgaagttgtggaatgcatggttgacagtgtatttttatttttcaagtaataccagaactgtttaactctggtcagcactggctaaaattctttctattttcagagctcaagctggtgaatacattcaccagttaagagtcagaccctgagagagactgaatccactttgaaatgagtctgcaatcagtacagcaaagctttgctggtagttttaatgatcgtatttgattagacttttccagaactactaagtaagggattttaacaggtttttattaatgaacagatgagtagaagtaccgtgaagtctgcagctattttattgaaatagctgaaaactttgtaataaaaaatgagtatttgtaattaatgttagttaagaacccaccaagctcatttgctagacttacagaattattttcagtgcattgtgtcttttggcattattcattaggatatataagctagctaatccttgtttactgatttcaagcacttttaatttttttgtgttccctaaaaattaaaggtgttgatcataaggctgttaatcccaaggctattattcctttttttttttttaagaagggctgctattaattacacataagcatgaactactagagagtgactgtagctcagatgtgcagaggcctgggtttgattcaaacactaaaaacagcagacaagtaagtagacatgaaaagtccccacactaaggctctaatccaaatactaacagaagtattgttcacctgctgacatctgaagtccttatagttcagtccaaagttatttaatggccaggaaaagatggaataatttattaaaatttgttttttctgctatctcagattatataccactgggcatgtatcacaactgcaatcctagtgttgaggaaacagaaacaggtgtgtccctgaggctcactgaatagccatcctggcctaattagcaagttccaggtccctgtaagggacagttgttcctgaggaacatctacacacacacacacacacacacacacacacacacacacacacacgcatatataaacaagttgaccctctggcttccacatacactcataaacacctgtacctacatgtgcacacatgtaactgcacacgcacatacccacacaccaagaaactaaacagttcatgattttgttatcagtaaagctaggcctctgtagtaaaaagtatggttcacattaaaatacagtcaaaggggagtgacatacaaccatgggcattagaaaggggagctgaacctacaaatgcctagtgatactccatacttgatactgtagaactgtacagacaaaatcataaagatgcctgttggttcctctgttataaaagcagtcacttgattttatggtacctatctatctttatatggaaaaaaacttcaattagcagcctagacattttataaactgaggaatcttggaccaattgataatatttctgactgtattaacattttagtgctataaaatactatgtgaatctctttaaattgtgacattctacagtctgtattagacatgctattttgttctgtttacagtgttttacttctgccttaagatttagggttttttttttattttgttatattttaatatattttgccctgaattaagtgttaatttgatgggaactctgcttttaaaaaaatcatcactttctgggttctaataaattaaaagttaaacttgtttcacagttttgattatatatatataattacatgaatataaacatttacatcttgacattaaaacttgaataaatgttatcatttattttaaggtaaattggactaaaagactagggttgggctggtgagatggctcagtgggtaagagcacccgactgctcttccaaaggtccagagttcaaatcccagcaaccacatggtggctcacaaccatccgtaatgagatctgatgccctcttctggtgtgtctgaagacagctacagtgtacttacatataataaataaataaatctttaaaaaaaaaaaaaaagactagggttgtttactg

SEQ ID NO: 27091 - DNA, 1994 bp, Mus musculus
cgtgctcaagtcctttagaaagtttaagtcgggtgtttgcatataacttttaaataacctcccacatgctcgaaatcacctctaaagtactcactaatatagaacagctaagtaaatgcactatgctgtttagagattataagacaatctcatagaaattatatggctttttaaaagtaatcttttcttcacacagaatgaagatgtccggcctcacatcagagacagatttcgattgcatgatttgctgcccccagattaagttcagagacttgtcatatcactgaagggggggagagaatgcaggacccttttggactaagacaaaaacattgccattactgttgaaattttgcatttttgtaccccgtcttgctttcttatctttggtgcccaataataatcaagggttacagaaagagactctcggattgaacacatacagtgggtaggctaaaacagaagcgtctgtagagtagacagctccagtgagactctatgtataggacatctgcagctcataacgaattctgtttctgccaccagcagtttgacctgtagttacacaggattttatgataataacagagatgaaagtggactttcattctctctctgtttggtgctctcagtgggtttgtagccactcttctgttacttcactattctcatttcaacaggaatggccagtaaaagttgttttatttttcctgttaaggtttataacctttttacatttctgacctgtattagattagaatctcatgatgcattccttttagttaaggcgcttcatagttttctggaaatagtcaatttttagttttttttttaattatacatttgaatggccgttttcctgctttgtctgcctgcatattgtatatttgtttaaaaatattctctacttttagtccatgttaagtttcatttaaaagatgcatttatattttgttctgtaatattctactgtaggtgaaatcttcaaaaatcaagagactgggtagttaagaatatatgaatgactaatattcaaatgatttgaatgaaccattgtgatgacatgtattccagatggtaatatcttgcaatggcacacgtttaatggataaaggtatacctcagacttcactgtgctcactagcctttgaggagaacgagttcaggcacctgttgggcttgattcggttactgctgcctttgggttttctccaggaaggaagtattcagcacagtgactcagtatttttactttgcatgggctggtagtacctctgttatgctcccagttacaatcagtttaaagctctgtgtaacagctgtggtacctaacggtggctatgcataatcctgtggcacagtacactcccgggccaccagtgcagtcaatgtgctcatagtggttttctatgctatatgaaaataagtcgtcacgccttggttctctaatgcagctaccacaagaggttgatatttttatagtggcgtgtaatctccttttcaggaggctttttatggaaggtagaatttgtaaaagtcagtatgctttgcctctcaactgcattaacatgccgcaggctcagactgtttttgtgtaaaggatgtcaaagaacggcactttttctaaagagaagtttgatattttgtatgcttgttaagaaagtacagtattggaaattaaaggtggacaattgataattgaggagtatgtcagttaattttttatgtatattacctgtttacttgtacaacttattgtacaaattacatgcagcttcattttcaaatgaatccttaaaataaggaaatctttttaggaaaacatttaatttttgtatttttgattttaaaggcatgagttgtcagttttcagtgtattaatgaagattttaacttttcatcaggttgagtgttttcttactatattatctgttgtgtatgtagttagcatattgtgtcactgaactgtttaaaaatctagcatgtagagcaag

SEQ ID NO: 27092 - DNA, 1234 bp, Mus musculus
caaaagtgtaaggccaaaaggccttcggttatcaatcattcactttcttattcctctcatgggctgtatttgcctaaaggtttggggggagggggctgcttttttttcagtgctgatgtatttgactatgccattgcttctcatgtcttcccttgagttgaaagcctgctaggactttgcataaaatacctaaaagttctcagagtaagaaccacaaaactcagtaccttatattcaaacgttgcttaaattattgaaatctaagtcacattagaatacattttcatattcatatttctgttatcttgaattgaaattccattgtaaatcaatttagtcttttagaaagtttattctagcatatggttttaatattagtattttaagataatatagttgactaccaaacctacctgctaatcagaatttcactgaggagcttttaaactgcacagcatcctgaagcctgggaagccacctcgtctatacagcaggcttggagagttctgtgtttttaaagctttcccagtgatttaaatagataactttggtatatcctgttttaaataatgtggtttgagaataggttgcaaaatttgaccagccatatttccctgtctctctgtctctgtctctctttctctctctggtagtttttttttttttttttttttaagtgctgggatcatatttcacagaacgtattcaaattcgtggaggaataatgaagattgaggctactgctcattgccagttttgtcattcatacttttaaattaagagtttgcatttatagaactctgaatagctgatcatttacatagctgaaggacatgtccctgaatgagaccattatatatattaactaaaatatttcactatttttttattttataaatctttgtagaaataagcaatgaaatgctactttcatcttttgaactgggatttttcaaggttgtgtccttttggcattaaggtaggggggagttaatattctctctacttatttccacatgaatcaatatgaagtcgtggacatttaaaaatctcaatttaatttctacttatttactatgcagtatagccgtgaacaagtaatgtagatttagttttctcatcttcaaatgccctgattaccctacctcacagggttgttgtggggataaataaaacttttatggaagtactttctttgatgacattttttcagcctttcaaaacaatggaattt

SEQ ID NO: 27093 - DNA, 1376 bp, Mus musculus
aaaggccaccatgaaagacgacctggcagattatggtggatatgaaggaggctatgtacaagactatgaagacttcatgtgacactttaccttctgctgtcttctttctttgcccacaatcccttcaacatgtagcacaacctcctttcctttcagttctgccaaatgctacaatcagaagtgcagtatctttgtgctggttacttaaccccttgacactcaggtgctaatgtgcaaatgagggaacttggatcttgttgccaaggggttaaaattgggaacctcagttgctactaaatcatagtttaaaaacaaaacaaacctaataatgttgtcattgttgctatccgattccatagcagcagtcactaaattggaaacaaaggttgcaacatgacaaaaaaagtgtagtatttaccagcaccattcagtaatacagccttaaccgtacctccttgaactacttcataacttgtcgagaaaagcagtttgcagcaagggcatgtgggatgcacctagtattaaaattgctttgtcttaaaattgaggtgaggatattaaaaacgtgtgaagaagactgcttatctcagagtgaagataactgtggctgaaaagtactagtttgatacttaagattttaatgaccaaaaccctccgacttggaagctgaagaaggtaaacttctccattattacagtgcaagtggtggactctccagtgcattgcctgtctagttatttatcagcctgtttctattgatggaggacttcatatgtgggagggaacactgtttctgtttgcctgattcaagtgtctgagaaacaaatgttctaggctgcagtgggaaaactttgaacagggttttggcgtttccttttctttataaaacgtgctcagcaaactgcaccagttacctacagtttggtaaattgttatgttaacaattatgacatctgcagtgttttataaagcaactaatttaataaaatcactattgtgaggacttaaattttgtgttatatcccaagagatagttgagagtacagaatgccactcatgggtgggggtctctactcactaaagctaatcaatgcttgatgtagtcacagctttgaatgtttgtgtcttcaacagttacagagccttcctactcttaattattttgttgtttagatgctaaggctcaattaagtacctaggactatttatttgtagtaatggagcctgttactaagtttattgctgtaagcataaattggattacatcttaaataatttacccaaacttgtgtacccctcaccccaggttttcacaatcagaacaaaaaatgtttttgatttctcttccataggcaataggaatctcaaagctctgt

SEQ ID NO: 27094 - DNA, 1376 bp, Mus musculus; identical to SEQ ID NO: 27093

SEQ ID NO: 27095 - DNA, 1099 bp, Mus musculus
atttcttcagcccttcacttccattttgacagcgggtctatgtagccctgcctgccctggcactcactgtagagcacatgtctaactgtgtaccatgtgtgtatccagtgcgcttattggccagaagagggtgttgagcccctggaataggagttagggtcggttctgagctgccatgtgggtactgggaattaaacctgggtcctctctacaaaggatttacctcctcccaaccgctgacccaagcctctaccatcactgccaatagatgcttgggtgccaggacaggggagagtgggcacaggagttcacttccagccttaggctgacactagagcttgtgtgctcttgtgtacacacacttgcagtatctctcctccacctcagggcccggctctgggtttctagagattcctagctagggagataccagttctggtcatcttaagtttgctcgcagttctacttctcagctcctcacgcagctgctgcatgtctaggttgtatatggcagaaactcagcagaggaacagagtggagcaagcctattccatctccctagaactgtgctcatgcggaggacggatggagcaacgtggcctgagctgtgcccttccttccccttcttcaccaccgtctaatttggggttggtttgttgtgtgtattttgagacacagcccttagccctaagtaaccaaggttgaccttgaactccagatcttcctacttctaagtgctagaattccaggattgccctcccacaccatgctttgcttttaaactatgtttttagacttaagctggttttttttttctgtttatttgtatcctgggctggcctggaattcactgtatgaatgacagtgctcttgaatttacagagtgctggggttagaggcgtgtgccaccacgcctagctatgtgaagttagaaatggagcccagggcttcatgcataccaagtaagcactcaactgcatgaactagatctgctcagtgtaccaaatgacagagtccactcatataggctgccaaagtacattcaatgctgtcttctcaaagctctcagaatgcctttttgttattttcgcatgcccag

SEQ ID NO: 27096 - DNA, 1099 bp, Mus musculus
gagtgtgtgtgagtgtgtatgtgtgtgagtgtgtgtgtgagagtgtgtgagtgtgtgtgtgtgtgagagtgtgagagtgtgtgtgtgagtgtgtgtgagtgtgtgtgagtgtgtgtgtgtatgtgagtgtgtgtgtgtgtgtgagagtgagtgtgtgtgtgtgtgagtgtgtgtgtgtgagtgtgtatgtgtgtgagtgtgtgtgtgagagtgtgtgagtgtgtgtgtgtgtgagagtgtgagagtgtgtgtgtgagtgtgtgtgagtgtgtgtgagtgtgtgtgtgtatgtgagtgtgtgtgtgtgtgtgagtgtgtgtgagtgtgtgtgtgtatgtgagtgtgtgagtgtgtgtgtgtgtgtgtgagtgtgtgtatgtgagtgtgtgttttcctaacacatctggttgccttgctttgttttaaatgtatgctttgagagggtcatgtggtgtatttgggtcattcacctcttacctcagttcctccacacgcaccctaccttcctacgtacgcagcttcatattctgtgtgtctctctcacctgtgtccacttagtgttggctgactacagctgagcctgaggcctgcctgtcaggacactgggtgccactccactggagaaaactgactcttccctctccctgaagcagccaaaggccaaatagctcctcagcccggcatgggatgctgtgcccacctcccctcctccaagctggaattttgtctagcttgagtttatgctggcctgtgagtttgtatgcattcctgccctgctgtatctggaaaacctgttctcttgaagtcatctatcacctgcagctcttaaaatcttttggtcccctctccacttgacatagatgtccccccagttgggggctgagcactgtgaagtctctatgctctgcaggttgaccagttatgggtctctggtaactgatgcccagtgtcgggggaagcttctctggcgagggctgagcactacacagatctgaagctcagggttggactccagagtcagacacccagcagccccagaggtccctgaggcaggcagaggcagcagattggatttggatggtgactttgtggtttccat

SEQ ID NO: 27097 - DNA, 1195 bp, Mus musculus
acctttcctttccttatggttttggaccagaggcctcataaggaaggaacaaaaaaaaaaaaaagggaaaaaagaggaaaaaaagaaagggaggaaagaaagaaaatttattatccaaatatagttgtatttattctaagtgtaggtaagattttggtgacttacaagaaaacaaaatatctgagcttttaatgttggttgcatgttgagacaacatttgggtatggctaacgtgtaatgctagattgggtttacccttctgtaacaggatggtaagcagcagctaggaagaactgtgcatcggcttgttaagccgctggcttctcagtcatctggttactgtgttggagaatgccctctttccagccctcctgctgtacctgcgaggtggtaaccattcagacaaccttatgatttaaagggtcctgcgtatttataaactgacacttctttaactctaactcagatatttttaacactatggatggcacgcaggtagcgcaagtggacctggctcttctcagagaagattctgagcagctggagcccgccagtgtctcttcctttacatcgctgagagtgtctcaggacttggatgttctggtgctggtcagctcagccagtactgcagttgctcttaacctacatttgtatttcaggtaggtagatggctcaaatttctcatttgaggtaaatagacccataaaaggtttaaaatatactccttagctttttttaaaagcctctttgctatgcagttagatctcattatggctcctacagtaagactgttaccatgcaagagtgtgtataaatgattgtggctgcctttatattttggcttgtatattaaaggtttggtttccacataggtggtattatgtaaaggttatgtcataaataatcaggattatgcagtgttaagaggctcgctttttatatatcacccctacttctttttgtttggttggttggtttttttgttgttgttgttttttcgagacagggtttctctgtgtagccctggctgtcctggaactcactttgtagaccaggctggcctcaaactcagaaatccgcctgcctctgcctcccaagtgctgggattaaaggcgtgcgccaccacgcccggcttcacccctacttcttgtcccatttaagagtagaagagaatggaattcagctgctgttgaat

SEQ ID NO: 27098 - DNA, 1130 bp, Mus musculus
gctgtagggcagaatttgcaagcctttctctttaaaggctttctcgctttccattggcagccggatttctgcccagatcccgcctttagtgctccccagtcaggacaaacaggtttttactttagagatggagcttgctgcccctttccttagctatccattcccttcctttcccttcttctgtgtagccttggctggcctggaatttgctctttagaccaggctggccttgaactcagagctctttccagcatcatacctactactagtcttccgagaattatcaccagagctctcagctcttgatgtctccctgtgaggatggaacggagtcttacattctttagcagcaactcctggtgcactagaaaacccgccgaggctgttttatttattcacaagaaggcaatgagatgtttggcacgcgaggagagcttaatggagacggataccaaataagaaagggggagtggaagccgggcgtggtggcgcacgcctttaatcccagcactctggaggcagaagcaggtggatttctgagttcgaggccagtcactatacaaagtgagttccaggacagccagggctacacagaggaaacccggtctcaaaaaacaaaaaaaattgtctttgtttttgtctacagagtgagttcagggcagccagggctacacagagataccctgtctcgaaaaaccaaaataaataaataaataaataaataaataaataaataaataaataaataagtggtctgcctgaatgtatgtgtgtgcacgactgggtgaatggtgtctctggaggatataagaccgaactggatcttctggacctggagttacagatggttgtgagctgccctttggctgctgggaattaaacccgggttttctgcaagagcaacaagtgctcttaactactgagtcattcctccggccccaggatggattttttaatgtattttttaattgaaatgctaacaaatttctaattacagttcttcccccagcctaacccctgccccccaaaaaactacacactgagtattgtagttgagattcaaagctgagaaaattaaaacttaaaagaagtcctcaggttcttgtaacacacaaactaatcaatagcag

SEQ ID NO: 27099 - DNA, 1223 bp, Mus musculus
ccggctgccaatggaaagcgagaaagcctttaaagagaaaggcttgcaaattctgccctacagcatcttgatgcagatgcatcaggaccacgtgacacatacattccttctttcactcctgcgagtgtcaggccctttgtcggttgctggaaagacagcggttttttgttttgtttttgttttttttttttttttcagagcgctcgcggcgtcctgcctgcagcagcgcactgttcccgttagtaacacaaaacacccgcgctccacctcagacttaaacttgctgttcgaggggtgctagccgggtcttctgcagccacaaatcccccacggcctccgtaggctgctttctctctttactctggcttgctaagtctgagtgaagtctcgtcccccgcctcccccctcccacctcgcgcgaccccgcctcctggctgtcaagtgcgcaggccccgccccgggcccgcgcttcgccttctctaggctccgccccagccccttactccagacccttggcggttggacgagcagaaccaccagctccccgccgggtccagcggacacctcgaagcaagagagcaacatggcagctccagctaagggcgagaacctgtccctggtggtgcacggacctggagacatccgcctggtaaaaaggggaaggagtgtgggaactcaggcagtcacccacccagctccggtttgcccctctggcaggctcagcagtggtacccactcccaagttctgttgctcatagagctggcagatagcccgtgccaagcacccctgactgcctgggtttacccagatctcagctggttaccgggaggtgggggtggggtaattgttatctatctctagagagagttctggtcgcgtgctcccagagcctagaccgggcgccaggcacgtgacctgtgcccaggaccgttgaaaactaatcaagccttcgactctaatagctgcaaactcacactgttgttattgctcttcagaagggtcagagggagacttccaggattaggatctacccagatcttctcttgtagacagtggaggacagaaaaaggtggcatggtggcatttaaaagcagtgaagtttctatttaatcctttttgtttggaactgataatatcccatagcagaattattatcatgagagggcctagcattcagtaagtgttaataatgcattttaactggggatatagcctggtgctt

SEQ ID NO: 27100 - DNA, 1615 bp, Mus musculus
catgccaaagaacttgtaggctttatatggcacacgtctgtcctgggatgagaagctggaaacatgaatggggtgactgaaaatagtctccataccctcagactgcagcccacaaggctcctgtcagaagcactgaattagaaataaatatggttgagcagtttctgagcttagtactttggggggggctgactcttttcctgaaggttgttaatggaatgtttgtgatctcttacaggtggccgatggcaatttccatgcttgcatcgaagacgttgaatgtaaagcccttagttacccacagattccccctggagaaggcagttgaagcctttgaaacagccaaaaagggagtggggctgaaagttatgatcaagtgtgaccccaatgaccaaaacccctagatgtgaattgatctatgccctcagcccactctctcagcatccgagagctaaatggctagaaggggaggccgtaaatgcagaactttcttttgaatggtaaaaataataaactcataagcggagagcctaagaggagtgggcatgccttaaggacagaagtagggacaccttgagggaccttgtagccagaatgagatgcttatactaaggaaagtctagcacagagagtctggcagataggtcctgggaacgccttttctctagtaccttccttgggtgaggagacacgcatgcctttgtgtgttctactgtgattgccagagagtggggctgacttatgaagaaatggattcattaacatggaagtggccccagggctgaacttttggtcagctgttcagagcacaatgtttctctagttaagtgtcatttatttgaggagaataaaaggaacttgtctggacccagacaaggaactgatctggaagaataagataaatcccagatgaggtaccctagcttacattccccagatgtggaaagtataagggcactcggctctgcccaaagactacctctgtctcagctactaagaattctgtccttacatttgcaaagtggaggcccaccttcccaacactgctcattcatgagcaggagcagtattggttgctaggcaaccagattttttttttcccaaccaaagatcttaaatcctgcctagagggccacaggagggcttgccccactcagaggattagactcctctcccagagtcactcacaggcaattatttcccattccactcagttctggctaccagaagatgctcccctctcagctgggtgaggctgctgatatctgtcggatgggtatcacagcgtaatttcatcatagggcttttctttataagatttgggtccaaatcacaccctttgtgatcttaagataatcaagaaatgcacagtaactgatgtaacttgggctgcagtctgtaatccacctcttcagctataagtaggggacatgttaaaaaaaaaaaaaaaaaaaaaaagactctgctggagaagatcatggcccagacctgagctttctcaaactgcttcgcataataaactgttgatggtgtccgactccgtatgtggtttgtgcctgtttaaggagtagacttaaatggccacaaggaagaataacaaagctttaagcagggg

SEQ ID NO: 27101 - DNA, 1170 bp, Mus musculus
aagccgagcgggagcatcaaggagagaggatttagccatcctaaatgtgggataagtgggagaggctgcaaggaagagagaagtcatgggggcggaaagccgaagctgaccggcattcaatagagttctgtccaaactgctaactcagtaccgagggcatccgccgcactctcagcaaaggtcctcatcggtcgctgatatagggtgcggggtggatctgcagccaggagacccactggggaacggccctgcaggcaggagaactctgcagagtccactggtaagggtccaggccccggagaccggcttccccaagacagtcacctcgggtccccggatgctcaggaggtctccggccacctccaacatctctcgcaagccccagattaccgaaccaaagtgaagcctagttagcggcgagaattcaatgcgcctgcgcatcgcaggctctgctaggttggagtcccgcccagcacacgggtcatttagtgacgcaggaagtgggaaggcctatgagtattgaagagcatattcagaagagcaatattacaggtccctggtagctcgccgtgatcgtatagtggttagtactctgcgttgtggccgcagcaacctcggttcgaatccgagtcacggcattgtggcaacaatggcacggcaaggggatccagtctttttttttttttttttttttttaatttccatgttttttacaagattcactggtttggtttgtttttttttttttttttccctcttactttgaaaattgagctactctaacgatcgcgcatctaagaattctttaacgctctaactacggcttcagatcgaacagtttctaatcccttccttctgaaaaaccgttatctaagccattcaacacgaccgaaaacagcgtccctgtgcccttgtagagatttcccgcacctccgtttttaattttaaaaatcgggtcgttcgtttgtaattacagactgcgtgtgaccaagtctaacagaaaggtttcttctcattcttcacgtcatccaccaattattgccattttccagtgccattatcttgccatgatagtcctagtgcaacaaatacttatgtatccatacgtgtgaagatattcctcctcttacataacataccgacacctccaactcccaaaaaattatgata

SEQ ID NO: 27102 - DNA, 1152 bp, Mus musculus
taaaatagtgattcgcatatgagtagattataggcatttaagtggctgcctgggcatttgtggcctttagatatgtctaggggaaaaaaggaaaatgtgcattttattcttaacattttcacacatcagttgagctcatttcttgaaaacatccttttaccataatatgggcatatctggattttcatgttgatatttggtaaaacagccttaaaatccatttgaatattgaaaaagttttcataaaaaaaaacagaagaacttaaaacttctgtaagtcttaactatcatattcatgtaaagtgggtgtacctgtaatctctgcacttgccttttgcagcaggggctagacgttgttcttcatgggtccacaagatggagagctggtagatttttacttgtttagcttgtcagaacccatagaggaaggacattaagtcagcagttagatcagggactacacagctgtaagatctccgtctttctcctttggagacacagtgagtggcacaacctctcagttaactgtgagaactctttgccctgcaaagaagcaggatctgaattggggagatgcagtgctaatcgtgcactgggaaacatcacaacataaaacttggcaattctccactgcactatattctaaggagtattttcagataattaattactgtagacattaacccatatttcacaacttgtgcccaatgcagtcttttgttttaggaagactctgtctgactaacaatcttgctgtcttaagaagcataccaagaatgcagttgagtaagacatacttaacaggcagaaccagaagctattgtaattcttacgggcagctatgttaactttccacagctaaaggttttcatgtgagcagattttcacattcacagcttccatccacattgtttaccagatcactagatgtcttggtttacagtgtttcttttcagtttgggatagaggttttcatttttctctctgacattatttcctgaactctcaacgttgtcttaagcccaggtggcccacgtgtcagtatttgtcttcaggagagccttcccacagtggacacagtcaagatcagagagaaacacgagcatcactctcagttttcagagagaactttcagccaatacttagaaatac

SEQ ID NO: 27103 - DNA, 2066 bp, Mus musculus
tcctggatccccattgctgtacacagagagcgaggcgtggccggtgccttatgccgtggcatgtcctgaaatgtttccagggttgctgtgtctttcaactcttgcttaactttacaattattatttgatcttaaatcatttggaaaatgaaaaacactttggctgttccagagtctgggttcaaaatgagcagaaggtctgagctccttgagaattgattttagtttcagtttctcctttcctgaaggcaggcctttcctgtatggccacactgatttttggcaattgctttttattgtttaaagagaaataccaattgtctgatcacgaatctcccagcaagagagctgctgagcttttatgaagaccataggcagtgtgtgcacactggaaacaccaggaccttagatgcaggctgggagttgatggcagacagatttttccagcccttctcctcagttttcccctgttgctgctgctgtagattttgggttcagggcaggattctatccattcctaatgctgtgcaacaatggtggacctgccagatcctcaaaggcatctctctctctctctctctttctctttctctctctctctctctgtgtgtgtgtgtgtgtgtgtgtgtgtgcatgctacaatgtaacaatgtttctgtacttcctccctccctccccactccccctttctttctagagacagcaggctctctataaagccctggctgtcctcaagaacctgtggggaccaggttggcctcaaacttaacaatccacctgcctcttattcccaagtgctgggattaaaggtgtgcaccgccatgccttgttctggtttttaagtagaacaaaatctgctgctgctcacatcatatgtaaatagtgtacagaagagagggcatgatgcctttactgttttctagaacttttttccctgttgttgtatgtaggagtttactctgtaaggcaagatgaagtatcattgttggaaatcaaaagtgcagtagtatactttctcgtcttagtgtttaataggaagcttgtttctagaccctattgtgtgtgagcagcacaagctacaaaggtgtctgattagaatgcgcatcttttatagcccacattacccttttagtaagctgggattactacctctgatcacatacggggcgatagagagatcgataaagaggaccagtgctcagaacctgtagcttaaagaaaggcataactttctttgaaggagcccgctccttcctaatgaatgaattgtgatcccacagatattgatcttgacttctgttcaagaatataatgagtctatttgaaaggctgtaacccttagtcacttgttgtcactcctagagcacaagtcaataggacctgcaggacaatgtcattaccttgcaaaatgttacaataaaatgcctgatagctgacgaaggctggcgattcttttcatgctgactttagaccagtggtggtgattgtttcaagtgctgttcctggacacttctggaaaacttcctcagtcttaaagtgaatctattctttgttttgcttaaagtttctgccagcgattctggtataccttaaaggatgaggcacttctgggtctggctgccactggcagggtttcccacactaaactgcatgtccttttcacctgggaacttaagaaagtgcagacattaccagttctgttgtggggccatagaagagttggagtgctccagattctgatgcaaggaactggtgggatagaccgtccagtggcttacactcataagcaatgcaatcgtttcaaagctacccagtaatttgtggaattaatcttaagaaagaaattattcactactgcttttgatagaatcagatttaaaactgaaccttagctagcaggaaattaagagtcctagttaatgaattggatttttttttcccgagacagggtttctctgtatagccctggctgtcctggaactcactctgtagaccaggctggcctcaaactcaaatccacctgcctctgcctcccgagtgctgggatcaaaggcatgcgccaccacg

SEQ ID NO: 27104 - DNA, 2446 bp, Mus musculus
cctcatctcttttccaaaacggacgctgcttatgctttgttgcacactgatgcacgcttagggagtgttccctctaactctcactgtgccgcatcgtttactgaacgcaggcttcccgggtgctagaaggaatctagagaaggttgggcctagcatccttggtatagttccggggtgtgctctagaatggtgaggagattggataaaagtgggacgaggctgtacactaatgaatatgttaagtatgtgaaggttggatcaaatcacaaatattattataactcataaaagctcaccaagactcagacagtgcaccattaatttagacacagattctagcatgaacatttttgactagttctttggagtctttgttgttttaaatctcctcagtcttaaagactacaaagtatggtttgtaaaaataaatgtctcgtgtcaaaattttaaagtaataaattagaagcttgcttctcaattacctaactgaagttggaaccacttttataaaagcttttctagtctggaatgctattgctatatcgagcataccaagctcatgtgctgcttcacacggcatgtttaagttacacctgcgttcttttccccattctgttcccctgaatcatcccctttccttttattgacagttgttacaaagatgttctttctttcttagtgaaaatccaagctccagcgttgtctctgctccctctctggctcggcattgctgccatagtttggtgctgctgcttctactgtgtctcataattcatccccctgccttttctgttttgttcctgtcctttcatcttagctcagtcttctgtgaacattgggtgagagaaaagagcctaacatgcatctctgactctgtcttaggaatgctgcctgctcagtggggtatcttgcacgacctcctgcacttccttcctgtcagcctgctcctctgctgcttgctgcacttgcatgtgttggctctgtgtgcaagcatgtgagcaggcctttgctagtgttcccaggcctcagtccagagcatacttatacccctgaatcatgtatgcaataaaagtgtcagctgttgcttcctgactacacatactattagattattgagttaaagcctctcttatcccatggggcccaaaccaattcaaatgctcctttctccatgtgcatctcccatctgagtgtcatcaaagtttattcagtctgcctgtatgaaccatggtattagcagtttatgtttgcttatggtgttcacactttgaaattctagctgatttcattctgtgtctgggaaatggctcagtgggtaaagcgcttggtgcacgggcatgagagtctgagatcagattctcaacaccacataaaaaagcatggcagcccacatgtatactctcagtgctatggaagtcagagacagacagatccctaaagttcactggccagctagtctagcctaatcagtgagctacaggttcattgaatgactgtggtctcaaaaaatgatgtgaagtctcaaagaattgagggctagcatccatgactgactctggcctccatgtctgtgtgttctcccttcccccacacttttagctgattaaaaaaaaaattattgtgagttccttaaaggccaggacttacttgcagttcatcatctctggctccatagtgtgttgtgtaaccatgtactaattactaactctcaatgagaactcaggtcttttagagtgttagatggcagggtgtagttgttaccttcagaaacctgactaagaccatgcaagcttagagaaagttgggagtaaccggaatcttcctgaaatattccactgtctgtccttgactggcgacgaatgaagagctggctctcatcctcccatcccaacagtgtctgctgttcaattctctcctccatagctctggcaaggcagggacaacagggactgcatgttttcatgacatgccggctgatcgtggtgtcaaaacacagcagcagaacatagagcccatatatcagtagcagccctgctccttcgtacctagacgtggaggaaagggctgtgcagttatccagtcattttaaacaatattctctaacaaaagcaacagtggaaaattcaaggaaccactcctaaatgcttttatttacccagttttggttatagtatggttacaaattcattgattaaaaaatctgcctctttaaaaagtaatataaaatccattgtctgactttatagattcctttcaagtaataggcacaaaatagtcggagagttaaaactaattaatagatattttttcagttcatttatttagcatactacatttctcaaatatttaataattagaaaataaaatactatctcttagattttctgatacagaaacatggtgtagaatacttagactgtgctaggtttttgctggagctttgcag

SEQ ID NO: 27105 - DNA, 1383 bp, Mus musculus
tgggctcgtaattgtgtaactctcctttcctaggtcatgtaatgtttgcagagataaagatggagaatggcaagtcaaaaggctgtgggacagtcaggtttgaatctgcagagtcagcggaaaaggcctgcaggatcatgaatggcatcaagatcagcggcagggaaatcgatgtgcgcttggaccgcaatgcgtaatttcaagcatggttggaacctttcctcatctgtttatgactctcctagtaaaagtcatttttagtaatgttgtatgcttacaaatgctgtaaaaatgaacttttacaactcccaccagctattaacaggatagtgtggaaaatgtactgtgagttttttgttttttgttttttgttttttttttttttttttttttgttctcaagtttgagtttctaaagacagcacatctgatcattcagtttcagtggatggacataccatttttaatgaaataagccattttgttattttcagtagcagagtttgtctgttccagttttcccgaccttggtgtaagctcacagatactttgttttcttttaaaatctttgctttgtatgtgagttaaaggaaagaaagggctcagacaaattaggatggattttggtttggtttaaattacttttctctgcttataaagaatagtaattaagtgttagactctaaagttgaagatgctttttatttgacctaaatgaagacatgaattttcttctttttgcccctctaccattccatctttccacataacactattaaaaaatatcaaactccacaaccccttattctattatttccaataattccaatttcatatagaactgataaagtagcaagtcctaagtataacactaggcagaccacccccaactttcggtctagtttccagccattaaaatgaactgctaagaacagaaataaaattgaaatgttgagagagattgttatatatgtgagtcccttgctattcacttctataggagcagatgcattcgtaaatgcagtcttaataaaccagggaagacctaggcatagcatatcaaacacattggatcccacgatgttagatatagccatgtctcctttacctgcagaagaatagcatgttgttaaaatgtgcacatcaatactatattttattaataatcttcataagaaaaacactggatactttttgttggttagttttagaaaactgttattgttagagcaagagtcttattgaatttgtatttccttgggttagtattttaaagtcttaacatttatttaataattgtctttatttattaaaccatttttaataaggtatacagcttacttgttgctttttattctcatttgacagtgaattaccatctaat

SEQ ID NO: 27106 - DNA, 1099 bp, Mus musculus
catctgcagagctatagtcaagtctcacaactattctctatttcataggagttgggtttggtggtctggaagcaatgaatagcatggcaggctttggtggagttggccgaatgggaggtaggtgaatgtactcaggggtatattatctttgctttccttagtattgagatacttcacacacatacacacacacacacacacacacacacacacacacacacacacacacacacacagcggtatagatactatagaagtcttcagaaggcacatgggcactagagaacacttgtaaacatgccaggaagggggaagagggatgggtagtgggttgtgtagtgagtgtatgaaataagttggtatgccacacactattttgaattggtaacttctgattttttttctcctcagtgtagcttagacatattcctcaatggtttccatgcattgatgtacttgaagaaaggttaatttgctgtacatcttttcagagctataccgtggtgcaatgactagtagcatggagcgagatttcggacgtggtgatattggattaagtcgaggctttggcgattcctttggtagacttggtagggttggctgtatacttttttccttttgcaggtcatagtcttaactgttctttttggtgtaaaaaaattgttttaaaagttataatttacatagttctttactagaagaaaacattttagggattttaatttcatggttctcttataatttacatagttctttactagaagaaaacattttagggattttaatttcatggttctcttttacggtattgtgaatattttaagtatttccagaaaattttatgtttagttatttgtgagtatagtaccttggacattttgaagtgtcattatgtaaattaattagtatattatcttttcatccttgtttaggcagtgcaatgattggagggtttgcaggaagaataggagcttctaacatgggtccagtaggaactggaataagtaggtttaaattttaatagaatttactgagtagtatttgagtgcttgcaaggagtttgtaagagtagttattgtagtacagtaatagtttgctt

SEQ ID NO: 27107 - DNA, 1174 bp, Mus musculus
atcctcttccttgactctaacccttttctggtaactccatgctactgtcactctctgggagttacttgtcggatattatgtttctctattacctgctactattcactttcttttgcagcttctatttgttaagcttttattttattttttcaacaaggatttattgttagtaaattcttgtaattatggctgctctgtaaatgtcttctaaggtagtttgatttgttagttcaatttaagatcaagttactttatcttagcactttgaaaatagtttagtcttctgctttctgttgttgctacttcataattcagataaggttttttgttgaattatacctttttttggttgtctcttattcatggagctaattttaaagttttggtccctggttgacagttttgctgcagtttgagtggaggttactactgactgagcttttgcagtggagaattatcagccatgcatagttgagtattccctttataaggcagcttcttccagtcccaggtaatctggttaggctcaccttgttgaagatcctaactgtattgcctctattaacaataaattttagtgctcaagacctgcactgttaagccagctgtactctcagcctggatgagattggcgaaggatgcgtgcagtcccacccttagttgagaactaatgttgctgaggaagagagacttggttttcttcagaaaacaggaacgcctctgttccaattgatgtccctgcatccatgcaaatgcagtactaagtgcacttaggaggcaaagcaacaaagaagtgtgtgaagttgggaggcagagatgcgggttggtggagggctgtggtaggggttgggaaggagtgggcaataattcagtcaccatttatttgtatacatgtgtgactttctcaaacaggaaattaaaaaacatgtcctgttaggtgttctttacatttttaaaaatgatttgtattttcatattttcttttatcttgatatataataaagtcacaagctaccatagaatcaaattttttactactttcatctgatttactcaaattttactctaacttgacaagtgggaaatttctcattttccatgcttctgagttctttgagattataattactgtgacatcagaattgacacaatggtgattgtatttatgagcatg

SEQ ID NO: 27108 - DNA, 1099 bp, Mus musculus
tttttccttttgtccttttagctatgctggagaatttattaaagtcatctttccttatttgcttttttaaatcaatatgtacagactgagatagcagagaagtttttggtgaatattttctctgagaatttcatacaatgtattttgatcattttatcctttttctccctcagctcctcccagatccattcctacattctcaccctcccaactctttgtgttcctcccaaatagcttttagaacctgagtccactcattctctctctctctctctctctctctctgcgggtgggggagaggggtagcatcctcctctgttacctggttgacctgccagggaacacacctttaaagaaaactggctctttctttcccagaagccatcaactgccagtagatgcctcataggtaggagctctgagtcccttttccctccatgttagaatgttggctagtctgatgttgtgtaggcaagcataaatgctgttaatgagctcatgaatgagaaagtagaatttctggtatgatcatttgcctacacatgatggtcctcttaatgtaattttatttgtgctttgttgttgatcttctacctaatagaagcacatttgtactttgatttgttttaataaaggatatttcttttaaaagttaaatgaacttaaatatatttgctataattctttacttggacacttggcattctgttatccccttttcccttcacaagtccttttcactgttcaggaagctaagagattatacgatgagtaaggagtgatgttagccagtgataataaactttcctctatctcagtctacctgagtttatagtagtgtgttctcgtagtgagagggtcaatctacaggattttatggactcactttctggataaaaataacaaaacccttagtcctcacagatgttagtagtttggtccagctgggttagctgctgtccaactttaagccacttgaattgtatatattcactgatgtatttgctggcagttaacattcactacacattataggatccggatggagaaaatgctcgccgggcactgcagcgaacaggaacatcatttcaaggatcac

SEQ ID NO: 27109 - DNA, 1898 bp, Mus musculus
gttggcagagcagacgtgaggtcctagtctttccggtggtagtcatctgggggggttggaggtggtgcgtcctatgctcagcctgcagtaggaaatgctcaccacttgataagcattcagattggaaaatcgggacacgtttttcaaattcttgcattttagtaaaacttgtgttcagactctgtagggcctaagggtgactttgtcagttgtaatctcaggaagtctttggcaaagtggttttgaggtcactgcagacccctgatgaacgaagctaacattgctgtctcctccagctggtgtcatagacgaggattacagaggaaacgttggggtcgtgctgtttaactttgggaaagagaagtttgaaggtgagttaagtcaatatgttcatggaaacattttgagctacctgtgtcagtaaaaaactaactctagttctcactgaacaaggcaggttacagaaaatgggtcagtacacagcgatggtaatctgtgttctgctttttctttgaagtgaaaaaaggtgatcggattgcgcagctcatctgtgagcggatttcttatccagacttagaggaagtgcaggtgagtactggaaactgagcggagaatgcctggtgtgtgtgtccagtggaggaggggcggctcagctgatgagctgtggggctagtgactggtagtcttcaagcaaggttaggtgtttagtttgagacttgattggctttcctcagaatgggtccgtgcagtgtgcagaggctctgactgccgctcctttcccttcctcctaataatgtctttcagaccctggatgacaccgagagaggctcaggaggcttcggctccaccgggaagaattagaactttgctggaagtatctcgctgtttcaacactggaaaccagaagctctaacttcggaagcatttggtgttctaggatgcaggaaaggagacctcgatcacatcacgttggaacgattctgttccctggttgaggtcgcctgtaagtctgcactgtgagcatggcattgacatgcagacttggtaaaacccagggtacagttagattttttgttgttgttgtattatttaaattatagccttccaaaaactgtttttgatcataattgctgtatcatttgtaattttttttaatccaataaagttgtcttttagcagatatgattttacataaactgactggagaacatggaggctgagtcaagaggattgcagtgacttaggctagcctgggctagtatgagatgctatctaaggaaagagggtcatgttaaaagctactccttgttcttctctgcactggtgctgtgtgacactgggacttagaagatctgctcaccccagattttgaacccacaaaaaatacaatttagagtttatggtactgtgggggagggactacaaacaggagcagaaatgacttaaaggtatcactgaaagcctgcccacccagcatggtgattgctccttaaagctgtgaaccgtgcagcctccaggcaactctgtggatcctagggcctcaccctgtgtgtaatggtggaggtccttcttccctgcagtggcttttccagcagtttcctgcccgacacgactgtctgccaccctgattgcttcccctcacagtcccactgtctgtgaatagaaatcttaaaggccaaaccaatgttagtattagcaacagatttaggagtgtccgaagataaaacaatgcaaggcatgccatccttcaaatgataatgctatctgcggctggacattttggctttttctgctagtgtaaacaaatcccccgtcccgccccgccccaccctgccaccaggtaattgacctgatcattttagctgagaaatgcactctttatcatcctaagaaaggct

SEQ ID NO: 27110 - DNA, 1134 bp, Mus musculus
tacagtgatgatcctagttcaaccaaccactttctcaggcttctcgtgagtagctcagctaccctgtcatgcgtattgattcctgaaaactgggacatgaatatccgctgaggttggccattcacgccgatgggctatcttcccagcctccgcacaggaacgcgcttccatctgatggactgttccgcgttggtcttcagatcttgaaactttgcttctccgagtgcaagcagtaggtttctgttgtctgtttggtgctagtaaattctcaaaatagatttattgatgcactgtaataaagacacgagttaggaaccaaattgccaagtactcagttcaaatacttcatttcaatcaaccaaagttagttcagtagcttatctcacttatgagtatggtgcagtacatgtaaattaagtgtgtgtacactgtaacgtgctatttttatcattgaaacatttataaactacaataataaagcccttaatgtgagggtttgtaatggtgcttattaagaccaaagacttgttaaacatctacaccaaatggtagtggattctctgagactggcccacttgtgcactgaggttggggaggacaaggaagcagcctcagccaccagaggatcaccaccgcatcctccatcacacagcatgtgcaatacgccaaaatcactctcagtcattcctgtcaacaaggggttaatgtcatgatgtcacaataaagtgatcctcccctccctccccattttagtttacaccttggttttatgttcttgtgtggattaaggctggaggggcctttctggaggtgaaataaagtctcctgggtttaaagtatccctgctttgttatctgtggcttctgtgtatgtgtgatgtaagcaccaggagaagaaatcacatcttcagttagtcccttcacggtggtaccgattgctgatgtttgttatctgactttcctaggaaaacacttagattacagcatcatttctaaaatgtgacctagttagtcctggggcttttaaactcccagatttaagaactcccagatataaaatccagtcattctcttcgagctgaacttcatgctccttcccctcacgtacacagcattggcaaggtgttccatcctt

SEQ ID NO: 27111 - DNA, 1195 bp, Mus musculus
tggagaagagctttctctgttaagcttttaaagatggtttggaagagtaaattgtgactaccaatacaagaatctaattaaagaatggggggaaatacattccaagatgtctttaattcgaactgaaaggctattgaaaaaaaaaaaaactttccaaattctttttggtgatttatacacatcagttatcaaaagctaaacttgaggtttaagattgagtattcatctaccccacagagtagtccaagtaaatgtgggtataaatgtagacgtgttatcatgtgtgctgtcatcttaaaatgtgttacaaacgcttctggaattttgactgcacatgtatcttcatgatttataaagctactgtgacctctaatttggaaaaacccattgtaatgattttcaaagtaaagaaagaaacaggatgtctttttaaggttttaagttcatgcattaaataaaatgtatgggaaagcccaaagacaaactttctaatacccttttatactagggaaatttcacttgctgttttgtaccttgacagatggtaagactataactgaagttcatattgtaagaactgtttgctaaaattgtcaagtaaaaagaaatcctgcctgtatctataaaaagatgtatgagctattatgttgtcaaactttgaaggttttaaacctacccagaagtccacctgggtgtctgatattcatattctctctctccctctctgcctctttcttcccctccccctcccttcttctaattatgcttgttaatctttatgcaccagcattggcgataataaattttcttgttctgtgtattttgctttgtctaatagctttgcatacatgctttatacaggattctcttgctgtgtgtgccacgcctccatcttgatatttaaacatccaatgcttacaatgtaaaccagtatcaaatatccaaaaaatgggttctgggatgttaaagcaaatttcagagttttctggaagacccgctctgtgaatgtgatgctatggcttaattgatgctgaagttccttgagaagaaaatgatgtattagcacgatgtccctgctgatgccaccatggcaaccaatacagaacagagctgagacagtaggataactcctgggtttctgtggggttggttggttggttttacagtcatcttgtttgagaggctgccgaggtgg

SEQ ID NO: 27112 - DNA, 1301 bp, Mus musculus
caagttttataatgctggcatttaatgcggagagatgaaattcttggctgatgttatagttttttttgtgaaagtttaggagcattgctctataaaaaatgtcagtcaactttattagtgtgctaaaggggacagtagtataccatccaatctaaactgttgtccagtatagacgttaggcactaagtatctgacacttcaattagacgtaaggaatgaagccaacagtgaggtggatctacacgggctgagtcttactgtctgcatagttaagaagccttaacttgtttaaagagatgacggaggttgcgaatgcctgacagtcttgaaaggagattgagaacttttcctactttgcatgatcgtgtttcctgcttggtgtcagtgactcagagagctcttgatctcgagttagtggcttttcaaagtttcttgtattttcttctcggctgggtgcaaatcatcattttagatttttgacgcttgtaccaaaagagaagttgaggagatcttgaaaacaccagtaacttaattttgccgtcggtttagaagttgagtgggtgcccgctcacaggcagtggctttctggccacaaatccaagggaccacagactttatacagggaaatggtcacttctagaggacagttcacagtttatcaaagggagtgccaccaccctgagaatattcctaagtatgcatcagtgtgtgtataatctatttcctctgggtaaacttggtcgggtggggggtatttgtgtatattgagtcccaggctctagaggaggtacaaggaataggaaagttttatttttggaagtaggtatgactctcttcggagttgtagacataaatctaatggtaagaataagtttattggcataagaagtaaaaactgaattttttttttttttttagtgtgtagatgtagttttactggcaataattagtgttagatttctatcagcacatgaattgcagtataaatcacaccccctgcttagccccctctggtaagcctctttgttgtaatgattactccttgaagactggtgttcataatagcttaattttttggttttaatctttgtaaatgatgtaatataatttcttttgactaaacatggaaaaataacgtgtgttatacattgaagtttttacaggctttgactggaatcatttttgaagagacggtattttatatgcttccagtgtttggaaaagaattagtcaaaaggaattcaaataatttaaatattgacaaattaatatccaaataacatacttgtgtgattttttta

SEQ ID NO: 27113 - DNA, 1114 bp, Mus musculus
tttttaattcccaacagactttttgtagctcttacctattttgttatgatctctgactttgcttttaacagtgtccaagtctatttccaagaattgtttagaaaatcagacttgtttcaacttactttgtaatgaaaaataatgactaaagagagaagaccaaattctaaagaaaaacaaacaaaaaacccaactaatgcctatttaaggttattttacaaattaaagatggaggttcgaaggaccagtgtttgcttgcatgcccatctccttcaggggtatctgtctgagttacagaagctgcttgtgagaagagctggaggtagcatcggggactaaaggccgaggccgcaagaccgaacagtgctgtgcattaagattggatgcagatttaatttggtccatgacgtttacttcagaagtactggtcattgtgaaagttgggatggactcaaacggcttgcaggagtcaggcgagcactggagcgtcaacatgctgatcttgtttgtgggaaggggtagatgtctgtaagatcaaacagtccccgtggtgggacttgccaagttctgtctaacccttgcctctgacctcaggaatgctcttgtacatagcatgtaaagttaggcaagctctgacaggccaacagtgcaggttgtaccagcgcagcccttccctgcagactcccagaagcaaggctgccctgccctgctctgctgctagcatttgctttaggaccctcctggtttgaggtgtggatctatttgcatatttaaacgcatccacattggaagtcatttcatctgttttttaatcatacatttctataccttcctcagagcaagaaccacagttagaggaagtcagggaaaggaattttgcagcctgtgacatgttcagggaaggcttggaagaagctggagaagaaaacagaaggttattctaattgtgctgatccttcagatggtttatcatatacaaatatatgcagaaattaattgtattcataattatttatctctgtccttctctaggaatgtgtgtgtttgcttgggagaatcctaatgagctgttttgtttgctctccagtcaccccctggattctgttgtcttcac

SEQ ID NO: 27114 - DNA, 1881 bp, Mus musculus
tcccaagaaaacagctttaatctccagaagaaaaccaaaacaccatgggatttatgctgtgttgacatcttgccctaaacatacaacaccatagtaatttgtcatgggcgacatgatcagagagaagatttttgtcatgattttaaaaacactgacacgctactgttggttaaatttaaacatgttgtacctgcagaaattctctcacaaataacctgcaataacttgaaattcatacccttttgaacacttccttttctcatgtataaatgaaaatgtttgctgcattttgcaaaatgtcaattctccaaaactgtgtccgtctatttctgttcttgcagctagtaaaggttagacaacccgaattctcagtggcacgctgtcacctagggctcaagcagcaaaataaacagtgcagctcagaaattatagcttggttcttgatgtgtttttattacattcggggttgctcttttgtttttagtatcttaaagatttcaggttattttgtcttcagttaagatttaaaagcctgagagcaaatagttaaagctagttatttgcttccaggtttttaaaattaaagttcattgatagagtaagaactcctttctaacagagcccttacatagaacttgttttgacagtgatactttaaaggattatgatgcttttttttttaaagactggtaatttctttttaaaagaatacgtgttaactctcagaatgtcactttagacaaatatgccagaatctagacagcgaagtgaatgttacctgcatagtgaccatgctgaaaggttattttctaatgccagcaacaaccattgcccgaagcctcttgggtttgctcttggagaattacagtcaaagttaatttaggtaactcactactaacttcatgtttacaccttgtttgaaaagattattaacaagcttgtctgtctttaccctaatttggccccaaataccagtttcaaagaaatacctaaatttagataatgtagaaagtatgcatctggctttgaaagcaatccccaaataattttcaagtattttgtgcagtggcagaatagttaggaatgaactatggccttcgatggtggcagaactcagcccatttgaatgtattgagttttggatgtatttgtttctttttttaagttcacattatcatatagtgtcaaaagaaggaactaagattaacataatgtgcttggttttctattgctcattattatgtaaacagttgagtggcagtgcagaaggaagactgtgtgactgaagagtggcaaccaagaattttgatcattaaatcagattttataaacagtagaaagagcatggacttaaaacaaggcatgcttatttggttttgtcaaaattttacgaaaatatgtgatatatatttatactaaaactatataatccttagatttaggaaagcagtcagttaatgtctagcagaataaagcagtattaaatacagatatacgttgaaaattgtagaaaaccgaaagaagacgaaagacaaaatgtcaatggtagggaataaaaagtttaagatattataaaagtatgtgtattttcttctattctacataaatcatttgtgaaaagtgtgttcacgttttttacaggagtgatatcaattaggatttatttttccaatacaatttggagaccctttgttacccaaataaaaatgacaagtttctgtgcctgtatcaggtgtgtgcatgtgataatcagaactcaaagggtctcagctgtgtgtcccatccagctcctgttaagtgctggttctgtgctgtcttaagtttgtagaaggcagtgtgcttgttaccctgtgggaaactaggccaactgcgtagtgaaac

SEQ ID NO: 27115 - DNA, 1140 bp, Mus musculus
cctaagctgctcatcacaaacacaatctttctgtcttcccatttcattcacccatatgacaatagggtcacaggacttgaatacttatgcctgggtctttacagtcatgttggtagcttgagcttagttcttcatgcttgtacagcaaacagtcttaccctgtccccacttcccagcctctgaaagtgcaaggtttgatatgggaaaatcatttctatcttactgtatactttattccttctctgttttagtttattttgttttccctgagacatggtttctctgtgtaaccctggctgtcctgaaacttactctgtagaccaggccggcctcaaagttagtgatctgcttgcttctgcctggaattaaaggcatgcaccaccaccaccaggcttcttctccaattttaaaataagatcaatgttgatggttgttttattttatataaaaatagagtaagttttatcctaacagtattcacttattacagtgctgtatgtgaatttctttttctcatttattatctctctcctactacacaggagtactctgaagacagtaactctgagcccaatgtggatttggaaaatcagtactataattccaaagcactgaaagaagatgacccaaaagcagcattaagcagcttccaaaaggtgcttcaaagtctgtttccagctgattttatgtcttgaagtgtatttggttttaataatgctgtatatgttactgttctcattgctacaaccaagtaatctgaccaaacccaggacgtgagtattttcttcagatcactgctgaggacgcagaagtccttcccagcagagaagctgtattgaccagagcatgttcctaggattctttccgtctcaggggacagtgtggtggttgagtgagagtagcctcgtgggctcatatgtttagatgcttggtccccagatggtgaagctcttcttgagcagaattaagtggtgtggcctcggtagaagaggtgtgtcactggggtgaacttttgaggtttcaaaagcccatgccattcacggtgtctgtgtctctgtctctctttctttctttttttttttttttttttttttttttttttttttttggttttttggtttttggtttttcgagacaggg

SEQ ID NO: 27116 - DNA, 1100 bp, Mus musculus
ttattttgggcaattaggggaaatgaagaccaaagaaaggccagtttataaacttggctatgacagaagtgtaaagagagagcatctttcacaaaatctccagacctccctgtaattgtgcaacaatggggataatagagtccttcccagggaggtcccacactgaccttggagaactgaaagggaaattggagggaaatcagatgacctgtgttagctcactctgacgatgacacagccctgcacgcaactagcagtggaaatgtaattagccacttggcgcctgtggcttgccaggctcatgccacacccagtcagaaagtttaaacccagcggctagagtggatcacaaatggcatgtggaacctgcctggcccggccaggagcttgtactcagtggctgaggcacttcctgcagacatcagcatttgctcactaattgccaacccccccttccagagcctgttttaatttaaagaaaaagcatcaagggcccagtgaatggaagagacaaacactgttcagtcttggacataagaggaagggggatgatttatgtagaaatgaggaataagttgttttggcttggaagggggaggggaatttgaatccaaccggaaacagtatggatgggatctgccagcttcctggaatttcccaatgtgctttttttctccttggatggtcaccagtaccggtttacatttctgtgagcaaagagattagtgatgatctaaaaaataatttgattgcttgtgatacatgttgcagacagaaactgggaggaatagtgactgctagggttgaagggagagtctttatatagagtggttggagaaggcttctctgaggaagcacactggaacagaagacctgaagggacaagcagacaggcacagcagggaaggaaggaaggagaggtgaagcttgagcggtgtggatatgacactctgcaccgaccccattagctgcgggaaggactcacactgcatgcaccctgtccgctgtggggaggattccagaagagaaaggggctcaatggatgtgacagttgactctgtcctagatatggttgaaggaaggttctagaccattgcaac

SEQ ID NO: 27117 - DNA, 1196 bp, Mus musculus
cgaagcccagggggccccgaaccggcccgcctggcttcctagagcggccatgatgcctgctggggaggggcctactagagtcgctgcctctgccacctcccccctcccctgagttggcccagtgcagccagctgtgagagctgccttcctttccctgccccacgtgttttctctctctgccccaccctaagctgctaaccatcaagggagacatctgcccacttaaaacttctgtcccaggtaaggagcacctacgagtctaatcaccaggctctgacaaatgggtatagaggtctagaaaaaggtgagcttagactgtaaggaagagcaaagctccagcagactcaggagagacagtgaaaatagagatgaaggagattagagaggtctgagatgagagagataccccgaatgagaaatatttagagtagaaccagtaagtaagaggcagagaaggcgtattatgagagaagagagaggcgagaggcagtagaaagagaaaacaggagggatcatagacaagaaagaaatttgactagaaacttggccacagtggtgagaaagaaagaaaagacaggatctagacaggaaacctgggcaacagaagaccgagcctcagctaaaaaggctcagctgtgtcagactcaagttatctatttgagatacacccttcaaggtggaaaacagtggctaaaagaagccagaaaaaaaactgtaactacaccaaggcaagtaagagaattcttgggtaccgctggtttctgcaggctctggatacctgggttggcaactttagctgcctgttgtaccccctaaccaaggaaggggaagtgtttgtgtggaccccagatcaccagaaagcctttagagaaatgaaaaaggccctactgatggtcagcctttgcctgacctaaccaagcctttcactctttatgtggaagagagatcaggggttgccagaggagtccttactcagactttgggactttgaaaaaggccagtggcttacctatccaagaagttagaccctgttgccagcgggtggttttcttgcctgaaagctattattgccatagctctgcttgtcaaggatgctgataagctcactctgggacaggaaataactgtagtggcaccccacactcttgaaagcattatccgaaaacccctgactgatggatgacggccaatgctcc

SEQ ID NO: 27118 - DNA, 1823 bp, Mus musculus
tttcctgaaactaaatatgttctagtacatcttatacttccccttcctaaccctgcagccaattccttctccaagggaccctgtactgctgcttctacagactctagacacctgggttggtgaccttagctgctcgttgtaccccctaaccaaggaaggggaagtgtttgtgtggaccccagatcaccaaaaagccttaaaaaaaaaggccctactaacggccagcctttgcctaacctaaccaagcctttcactctttatgtggaaaagagatcaagaaaagccagaggagtccttactcagactttgggactttaaaaaaggccagtggcttacctatccaagaagttacaccctgttgtcagtgggtggttttcttgcctgaaagctattgctgccataacactgcttgtcaaggatgctgataagctcactctgggacagcaaagaactgtagtggcacctcacactcttaaaagcattatctgaaagccccctgactgatggatgacgaccaacgctcctgtgacacatcagaactttttgttgactgaacgagtgaccttcgcttcattccacctgctgtcccactgtgtgagaccgcacctactcatcactgcgctgacattctggcagaagaaatgatctgaaggatcagatcagccttagcctgagggcagtagcctcacggttaaaggtaagcagaaggcagggacagcagtatggtggtgaacagaaagcaagtgatctaggccagcagcctccctaaagagacgttggcccagaaagctgaacttgtgactttaagacaagctctataaatggcaaaagaaaagtctacactgacagcagatatgcttttgccactgtatagagcaatatacagacaaagagggctgttgacctctgcagagaaagacctaagatgctgtggctaaaaaaaaaaaaaaaaaaatcaggtggcagatctaaccgccaaacaggtggcccaaggagcaatgatcctggcagtcaaggagcctaaagattattatgacatcagagagaccagctttagatacaccactgagcactatcaagttatggacattgcttgacccacctgggggccaagaaattcaaaggtgtggttaggtcctttgactacaatgttacaggactctctgacttggcagaagaaatagtcaaaagctgcaaggcctgtgctatgatgaggtaaaatttctaaaagaaatcttcccaaggtaatggacctgcctttgttgcccaggtaaatcagggactggccaagatattggagaatgattagaagttacattgtgcatgcaggccccaaagctcaggacaggtagaaaaaatgaatagaaccattaagggacccttaccaaattaacagcggagaccggcactaatgattagatagctctcctaccctttatgctcttcagggatagaaacacccctggacagtttagactgacccccctataaattattctacagggggcccccctccactggtaaaaatagcctctgtacatagtgctgacatgctgctttcccagcctttgttctctaggctcaaggtgctccagtgagtgagacagcgagcgaaaaagcagctccagaaggcctactcaagagaagaagacctgctacattagacgtctccaccagaaaaccttgagactctggtagaaaggcccttatcttgtactcttgaccaccctactttctacctttatgggaccccttttgattttgcttctgcttttaattataggtccatgtgtgttaaataggcaagtcacctttattagaac

SEQ ID NO: 27119 - DNA, 1664 bp, Mus musculus
tttaaaactgaattctgtaaatagttttttggttgtttctttttttactgttataaatgagttgatgaagcttgttgctgagatccagaggccacagcaagccactgttacggggaattctttttgatttcggtgcagacttaatttctcagaaacagaagttgtaagcgtggttgttgtctcttagaccaaatgtggaacaattatggtggactgatgctggaaatactctgcaaagagatttcgcccaggaacttttgtacagcttttaagttgtctcaggttctctgaaaacattttttaggaagcagaaattttatatttgttctatttcagctacatgcaagtagatttacatgtatatgaagcaaatatttttaaaattttgtttgtacatatcctgcatgttttatgattttaaaacacatcccttgcttaggtatgtctcctacaaagacgatgaaagttaccaagaaaaaaaccaaggcaccactgtcgttctgccggtcgttgagagtgagtaagctcacagctggttttactggcgaccatgacaatgttcttggagcagcttgcaagagaactcgaatctgcaaaatatatgcttttctgacaattgtattgtgaggatgtgagactgctctgtgccttccttccatcatgacttccacacgagcactttgaggcgctggattttaagataatgtttttggcaaactcagtgcatttgggtttctgaaatatttcatggacttactcccctcccctaagaaattaaattattcttatggaaattgcttttgtatgcagagcaggaccttttgtactcagtgaggctatgggtgtgtctaacgtaactttcggtattccctgtgaacgcgctccgggcctgtgctgcgactctctcacaatattgtcaattctgaaatgtatggacatttgacagactattccattctcttttgtaaaatgtaacttcaagctctttattattttgttttgttctattgctttatgaaaacgtttgcccctcccccaccccaggctcctctagcttatctgtataaagaaccagttacctgcgagactgtactctggcctcattttctattttacaattaaataactttccacatagctccatgcagactcatgttttgactgcacattcataaaatgtggaccatagagctcggtggtggagcaggtccttgacgctttgagactctggctcaaatcctgtcgcacatacaatctgagacacgttctgccatatgaaaccaattagactcctcatgccttgaaaagccccagagtggctgcctggaaatgtgctggttcgtgcctggggtaactttacaggagttagtgagggtaagaaagggtccgtgtcccagcctctctcacttgcctttctggggaccacaaggagcctctatagcagtgctcctcagcctccctgaggctgcaactctagtccagtgcatgttgtagtgaggaactgtattaaaatgtttttgttgctacttcagaacggatataaactgtaatgtaaatttctgatattcaggatgtcggatctgggacccctggggaagagtatatgaccctccagtggttgtgacccacaggttgagaacctctgctctatgacaaccatttta

SEQ ID NO: 27120 - DNA, 1136 bp, Mus musculus
attggacccggaggggtggtgaacctcacaggtctggtatctaaggcggcaggtattgagatgcatgtaggatagctgttaggatgttaagctagtaggtattcatcagtttaaggaaggactgttggagaatgagggtaaaagtaccatccactcttttggtctcctagttatttacaaaccatttgctaagataaacgaatctaaagaaaggcagtcttacatggtgtaaaacagtgttacctttcccaaactgatgctctccgatgttggttaacactttagtgagattggaagatgagtggggtacatgggattaaacaccctaaaatgtgaattctgttttcttctctcctagatgaaacaggagtatctgctgttcagtttggaaactcctctacgtcagtattagctacgttagctgccttagctgaagcttctgccccattgtccaattcttcagaaactccaggttagagaacaagggaggtttctgcattgactctttcactctgtcgagccctctgggcttagtacttttgaatcctgtttaagaaatctgttcagagtttattgcagtgttttgttttcttcaagagtcctacttataatttgtgttcacctctgcagttctttcagaattggttggctacacttcctgttacttgcttatatcttattaattaaagttactatttctgatttttatttttgtgtcagccaccagaaagaggcaaagtgctgatcccatccttaataaggaaactgcaggtcgcagtgctcacagaggctgaaagataacagggctagagtggaatgaaatggtgctcacctcacgtgaggtagggtggagcacccactgctcagcatcccctgagtgtggtcgtgtgtcccaccttgccagatcatgggtttacaagggcaagagcaatccaatatgaacggagcggaaggtcaggtcaggaggtatgctcctgaggtacataccaggtaaagaaataacagcctcagatttagttggtacatgctcagtttgtttttttgaggtatggggttttcgtgggctacctccttgggtaagagcatttgttctgcaaacacgaggacctgagtttgaagcctcagcacccatataa

SEQ ID NO: 27121 - DNA, 1197 bp, Mus musculus
actgtttgctatttagcagctgggatctacatatccgaaaacactacataatatccttctagaattaatgtataatttatatttatacatgattttataatatttaattctctaacattccggttgagttagagtatttcatgatgctaatgtctctgggtcacttggagaaggttgaaagagctttttcccattgggcagtagccgagcctgtctagacaagaggaagctagaggacccgtctcaggccacctctagaaccaagaactcaggagaagtggaaggcatgcattcatgggaggggcctggaacatagtcacttagcctaattgctagatgtcttagggaactcagcagtttagcctgtggcttgtgggcaggattttatctggtatagctgctccagctgtctaccatcttcatgtggacccagcttgagatgctctgcataaggcatcttgttctttctttctcaggccaccatgttaccctaaagctgagatttcgaggctttctgcttctcagattcggaacctcaatcctgtatttggaggatcaggaccagctcttactggacttcgtaatttgggaaatacttgttacatgaactcaatcttgcagtgcctgtgtaatgctccacatctggctgattatttcaaccgaaactgctaccaggatgatatcaacaggtaaaggaacatttcattctgcagtacactctcgagaaggatatttaactgtagtgcctggatgcagtactcgagttttgtatggttacaacatgccagactaggtaatcatttttgtttatttgtttatataaaagaattttgattttttaaaaaatgtgtgtatcttgagtgtggctatgtacaaactagagcacacacacaagcgtgaagatcagaagacagcttgcaggaactggctctccagggtagactccaggattacatcatgtcatcagctcgcacgtgagcgctttacctgctgagcttgctttgccatcggtgtagagacagggttcaggattagcatgtcagtatctcatcagggtcctgtgctctcccagcaaacagcaggagacccaggggcccagggtgagcccttcattgtgcccttttcagtaggcatagcctcttcaggtcattttcattttttgttttttcattgtatctttaggagtatgtgcatgtg

SEQ ID NO: 27122 - DNA, 1304 bp, Mus musculus
aacgcggcaaggcagcgctggtttaagtttgatgaccatgaagtttctgatatctctgtgtcttctgtgaggtcatcagcagcttatatcctcttttatacttccctgggaccacgcataactgatgtagccacatagagaggagtaggctgtcggcttattgacgtctccaaattgcagcctcacatctaatgcttacaaagataatggatcgctgcagctgctatgtagagggattccagaacactggggctgtgctactagcaccatataattcaggccagtgctgtttatcaaaagaaagaaagaaagaaaacagcctgacatttaacaactatcatagtacgcattccttacaggagtcatttatttcaaaacaactttttgagtctgccccaaagttaaaataattcattagtcagacatttattattctcttggtaccaaaccatcataacctccattttcctattcactgctccagcctcttctcatttctagccccagctcagtgcactctgaatgctctagaatgacctagctcagataggaatgtatatgtacatatttattgcactgttgcacatcagactgctggacacagtttaacatagccttctgtgaaagcctagaaaggattttttctttttcttttggcctcttctaggtagctgcaatgctttcttaaggaaatgacagggcaaaactatttttctgttggcttccggctgtatttgtgcactaaatctttattctaaacaaatggaaactttaattttttaaaaataattcatttacatctacattaaaatcttaatgaagaaaaaaatcatttgaaaccttgtacatgttttgtcttctttttttcttaagtgttttgagacagtctcactgtgtgtcctctcctggttgtcctggagctcacagatccgcctgcctcttgctttgtgtgttttacacacactattccctacactcactctggatttagtttcttattctgcaaattaggacttgattccactctctcctcgtgtggtattcagatctcaagagctggaagtcagttacgtaatcccagatgcctgtcagaattctgtagaagaatcaaggaagagtcctgagtggctgtgtttgtaacatgcacactgcactacggagcctgctggtctttctagagcagagacgtaagggagccctacccttccgtaaggacagcaacggggactgcacagtgggtcttagaggggctgctgggtttgttggtttgtttgtttggaggcttccatactgtgctgtttaga

SEQ ID NO: 27123 - DNA, 1877 bp, Mus musculus
atagccattttcacagtattaaccataacagtgtaatgagcatggggcgttttccatctgtggtacaagactgtgacccttttgtcacaagcgtgacaaaagcagggccttgtgcactgtgttcattaatgtactgtaaacttacataactacaaaattgtacacaccttatacgctgtctgttgctatattatcatatttacatggtttactgatttgtactccttatgtaataattaaatagaaatgtatggttattaagtttgtaatttaagaaaattgatctgacacattgaaaattaatgtagaaaatgttcttaattcttcatttgtaagtttctgactttttttcttttttttccttttctctgctgggattgtgaacatagatttgaagaggaatgactacacgcctgataaaattatatttcctcaggatgagtcatcagatttgaatcttcaatctggaaattccaccaaagaatcagaagcaacaaattctgttcgtctgatgttatagtgctgagtcattggtttttgcctacacttcacaaaagtgtaactgtcagttttcctttcgggggaattgatgatataggaagatgtgtgcaaaatgagcttgctggccccacacatagtctagaggtaatgttctcattgaaaaacgcctggaggctgcagatgacagctggaaagtgctagctggcagagagtcagtgctctcggctggtgaagggcgggaaccttgctgctgagagtggtggttctctcacctggtgcaggaccattaaccaaagtcaagtcttcagatttgattggctgctcagtcacagccattcagctaaggaaactaaattgcgcagctttttaaatggctgaagtcttcctcagtttgtgctctatgataatgatgttagctctcaactaggtgtttgtggccacgggagaactactccttacaattttgcttcacaggcatgttacaaagcctgcactgaaaaccgtttgtcttccctctctccctccctcttttccctgtagtattgaggatcaaacccagggcctcatgaagaccattttctaagagacattttatttaagaatcaactatagagtctatgtttatggatacagccagtttttgttaaacaaaacctgaattgtgcaaaagggttttttaacatttatcaatgttaagtaaaagaaagccatgataaataagaattaactcactgttcaatgggtgtttcctgtgaggaaggttacagttgtaacagcctgcagttgcatacatctccaaagatttacagacttagtgtatcaaatcagagtgtcatgtgagctctcacattgaaaattctataggaatgtgtcaatgtgaattctatttctggtacttaagaaatcagttgttggattatccttatacagtatagggagatcacaatacaactttatgccaataaaatctaacttaattgcccagatatttttgcatatttagcaacaagaaaagcttatcatttgactcaagttttatgctttctctttcttttcatttcctaggtactaattttaatttttatttggaaggagcagtgtaaagcttacttgtattcaatagtgtatctcatagatacagacaaggccgcagagataagctgttaaatagtgtttaatgttgatgtggagagaaaggtgtattacttaaaaatactataccatatacgttttgtatatcattaaatctttaaaagaaattaaatttattcttgtttacagatgtttaatgagtttactcattctgaaatgcatggtttgtctgtgtgtgtctgtgtgtgtgtctgtgtggcatgcaatgggggtcagaaaacaac

SEQ ID NO: 27124 - DNA, 1225 bp, Mus musculus
tctgaagacagtgacagtgtattcacatataataaataaatcttaaaaagaaaagaaaagtgtttgtctttaaacgtaagctcaataatattaaactgttttttaagtttgtaatatacatgcataaaatgtggtggtgtgcacacagacagcaaaggagaaccttgtgtcctgctctgttacttggtgccttgtatctcactgcacctggaaccaggctggtaactagcaaagcccagagctccaagtagcactgggttaccgttgcccacgtgctggtctcctcaggtttgcccaacaaacattttatccagttagccacatccccttcaaaggaagtgtatttctatttttatcacgtatcatttttttgtaaaattgcaactttcgggttatcttttattttttgtttaatattaaccatagataattacaaattcttactattctttgtcatttttttaaagttatgatttgatcttaaactgttcatttgtgttacaggcgagcctgtcacagtgtaccgtctggaggagagttctcccagtatactgaataacagcatgtcttcatggtctcagctaggcctctgtgccaaaattgagtttttaagtaaagaggaaatgggaggtggtttacgaagagcagtcaaagtgctgtgtacctggtcagagcacgatatcctgaagtcagggcatctctatatcattaagtcatttcttcctgaggtgataaacacatggtcaagcatttataaagaagatacggttctacatctctgtctcagagtaagtgtcagtgaacttgactgtaagctgtgatctgagtttcctattttaactttggaagtgtgaataaatgaaatcttacatattgataaggcccttcccttttctataggaaatacaacaacagagagcagcacaaaagctcacatttgcctttaatcagatgaaacccaaatccataccatattctccaaggtaaatgtttgcctttggtggggacttcgtattacttagatggcagtctttattggcactcattgttgctggtgtgtatttgctatgcattgctacttatcaattagaatctcacttacaatccccggtgatatctgacttttttgtaaggttccttgaagttttcctgttgtactgccattcagcagggcagtggtttgctgtagaagagtgcatgactggtgaatttagaaaatacaaca

SEQ ID NO: 27125 - DNA, 1187 bp, Mus musculus
cctcaataaatacatacataaaattgagctgtggagaaggggatctgggttatccttacatcccagctcacttctcacattagaacacctaaaatagtaagatggtcattgtccccaaacccaaagggcaagaaacagaacagtttttcttttcaagtggcaggtgtgaaggtgcagtttatgccaagatggagagtggggcctcatgtgtttcttcccaggtgtttggagcacagtggctactgttttactcagtgaaatgtgatgtgtgatagtagtttttttattatctttcttttttcccgataggataggttatgaaagaaatttaagattattatttgagaatgtcttagcataaatttatgctgtacaggtgctttttaaagtctgatttatttacaattttaggtcttgcttctccatttaagcccgttttggatacaaattactattattcaggtcagtgatactgaaaacaaaatttactgatctttgaagtattagagatttcatcatttgtctctcatttcaatgcagctgtggaaagaaataacctgatgaggttgtcacagagtattcccttcgttcctgtacctccacgaggtaaatcccaaaatcataaagtaaactgtaactggtctctagtcttaacttagaagaatgtgggtcaggacagactgaggaggattcctgtgaagaaatgccagctttgtgcaccttcttagcctttgagaagcacagagtgtgctaaaatatgggatagaaactattctttgttctatttcaaaacctggaaagttgacattatggggtgtgtgagacaggcggctctaaccagaagtctaacattttcctcgagactgttttacttgcttcctaaaagtttatcctcacgagctagcaagatgagccagtcagtaagaagatgagttctttctcaaaaccttgtaaagaagccaggtgcaccagtaagtgttgtcatttccagcactctggccagccggcctagcctaattactgggcttcaggccagttacagaccctgctccaaaaactaatatggctggctggctggctgctgaggaattgtaaatagtctagctatgacgttcccttccagcccctgcctgcttatgtgtgtctgtactccccacacagtggtcattacatgctacagtttgaaa

SEQ ID NO: 27126 - DNA, 1091 bp, Mus musculus
taggttttttttttttttgagacagggtttctctgtgtaaccctggctgtcctggaactcactctgtagaccaggttggcctcgaactcagaaatctgcctgcctctgcctcccgagtgctgggattaaaggcgtgcaccaccactcctggctgaacctatgatttcttaagaatatttcctaaggatatcagtgtatgtgtttgtgtggactgtgtttatggtgttttcatgtgtgtgagggtgcatatgcacacatgcagtggacagaagtggcattggatgtcttctgtcaaccttcatcttattcctgtagacaggggctctcacacactagccatttttacttgccttctttcccttcctttactctctcttttgagtcttttctcttttgcccccccccccccatattttagttttgagataattttagattcatatggagctgtaagaaataatcaaaaggttacatttccattcttatcttttaagctttatctcatatgttcttagacttttagctgtggtgtactcacaaaggcctttgcatggtggtacatgtctctagtccagcttctgtgacgtatgcagagtatagatatgtgagaataggtagaggaaagtctgcatttccattgctagttgacaaaatatgagaattggcacttactggagttaagtcttccaagtttgcccttgtaactatagttttggttttgccttatatttgcaaggcataggctgtatttttgagccattgatgtagtttattacagagacaatctccttcataaggcttacgcaatgatagcatttttcttaatgctattattagcagtaaatggaaactcaaatattttacttattacctattacaacattagaaacactctttaggataaattttgttgtaggaattaaattctcttgtttcttaacacatttctttttctttccttttttaaaaacaggtggccaatatgttctacattgtagtgataatggctcttgtattgcttagttttggtgttcccagaaaagcaatactttatccacatgaagaaccatcttggtctcttgctaaagata

SEQ ID NO: 27127 - DNA, 1224 bp, Mus musculus
aagagcagtcagtgcttttaaccacagagccatctctccagcccaagactttcaatagtatcacagctctcaagggactgagactagaggcatccttgggttatacatataagactttcaaaaataataaaaagcaaaagctagacatactaagccacaaattaatcctaacatatcttgtcagaaagaaagtcaattagtaaaaacacaaaggcttatcttcggttaatacacacattctagttgcttgaacagatttcagtgaataaatgttgagagctcttgttataggtgctcggttttttataaatatactggttattgctaacattcagtgttcaaggtaaagccaactgtttcacatgtaattttattttaatttttttatttaaaataaataagattaatttactgagttttctcatatttactaattaaacttttacccttttcaggaattgggcaaggagttcctgtggtggctttgatatttgaaggcgggccaaatgtcatccttacagtactggagtaccttcaggaaagccccccagttccagttgttgtgtgtgaagggacaggcagagctgcagatttactagcctatatccacaaacagacagaggaaggagggtgagtgtagagtatagcagattttacaatatagagtgttatagcttatccagtactgaattcctttgtttatttaatgagaatgaaaatctcagattcaataaaatgctttgttcagacttaaggcagtagcttgtctcatacattattggaatgaaagtataatcatcttttttattttttttttattcaaaagattattttgataaaaacatacctttaacctgatagtttaatttcacataatggtttctacaagtaaatactcatataaagtttttgttgtagggttatttgtacaagataaagacatagaaaatctaccaaaagaggtctaaataagttatggcatgtctatatagtggaatgattgcagctgaggaaggatgggacctgtgtattaagtcactctactcccctgtggcagcacaaacacacacacacatacacagaggcatgatgcagagtagtgtagctcttatgcaaggatgacatgcaaacttgtgaagcattccttcctttttttaaaaaaagatttatttacttattttatgcatatgagtgtactgtagctgtgcagatggttatgagcct

SEQ ID NO: 27128 - DNA, 1132 bp, Mus musculus
tacaaagtgagttccaggaaagccagggctacacagagaaaccctgtctcgaaaaaaagaaaaaaaaaaaaaaagtggccttcaaaaataaaattttcagcctggcagtggtggtgtatgcctttgggaggcagaggcagacagatttctgagttcgaggccagcctggtctacaaagtgagttccaggacagccaaggctacacagagaaaccctgtcttgaaaaacaaaacaaaacaaaacaaaacaaaacaaaaacaaaaagtatgttacaagaagcaaattctacatcagtttgccagtactagacttaccggtgtgataggattcagtttacatgggttttggacaattgcaatgggtttgatactgtgtggttttgttcatctgtttggttatcttacagtttttataagcttggctttggatcctatagccttagaatctttttttaaacaaatttcataaattgtaatgttagaaactactgggtttttctaatggtaattaaattttgtataaacaggtgtggcaaaacatgttggtgatgccctcaaagaacatgcttccagatcatctcgaaaaatttgcactattggaatagctccatggggagtgatagaaaacagaaatgatcttgttgggagagatgtaagaaaggttttttttttttctaatgtcttaaatttgagcttgtatataaacagaaataatgctagccaatttgatagactgtatcatactttcacactaagtttaaaacaaaatttccagtggtcttttttgatcctttggaatatgtctatcaatataaatgcttataatggtgttggtccttttgttttctgtctttaatgtagaatgttattttaacatgttttccatattagtatttgtaattgattttcttttcttttctttcttttgtttttgtttttcaagacagcgtttgtctgtgtaactgttgctgttcccaaggccaggctagccttgaactcagagatcgaactggtcattatgttagggattaatcttgtcaccaagagtaggaatcaaaggctagtgttttattcaaatagattgaagatgtgaaccggtttatgaatattcatcaggagcctattaaagtaaa

SEQ ID NO: 27129 - DNA, 1183 bp, Mus musculus
aagtgaggtctggtaaccacaagtgttctgaagtccatctcttttctcacctctaaaatgagtgagtgctccactcatttaaccactttgctagcttgcaacctgaaaaaaaaatttccttctgcagggcgtggtggcgcacgcctttgatcccagcactcgggaggcagaggcaggcggatttctgagtttggggccagcctggtctacagagtgagttccaggacagccagagctacacagagaaaccctgcctcaaaaacaaaacaaaacaaaacaaacaaacaaagaaacaaatacacacagatatatttccgtctgattctttgcaaaatctcaggtgtttttctagaaattagaggtgaaattatcttcaagttttgttttgtttttttaaaatttctctaagaaagtaccaggtgacaagtcatcgcagaagcgcaggcttttgtgtttctgtatcaacattgcacaggagacgtgagcagtccagtcgttcatgttaaggcaaagccagcttcttcaaagtaaaacaggcatactgaaaaatgggttagacctttgatatttgaactaaagttcacattaaatgcttttttgtttaattgttaacttttgctgagtagatgacaaagaagcgggactgcttcgttcttctaggtaccggatggggtcttttgtttacagtaaagctatctggcaagagataagtgccatttacaattctaactgtactttcacatcaactgtcaataaaatgcctgccaaaatacagctgttttagtaacatctgcattcccattcaagtcgcgatattcaaaagcaacagttacaattttatggagactattaaagaaaattattctttttaaaaccacattgaaataagatgatatctcaaaataatttggttttattaatttgtagctaatatcttaatttcctaatctaaacttttgctccagaaaaccatgaacacatctacaaatctgaattccaacttattggaaacattttctattttacccagccatcatattgtcttctatatggtctggagtgtatcagtgttagagtacttgcctaccatgttcaaagtgccttccccagcactgccaatgaaacaacttactaagtagctataaataacaaaagaatttcctagagtctctctaccctcact

SEQ ID NO: 27130 - DNA, 1137 bp, Mus musculus
tgtatttatgcctgtctgagtttaaagttaataatgtgtttgggatttttttgtttgttttgttttatgagacagggtttctcgggagcctagttgtcctggaactgtctctgtagacctggctggcctcgaactcacagagatctatctgtctgcctctgcctcctaagttcaggaacaaggtgtgcactacctcagtgctaggacttaaaggtgtgtgccaccatgcccagatgtgtttgggatctttacactgaattcctgagacatgtctagtgttcaggagccatctgtggctggtggccatcagtcttggaaagcaccgccaacagagggttttgttgaggcagttattatgcctcattggttttatgtaaaaatcatgacaagattaatattacaaccactctttgttaatgtttgacacttttttgtatcaagggaacattttttatctatagcacaaattaacttttttttctttttcaggattttgtgttgtggcaaaaacattaaagtgagcctgattttcctttccgggctgtgcatctcagttgctgttgtgtgggctgtatttcgaaatgaggataggtatgacaactctaacttactttaaatttaggatgcatagcgttatatcttttcctgaatcatattcattatgattattgtggatttttttgtttttattcaagaacatattttaaaacaaggtaatttgttttttcatgaataagttatttaacaggatctctgtatgagccccgttgctaacttataactctagccttaaatttgcagtgactctgtctcctgaggttacaggcgtaggccaccaaacccagcaaatgaacagatcttaggctaggagtttgagctcatgcagggaaggaaatcaggttctgccttagacacctagacttaaaatatgcatagtgatgctgtgtggcagtgttgtgtcttataacttcaacagatggtatccccactgatttccacaatgggcttttaaatgaaaaaagctgtcatgttttcatttctgttactgcaatctgataccctgccaaaaagcaatggcaaggtgaaagggttcattttagctcacagttccgggtgccagtcttttatagctgaaaa

SEQ ID NO: 27131 - DNA, 1177 bp, Mus musculus
ccattccataggtgaccccaggaggaggttttctcatttctgacaactgcattatcatttcttttttgtttgttttcaagtcagggtttctctatggaactctggctgtcctggaacttactctgtagactaggctgacctcaaattcgagagatctgcctgcctctgcctcttgagtgctgggattaaaggtgtacactactgccaccaccaagcacattattgtttcttagagaaaagctttcctgtcatttaaaggctattgtagttcaaacaatatcattaatatagtatggtggtacatgattgtcatctcagatgcttagtaggctgaggcaagaggtttacttgaacccataaaaagtttgaggttggcctgggccccccatctcaaaacaaaaagtagagcataaggtatgagagtggcagctgtctgttgtgtctctgtttcctcctagcaagtgagaggtgaacatgtgatcgactgttcttatgtctccctcccctgcctgtcaggtatacatggactggtatgagaagtttcaggacaggctcaacaagaaggtagtgctgctgacgggggagaccagcacagatctgaagctcctgggcaaaggcaacatcatcatcagtacccctgagaagtgggacatcctctctcggaggtggaagcagcgcaagaacgtccagaacattaacctctttgtggtggatgaggtccaccttattgggggcgagaatggggtatgcttggctttgtagcacagagaaggactgggccgcacccagtttgtgttgggcctgaaactagggactagggtcttcacaaagatttcagcctattgccttatttcaaaagagtgatctgagtttatatattatgttgcttagtgaaggtgtctctttgaggcaggggaactataattgggactgccagaggtggttcactaagggaagctcaggtagagggtgggagcctgggcctgaagtgactctttctcttcttcccagcctgtcttggaagtgatctgctcccggatgcgctacatctcctcccagattgagcggcccattcgcattgtggcacttagctcctcactctccaatgccaaggatgtggctcactggctgggctgcagtgccacctccaccttcaacttccatcctaatgtgcgcc

SEQ ID NO: 27132 - DNA, 1131 bp, Mus musculus
ttattgctctatctatgtgacttggcgtggcccgttcctgctttgtattatatgatactgttttctaaatgtttcttctgtttggctattctgtctattatacaaaggccattcattccctgatggattgcccttgaccctttattaccacgttgctatttattctttttaatgccttccctcacccattccacaggattttttcaaaaaatttttgtatgagccattgccagtagagtctcacctggaccactgtatgcatgaccacttcaatgctgagattgtcaccaagaccattgagaacaagcaggatgctgtggactacctcacctggacctttctgtatcgcagaatgacacagaaccccaattactacaacctgcagggtcagtgaactgaagagcacacactgccctccagggttttcatagccctagcgaggcagtgtcctgagacttccctcttatatctccacagggatatcccatcgtcatctgtctgaccacctgtcagagctggtggagcagaccctcagtgacctggagcagtccaaatgcatcagtattgaggacgagatggatgtggcccctctgaacctgggcatgattgctgcctactattacataaactacaccaccattggtgaggaccagtggcacatggcttctggagcctgttgggatgagatgtgctagccagcatttgtcagagagacgatagtgcaggacggcagtgcagcccaggcagttgatccttgttattgttattctgctcctcacagtgcccttcccccacgttggctcttctcacattcccttattttcttttcttttcttttttttttttttttttttttgagacagggtttctctgtgtagccctggctgtcctgttgctcactctgtagaccaggctggcctcgaactcagaaatccgcctgcctctgcctcccaagtgctgggattaaaggtgtgcaccaacacacccgctttttttttttttttttttttttaagatttatttatttttatttatatgagtacactgttgctgtcttcagacacaccagaagagggtatcagatggttgttgagccatcatgtggttgccgggaattgaactcaggacctc

SEQ ID NO: 27133 - DNA, 1197 bp, Mus musculus
aagactaagccctttggggacatctttagactgcttaaaaactcttaaggtgggctggcgagatggttcagtggttaggaacactggctgttgttcttccagggattctgagttcaatttccagcaaccacatggtagctcataaccatcttctgcatgtaggtgtacatgcagacagagcactcccacatcaaaaacaaaaaacctcttcaagtgttccggcaacttttagagttttaatctgagttctgttactctatttcatagccactctcacacttgcctgtggccatcaagttttacatgctcaagttgttggttttggtccttgtagaaacgtgaagagggctggtgggttgtgattggagacgccaagtccaacagcctcatctccatcaagaggctgaccctgcagcagaaagccaaggtgagtgtatgcaattgccctgcacctatccctggggctgcatagggctgcttcctcccaggtccccactaacctgatttctgcctgttctctctaggtgaagctagactttgtggccccagccacaggtggccacaactataccctgtacttcatgagtgacgcatacatgggctgtgaccaggagtataagttcagtgtggatgtgaaagaagctgagacagacagtgattcagattgagtctgaggcactgaacctgaaaacaggaatgtggactaggtctgtcaggctgaggtctggccattcaggccgctgctgtccccagtccacatccagttactgtcccactttggaccttagttcaaggtctgggtcttgtattttcaagtgtcatgtcaagcatgaactgtacaatatttggaggcatggttttctagttccttgagtcagacattctaataaataatttgaaaaaactatatgtccttaacagtgatactaaattttctttaatcaaaggtcatggccaaaaaaaaaaaaaaaaaccctttttggcactgaccttttctatggagtacataaagaacaaacttgccctctgattgggttagtctgaaggacaaaacaatggtacatagcttctcttcaaagttactctcatagcaggagctgactcccatcttggccagagaacaaaaggtagaggctcctcttgatctatgttgtaaaattctgtagccttccctcccaggaggcagcactggggtgg

SEQ ID NO: 27134 - DNA, 1222 bp, Mus musculus
gccaactgactgcatgtgccggcagggaaaatgactcaatctcatctatagctggagtaaacaggtgggagtaggaggaagagcctttgtagatgtggtggatcttagttaggaaagcttttctaagacacttagctgaggcctgaggtttaggaagaaactaggccagggactgttgaacacctgtaatttgccaggttggagaggcaggagtcatcggctaccccctgacatgtatgtttctctctcaggtgtcagctgacaggggccttggctacagcttgtggagatgatgccatccgagtgtttgaggaagacccaggctcagacccacagcagcccaccttctctctgacagcccatcttcgtcaggcccattcccaggatgtcaactgtgtggcttggaatcccaaggagccagggctcctggcctcttgtagtgatgatggggaggtagccttctgggagtatcaccagcctgcaggtctctgagctatagcttgacttgggagtcttgattcccacagaaaacgtcctaagacttctagtcgtcaagaagacctgaagcatccttgaccttcattttgctcaggactattcactgtttcccttccttgaggaagccattggagagagccacagaacagcagtatattgtattaaagttttgcttgatttagggcatggtgttacattttgggggtaaaatatatttataatcaatatatatgaataagagcttttgaaattgtgatctttatagaaataatccatctgtgctccacttcctgttttataagtaaggtcatttatcatttcttataacttgactattgggaataagctccactgtcccaattctagagtagttcttgcatttaaaacatgcaagctagctgtagtgttttcctagcactcaatcggcaaagacgggctatactttgctgcatagtaagtttgaagccagcctgggatgagacccttttctcaaaaaacaaagacattcaaaactagaggaatttccccccaaaaatgtaagtttgttcatagtaaaaggacacctctgcttttccttagaaaccctcatatgcctcttgagacattatgctgtgggcttctgaggatatgaaaagaaatgaactcctataaagaggaggttttcagtgagggacacaaaacatctacaaagtgagttccaagacagctaaggagacagtgacca

SEQ ID NO: 27135 - DNA, 1934 bp, Mus musculus
caagagactgctcctatcaaggaccccagtgaaggggactgagtgccctagcctcttcaccgtttaatgtgagtggttttgaaagaaaaaaaacaaaaccaagcaatagcagccatactctttctaaaatagggataaggctgttgttgttcagaaatgtagcccatcccttatggctctgcaatattttggaccatagcaccctctgagcctatagtcacgccttcccagtttccaacagtatgcaggctttctgtcctggctccttcttccaggcagctgtgactccctggggcctttctgtggaactagggccacatggcccccacggggctgagaactatggcctgctggctggccagcgtggtgctcctcagaactatggcactgagatgtaacctggcctcagttcagggacaggggccaagcagggcaggaccctccactctccacataggtactccacccagaggcccaccaggttggtgtcagggccctgtcagatgtgcaggcctggctgtagccttcagagtcaatgtggccctagactgtgacttggggctacagcttgctgcatgcccctcttccgttttggaatgtatgctggtcttgtggtgtgctactgggctgttactctaggtattctgtttgccttgggtccagtttttttttttttttgaggggggggggtgttgggtttttttttccctggtgatctggggcacaaggtaggtaagacctgagaggcctgcagcatggatccaggtaggcaagctgttcttgttccgttatgagcatctctggagtaatagtctagtgttagctgaagggaagatgaattccaatctctgccctcccataagacaacaaacattttgaacaagaatggagaatgaatacagttgttgacctgtgactacaagaagactgtcaactcgccattctttggccagaaagaatggtgaatatgtggacaaatgcctatgcagatgaagaccaagcgtgcccacaagaaggcatctgcttggagttccctgctgcaatgccaaagtgtgccccagtatgactctcccattttcccagacccctctcggaggcaagaaaggctgccaggtgatgcctgagcacaaagtcaaggagctaaattaaggctacctttctgtgaagttctgagctcatcattggcaggttgctgaagtgtgtagccagctctctctaacatggcacctgagggagcaggccagaagatcaggcaccaaacatgcatgccaaagtgaatgaggacttgatcctgcggaccgttccttgtgatttggaacccactttttactagcttcctgttcctgggcctttcttcctcctctccctgccattctgacactgatagtttgtcatataaaggtccctggttgtgtttcccccccaaggggaaaaattaaaatgcaaaacaaaaaccaggaactacaaatgagaacgcaaatgccagtggctgcctgtcatttctgttacaattctccagatgtttgttttcttcctcccagagaagcagaaggcattcactgacgaagcttgtaatatgaaacaaagtgaggagggacttggcatgcgcctgcaccacgcacatttggatccttgggagcctcccactcctggcacctttcacagaggaagttctcaaagcccacagctagatatagtaggttgctctgcccaaaatctcaactacagaccttgagccgcctctctctgcatgtcctgattagctgcagaagagctgtttcagacctctgctggtacttactgggagaagcctgaaaataaaaatgagcaagacctgcagagtcgctcttccaggcagttgatgggtgataccttgatggctacccacagtcttagttcattcattctcaacccatacactggaccccaagtgt

SEQ ID NO: 27136 - DNA, 1209 bp, Mus musculus
ggacctctctcctaggattctttccttagctcaggagatggactcagccacaaggaaacagtgaaatgagtagtctcctggacactttgggaaatcctgtgctagaaatgggaggctggatctaaccagaaaaattaccaacgtcttccaggtgggaagctgatggagctgggttggtgtgcgagagcatttcagggaggggctgttccctctgagggaatggcagtagtggtcaggttgtagtgtgaagtgggacgctgaaggcctatctgatgtttctcaaagcaatgggaagccataggagggtgcttaaaaaaagggatccagttttatggtgatgtggaggggctattgatattaagtaaagtacctgaaagtgtgagaattggggggacaggtatacatcatgtggaggaccctcaggcctggtaggaggagagaatgatcactgccaggtgctggggtagagagcccaggaacatccttgtcatatgcactagaagatgggatcaaccttgtagctcaagtgtgcctcaaaagagagctatgttgggtaaggacagcagagagaggcctctgaaaacacaaagtggctgttgtatctgggggaaaggtcattctctctagatgactccaaaatctccagctggtttcttactcagaggtacctgggccaggacagtatggaatacaaggttctgtggggagaaaaaaaagaactaataaactttatagcctttgttttcaaatagcctgtagtcttcctgtgcctttcttgtgggagtaccattgtaactagctcaggcaggacatacagagaagatgactccaatctgggtgaatctgcttgaaatgagacaaactctttggggatgtcagttccttatgagatgtggggaaatgcttgacttcaatcctggaataggggctctttcttcagaagagattcagagtggactggcttgtccgttatactgagtgggaaaacccaagcctggtgaggtgccttttccaaagatgctgaaggggaggtagaggccatctctgcccaatcatgtgtctgaggggttagttaataaaagaacttccaaagaggctgtttccggtctactctttacatggctctctcagagtgcaggacctgtaggtgtcttcatttgaactatcttgtcctgactatccctaaaaaatggcaacccgcttcctaag

SEQ ID NO: 27137 - DNA, 1185 bp, Mus musculus
ggaccacccgtactctctcggagccggaacccagaaccgcgtccctgccgcagatacttaggagggctcggggaatcagggcaagggggaccaaggaagctgcccctgggctgtgataggtgcggggtcacgtagggcgtgcaccgcccctcccgggactgtagagaacagggaaacaggccgggcctctcaggacaacggaacgccaccgcacctgaccgtgcctctcctccggaccgggtgagacgtccctaaatggctgcaccgccgggtccgagggtcactctccaggcgcccttgacaggccctcccgccacgccacctagcttgctaccaggcagcccggagcaagggcggaggagcactttggcttagccaatgagcgcccagggttctgagatgcgcccaatcagagtgcgggcaggacaaacaggttaggttgcgcgcactcggcgcgagaggcggacacaggcgcacgggaccgcttctgctgtggcctgggacggccaccgctttgcttcccgcgccctggccgcgggggccccgcgagttcccgccgtacacacagacgggcgggctgtcgggaccgagagggcctcgtgcaacggcgctctcctcggaagccacgctacctcagccgcttctgcaaaaaggcatgagggacggctcctggcttctggagcgtgaggtggcctcggggtcaacccgttaaggggactgcgcggacggcccggcctgccttcccccagcccttcctctccggggccccgcggcaggcgcgggaatccacagaggccgacatgttcccgaggaggccaccggccaccctggccgcctggctggcgggcgcgcggggcgggggcctgctgtccgcgctggccaatcagtgccgcttcgtgacgggcctgcgcgtgcggcgagcgcagcagatcgcgcagctctacggccgcctgtattccgagagctcgcgctgcgccctgctcggacgcttctggcgccggctgcgaggccgccccggccatgcctctgttttgatggcggcgctctccggtgttttcgtatgggacgaggagagaatccaggaggaggagttgcagaggtgagcctcttggctgcagttggcgtccctgttccgtagagaagggtgggcctgggcgggaggttggtgggcaccttggggcttga

SEQ ID NO: 27138 - DNA, 2344 bp, Mus musculus
tgggtcaggctgacaaaaaaaaaactaaccagtacaacagcttgactagattctgctgtgtcccaataggcatgccagatttcttggagaagctgcacatggccactctgaaagccaagaacatggagatcaaagtgaaagactacatctcggctaagcctctggaaatgagcagtgaggccaaggccactgctccatcccctgagcggaagaatgagggtagctgtggccctgctcggattgagtatgcttaaaggcctttgggataaggaaagacaggcacttccagccctgccttgctccttcagctctgctgcaggacagggacaagtcacacatgttagaagacatctgctgtaactgtcagtgcaagaggatttagaactggagttagatttcatctggagccctattgctctttaccaaacagaggagcatgacattgtggagttgtcatgttctcaggccagcagttgtgaaatccagtatcgtgcttacctactctggaacaacctctcatgttaggccagaaggagatgactcctatccgcctcctacgagaagcttccttgctgacattccaaatgccactgttggttatgcaatgctctggatatccttcagttctgtaggtcacttggagagtggttggcccctggttctcactaagtggttttttggagtgctcttggtaacagtcctgtggtggtgtgaacaattctggctgagctaagtgccttgtcctcaccttgctttatctttaaagacatgaagtttgtaccaagggatccttccccctgcagactaccatgacattgactcatctggtggaggcagctttcatcttaactggcctttctgttttcatgggctgtgctcactgtgtcatggcctctgccgtagccttagcccatttgctgggagcaccagagacaaactcctctagacggtagcttcctaaatgatgtcatcagtgttttgataggatcagtggaagtgtgcacaaaacatcttacttaaaaatagatttctttttaacccttgtagcaaatggagttaggtggttgagcacaactcttcccttagtcttgtttgttttggcactattttcccactgcagattgactgcgctgtcctggaaggataaaggtggtagatggtggttgtgccatttcctcagagttttcaaaactgtaagctgacatatgggccaacagatggagtcttgcccaataccagtatggtagggatggggcttttgtgacctcttggtcttgtaaagcatttctctccagagctgacatagaagtaatagacacagtttggataagatcacaaccagatgctaggtgcctggccttgctggtttctttatggtgaatagggatcaagtttcacatccttctctctcttttcctggaattaatagagctgacattttcttttcttgcttgctacctaccctgttgtggtgttaaaagagactaaacccaaggtgaacataatctttaaccttctgttgcctattcagttctgtgccaaggaaacagctaactccccagtgtttctgtcttttcggttgttggcagagcagagagtggcattgagaagccccagtgtctctcagtgagcatttttcccttcttcccaggacctgacaggaaaagaaaaaatctttatttgactttaacatctgtagctgactgcctgtgaatctgtgagcaagtgtaagcatgtatgtgtgcgtgtgtgtgctggggctcagggactgagcagttacgtttaccctttgttttgtgatttgactctgtacagttaacttgtgtcatcataatgagtttgctcttaactgtgacatttttatcaaaggtgtgaataaatgcataaagattggtacagaagagtgttcatttctggccacatggtgggaaactgtgctccttgtcatcctgatcacagacttggcatgggtcgtccgtcagtgggccttgttctttcttggcagacaatgggtgacacaaagatgacatcttgcatagactgtgacccctaagtggctagcttgggagctaacggtaaaatgcctgtctctactcaagtatcttgatctgctaactcatagctagaataagaaaaaggtttagttaagggaatctatgtcagatcttctatagacaggcttcgtagaagatgttttcttaggattttattgctgtgaagagacatcatgaccaaggcaactcttataaaggcaaacatttaattgggggtagcttacagtttcagagatttaatctattatcatcatggtgagaagcatggcaatgtgtaggcagatatgtga

SEQ ID NO: 27139 - DNA, 1201 bp, Mus musculus
ctagaagcatgggttgttttctcactcagcatccctctgggaggcaagtgggcacgtggatgcctcagtggaatggtctggaatcctggcctcgacctcactaaggtcctgatcactggcattcaacctcgcagagagcagggtgacaattgcctgccgcctacttgcagcagggagatgaaaggctttgcagagagctttgagctccatgggggaaatgcgctagagagccagcaaatgtgattatctggtgatataaaaatccctttcctgtgtgtttaccactgtgagccttcctgtagacttttgttctgtgcttggggtgtgtgaattcctaccccaaactggaagtgggttgaggtgcacggagtcactctttcaaattccggaatttctttgagaatgctttcttgtgcctgaaaaggtttgagttattatgctgttgtcagcttctccatctgttacctgtaacagagttttcagtggcttggccccaaccccattaggggataagctctttgtcattgagcaggcaaatcgttttcctaagctaaaaatacttacatcaaggaagcagtctgagatgagatcctcaggtggggtgctggggctagaacaggcagccaaggccctgtggactcctgggatagccaccctctgtggggtcccagacaactctctgaaccccatgtaacacctttggagacagaaggagaccccagctcagaaggatgtctcattagctgttacgaaccctcatggcgatacagctgtgcactagggtgtctctacctcctggttgtctccccgacttagaaattgctccccagagtgactggggatgcatctgggccttccccacaagcagcctgacttcagctttgggcaatagacctcttagcctcagggaaggggtagattgagccatgcaggctacaagctacacaggctattagcccagggtgggtttatcagattttgaaggtgctaagggagttttctcgggtaaagacaaagatgggtcctaaattgaattcctcttggagaggatgaatagcttggtccttggttggttgctgtttcgaggctaggacattgatttggggtgtggctgaggggttggtttggttttttgtttttgttttttgtttgtttgtttgtttttgagacagggtttctctgtgtgaccctggttactctg

SEQ ID NO: 27140 - DNA, 1105 bp, Mus musculus
ggatgactgagtggaggagcaacatgtgcctacagaaggcacgtgctgactggatgtccctctggcatgctgttggggtggctctggctcacaatgcacgtgatcctgctctcccctgctagggtagagtttgggttgtgtgtctgggaacatctgtcaaatgatggaggagagatcaaggctctctaggcccctcccatcagcaccttcccctctctccccagccagtgtggccagctccgcagtgatgagcacagccatcatggccacactgcttttgctgaagcaccaaaaggtaaggcactgcatggtgggtggggccagggaagggccaggcgtggcactctgctcaggcctgttttgcctccagggtgtggtcctgtcacagctcctgggagaattctcctggctgacagaggagacactgctccgaggttttgatgtgggcttctcagggcagctgcggtgcctggcccaacatacactgagcctattgagggcacatgtggttctgctgcgtgtccaccaaggggacttggtggtggtacctcggcctggcccaggcctcacacacctggcacgcttgagtatggaattgctgccaaccttcctgagtgaggctgtgggtggtgagtcagtgggtcagcaggattgggatgcatgtgcaggggagagggagggagcaggtccccttcttatgccatcttctctgccagcctgtgcagtgcgggggttgctggcaggcagagtaccacctgaggggccctgggagctgcagggcatagagctactgagtcagaatgaactgtaccgccagatcctactgctgctgcacctgctacctcaagacctactgctgccccaggtcagaccccctcctgtagctcagcaggaccttgggccttgtccttatgacctcctgtgatagtgactttggcctccaaacacctctggtcaggattctgccagcagccccttccccccatgggtgttctctgaagggcattggtgcttctcttcctacagccctgccagtcttcctactgctactgtcaggaagtgctagaccggctcatccagtgtggactcctagttgctgaggagg

SEQ ID NO: 27141 - DNA, 1158 bp, Mus musculus
gtgactcactgaggacgccaccctcacaacagtgtccaccaggatagcgtctcccttgtagacacatcccgtagagctctgcctttgtctttcaaggcacaacagtctgctgaattagagtcttctcaagctctgaggaaactaggtgtgggcattctttctattcttaaggctgatctaaaatgtccgggtgtctgcagtctcttgatgtgtttggacatgttctcagaccactccttgtgggagaaagggacctgactctagagcaaagtgagaggcaatggctatctctggctgccacactccaggtgagggatgtctgacctgaaagaagaaagtataattaggaaggacatggagaatctgcaaagtcagacgttctgctaggagatctcactttgtccccacactttaaagaactgagtgacatcctagagatggagtcccagatgcagggatgtcctgccagccaccaggagattcaggattctagcctcagtcagctttcactagctgatgttttattctccaacaaagtaggagattgagacctacaactaaattagatttggggatttttctatgttggttctcaggatggaacccagggggtttgcatgctgggtaagcactcttctaccagatcccatcatcagccccaaattggatctcactggcacattcagaaggactttggttatcccagccatactggtatctgaattcaccatttgcccacttaacacagccaaaatttcatactaaaacacaagcaaaagattagggggagttatttttaaaaattaaaatataaactaagagattatacaaagtttattataatgtttaacaaaatctgtaactgagtgctgactggggtagtcttatactttcaacaaagctgaaccctaacattacactaaccagcagctcaacacgagtgagcatcacttttagacaagaagaagaaagagatgaaggaaggaagaaaagaggcaaggaagggtgactaagaggaattgcccaaggtttctcaatgtttcagatttttaatcattaaaagaaactttcatacaatctttgtctcactcttttgttgttgatgctgctgctgctgctgttgctgctgcaaattactataactaaaaaacccagatt

SEQ ID NO: 27142 - DNA, 1123 bp, Mus musculus
atttaggtcttagtcaatcttttctcaaacaggcaagtctacacaaaggcttgccggtctactggccttgcacacgccttgcttgtagcttgtgctatggccctggagcagttgagacctgccttccctgactctccccccccccaccccccatcacacccctacttcccaggtattaaggttagggctcaagaaaaatgtacataaaaccaactttgagaataaatttgtggatgaaatcagctgctgggtttggggagtcagaatgggaaagatgcatacgctggatccttcagaaatttacagggcagggctcagtgttcctgtgtggagcttcaaagaccaacctcctaaggaccagaggcatcctcggcctttagaaaagacttcggcaaaggagattggaacatcacaaccgtaggtttaccttcagactcctcccagaaaccctggggaatcagcagctgctctgctgttgtaggggccgggaaaggacccagatggaggtctacactcatttctgtgtactctcaactcttcctagggaccctctgggcagggccagcctgcaggactcatcttggaagggtgtttgcatttgggggtctttgggttttttccaaggacagaccttgtgaaaagaaaaacaggaagtctaatgagcactctccagagttagctgggctctgtcttatcaccatctgggcatgtctcagccctttgccaagggcccctgcacgccaagggtccttacccgacagtccaaccatctaaataattaccaaaagggacttaactaaatctaactttcctccgtttgtgtgtggtggggggtggggatgggggcctgaagtatgttggagtggggctgggacatgggtgtgtgtgtgcaggcttagcttcgccactgtttaccggttactaattgccccaatgtcttgaaaagccaccatttctctctctcttttctttttctttagcctgggaactgtctgtgatcttcaccattgagtatttgctgaatgacctcgagcaaataaaagattgttggacagtgggaagtgtggagtctatcgctttgttattgttggcccatgcatctggccatctttttgttgattct

SEQ ID NO: 27143 - DNA, 1158 bp, Mus musculus
atcctaatgacctgcgtataatcccagcaacccatgtaaaaaggcagatatggtagtacacatctctaatcccagccctcatatagtgagagaggcagagaactagaaattgcctggaagcttgtgagccaactggactgtaatatgcaatgcagagaattgagaccctggcctaatgaagtaagagggaaccaaccagctcctaaaaggtgccctgatttatacatgtgtgcacgcaaataataatttaaaaaataaatacaagcttttggtgtgtccatgtttaagaagctacaagaagccatcatagaggctagtctttttgttgttgttgctatactttgaaaagttctaatgacttgattagtaatattcaggacttcctaattttgtttttgtttatatatttttgttttgcatgaaaggttagtctagtatgtgttggacaaaatacttgctcccagcaggaattgaggggtccaagtctttcatccatcagtcatcagacctcagagagttcaggagagaaaccacaggaagaaccttctgttcctcttatggtaaatgctgttaacagcactttgctgttcccagctgccaacctgccagctcttcctgttcctgtaagtggccagtcattgacagactccaggtaagctaagtgtcctgggaatggtagagatgtgagtggcatgtatcatttcttttcatgatctgcaatgtcatgttgtgtaagagatgaacaaacggttctggtttttaatttgtatgttaaaaaaaaattaaatattggctccaaatctttcagactaacttccaagcttattttacagcatttgtttacctttttacttttttattgcattaaaaactttcagcagtctctctgtaccttcagaatatatagctgaaaatggaaagtacctttgtttactggctttaactgcatacttgtaggcattattaatgcacagaaagctaattgacatgtgttctgatgtttcctctgtcttccttcagaagctatttggtataagtgtcaatgattctttgtgccaagatctatctccacactattccccaatttagaaggatttttctaggcttcaaaaaatagtaataccaaatttcttatttgttttacatttttgtctttgg

SEQ ID NO: 27144 - DNA, 1162 bp, Mus musculus
gacctaaacttcttctctatcctgaaatgtccctagacattggaggagggaaacccggcctaaactcatgcattgcattaaggaacactctggcctggtaactcctctgtctttggagaggcgacatttgtgcaggattcaggtagtttgagtctaaagactccctgtatttcttttacctggtgcttgcatgggtcgagggttaggttttatgctcccgtaggaacggtgcagaggcaagctgtctttggttccttccaccgagaggtgtgcggtggctgccgctgacagtgtagagccaaggtggcgtcttcagtgtagaagtattcgttttctccagaatggactccagagcttaagacagaggagatgaagccgcactagggagaggctgtgccttctgaaagattttcctgattgttatgcccaggcgctgtaccaagccttctaaaccttggtgtctactctgcagtgtggtacccatctggaagacttaggaggatggcaggggctcttcggggagctgttcagggagtcagtgggtccagagagaagctcagagggactggttgttggaaggtcatggagaaagcaggcagtttgcgtttagctgagtgctgaagggtcattcatatcttgcagcctatgtttgaagcctcttcgtcttcgtgtcagggatgcgtcaatgttcgacaaccccatttcacactcatctcccatagctgtcatcagggccgtctccatggctcagctgccgctcttatacccatacctgggccaggtgacatcaagtgcatgtcacatagtcctcagcacctgtgggcactaattatgaaagatgtccacttgtgggtattttggccatgggctaggttgctgggaaaggcctgtcagccctttagggtagctgttgaggggatgtcctccaagtgcccagcctaaagctaagacccctgcagatgggacagtgagtgagtggaaaccctttgtctgatcacaagaaacaccttttggtttacactgcttccttcccccttggtctgggacatgtgcaggcatgagttgattggagtgtacacagacaacaggagaacccagcatcagataaagtggagctaaaacgggggtccacacagatcagctttgataaaacacaagtttc

SEQ ID NO: 27145 - DNA, 1181 bp, Mus musculus
aattttcttctgcttgaaacatccttccaggaagaaggggaggggagccccaagacactaaataagcatcacgtgtcttaggaagctgaagcttaagagtcacaaagtgctttcccaaggttgtagaaatggaactgtatgggaacaggacagaatgggacagattgacttaccagcagagctccccagagaaggcctggctgcctgggagaggagattccctgactagtcaagcagcctgcaagttgtgtagagttgttacccatgatgatgtgggctttggtgatagagctgctttttgagtcgttcctgctcctggaacaacacaaacccctattcctacaagtgaccccaataaactcattatattgctaaagttggactttagcaatgtcattactttggtatgccagtgattctctggtgtttgggtgcatgtgtgtatagagaaaagctcctgtgtactgtatggatgcagtacctgtcagttaaaagctgatttgcctgaagctgaagcaggaaatagaaggtgggacatctgataggcagtaaggattctaggctggggaggagcaaatccacagaaagaagatggttgcatgcaggttcttatttgggagcttggggtcaggaggaaaacttggtttttaacagatgacactaaacatataaggcaagaaatccaaaccttttaatttcatactaaacagataaagtcctggatggaaagtgaataaacaatttgaggccagtgagcatgcagtgtctcagaccaaaagagcctgcctgcctgcctgctgccactgaaggagcaaagagcctgcctgctgccactgaaggagcagaggagcacttttaaggttacaacacttgctgaactttggcacacttttctgtggaccaaagaagacctctccctcactgtagctggtggggacctgcctgggaaacacctgcaacgggccacagggacaggggtcagtcatccagatcatgcagccagaattcagaggtttaaaaaacagccctcagtgaaaccctgatggcataaggcagggtttaccccgcctttccagagtggggaaaggtcacaacgtgtatctgtgcaaatacacaagagctccggactgctgggacccagagacagaaacagattcgcccatccctgtaaacctaggagc

SEQ ID NO: 27146 - DNA, 1097 bp, Mus musculus
gcattgatgggcctttttgtccgctggacggacaccaagaagagattctagtgctcttgagtcaaccatgttaggatcttcagataaactatttactagtctccaaaccatgctgtgggaaccagtcttaccatgcacagcagccagcctcctgggaaccacgtcaagggaagagcccgagaaacacctgaagtgttctagtatcaaaagtggcacttgtgactacaagggaaggctgattgcccaggacgttgcttcacctctgatacatgtggaatggagacacaaggggcagctgctttgagtgtaggtactgtccagcagacagacaatggagcggtgtgctcagattctttccccaaagggtactgacgtctgtccttctctctcttggtctaacgtgggagtgaaggaaaactgagctcagatgccaaacttcatctacactactccatcatagttctcaacattctggactctaccctatctgctacacccaaccctgctctggtctgctgctgcctgcatggattctgagtccaagagaatcagaaacaactcaatgtgaactggaaggtcttagcgttggcagagcttctgaacatgttgaaagcagccaagcacctttgcaatcacatgggcttttgtgtgttttcttgatgtttctcccattgacttagtcatcactattggtcacattatatagagcatcttgtttaagcttttgtctttttagctaaaaacacttctttggtaaacttttaatactgcaatctttttcctttagaatattttggagtgtacttttaagacttttttttttcttgaaacatatcagaattttaaaacaggaacttcataataaatttagtaagatttataagcacctgccagatcttaattcctgttcttttatactccaatgtttagctgagctgctagcttttctctgtagctaatgatgtctcaagtctctgccttgtgaggctgcagaccacgtgttttaagaactcaagacatgttgggtcatggtgtcatggtcacctcataggtggagggtgggtacctaaaacaaggacagaagccagcagctagtg

SEQ ID NO: 27147 - DNA, 1247 bp, Mus musculus
caccctagaaatgactgcggcacagaatcctgatggcagcaaagtgaaggcagcatttctgttttgtaaccaatggaactcagttgcatacgcctcactgtgcttaaaattcatgttgaaaataagacagataacgctggtgctgtccacgtgtcatatgatgtataaaacatcagttaaaactcacattttgtaaataaagatttttggtttgttttcaaaactattgattgctttggacttcagagaatagatggacaggctgagtttttaagccttataactttagtggttcaggttctgtactcagaagtgcaaggcttaaaaagccacattgtgaaaatggactttgtgctctccgggagcgtttgtgtgttgtctgttacgtaacagttatcttctctacaatgagtctgtgcttcccgtggtggatggatgacagacagcgttactgccagcagttttctactgaatgaagaattgctcagcatggagtactggactgtgcccaagccctgaccttggtgcagctgtgtaggctgcagctctttggaggtaatcgaggttaaagggcactctaagggggagtctatttggtagaatcgatgtcctgctcagaagaggaaaaagagatgattttctctctgtaccatgtgagaactcatagcacaactgctcacaaactaagaagattcccttgtgaggaaccagtcagacagtcttgagctttagcacctagaagtattaagcgataaactcctgatgcttgtctgtggtacttggtgtttgcagcctgtgcaggctgtgcatgacacctgctcaaaatactgaaaatacagaattaccgccacagaggagtgttaagaaatacggaaatcagtctatctgaactaaaggtctggaaagtgcttttgcattctgagtttcaggacagctcatgatgccccatgtaacaggaacaacactcctttcactccatttcaacctgtgctcacagctttctctcagaccagtgtgactgtaaacaagtaggaactgcagaatgcctactcgttaacttcccgcttgtttctgaaaaagccaatagaaattgctgcgttgggatttggtaatgtccatctgcctgcctgcctgcctgcagcaaggtaatttgtggctgaccttgagggcaaaatgtgctttccttcacttttagattagggattgcaattaaatggcagttggtgatgaacattcaatttgtatca

SEQ ID NO: 27148 - DNA, 1273 bp, Mus musculus
tataatatttgtggattgtcatattcctattccttcatgttactgaatgccagaatgtcctttaaaaaaaccaaacacctagtgagtatacagtcattctatagacattacttctcttataacaaggagactccaagatttatatcctggttagtggcatagacctatgcagtagtttttataatgtgaaagaaaattagaaatatcaaaatgcccaagtatttaagttatggcatgtccatatgctcttatatattggatgtagcaagatcatgctgtataaggctttttgtgtttgaaaattgcttataagttattaaaagggttaacatgtatagtagtgtctgattttcatctatgaatatatatatgtatatacagaagaatttctgagtgtgatgtctataggaataatatcagttttcagtaggtggtgggttgtatatgttagattgctccatagtgttctttttttttttaagatttagtttgaaaattacaaacatttgtaatcttccaagttcagatatttttggtaatgaagaaagttgtaacactaggtaatgtttttgtgtcaccagacagggccctataacctcgaaacctgcctgagtgtggtcctgctgtctcttgccatggtgatggctggctctgggaacctgaaggtgttgcagctctgtcgctttctgcacatgaagactggtggagagatgaactatggcttccacttggcccaccacatggccctgggccttctctttttgggaggaggaaggtgatgagtgtttttgttctgtttgtcctttaataaaagagttcatgagggagagctatatatgttatctgtttgttcactttgaaaactacgtgtttctcttgttggcttttttcatacaaatgttggaatttgtcatttttcatagtaaataactggatagaacattaattagaactgtattgatggcacctgcagcagaggattgaagtcccttgccatgttgtcttcagctattgctatacttatgtggtgccttgtgtggtagagattatgagcaagatgggtatttcttaatatagtttgtggcagttgcttctttttattaatttggaattatgaatacttaaaggttggggctgtagctaaatcataaagcatttgcctatcatggacagggcccaacctgtgaattcttggtgcaccaataaaaattaaaagagccaacaaggatgggtaaagaaatgttagctgtaagaattctttagtattttgtga

SEQ ID NO: 27149 - DNA, 1147 bp, Mus musculus
atgatagtgtttttagctgggtcactgtacatacatcctgtcttagggaagcaccatcatgtatgtgggctcttggtggaagtgctgtgtggtgcatgttatagttttagattagttattccatgggaaccaaagtaagtttttatctggatatatatcactttttttgtttttttccagactaacactgttgcctccatactaaacgaatcaaaaaactagcatttgtaggaactagacacttacatagactcgggtgataatgagatcaggatcgcgtggccaacctgggcaacatggtgctgtcccagtgcagaagagctcagcttgtatgacagcattgtttgacttcagaaagtttactggttatgcttacctctagtgtagagttctgttccattagcctgttttcccttctcaggctagacatacaactacctttcaaatcactactctaaaatccatcacacaggtgctctcatcagaggtgtcttcaggaactgaggcagaggaggaagatgatggcatgaatgacttgaaccatgaggttatgtcattaatatggagtgaagatttacgggtgcaggatgtgcgaaggctgcttcaaagtgcacagcctgtccgtgtcaatgtggtgcagtacccagaactcagtgaccatgagttcattgaagaaaaggaaaacaggtaaaatagttcatctcctgtccaatctgttacacttgagactagtttgctttcctttaattttttaactttgcttttttaaacattgtgtgtgtgtgtgtgtgtgtttgtgcgcgcgcgcgcgcgcgtgcttgtgtgcacactgaagtgtgtatgtggaggtcagaaaacaacttttgggagtcagttctttccactaggcttcaggataatccagctcagaccattaggcttagtggcgagtgccttttcttactgagctgtcttgccagcttggtggttattaaatgttatcttgctatggtttagaattacctgggagagaatttaatttgaggacttagaccaagttgatctgtagggaattgtcttacataagctaaaatgaagtaacttactttgaagttaagaatctaccttttatattaactttatatctaatgccagcaaaccatctata

SEQ ID NO: 27150 - DNA, 1173 bp, Mus musculus
tgctactattgtagtagttgttgggatcattttctgaaaattgatagaagaaattaagtacttactatttcaggaagacaaataatttatcactgtttgatgaaggaaactcttattgaagaataccaacctataaatgtaaaagaaatggtagaagcagaaatcatcttgtagtttctagtgtgctaatgttcaggcatggttgtaatggttattaccacagttgcagaaaaggatagtacatgacagcaggtattacatttgctaagtttaaagagacaaatgaatcttctcttcagaattgcttcttgtttctagtaaccaaatgattgggttcagcttaacttttatgtactctatgtagttgtaatacagggaaaagactgtgatttctactatattttcttttgagaaatatttaatgtgaatatttagatttagcattcagtttatagtaaacttgagatctaggagtgcaaattcctaagtagcatgagatttgaggaatggcttggctgttactcagtgacggctgtgtccagaaagatggttaagctgataaaggcactttctacaaagcctgacaacctgagtttaatccacaggacccatatgctggacagagcgaactgactccttcctgcaggttgtcctctgactgccataagtgtgctgtggtatacacaaataaataataaattccatcataaagaacagaggctgggtgtggctgtgtacgccttcaatcctagtacttaggaggcagagccaggcagatctcttcatttgaggccagcctgggcatagccatttacaggacagagtgggctctgtagagataccttgactcaaaatgaatgaatgaatgaatgaatgaatcaatgaataaagctagctggccagagctgaacgcctgtatttctagcacttgggaggcagaggcaggtagatctgagttcaaggtgagctttgtccacagagcaagttccaggattacacagccagggctacacaaagaaaccctgtcttgggaaaaaaccaaaaagtaaaaaacaaaagaatgggtgaaggctgataattatggaagctgtggataaggataaattctgttttctgtgtgtgtgtatttgaaaatttctgtgatcaatagtttaaaagaaaaaaagatagtga

SEQ ID NO: 27151 - DNA, 1133 bp, Mus musculus
caaaagtccttcaacaggccatacctcctaatccttcccaaacaattccaccaactggagaccaaacattcaaatgtatgcgcgtattggggccattcttaagcaaaccactacactggttatacctgaggttttggtacttgttttccttaccaagtagagttcatggccggacagcaccaggtgaaagctgtcaagtcaggtttgcaaatacataaccaaggtcttgagagacaactttttatagagatttcttttatacagttgcctgcaactaaatcagaaggctcacaaccacctgtaactccagttctagaagactgatactctcttctggcctctgagggcatctgcacacacgaggcatactctcacgcagtcatatgaatcaaaataaatctaaaaataagtaaatcaatagcaaggctaggcgtgtggctcagcaactctgtgcttaacctgtgaactgtcctatatttcatcccaagaccccaaagcagtacagaataaaaatacagaggcgaggggagatagcttagttggtaaagtccttgacttgtaagtgtcaggatatgagtctgatccccagagccaacatagcacaactttgaatgtgatagcacacacttgtgatctcagtgctggggaggtggtctcaggtggatttctgaggctcactggccagctacccaggtgagttccaggccaagtaaggcctgtctcaaaaaaaaaaaaaaaaaaaaaggtggacagcacctgaggagtgatatttgatgctgttctctgtacacacacacacacacacacacacgaacatgcattcacaagaaaaatataaataaaatacataatatatttatttaaagagagaatatatatgtatatggtggaaagagccaaggagattatattttaataaaagatgacttatttcactgaccttgcagaactcaaaatgtatccctcagtgttaacatttgtacagaatcaatgttgctttttaaaagttgttttcttttccacagtattaaatgtaaaagtgtttgttaagtgaaatggcaggtttgccttcattttttgaccttcacgagaagcctggcatgtctccatccatgcatcatgtgtgtgggaga

SEQ ID NO: 27152 - DNA, 1557 bp, Mus musculus
aaaactaacttagacagtcagtttcatggccattaagttgcctgatttggaaacaatttaagaagttaacaacatgtgctcagatgcctcttaggcggcagccacaggcatgccatgttgtgtgtctcagttttctctggacaaacgaatctgtagctgggctggcggcacactactggtaaattcaaaaccacgcctggtctacatagttctgggacaaccagagagagctacatagtgagaccctgcctcaaaaaaaacaaaaaccaaaaaggaaaaggaaagagaagaatctatgagcattccttccctcgccttcgagataacgtgattctcctgaatgctaacacagcactgttcatcttttgtaatgataattttatttgatttttttatactgaagtgacaatattggaactcgagcatgttcatatatttaatcttgtccctttcattggtgtacacaaagctcttgtttgtaaataccaccatgcactacacatcacggagtctgagctcgggaacacgtatgggcaaagagagacgtcttgagggtatgtccaaagacttgcaggccacaggtacacgtgctgctgctacttctgctgtgaacctggccatgtgactcccctacagcactttatctcagccccggtgcactgtttcttgtgagccttgtggagacttgtgagatatacaaacatctaaccttaccatgcatcaacatgtacttaaccagctctcaaccatatcttacaccttgttgttaaattatgtttataatgtatgattgaaagtttctattctaatattttttgaatatagaatgttctagacttgaaaggcacttgaatgtagagtgatgaaaatgtgaacgttttgccacgttcgtgaccaaagataccaggctgttggacatgtaatgtggtaatgacaggcagggtcttgtatgccttctctggaggacttctgccctgtgagttagaataacttgggataattgagaaaacatgaaaatgacaaggaagagcactatccatagcctatgatgattttttcactgtggcaccacaaaacaaaaggttttctttcaaatgcctactttctgagtttatttcctgcgtactcgtttcaaaagggttggtagtgacatatttctatagttgcgtgtccgttttaggtttgtcatagtccaccttgtaacccagctctgtgaaaactggggatgtcttgcacggggaggagcattgcagggtgtcactgtatagctctggctgaggatgggcttgcgaacctcttgctaagactctaggcatgcactaccatggcctgcttcacgtttttagtaccctgtcctcacagcatgaagtagctgactctcaacccacaggtctgcacttgagtatttctgcttagagccagcaggagctacacattgagcagggtgagtctgcagttgatggctggggaaatgcttctgacaccacctcaatgggatttctaaaaagcagggaagacaaatgatgctgcctctggtgtagctccagactgaaatga

SEQ ID NO: 27153 - DNA, 1097 bp, Mus musculus
ccaggacctccgtgcagctcctcaggctccttccccgtctgccccaagtctgcagaccacactgggacctcacaggtgctcagctcagcctccgttcaggatgctgctgtaggatggctctggtaattgagaacactaaggatcaggctccagttgtattcaagacttcttgttatacagttcatgttagatttggaggcatatgaagtttgcttgagacatttttttcgtgctttgaattaggttaatatttaaaaatctgcctttgggggtatttattacatttcagtaagaaacaggaggtggaaattgtaagcttgggagttggtaggatactcccatgcatttcctgttttttgtttgtttgtttgcttttttgggttttgtttttaatctgtcctgtgcagagtgccacctgtatcacggtacatcatgtttatactactatgtcaagattaagcttaaagtatacatacagagttgatttttataccctcttgaaggtttggagctattgccctggctgtatatgactgaagctgagagagatcatgctacgttttgtctctcgttctgatatttgtgtctttgtatggttgacagcatgcagtaagcaatataaaacaccaagccttacgtctatcagaaagaagtttaatatataaaattctgaacatataaatatatttaagtgacaatactagagttttaaggaagtgtgtactccaggacggggactccagggcggggactcaatactgtacttagaagcttcttcagaattagggaaacattcatttccttggggagaaagtttagaggttaaaaatagattctctattttaaaaagttaaattataatttggaagaaatttctttgactatagaacacagcaatttaaaggaattttgtttgaaattttgtatttttgtgccttaatatttggttttttaataaattgctttctgacatttggagattgtttcctgggattatctgttagtgctgcctcatgaaaatccataggggatgtggactcaggagatggcacgagatagagttctttaaaggagaggtgtagctcaaagtcagaaag

SEQ ID NO: 27154 - DNA, 1123 bp, Mus musculus
cgggctgtgccctggcctgtcagtgaaggcctcttgcttgtcaccatcccggtgggctatgagtgagcgcctgccaggggtcctgtggacgccagtgtatgctgctcactgcatgttttagaaacaaaagccgcaggcctgacgaatctgcaagcatcaaataagcatgagagagagaaaaacaaaaacaaaaccatgataatcttactttacttaaagggatgggtggatgggtgggtgggagggagtctctgaagagtcttgagtctcagttatctttggtttaaccagaattctgaatgccgctttgcaatttctctcccctttatccccccacaaccccctccccccacctttgaacctttgtagcaatcctttctgggagtcagagaaggtagaatccttttcctcacactcctcacctcatagctctccccatgcggggcctccttggctccaagggcctctgcaggagctggagggccaggttccattccagaaagggcccagtctgcatatgcatgtaagtgacaggagagacgccctctcagtgagggtgtgcctgcctgagtgagaaagaagtatttttggagctctgcactgcttcttttaagtgtccacaaaagtgtaccatgagatgttgtttctgggtcatgggtccattcatattttatagacttctagggagcccgcttccatggtggtgtcaggaagagtctcgtgtattcagggtgagcgtgtgaacaggcgcttctgaagagtgtcctggaaccacggcagacgaagcgaatctgcccttctccccagagcacagtgtgttctttgctggtgtaaccgtgtgcgtcttcatttgcatttacttcgtacactctacagtcgagtgaaatgtccacagaagacctgctgaagcacctcttcctcagacagggtgaggtgtgggcgcttgcggcgaggaaaggaaagatgagacaattttagaatgtgcaccagtgggtggcagcatgtgacagtatttactgaagcaaggaaagttctaactcatgggagcctggagttagagggcaaaggtgccagggttacctggaatgtgggtaacagaggcggcaccaagagcaaagttaaa

SEQ ID NO: 27155 - DNA, 1148 bp, Mus musculus
tccttcccaccaagtaggaagatcggctggctttgagccgtttcataccattatatggtatccctggcacagatggccatgcctggcctcccagtcactcttcatggtcagttggtgtaagtgctgcccatcacccagggttggggggttgtttggagatgccaattccacccatggcactgtcattagactgcacaatgtcacacaagccaaataacccactgtgccttagtgtctcgtggaggagacattacctgacccaggggctacctcagggaggttttgtgagaacaaaagagagtaagtggaagactcaggggcctttggtaccaaggttctcaatgccgaccgcatgctacactctccatgaagttaagtaagtggctaacccttcccacctgtggctaattgaatcagaacctcaggtaacagtatgccttgaggtgccttgaaccattgctttgggaaagagggcaacacattattatcttggaagaatcacttaaggattaggctcaaaaaaaaatactctttgaagcaagcaattctgtaagaacaatcagatgctgatatgtgtattcatagtctaaatattatccaagcagtgtctcagtttgcttctcgtccaggcatctgaaaaatcaaacatgcgttcatttacctaagcagtagtcaagtccttggtagcaaatgtacacagacactaatctataaatctaatcatatatattagagttatccattaattatgggagaaaagcccctcccctcacacttgacttcaatggcaattataaagtccattttgccaagaatatataagtgcctctgtgttgtgaaacagcatggagctggcctgcacagcagctgacagtgtgtgtcagtagctctgtgggatgacacatgcacaggacatcggggagcgctgggaatggtctgtgacccacagggccagccagtgatagtgatgctataaggtattcttataaacaggcgtggttgtgttcttgggtgaactcagtcctagtaccagtgtggcagggaggggacccatgaacaaaatgacaaggtgccaaagtgggttgcatgtgggttgtgggtgctgtcctgaggattcagtagccgatgtatgtgcctccaatcctgga

SEQ ID NO: 27156 - DNA, 1100 bp, Mus musculus
gttccttgtccctgtggagagttagctcagagaatggggttgaaggcagtctgtttttgacctggccctgggaatctggcatctctctttcctttcgtatctctcttggtgatgtaggacaggcctaattagtcatgggaggagatgattccagttttgaatacccagtaggatcattggactttgctgtttggccgattttaaaatcactgctttgctttggagggctggttttgcttgggcattaaggttatgagaggctcagtgcagcgtgtgtgtttggtttgatttttggtgggggtggcgaggttgagaggtagctcagtaaattaaatgtttggtggtggttaaaaaggaaggtttattttttaaaaaaaaaaaaaaatgtttgttttttttttctgtttcaggcactcgtgagcttttctgattatcagattttccaggagcttatcaagggcaaagaggaggactctttctttaggaattctgtttctcagatgctgcggattgtcatagaagagggctgtcactcacagaagcaggttcttaactatctgggagaatgcttccgagtgaagctcagccttcctgattggtaccctaacgtggaagctgccgagttcctgcttaagtatgtgtgctcttggggcgggggggggggggggggggggggggggcgggggggggtgttcatgcggggcagtgagcctggtgggaaggtggtcctagccgggaaggaggctttgctttttccaagtttgcaacagtgtccaagtaagacaatagacactggaagtcactagtgttggtaatttgttacatttacaaaatgctcactttgtctgtccatagatacacatttcctctctgttcctttgtaagttgtggggccctatttccctgtagcagtgggtttgtattacataaacacggtattaaaggagcagggttccagcaattgaggtgtggccattgttgctgaaaaaaattaagtcttatttttaactgagctggagtagctctgtgtggttgcttactccctaccatatgggtgagcacagctccagactttgtggcactattccatcaaggttgcc

SEQ ID NO: 27157 - DNA, 1152 bp, Mus musculus
aggcctgacagccatgttgcacttaggaagactaggcagcccccggtactaagtgttggtgtggccttgaacaaacattgaaagactttcctgcagttggagcacagagcaaaaatggccaaatatctacagcgggacactcacatttctgccatgttacctcacaagtagccatattataatgtctaagaggtgtatgtccaagtatggaaaccgcagataaggagggtcggcattattaggtttttctaggggaagggtattaaatgagcaggctttaggaatccgcgtgtgcccagccatcttctcacaggagatgggtgcttgtgtgttcttgatgaaacaatttacagttgtacaaacaataccaaagcatttgtgttgtcccaaataggacaaataggacagttggacagctaagctgagaaagccgttactgaccgcccttttttgtcctttttcccccaggagtcactcctgttgatacagcgccatgtcgaccgtacagtgactgctaccctgtcctgctggatggcgtcatggtgggctgggtggataaggaccttgctcctgaagttgcagacactctccgtcgattcaaggtgattatcagtctctgaggtgtcttccttaccctcctgagtttggttctcagcctttcctagttgatgaagtgtcctggttatgtctacagtggtcaagcaggcagcaggtggaagctaattccagaagtgcctcacccttcttctggtggtatcttgccttgtgtgaggagtcattgacagacacgtgacctctaagcatttattggtcatttctgaggtccctgtctgcttatgtaaccagcttgacttcctaggaatgtcaccagttggttaccgtgactgctccccagttgtctgccctgggaggtattcatctgcacctcttaggttggtcacgtgtagttagtttttcaggggtaacttgtggacccacagtctgatggttctcgctgactgatttctgatttccactgctcctttggttgctctttgctaagttgcttgtgactgtggcggttggctgcactcactctagttcacacaggccttggccgtcttcctgctcagtcccaggaagctagggttacagtcagagttctttatttct

SEQ ID NO: 27158 - DNA, 1261 bp, Mus musculus
ttggtgagatgttaaaggctgctggctacaacttctacggcaccgagagactgtatagtggcatcagtgggatggagctggaggctgacatcttcattggtgtggtttattaccagcgcttacgacacatggtgtcagacaaatttcaagtcagaacaactggagccagggacaaagtcaccaaccagcccctcgggggacgaaatgttcagggtggaatccgctttggggagatggagcgggatgctctgttggcacacggtacgtctttccttcttcatgaccggcttttcaactgctctgaccgttctgtcgctcacatgtgtgtagagtgtggcagtttgctttctccgctacttgagaagcctcctccgtcttggtctgcgatgcgcaacagaaagtacaactgcactgtctgtggccgcagtgacaccatcgacaccgtctctgtgccgtatgtcttccggtactttgtagctgagctggcagccatgaacatcaaagtgaaactggatgtcatctgacttgatccccgccatctgagctaggagataagaacaggaggtgtcctgtataacacaagtgagggtattatgggctcactctgggtctatacaagaatttcagtactgaagccaagaacaggcaggtgaaaattcaagacttctgagtctctgtaacctactgaagttggttttcatatctttttcaagacagggtttctctgtgtagccctggctgtcctggaactcactttgtagaccaggctggtctcaaactcagaaatccacctgcctctgcctcctgagtgctgggattaaaggcgtgcgccaccacgcccagcctcatatctttttttaaaaaagttatttttgtgcctttaaaaaatgacttaattgataatagatcatgcagggcagggcgccttctttctgggcccaggttcactgctccctgctttcagtagcagagggtgtctgttatccagagcaggccagtacaataaacagaaaatggaagccatatgtgtgatttttatttttatatacatagaaactaaagctagttcatgtatataatttgatgggtaaattggaatgtaggtgtggtctgtgatgtcattatcacagtcaaggtgagtaactagatctgttggtcagtgttgagtgctgcagtagagagagcagctcaccaagatgctaaccattttccacaggagcaaaggagctcagccttcttgaaaagactgaccccagctagc

SEQ ID NO: 27159 - DNA, 1110 bp, Mus musculus
atgttttctgggccgccgctgctgcagccaccgccgccgccacctgggggttggttgaggcggacggtggggtccctgccagagtgtggcaccgccgctgcgcggagaagaagcgggcagttagaaaatgggtaagaagagtcgagtgaaaactcagaaatcaggtactggggctacagccactgtgtcaccaaaggaaattttgaacctgacaagtgacctgttgcagaaatgtagcagtcctgcacccggcccagggaaagaatgggaagagtacacgcagatccaggctctggttgagaaaatacggaagaaataaaaaggtctgtctgttacttttgatgggaaaagagaagattacttccctgatctaatgaaatgggcctctgaaaacggggcgtctgtcgagggttttgaaatggttaacttcaaagaagagggctttggtttgagagcaacaagagacatcaaggcagaagaattatttttatgggttccacgaaagttactaatgactgttgaatctgctaagaattcagtattggggcccctgtattcccaagaccgaattctccaagctatgggaaacattgcactggcctttcatctgctgtgcgagcgagccagccccaactctttctggcagccatacattcagaccctccccagtgaatatgacacccctctctacttcgaagaagaagaggaatgtgtcttcagtcaacacaagccatccatgatgtcttcagccagtataaaaacacagcacgccagtacgcctatttctataaagtcatccagacccatgccaacaaactgcccttgaaggagtctttcacttacgaggactacaggtgggccgtctcatcagttatgacacggcaaaaccaaattcctacagaggatggttcggggtgggggggggggatccttggctctgattcctttatgggacatgtgcaatcctaccaatggcctgatcacaactggctataacctggaagatgaccgctgtgagtgtgtggctctgcaggactttcaggctggagatcagatttacattttttatggcactcggtcaaatgcagagtttgtgatccacagtggttt

SEQ ID NO: 27160 - DNA, 1544 bp, Mus musculus
cgtggggcggggcggggcgggacggggtggggggtgggggagcacagagatcgccctgtgccccaccttgcacagcgtttgggggactgaagacataagtgacgggcgggggggggggggactatgcggagtcccaggctgccctcttcccagagatgcgccgctattgttattttcttccacttcgtccccccaggatgaacttgcgtcctttctctaatccgccatggaattctgctccgtgcttttagccctccagagccaaagaaaccccagacaacagacgcccagacgcagcagcgtatagcagtaactccccagctcggtttccgtgccgtagtttacagtatttaattttatataatatatactatttattatagcattttgatacctcattccgtttacacatctcaaaagccgcttagtaattctcttattatttaaagaaccactacactagagaatggaatctactgtggcaacgattactagtaccctagctgctgttactgcttccgctccaccgaagtatgacaatctatggatgctcatcctgggcttcatcattgcatttgtcttggcattctccgtgggagccaatgatgtagcaaattcgttcggtacagctgtaggctcaggtgtagtgaccctgaagcaagcctgcatcttagctagcatcttcgaaactgtgggctccgccttgctgggggccaaagtgagcgaaaccatccggaacggcttgatagatgtggagctgtacaacgaaactcaagatctgctcatggctggctccgtcagtgctatgtttggtaagttgtagttataccttatgttcgctccagtcttgaaccttctctccgcaaggacgcactgcttatgtaacagttttgccatctacctgacaaaatctgattaattctgtttcaggttctgctgtgtggcagctcgtggcttcgtttttgaagcttccgatttctgggacccattgtattgtcggtgcaaccattggtttctcccttgtggcaaatgggcagaagggtgtcaagtggtctgaactgataaaaattggtatgttgaattttaaatggttttattttcgttgtgtgctgctgtgtgtcgtggagtgggagtgaagtggaggggcaagttgaagagtatcagaaatggagcacctaccatttcggggtcttgttaacaaaaacgtactttccagacctgacacttcattttgtattctattccagtgatgtcgtggttcgtctctccgctgctttctggtattatgtctggaattttattcttccttgttcgtgcgttcatcctccgtaaggtaacctttctacttgcgacctttcatgagtcacattcagtcttgttcaaactcactggtattcttctcagatgtgactggtatgtaagtatgtggctttgaaaagctaaaaagttctttgttctgtatacctcctgtatgttgtggagttctgtgaaagaagcaagtttttaatgccccagagggcattcaggaaggaaaaacttgagta

SEQ ID NO: 27161 - DNA, 1099 bp, Mus musculus
agtggatcgatggcgaggttcacagttgatttaactttgcactttggtaaagccttctgtcacattgatcggatatatagataagatggttgtgtatagtctgcagatttttaaatttaaggcggcaggacatcaggaaataagcattttaccttagtctgtttttctccagtatagtagaccctggggggcctgtgctcaggtttacagatggactttgggtaactcagagaaactggttatttgtgatattagttatatccttgttactaagaatagggagaaactgttgcctatgatggtaggtggcattagcttccttaggtagcaaatgtaggacagagtccagttggctttgtagaaattatggtgggaggctgttgctagcaccatgactcctagtttgtcttgccacagggtgctctgaaagagatctacatttacaacttttaaggtactgatcttcatgtcttacaggcagatccggttcctaatggcttacgagctttaccaattttttatgcctgcacaatcggaatcaacctcttttccattatgtatactggagcaccgtgtaagtacaaatcaagatgcttaaatgtgaattttaggttatttacaaaactttcattaaatgcccaatttacccctttttgctttacagggctgaaatctcctagaaggtggctggcctgcatccatttcagaaggctgcaggctagtgtatgctgagttaacctagataggttttcaaccagagagacctgctcacattctaaatcactccagacctttcctccttagtcttcacaggatccactgataatatgaccttctccctccctttcttgtgtctatgctaacaatgctggaaatgatgctggcctcaactactgaagagtcattagttaaatctgctcttcagtaatcagccacttagagccgcttgttagatgtcatttttctctcccagttggagccatttcgttttctaaagttctcagtttgcccccctaaactgacttgaacgagaagagttgggatgtgtaactcctggtctaattaattacacttggaagaagaatgtccgcagctagga

SEQ ID NO: 27162 - DNA, 1392 bp, Mus musculus
gactggcgactgtttcgaaacatttttatggcctggtttgtcacggtccccatctctggggttatcagtgccgctatcatggcagtattcaagtacatcatcctgccagtgtgacgctggggttgaaagctgtgtcagtgtctgggaccattgtacacattcctgttcctaggagaacgctcacagtgttgctgaagacaggcaagggtcttaaaggagccgtgggaaggaagtgtaatttacactataattgcttttgtgctaaatatgacttatctcaaaattagctatgtaaaatagccaggtttccattgattcattccaaggtcccttttctcctgggctatgaattcctgtacatatttctctacttttgtatcaggcctcaattccagtatgttttaatgttgtctgtgagataacttaggtgggttctttttaaacagccaggcagagccatttgatggcatgtactgctttgtcggcctcaccagcttcttccccaacatgcacagggatttaacaacatgtaactgaagcttccctccctcatagtctctcatagaaatagtcacggcactctgctccctgtcactagtggcaggttctgttgatgtgtgacaacttcttagagggccgagaatctttggcacagtggaaatataagtttgtagtaacctctttgcaaacagttcacggacatgttgctaagaagcagggagacaaagccccctggcggttgtggttattcttctgagatttctggcagtgtgggatgggtgaatgaagtggaatgtgaactttgggcaaattcaatgggacagccttccatgttcatctgtctacctcttaactgaataaaaagcctacagtttttagaaaaatttctcttgtgctttttgtttttcttgagtcctcagagtcctaatcgttcagcctcgtgacattcttaggaggctgtgtacacctcccaaatggaggtgctgccaggctcctcactgtcttctgtgatcccctaaacgatgtggcctcacacagcaccttggtggatgaggttgatggttcctatcctgagaattgctggacaatgcttttgactattttagtttcaaaatattataattaaactcatgactaggccagcagaaggctatgcccaggaaggttggtcactggagaattctcagtaaatgtttgcacttaccgtcaggcacggagcacgtcagtgcttggtgtgtattgtcagagaagagacatctggaggctcaggctggctggcggtagaatgggaaagatgaacttgagtgttaaatctggatgtgagggttggaaggagatgctgagaactgggacaggccttcattcccaggactgatctatggcatgaaggtc

SEQ ID NO: 27163 - DNA, 1870 bp, Mus musculus
atcagcattgtttccaaaaagtgagtttaatatctctgtcccctgttcatgcttctggaaggactatacacaggagagccagggcagcagttctgtgccttcctctacctggaagcacagctagcctgaccccttagccttcatttgcctactgttgttagctcatgatacatgaaagcagtcagtcagccccaagctcacctccacgggctccaagtgcaggcctataagcttttcagctgacctgcctgctagtttcccataagctcatgcggccagtggttttgtgaattttaggtcagttgtggaaaggttcctagttgcattggcaactttacaaagaagatagatgtccagatgttcctgtttcaatacatgtttggagcggcatcttaataggttttgagtaattgacagtcaacacaagaaggaatcttagaagtcattagtgcagtcaagctctgtgttaggcccggtttcctcacagcctgtaaatatttataagataaacaaatggcaactgtaaagcagttgacttcacatcaaaaccatcttcaccttcattcatagctttgtaatgttaacaccaccatcctgggcttcctgagcaccaggggaaagccagcgtaggctcacactgaagtaccagctatgcataagaaacaaagtacaagagcaggatgttcctggagccgagaaggttttgaacacctcctccttcggtctctttcagaatatgcgggatgccagaagtgcaagacatgaagcttatcactcccgtgaggcgctcagccaggatcgagcgcacggtggctcgctacccagaaatgctgcaggagcatgatgtggtggtggcttctcttaatgagctactggaagtggacaaaacagagtgtttcatcttccgtgaaaatgaggctttgcctgtgacactgggctttgaagtccttgaatcatgatcttttgatatttgtgggttttgttttgtttttttaactttaagtgaggtttttttcagagcttgcaagacataaatgcccttgtcaagatgacatgaaataaatgtttgctgagacctcaccatgcaggtggtagactctttggtctcagaaggaatgcattgagtttactctcagattgtatatccccatgagaaggcttttggttcatgtatttgttatatactttataaaagttttatagcatagtttttcagcatccacactacctggagggcaggcttctagagtacaaagggttgacttttgacaccagctcaccaggcggaaagtcaaactccacagattacagagacgtttgggctagccacatcttcactcagatcccagaaggtatttgtggagaccttcagcttctaccacagtgaccctaaagatgagggggacgcttgtcctctctgggtggctttcctctagtgaagcacagtccagaattgaggtggcagcccaggttttatttacagtcctccttttgcacttgttattgagaaatgcttcgagtaaagacaaatatggggacagagcctgctgcgtccattcctctccctaccagaggactggtagcctgaggaggccacgagcaccgcagagactatggcaggggatcttttctgcaccttggacaactgctcctggaaaggaaaagcagcgttgttttgtaaatgtaacataggaaagcctggttggcaatttttaaaccttagctttgttcctatgattactaagtactaagtaatatctaaaataaaaaccactgaattctcttcatctctgcctgttgttctctttattatcatggtgatggctttagtaagacatataggggtttctctgggaaaccccaagaggtg

SEQ ID NO: 27164 - DNA, 1120 bp, Mus musculus
actgtcaattaagtaaggagagagactcttgaaagaacatgaacttagatgagtgatagcaacttactgtggtaatttgagtaggtatggcccccataatttcatgtgcttgaatgctatgaatgccattgtgagtggcactattaggaggagtggccttgttggaggaagtgtgtcattggggaggtgggctttgaggtcaaatatgttcaagtcatgcccagtgagacaatctcctgctgcctatggattaagatgcagaactctcagctccctctctagcaccacttctggctgcacactgccatgtttcctgctatgacaataatggaccagacttctgacactaagtcagatccagtgaagtgttttcctctttataactgaggtggtcatggtgtctcttcacagtaataaaaccctaactaacacacttatgatgattaaacatattaacatgtcagggcatctcttccttttgtctttgtctcttttgataaactgttattttgttttcctgaaggttccaagaaagcaggtcacactagtccaggctgctgtggggaaaataacctttgctcagaattgagcacatatttactgtaattataggagtcaatcagtggatgattacagctcaaaaggccaggccatagagagcaagaggcgggagtgtttcatccctctgatctacgtgctccacaggaattttacttgcatgtctcaaggcggtgaattggaacgcggaagtaaccataccttctgtgctcctgcatgggtcttgtagaacgttcagaacttcctgcagctcctgtactggctggaggcaacaaaataaacaaacggcattaaaagcattcatggaaagactgagctaaggacttctgcttagtatcaaataaactttctgcaataaaaatgttttctttttcaatcccatattcagtgataaacacttaaaatgattcagttttaaagattcataaggaaaaaaatgaagaaactgaacatgtcaatttaacactggcatatctaatttcagtgaaaagatgtgttcaaagtttctttaaaccaaattcttttttcctaataatttatatcatatcattaaatcatatca

SEQ ID NO: 27165 - DNA, 1192 bp, Mus musculus
gtggctttgatttgggattacatgcatcccttttcatagtccaagccagttttggctttgtgcgtcatatcctattttgtgatgatggggattctgaccatttatacctcatataaagagaagagcatctttcttacggcccacagaaaagaccctacaggaatgagtcctgatgatatttggcagctgtcctccagcctcaaaaggtttgatgacaaaaacaccctgaagttgaccttcatcggtgggaggacaaagcagcagcgggaagccaagttcaccaagtccattgctaagttctttgaccacagtgggacattggtcatgaatgcatatgaacctgaaatatccagactccatgacagtctcgccacagaaagaaaaataaaatagccaattctaaaagctctccttctgctggatcatacgactcactggtgggtaggggaggagacagaaagcttaagcttggtcaagtaagaaatgttaaagatgcccctgtctaatccaccctagatgaatagagtttcctagttcagatatgcagttgtccttttgatggctgtagcctcatggtctgctgaatggttttctgttgctttccttaagaagcatttttgtaagagctaagcatactttttcctttgtgcttaatagtactttatacagtctagctttgtgccatgcagtgtttgaatgctcagttcttaagaactactaagaacttgctggggcacagtagtgttcacccagaatcccagaacttcccaggctgaggaagggggaatgaatttgaggccatcctgggctgtagagccaggccctgtcttggggaatgagtattgttaacttgttgctgactttgtattgacccctgcatcggcaactatttccttaaatccaggatacaacttgttaagtatgacagctttcctttacacaccatttttgtgggtatatatatatatatatatatatatatatatatatatatacatatatatatatatatatttgacttggggagaattattttttacaaaaattcaaaatagctttttaatttgtttaaaatagacatgcctgttactttttgtgctcttaaccaattaaagaagccagtggcatttttagttttatgttctctgttttccactcctatgttcctgttaatttgtttgtgccctttatt

SEQ ID NO: 27166 - DNA, 1843 bp, Mus musculus
gtaaattattgagaaatgtgaactgtgcagtcttaaagctaaggtgttagaaaatttgatttatgctgtttagttgttgttgggtttcttttctttttaatttctttttcttttttgattttttttctttcccttaaaacaacagcagcagcatcttggctctttgtcatgtgttgaatggttgggtcttgtgaagtctgaggtctaacagtttattgtcctggaaggattttcttacagcagaaacagatttttttcaaattcccagaatcctgaggaccaagaaggatccctcagctgctacttccagcacccagcgtcactgggacgaaccaggccctgttcttacaaggccacatggctggccctttgcctccatggctactgtggtaagtgcagccttgtctgacccaatgctgacctaatgttggccattccacattgaggggacaaggtcagtgatgccccccttcactcacaagcacttcagaggcatgcagagagaagggacactcggccagctctctgaggtaatcagtgcaaggaggagtccgttttttgccagcaaacctcagcaggatcacactggaacagaacctggtcatacctgtgacaacacagctgtgagccagggcaaaccacccactgtcactggctcgagagtctgggcagaggctctgaccctccaccctttaaactggatgccggggcctggctgggcccaatgccaagtggttatggcaaccctgactatctggtcttaacatgtagctcaggaagtggaggcgctaatgtccccaatccctggggattcctgattccagctattcatgtaagcagagccaacctgcctatttctgtaggtgcgactgggatgttaggagcacagcaaggacccagctctgtagggctggtgacctgatacttctcataatggcatctagaagttaggctgagttggcctcactggcccagcaaaccagaacttgtctttgtccgggccatgttcttgggctgtcttctaattccaaagggttggttggtaaagctccacccccttctcctctgcctaaagacatcacatgtgtatacacacacgggtgtatagatgagttaaaagaatgtcctcgctggcatcctaattttgtcttaagtttttttggagggagaaaggaacaaggcaagggaagatgtgtagctttggctttaaccaggcagcctgggggctcccaagcctatggaaccctggtacaaagaagagaacagaagcgccctgtgaggagtgggatttgtttttctgtagaccagatgagaaggaaacaggccctgttttgtacatagttgcaacttaaaatttttggcttgcaaaatatttttgtaataaagatttctgggtaacaataatgccttgggggtgttccattttgtctttgaagctctgtccttggagtctgccagttgcctgtcctctggggctgggggtgaggatgaactgtgccaaggcttcaaaacattctgtgtaacttggtctacgctaggttttacagaagttctgttcccttggctcagacagagtcatggttgcatcggttgtgctgaaaattcagacagactttctctactacttcagtgttgtgggggatttggacagttcacccacccgctcgctacctccgggaccttggctgtacaatagggtttaattgtgcccctcccaaggttccctggggattaaagaaaggatcaccccgtgctgcatgcaggtctgcattgagtgttgagctgtgcctctctacctgcccaatggggctgatgaccatggcataggctttccatggctaca

SEQ ID NO: 27167 - DNA, 1612 bp, Mus musculus
caggaaagaagagcaagaacatatatgccttgaatagattaggaatcatagaagctagagcgatagctaaatggtaatagtagaaccagcacgcactttacaaatctcgtttgctttttgttctcagccttacagagaatggatagaatcatacaccagttcaaaaaataaaaatacacaagaaggcctcaaagtcaactagatggcagcaaatgtagagtcttaaattcaaaccccaggtgcttgacaccagcccgaatgcctctgccatactttgacttagtctgtatgggtagaagtggactgcgggcatagactttgcttggtgccagttgtgtagatcctcatggcacagttatttgtcgccgtcttctttctttgattgagatagtatctgaatatccactcaagctctttcctgtcctttggtttaggagaaaggatcctgggctatgctgaggagccctgctatctctggtttgtcatggagtactgtgaaggtggagacctcaatcagtatgtcctgtcccggagacctgacccagccaccaacaaaagtttcatgctacagcttacaagcgccattgccttcctgcataaaaaccacatcgtgcacagggacctaaagccagacaacatcctgatcacagagcggtctggcacccccatcctcaaggtggcagactttggactgagcaaggtctgtgcagggctggcaccccgaggcaaagagggcaatcaagataacaaaaatgtgaatgtgaataaatactggctgtcctcagcttgtggctcagacttctacatggctcccgaagtctgggagggacactatacagccaaggcggacatctttgctctgggcattatcatctgggcaatgatagaaagaattacctttattgactctgaaaccaagaaggagctcctggggacctacattaagcaagggactgagatcgtccctgttggtgaggcgctgctagaaaacccaaagatggagttgcatatcccccagaaacgtaggacttccatgtctgagggggtcaagcagctcttgaaagacatgttagctgctaacccacaggaccgacctgatgcttttgaacttgaaacccgaatggaccaggtcacatgtgctgcttaaactccagggctgaacgtcttgggtgtttttaaactaggtgagtgctcttttgttattgtacttacacactccctgggctggactctggagttgtagagaaaattcagggccaggaagtaagtcttgttgacacagattggctctgaagtcttggcaagtagagataggtcagattatctgattacaaagtaagaaatgtagagaagtgttttaagaggaaactatatgaggctgaatctttcaagttcttcagaaactgtttcttattatcaatgaattctccatataaaatggtgctgagaggaatacagttttcagagaaagcactttgtcccaactgtgcttgcttgttcatggatccagttctgtccacatgggacctgatattggaggaaattaggatgtatagagaatagaccaatttgtcttagtgtggaatacagataatatagagaacatggacca

SEQ ID NO: 27168 - DNA, 2332 bp, Mus musculus
ccaaggggtgggtgggtgggaagagggggatgatgtaatgtggtctctttaaaacttgttgcttaatgtagtgtatgtaggttctcagatgctgaacactattagcaaaatcttacagtgggtgcttcaaggctgtaacagcagttattgatgagagtggagaaccaagaccattctccatgtctgggagaatggcctgtctggaatgggtcctgtggggtacagggaagctggagttaggaaaaaggtataggatttgtgatcagcttggtagctggagccaacatgccttaggttcccccttccacatcttcccttagtcacagggccttggagacaccagttttcttacgtgagaaggtaggtagaagctcagcttacttcatgaaagtatttagaaaacagtatacagtgctttgggctcagtttggtttgggtgttggctctatccattcacccactgatcaagtgtccattccttgcctgccttctgtcttccaggtcgatccttcgggacccacagtctcatcgtgtctcggacaggatggcagagggtacaggtggtggtgatctcctgacagctggacctcccacaatgtgaagctcacgcttgggctgcccactctacccttctctttctccttcagtagaataataattgtttttctaaacattaaaccatcaagacttctgaagagcagaaggctacactctggacaggcacctttttattgtttttgttttgttttgttttgttttttttaagaacattgaatgtggacaaagcttatgcatatagtcactgttaatctgttgagttcttaagttaggaagcagttttggttttctctttcacgttctgttttctttctttacacacatctcagttctgctttagcaccccacttcccacagaattctgtctccccagagtttggtatttctcctggaaagggatgcgaacaaagagctaaggaagcagcctctgagttgcctcccccagatgtgggagctgctgactcctgggaagggctggttggtcctggcctcagacaggatcagagatgaagaacctctcagaagaggaacaccaggggttggcccgagggactctagaaagaagacctaaaccatgggtttggttctcgttaagttcttgagagccccaggccacaccaggactccctgtagtgggcattgcttccctcttttgccctgagtccctgaggaaagaaaccaagagtggtcatcccatcacttggggattgagactccatccccactctttgcacaagcctatcttctattaggactgttgtgccaaccccctgtcaaacttggtcttccttggcctcttgtcactactatgagaccagtacctttcatcctctcctggattgtcttctctgtgtgctacaagtccagcctgtcacagacactacctaggtctcaagatccagttttgatccttgcagagtacccttaactggctgctgacatcatttcctcacagtgaaaggtgtgccctgtgtaccaggatccctagtgtcaccactgggtgacactgtcaagcgccatctctcttacccccagggacttcatgttaggtgatcaacctccatgtcactgttgtctgataagcagagaaaggacctgccttgaagagggaggtctgaggcagatgggagtgtccaggtggctaatagaggcccatgtagcagctagccatataaagcactgcgacacacattttgacttgtacctccttgcagtgttctgacagcctcctgagggaagatctcctccctccagctgcctcatggacccaccattctctctggtgttgccctctacttagacgcacctttggttgctccaaaacttttccagacttttcaccttgttctggccttgtgggatggggtctctggacaaggaaagaaggtatctgtgttcattcttgtttatacttcctaaactagcacagggtggatagagatataagaggtcagggggagctttccctcaagcaggggtcccttgttcctgcagcgtgggggaaggccagcacagctgaccctgacagctggccccgcttagcagcgctgtccacgtttctctttccagccttctggtaggcaactcagcaccaaagtttctttctcctcttggccagaggtcagctgctgttcctgtgggtacatgactgcaggtgggagccctaccttgtgctgcactgtgatagcatctcgtctccttgagtgactttataagcagcctcctgagcctaatcagagtggcccctgggagagtgggaacagcggcgtcccct

SEQ ID NO: 27169 - DNA, 2329 bp, Mus musculus
ctctttctctggctccagtgagagccatgtcttgagccccaagtgcctcctcctgctgttttcattcttccctccctgtagtccctgctatctatcacctgccagccagctgcaggctggccccaggacatgcttgctgtgctgtggctggtgggtcaggacccctgtgggctctgcagtcttctcagagtccagctccctgtccctcttggagatggacatccttttcctctgttacttccctcttctgcctctgtctggggtgcagacttgccagtagaagctctggggcatctgatcttgggtgcctccaggtttgttaaatctgttcacattctagaagtttgcagaactcttaacgtttgtccttttgggggtggtggtgaggattgcctgttgggagactagcctggcctcagttctcagttctgagcgcaggatagatagatcatagtgccttacttattccattgtcttcccctgtccagactcagccagaagcaggtggctgtcttctggctcattttgtcacttatactcacagtctcccacctgtatatagccacaggagaaggaaacctgagcccccagccacctcctgtgggctatagccagacacacacccctctcgcctgcctccgtggccctcacagcagctttagaccaggaccaaatgctgctgcccacatatgcacactgcctttgttcctccctgttcttagctctagccaggacgacactgactgcaccatccaaactggcaccagctaaccccctctggtcactggagaccaaggttcgggctctagcctcacctagcttatggggcactggggcagggagtaagaactccagtcccaccttgtagggtttgccctttggctgcctgagggatgttttaatgtttacttaaagaaaataccctgtttacagctggaggagaaacacgctcacactaggtgaaggtctgactctggatagggcctggcctcctttgtggcactgccagtagtaactgcagtggtggtgaaggcggagaagcccggagggagcagaggctcttgactcactcctcttcctaaccctgtggtgctgagaccactccctgttttcctcatagcctttttgcctcactaatccccatggtgtcatttccttcctccaagattctcagctctaacatatcactattttagaaaaccagtgttttgcagcaataaagttatattgttttgtgtgaatcttattccaagaagaggaaaagagcattgtgggaatctgttgatgctattagctgtttactgtttgagaagatagctcggagggatggatgaatatggcttttaacctttaggtatcttgaagagtgggaagagcaagagtttgactgctgtcctcccaggagggactgtacggccctcgccttactctgatgtgccccttcctgccctgccctgcccaccaggagctcttccatctctcttcctcccaccccatctgggggcactgggggggctcaactctaggcaggtctttgggttacccctccctgtgactggatctctctccctacaagacagctgctgggagtctacctccgaattggctgagattgctgcttcggccctccaggccagcagactctggaggctgaggcttctgccttctctgattccgagctcatgcacacaggtcagcacaggcctgactttgagggaaaggagccttgtctggacacatgctctggaaggagaacccagtaggtactggcatcttggctgatgtcggtatccacagccattactgagggccaagtctgctaccattcattgcctagggcccctagtattggggagagtgccagaacaagtgggccttcccccccccccccgccttttaaaatccagatgagatcataggaaaaaggaaacctatttaggggacttcccccccccccccccaacacttttaccccaagggctccttgccgtcaaaactggaggatatttcagttactcttaatgctcatgtgggtcaaacttggttttgaaagaggtttaaagccaggcacaaggttagtttcaaatactagttaatccaatttttttcctttttttttttttttttgcacagaagctggtaatataggacctatgtgtgaactttatatgaatatttttttgtacttggcttacttgggttgttatgataacatatttaagttccttgaacactgtggattccccctaatgtgtatgaatgactgaaacgttgtaaattaagggacgtttgtgtgaataaagttatttgatggggtcaaaaagccata

SEQ ID NO: 27170 - DNA, 1220 bp, Mus musculus
gaacagagatgtgttcatggctcaccccagatgaaggtgtctgagatcacagtagagactgtctgatgcccttgactaatttaggagtatctcttttgctggtcatggtggcctatgcttttaattccaagactcaggaggcagatagatctctgattttgaggtcagccaggttgtgagactttctcaccccctccccccaaaaaaagaaagcccagagggcatcttgactaccagccctgtgttctttctatgaagtcttcatagtagatcttaagataagtagtggtcaaattttattacttttatgtctctgatttttgcatttgtagtttttttagacgtagcttcaggaatgtctccaaatagctctctatgttcctgtagtcacttgatagctacttacagagtcgggaagttgggggcttgagttatagatcaggcactgactaaaaacttgtttctcttgctttaggtctgctttgatcttcacacagcattatgtcagtagctcagaggcgatgtggaccctgttccccagggtcaggttaccacagacctgtttgtttgttatgcagttcatggagtctccctggattgtctggtttccctttcagggctccctccctgggaaatgtgccctccaaggccctagactcatcttggttctcctcagctccttgcctgtttccttcccaaaaggctgtatgtacatagtcctttttctctgtggcctatgaagctggtttataataaactaagagactgttatacatacagttgatatattcatttgtcttctgagtgcctaatagttagaaaaggttaccttggaaatttaaatcctacttttagctgtttcccactagtatattactgttgggactaaaaaaattactaagaaaaggtgaatcagtatgaagctttttgcctaccaaatgtaaagatcagtttgatgaaataaatatcatcccttgggtatgaaacaaacactaaaagtgaaaatgctcttgaggggttgcgggtagcttccgtttaactttgtctcagggccgcacagcatatactgtaaccagacttgtttgtaatgggattgccagtttgtttggatgaagagatagtgagcagcattaagtcttggtacttagtgcatcaagactagtggtgaaccatggaggtgtttggtttcttggcatgcagtggtagttctgaagtcacat

SEQ ID NO: 27171 - DNA, 1143 bp, Mus musculus
tggtggtttgtttggggtgggctctggcgtgaggtcacccttgtgaaaagtcagcctgtgtgtgtgtggaatctcttccctttattccgtctgtttctcatataaggtgaagggtggattgtagtaggccttgaggttgaattgtacactgcgtgggtgtggagccagtatcactcacttctgataaagaattgttcagcctgcctctttctgtgaagtctaaagctgaagggaggaaacaaggtagaagctgagacagccaggaaaggatttgccattggctatggaagcatctttgccatggctggggtgtcttgctgcttgtcctgtttcctggtcttcgtgtctacttggcttggtaggaaacagctatctatattcatgtgagatcacttagcctggggtactgacgtgttttagaaagtttatatactatttgtcagattacgtaatacacagccaaccttggtaaacctaatgttccctaccttctaataacttgcttatttttcttctaaaaattcaactttaggccaaagaactccaaacaagcagaaagggaagagaagcgagtccttggtctggtgttgcttcgaggggagaacctggtctccatgacagtagaaggacctcctcccaaagatgtaagtccttcccgagtacctgttgaagggaggcccttatgagagccaggctctgtcaggtactctggctttgcatccctttacagatagtaaatgaaatcttaaaacagctaccttgccagtgagtggagagacagctagaatttgtgactttaacgcccatgcccagaggaatcctaatcaatatggcctgaggccatattggttacccagcagttctgtatatgtatgcaacaacatttagtaaaaagggagaggaaagggaaaggggcaactgtaattatctcaaaaaaattaacagtccttctgggtactttggtgcaagccttcagtcccagtagaggcaaggggatctatgatttcagggctacatagtataagaccctgtctaaaacaaaaacaacaataaaacagctccaaataatagaatttatgaatgctttatttggtagttacagaatattagcatttattattatttattacctgtgcaccaggg

SEQ ID NO: 27172 - DNA, 1200 bp, Mus musculus
gtggacacttacagtcccccgagacagacacaacataagcaaagccactatagtctgaggaagatgacttttttaagggaagggagactagcaggttacctggcagaagtctaggctgaagctgggcgataggaagagtctcaggtaaagactgtgtggaagacagttggaaattgttgagagattagtctggtggaagacttgggggagggccagaagtgagagagtgcagaagagctgagcctccctgatgcctgttctcctcacagacggtgggcaagagcagcaagatgctgcagcacattgactacaggatgaggtgcatcctgcaggacggccgcatcttcatcgggaccttcaaagcctttgacaagcacatgaacttgatcctgtgtgactgtgatgagttcaggaagatcaagtaaggagagggctgttgggcgggagaaggaactgaggaggaagtggatgggatgggcgggccacatgctagtgctcttgctctcctgcttttgatttaaatgggaccgttggccaccaagacatatcttccttcgtccagcaaaccttgctctctgagtctagcaaagtggaagaggtgaggagggctgctaggcttttaattactctgatttgcatgcccctgggtactggggtaaagggctctcatgttctccccacaggtgtgtgaggggggagagcttgattttctggcctcattacctatttgtaaagctgtagcctacagggctctcctaatgcggcctggtctgaaactgctttaagaagcctctgaccctcttcagggtaagtgctctgctccccatgtgggtttggggccagtcatttttgttgacattttctaaaaaataaaaaaaataaaattaaaaaatggagatattttctggtttgctgcaattctgtaagttacaagctaactcaggcccttaaacaaagtggtctatttcagtcctgttttatatattcaggacatcttgaggctcagcaagatggtgagccttgtcatatgacactcttgtcctatgcagcattcatattatggactgactgaattcccttaagttctttttgagattgttttcttttgtggcccaagatcaagtatagaataaaaatgcagagatttctgagtgcctggtaggtgttagagtgggaccagcagatcagtgtggaacttcc

SEQ ID NO: 27173 - DNA, 1194 bp, Mus musculus
tttaaaagaggattggcattccgatcccagcacccatgtgagaagcttagcatccccataaatacctgaacccaggctctgcgcggggaaaacaggaattgctgggctttactggctcccagcctagtgaagtgtgggctccaggctcaaggacagaccctgccttacagaaatagagtaacacacacacacacgagagagagagagagagagagagagagagagagagagagagagagagagctaatatcactgctgcactacagaaagcccaagattaggtataagttagcaattagataattttaataaaaagtttgtcatctaggagtgtgctaaactgccaccttatcaggcttacaaggcaacattcagaaagttagcgaagtcattcttatgtaaaggaaaggcatccttaaatttttttctttttttttctttcttttttttgcttttaagatggggtctcaccatgtaacctagactaatttcaaacttgaaatcttacatccacctcaaggttttaataagctttcttacagactgaggtggcctacgcctgtagttccagagcttgggaagtagcggcaagagaatcaggctcagggatagctggactacatatggagactttgccttaaaacaagtctccaaacattaggcagagctcgcgaaaggaaggactgtaggagccaaaggggtcaaggacacaacaaaaaacacagtcagctaacctggcctcctaaggactcacagaaaccgacagtcagggagcctgaagggctctgacctaggccctctgcacacatgttttggttgtgtagcttggtgttcttgtgggattcctaacagtagaagcaagggccgtctcggaactgtttagcctgctttggggaccctttgctcctgttgggttgtctggtgtagccttaatgtgaggacagatgcctagtctcagtgcaacctgagaagccatgcttgatatccctgggttgcttatccctttctgaagggaaagaggaggagtggatggggtgggaggaactgcagtcaggatgtaataaatgagagaagagtaaactaaaggaaacatttaaatctcctttgctacacaggtgcgcatgggcattactggagttgtccgggataaagacacagagctcggcattgcggatgctgtcattgccgtggagg

SEQ ID NO: 27174 - DNA, 1172 bp, Mus musculus
ttggaaccagttcattagggtgctgggctgaggagaatcctctgcaaataagcaaatacacacatagactccaggagaaagctggagtttttgcagtgctgaggttcaaatccagggctttgtgcgttcacagggaagttacttaccaagcactagctcctttgggatagccccattaattccaccatggcgtaggtgctgcatcttctttctgggacatcccttctgactgtgagcctcggggttatttgcttcttgcctgttcatggctctggttttccatctcatgggcctccttggtacaatactccagaatgggtatattgttttaacgagcggagactatgccagaaaacacagctgcccaaggttgcccgctggcaggagctgtggaaatgggggtccatgtttaacacagtgcatgtctccagttgtatctaccagggagggctggcttgtgagtatgagagccttaattcctttcccccgatcttgagccagcatcgggtctgagcagcttcaacaaggcattccatatctccaggtatttcctgccaattcagacgcagagaccccagtgttgaaccttctgccagagcctcaggtggctcgattcattcgcctgctgcctcagacctggtttcagggaggtgcaccttgcctccgggcagagatcctggcctgcccagtctcaggtgggcagctgggcaaaggctgtatgggcagggcctggttcgagggacattcttcactaggtactgaccttttatctggaactcacttgccaccagatcctaatgacctgttccctgaggcccacacactgggatcttcgaactctttggacttccggcatcacaattataaagctatgagaaaggtcagatatgacttctctgaccctggaaggaggtctgcctatctccttcctaccagggcaaactgtctatgactacccatgagtcccctgtctttgtgtcccctttcttctacttctctcaatctcttaagttctgttccagttaccttgtcatgacaccttttctgcccccacccccacccccaactcctgtgcctttttctggatcatactatattgctcccatctgtgtggatctgtaagtctttccatggttacacatggtctgtgtgtaaccgcctcgtgctcctct

SEQ ID NO: 27175 - DNA, 1180 bp, Mus musculus
cagccaagagaggagctactgcatagtgtgagagtcacttatgtcctttacttaatggtccctccaggctagcaggagagcccagcaagcctaccattcttcttcttgtaggaagccttccccacacctgtccctccttgatggctgcttccaaccccatggctggagttggttgctgtaactacccttttctctgccttctcttaatgccctaagcttcaggcaaaggtaatatgcctttgacagttctcaaatgtccacattgtggaactagaaggccctgaggttcaagctgaatatgatggagtattctgtccttatcacacaaccttaccctcatgtagctcaggatggaagagaagaaatctgagagagcagattggatgttgtattttcagaaggcattcagctttaggagggccctcaggcccaaggatggatacagaaagctaggcccagcatggctaagggtataccagagcctcccaagaacaggcgcaggcccaggaacagcaggagcagcgcatcctgcaggctgagcagtcccgaggccatctttgttggagagaggggagctgcttgctgtcctgggccttcaccagccccctggctctgacccattgggagaagtctgtgtcgtggcaggttggcacctgtgggcctgtggagagagaagatggcagctcgaggcaattgctcatttgtgtttgtgacacctatctgacaggtggcacttacccatagagcaggtcaaaaacaaggaagctggtcagcaacaggagcagcagggctaggccagccgttgagaagatggttcgaattgtcactcctagtgcccccagccctaggatactgtccaggagctgggcctggctgaagtcccagggggggcacatgactcgctgaccctactcagtccctctccaggatccagacccctgggaaggagtgggatggctttagaagggcaagggtgagctgagctgggtcctagaggttattaggaagacctagtgctaagagattagggatcagggaagagaggagggccttggcagacactcaagggttagctctgtgagtaaggaactaagctttttggggatctccctccccccactcccaccccacatcttcaccaactctcctcacctcctcccacttgggtgaccattctaga

SEQ ID NO: 27176 - DNA, 1159 bp, Mus musculus
gaagggctggtcaacaagtaggaaggcattgagaagtcagtttatctggtttcctccttggtcctgccccagacacctgctggcttagccccaggagtgagcagcttcctacagatggctgtatccttcacgtatcgttacctggcactcttcacagacacaggctacatctggatggggacagcatcactcaaggtgtggttctaggacagcaagggatactgtgctttgtccaaggaagatctgttgtggatagagccatggcttttcaacagcaggatgactgttgaacagcagatgctggggcagggccatgacatgctgtgctgtttcaggagaagctgtgtgagttcaactgcaacatccgggctcccccgaagcagatggtctggtgaggatagaggcgttcttaaagggtggggttagagcatagccttgttgcctgggacagcctgagtcatcctgtcttctggccagactaagtggaacataggccttctcttctctgctgcacttaaaggagaactttgtcctctatgggccacttgactggtagtgtaagagcgagacggaaacagataggtcagcatgtggccagggaaatgggctccgggacacagtgtgttcaggctgtccccaggaaaaggggtgcaagcaatgcagaagacacagctatgggcccaatatctcgagtatcccagtagtgtatatgctattgctcataggtgtagccgtcctcggagcaaggaaagggctgttgttgtggcctgggagaggcggctgatggtggtgggcaatgcgcctgaaagcatccagtatccttggacacatcctgtatgggctgggagagggaaggaaaaggaggttaccctatctttggatgctcttagtagccttgactgaactcaggtttgtgctcgatgaggactcctacttagtgcctgagcttgatggggtccgcatcttctcccgaagcacccatgagttcctgcatgaagtcccaggtgaggctcccacaagcataccgtggggctctgggcaggtgctcctgatccaaaacaggatctgggtattaagggcagaactgagaattttcatatgtcatttctactcaaaaactcctcttctagtggccagtgaagagatcttcaaaattgcc

SEQ ID NO: 27177 - DNA, 1205 bp, Mus musculus
ttgaagtcagggaaaccgtaagtgagaatggagcgctttttaacacgtaagagggattcatgcacttgagagagtccacccacctctaatcaggttgtcacgatttgttcttgggttgtggccgagagatctgatgggtgattgtccaaggaagagcaatatgatggtcgaggtcacctagtacagttgtgctggacgattggtgggacactcaaagagaccctgggttcttttgacacccgtggactagagacagtgcaggcagccagctctgggagagatcccacaaagccaacctttctcttcctgtaggaggaggcaaaaaacttcatcactcgggagaacctggaggcacggatagaagaagcgttggactctccgaagagttacaactgggccgtcaccaaagaagggcaggtggtcaggaactgagcacagagacttctgggggcccaaataagcacagtgcttgcctagggtctgtgtactgggataggaattggtacatcccaggaggatggctcagccgtttccagagcaacctcagtcactccaggctcggcactcaccacctgactgggaactcccagatgtccctgttctggcaccacagacaaactcagggcagcattaaactctgggaagttcctatcgcacagaggatcggactggactgtgtcccctctagaagccaagcttgtcttgtaagtctcttggagtcgtgtgagccaaatgtttcctgcttttataaataaagtattggagcccagtcttgcccatttactggctatagttacagtgctaatgaaagaggaaagtagttacaccagatgctaacttgcttgtaaaatcaaaggcgtttgtccctaattatttgagtctttaggtttctagccagaagcaagtttcacctaactgagctatgagttaggtacctgctttgctcaatcctgggattttctggctagggtctggtgtgtccaagatccaggaagcaaaaagggtgccctgtttctcctgatggctctccagcagtgacttctgtaaccaggccctgtcctgatctatcatattttgaactactcagcaggtggtagactcccaagctaaacctgcttcttccagtcagttgctgcccttctgtgtgtgtaagtggtagccagagggcagccttggtgtcattcttcaggactctcaccttggtc

SEQ ID NO: 27178 - DNA, 1106 bp, Mus musculus
caatgttttgaccatattcactcctcctttttttctctttcttctgggtgtgtgcatatgtgtgagacaaggtctcagtatgtagccctgactgaccgaagatgtttactgcccaggaattatattttatttttgttttttgacgagtaaatattagactacatagtctcagtctgactgtgttgccaagttctaaccttgagctacttccagatccttcatccccaccttctaagtgctggaattatgggagtttgccactatcccctacttggccagaggtttgtttatttttaaatccagagccacagcaagaaatatattttatttgaacaagtatctatgttaactatgtttgtacaaatttgaggcaagctttatgacataataccattttctggtattttgtattttcttccattgtgggggtgggatgggggtggggggaggaggggagttgcacacatgccatggtacatgtgtggagatcagagcacaacttatagaagtcaattctcttctttgatgatatgggtcacagggattgaactcaagtctcagacttccactgctgcctgattgcaagctatttctttgagcagccaattactttagctgtgatctgagtttcccagtttttactttgtcaccatatttggaaaaagaggctaaatttgtacgtattttaccaagcagaatttacaataaatttgggttgcaaggcaattttcttggcagggctgggaaagctgtcttcctagactaggctctttgtctttattttatttttaatattgatccccacccttttattttcctggataaagcattaaggacaggaggtttttgaccttgaaagatcagtgtgttgaaactagataggtagctagtaaagctgaggtaacggcaggcagatgtcttgagtttgaggccagcctagtctacaaagttccaagacagccagtgttacacagaaaaagcctatcatgaaaaaacaaataacaaaaaattgtattacatttcctgagagaggtgcctgccacagtaagtatgtgtggaggttccctgcatctaccctgtggctcctccggcttggcagaaagtgc

SEQ ID NO: 27179 - DNA, 1182 bp, Mus musculus
ttacggtttaagcaagtgggagtcagccttacagatgatttgatgaatcagttgctgaagggaaaagccaagaggtatttccaggggcaaattgagttagagactggccagccacccatggagttaagaaagaagacaactgtacccttggtgaactctggttgcaatgggacagatagattgggggatgggatggttggcttgtgccctctagcccacatgcagcccccattagtgaagctagctatccagttcacaaacaagaaccaatactgctatggttccagggctctacttggattgcacaatatgaagaggaggcagctagttcaaattgggtaccgtgtggtagaattaccccactgggaatggcttccactactaaaaagaactcgcttagagaagctagcatacctccatgagaaagtgttcacctctgctctctgaagggcactcgtggacatttatcctcataaaaggaataggtgcataccttctacctgtaagttgagcatccttaaccagaaaatcaaagtcaaatattaaaaaacctggaactgagtactgacagatgtcagatcaaggatattcaagtggtaggtagtctatgtagataccctggacttcaaatctcaaacacctctagtctcaagtatttgataccgggattctcaacctgtcctccaagtaattataaaagccacagtgtaggtgggtaataaccgtctgttgagtagccatgggtgcagtgcctgtagcaattatatattacgacaggttttgtgtaaccctggttgtactctagttgtatgttttgctcagaataaataagcatcttcaaaatgacattgatccacaaagtcttactgcatttttttttctgtttctgttagtcttagccttgttacaattattttgaggaggtggtttttaaaaaataactattatgtgtgtgctgggaactaaacttgggttttctgcgagagaagtaagcactcttaaccactgagcttaccgtcagcagcatcataaaactagacccagaagaatatagcccagtgttgtggtacaagccttcaatcgcagcactcaggaggttaataggtggatctctatcagaaggaggccagcttgatctagatagtgaattcaagcctagttagggctacatagtaaagccct

SEQ ID NO: 27180 - DNA, 1180 bp, Mus musculus
ggcatctggatggatatcatgcgcaggtttcctgtgtacccaatggacttcactgatggtgtgtgcccagccagagcttagcctttcaggccaccaggccatgtgtatgtgcctgccgtgcatccctggcaaatgctgtctgtcttgcattcctaggcatcattgggaaaagcaagagcgtgggcaaatatgtcaccaccacactcttcctctacttcgcctgcctcctaccgaccattgcttttggatccctcaacgatgagaacacaaacggggccatcggtaaggggctgggggtggtagggatgtgccaggtaggactctgggcagtgatgacctctgaccttaccacctctgcagatgtgcagaagaccatagctggacagagcatcggaggcctcttgtatgcactgttctctgggcagcccctggtgatactgttgacaaccgcacccctggccatctacacccagggtacagtggggttgaaatgggaaatggtcccagaccccacctcagccctgactgtccatcctgccctgcttgtatacagtgattcgagtcatctgtgatgactacaatctggacttcaacgccttctatgcatggacgggcctgtggaacagtttcttccttgcactttatgccttcctcaacctcagcctgcttatgaatctctttaagaggtgattggtcctgggctacagagtccagagatgtgggtctgtctcatgtcaaagccctataaccccagggtagtgtgttctccaagaggcggaggtgggctttttaggagtggtcccattgagcattctttcatggggatgggctatataggagttcagggaacccactaattacccatacacacattaacctctttgcaggtctacagaggaaatcattgctctgttcatttccatcacgtttgtgctggatgctgtcaagggcatggtcaaaagtgagtccaaggcaggtgtgctgtgcatgcctttaacactatttgggaggcagaggcagaggcaggaggatctcagacagttttcaaacagctaaggctgtctcaaaaaaaaaaaaaaagtgagtaagtgctgagaaggggccctgcttgggagatgggagctctcaactgtggtctgctggggcagcagagaaggtatcaagctaagattgttcttcc

SEQ ID NO: 27181 - DNA, 1227 bp, Mus musculus
attattctagtaatactatttataccggtatagtaatttttgagtctcagaagctaagaagtaattgaccttctagtgattgacttaatgattgcagtgttttgctctctgtgtcagttgcaggacgtgagtctgagtctgtggaatgtctacagcaggatggaccctgcgtctctggagaacatgctttcagaagtaaggagccaaagtgtactcaacataaccatgttcagttatctaggcaattacccaccaaaggggtttaactggaagacgcgcaaggcacatcttagtttgctttaatcagagtggagcatctcttcccatcctgggagagttgaggcttctcggtgaggaaagcctgctgaggcagctgtttcacctgaagactttttggttattttttttccctcaaggggagagatattattctggacttcggtaaaaacaaacaatgcggaagttgtaacaggaaagattaagatgacaaaatgcttaaaaagatcaaagtttggaagagaggtgccagacttgtcctattgcctagacatcctgcctaggttcctgcacgtgcttagcagtatccctgtcccacaaagctattctaggtagtccttgaactgggtgtgtctgtgctcgcctgaagccttatgtacagaaacgtgttcaccctagaatgtcattttctgcctctgagtccttaattgttcatctgggtgtggtggtgccttttctcccagcatccggaggtgctcaggctgctggagctctgagttcaaggccagccccagctaaatatagagttccagaccagccctgaccacacaccctacctcaaaaaagataaagacaaccaacaaaatcttgctgtggagccagtgggatggctgagcaggtcgaagcacttgttgccaagcctgggggcctgtgttcgctccctgacatccacagagcagagacccagtctcacaaaattgtcctctaacctataaaataagtaaatacatggtcatagttatcagagatgtgtcacttatactttgtactaaccattttgaatagggtaggataggttattgtcatttatatatgtaaacagtaattagaaaacaaaagaaaaagagtgatctacttggaggctgcacaaagaaaattagagtcgtctccttctctgcacaccgccccttccctctctagcactgcctgaggttacgtgatcatctggac

SEQ ID NO: 27182 - DNA, 1086 bp, Mus musculus
tggctctgtcttcctacagctgctcgcactgacctgtgggaacctgtgggtcatccccaggctgaatggagtacacactagaagagggatgatgcctagcattggggcagcatctgctcagcacatggaaagggacctggttccatctcccctgggcaggagttggtccagcctcctcccagacccagctggtggctgtgaggaggtggggaatgctaatgagaatgaaaagcacatgggttgatgggaagggacaagattaccacgttaggagggtgagcagccctctgctatgtgcccaggaccctgcctggacattgcatttccccatttatggtgctccgtattctggcattatgcagcagcctcacacacctgtcctctccttcttcatgtcctacagttctgctatcacctgactagaatagccctctaggcaacagtgctcaaatgtatgagtttggagaagttaacaatcagaagaacaaaaactgtagtgtttcacctttaaatgcagtgttgaagagggagcctttctctaagccctgcactaacccactcctcccaagactcttgtggagtgacagttccaagctgaaccataaatcactgatgcacaaaacactgctagaaggctcacctctcaaaacacgactctttgcatcactattaaagagcagaaagttctagaaatgatcccagcctcatcccctatacagttaggagctccccacatctctaccaaaacccagcacataagtatctgcgtggtctagcctttcatctccgtaacaagccaggggactcttggccaaaagaaagaaagggaagttgcactagggcttgtccgtccataaggaattcccctctgctttgctcaaaggaccaaatttctttggccaaagaagttgcttctatgttagtcccataccctgaagtaatatgtaccatggctcccacctacctgtttatgctctccctgcccccagggaaactgtttattctttcaaaagaagcaaacagcgttcatttctgctcctgtaatggagaaacagccagctcccctgcatcccttacagccaacag

SEQ ID NO: 27183 - DNA, 1322 bp, Mus musculus
atgagaccggcttcaatagattcttgaagctggcagggtctttccccgaatccccagctaatgccagggagaggtccctgtggaataaaccttgtgtggtgccagcatgcagccagcacgctctaactcgggcctaccttgcagaccggcaccacggtacacccatgctgctggatggtgtcaagtgtgtgggcgctgagctggagtatgactcggaacagagcgattggctcggcttcgactgaggcctgggaccgtgcctgcctgcctgcctgcctgcctgagcccctgagccttaaacttcacctgctccccgacatgctgtgtgacggtgtggcttcctcacctctcccctggtgggcatggcagggctagaccttgctcatgccccccaccccccacttctgccttcattccttccaccaccctgcctctccggtctcctcccccacttcctcctctcccatgtgcctgagtctcctaaccgaagaaaagggttgagccccaaggaggctatctgagaggagggacctggggtggggtttacctcttccaccccaagccatagggagctctattgggaggggacaggtggctgtctgtgtgacattgatgccccattgctgctgctactgtcgtctccccttcttcacctctgctgccctcatctcccttctccactgctggttgtgtggtgaggaggtacagttcctagcccctaccccctcaggtctgtggtacttggtttttaaatgactggttgggatagagacctcaataaataaaaactccggtagatttcagaggttagcgggggttttttgttctctggggttggaagcccacccttatccttcatagatgggccaacaagatcaggaggaaggtactgcgccacactgcggcacctgtacgaggacacggatgccttttgggtcttgggactagttgcttgagtggggaggtgtctaggacgtaaagcagtcttcaggaactcagggatgctggacaggaggagagcgacaactccttgccatgtccctttgatctgtgtagctgacaaccgtcttctattattcatacactaatcccacttatggaggtccctgctctggtagttctagaaggctgttcttttccttaccttgcaaactttattttcaccttaggataagttctcaggcagggaaagctgtcttacgccatggttggcaggaaatgtctgacatttcacacttggagaaactgattggtcagatttcctaatggtatactgatatgtggcagagctggaaacccccgcccccttgccacagtaactc

SEQ ID NO: 27184 - DNA, 2630 bp, Mus musculus
gagatcccgcgcgcgctccgccccgcgccgcgccgcgctccccgctgggcacgtcctgccgcccgcgccgctcgccaccgcccgccgccgccccgcgagccgctttgtctcgggcggggcgcgcggagaggccaccaggtgccccccccgccgcgggcccgggccccccgccccggggcggcgacggcggtgccgggccccggggcggagggcgcgccgggatgggccccaagcggcggcagctgacgttccgggagaagtcgcggatcatccaggaggtggaggagaacccggacctacgcaagggcgagatcgcgcggcgcttcaacatcccgccgtccacgctgagcaccatcctgaagaacaagcgcgccatcctggcgtcggagcgcaagtacggagtggcctccacctgccgcaagaccaacaagctgtccccgtacgacaagctggaggggcttctcatcgcttggttccagcagatccgcgccgccgggctgccggtcaagggcatcatcctgaaagagaaggcgctgcggatagcggaggagctgggcatggacgacttcactgcttccaacggctggctggatcgcttccgcaggcgccacggtgtagtggcctgcagcggcgtgacccgttctcgggcgcgaagctctgcccctcgggccccagcggcacctgccggcccagccacggtgccctccgagggcagcggtgggagcacacccggctggcacacgagggaggagcagccgccgtcggtagctgagggctacgcctcgcaggacgtgttcagcgccaccgagaccagcctgtggtacgactttctgtcggaccaggcctcagggctctggggaggtgatggaccggcgcgccaggccacccagcgccttagcgttttgctgtgcgccaacgccgatggcagcgagaagcttcccccactggtcgcaggcaaatctgccaagccccgtgcagggcaaggtggtctgccctgcgactacactgccaactcgaagggtggagtcaccacccaggctctggctaagtacttgaaagctctggacactcgaatggcagcagaatctcgtcgggtccttctgctggccggccgtctggctgcccagtccttggacacctcgggcctgcggcacgtgcagctggccttcttccctcctggcaccgtgcatcctttggagcgaggagtggtccaacaggtgaagggccactaccgccaggcgatgttgctcaaggccatggcagcactcgagggccaggatccctcaggcttgcaactgggccttgtggaggccctgcactttgtggctgcagcctggcaggcagtggagccctcggacatagcaacttgctttcgtgaggcgggttttggaggtggccttaatgccactatcaccacttccttcaagagtgagggagaggaagaggaggaagaggaggaggaagaagaggaggaggaggaagaggagggtgaaggggaagaggaggaggaagaggaagaagaaggggaggaggaaggaggggaaggagaggaggaaggagaggaagaggtagaagaggaaggtgaggttgatgatagtgatgaagaggaggaagaaagttcctctgagggtttagaggctgaagactgggcccagggagtagtggaagccagtggtggttttgggggttatagtgtccaggaagaggcccagttccccactctccatttcctggaaggaggagaggactctgactcagacagtgatgaagaggaggacgatgaagaggaggatgaggaggatgaagatgaggaggatgatgaggatggtgatgaggtccctgtgcccagctttggggaggccatggcttactttgccatggtcaagaggtacctgacctccttccccatcgatgaccgagtgcagagtcacatccttcatttggaacacgatctggtccacgtgactaggaagaaccatgccaggcaggcgggagttcggggtcttggacatcaaagctgagctgctggacatagctgtaccccagcccagatgggctgctcctgcccaaggcagagaactctgggcagctgctggagatggctggagaagcccagggctttcagcaacgcttcgccaggttccaggctccaggctctgagacaggcccaggggctgaggtccccctcactgctgttgcctctttctcagaatcctctttcctccccattagtccctgggctcagggcactggatgggtggggagctgtccggtgctaccacaccatgccatcagtgggctagatcacagcagcagccagggttgggtcctggaagctcttggccagagagtgcctctccccctgccacccaaccaggtctttggtggggggatcccaaagccattctggaaagggctccagaggaaggtctagcctaggcccccacaaaactagcagcccccctcctgcatctctaggctaaaagaagcacagtgtaacttagggcgggctcccgagcctgcctctgcctgctttccacctccccagatccctttctctggcccagtctttggcccttggttttctttccagattggaggtttccaggaggccctccaggggcgtgaca

SEQ ID NO: 27185 - DNA, 1188 bp, Mus musculus
accgtgcagctaacgactaccccagcctgtactacccggagatgtacatcctcaaaggcggctacaaggagttcttcccacagcatccggtactatgggtgggatggccacagctctcctggcatggactgtagggacagggtccaactaggctttaggccccacccccaccccagaacttcctctttctcccatactgatgggctctcttcatcttcccatcctctagaacttttgtgagccccaggactaccgacccatgaaccacgaggctttcagggatgagctgaggaactttcgccttaagactcgcagctgggctggggaacggagcaggagggaactttgtagcaggctgcaagaccagtgatgatgagcctgctgccatccttacctcgtgaggcttgggagccagtgggtcccatgggcctgtgaggccacctaccttatagaggcctcaggtgctatagggggttgggggcatggtgtggtgtcacatctgtctgcccctgtcctcaattttcctgtctcactccacttattttctgtatcttggtactggtcccagcttaaagagctgaacctgagggtggatgccagctgaggagaagtctgttgtgttcagtgggagtccttttacagtcttttttccttgtttgtgttgactctttgtcttcccgctttttggggagagcctcagcccgttaggatggcacagtagcttcttgcatggcctggatgcaggatgctactctgctacacagggctgtgtctactctcctctcctggccactgcatagacttatgctctccattggaagcataagtgctttctcttctgttgtagtcttacctgtagctttcatttttttgtctgtctgacacactgaccgctggggaggcttccttgtacagcttggggctagagattcaaatatcacttactcgttaggcctggcttttgttagcccagaaagggatcttgccctttaagacccccagggctagagggaaggcctgactcaggagcctctgggagccccatcctcactactgtgaaccccagagcctcgctggtcagcacttgctgctgggcaatggaccagtcaccgagctttgctgtttgatccttctctgcccttccctgttttcctttctatatctggcccagaagacctcttgtatgtg

SEQ ID NO: 27186 - DNA, 1608 bp, Mus musculus
catggtccagaggagaatgagtattcgtcctttagaatccaggtagacgaaagccccagtgctgatctattaggaagccctgagccactagccacccagcagccccaagaagaggaagaacattgtgccagttcaatgccctgggctaagtggcttggggccaccagtgcactcttggctgtattcctggcagtgatgctgtaccgtagtaggcgcctggcccagtgaagcctcagctgtatgctgttctcttgctcagttctgccaagcatgttctctaggcttgggctagtagaggctgagtcagagaaacttaaatatggcgaggtccactgagctatccaggtagatagctacaccaagacgtcatcactgttgggtgggggagagacattgttttatcctggttcatatgtcatcttctggtcttcagcttttggaggcactgtgttacctccattgctcctgacctgcccacgtggcagtgtaagagttcatgctctgtgctcctaaggaggtatctccaccagctttatccctgttggcccaagcctgaagatgaggaggtatcgcactgttgacaatgcccctcatctcgcccagatcttctgaaacacaagcgtaggtacactgatgagtgctcccatagcatcttatgccttccaccggcagcctggtctaaggccttggcaggagagcctgggagtaacagagtggctggtctctagggagctttgagtgctctgcccctttgggccctctccacagccagtcaaccctgagggtgagtctggaggttctctgtggactcttaagaaagccagaagcaactgccaggcctgaggaagcccctgggagggagcttttctccaacctccttaccccctcctcgcttctccactcctggtctccattctctccctatactggatgatgagatacctagtgggcagaactcaggctgggcttgcatcagttccaccctttccctggcctttagcagatgtctagcttctctagtcttgttcccaatgtagatagcgggcagctcttccttttactgggctcctctgagtttgaaggatacagatacttgcctagtacttatctcagagggtgtgagtacaagttcttgccctcctgccctggctggctgagctaaggtgagagtgtgagaggcagagtgcatattggtaatggcagtctttgagagagcagccttcatctccatcatgcttctttctcctccctggtcaggtgtaggcctcacctctgtgcctcacttttcttacctgtgagatggggtgagtatgtgtgtgtatacacacacatacccacagacccacgcccacacccacacatacatgctaatatattctcacctgtgagatggaaagtatgcatacattgatgctaatatattctagttttatcaggataattaaaagagtttatctgtgcaaatcttgtgagttccaaatttcttaaaggatggatacatgttatcaccaccccaccctagactgtttctctgtgtagccctggctgtcctagaattcactcggtagatcaggctgaccacaaattcagagatccacctgtctcttt

SEQ ID NO: 27187 - DNA, 1190 bp, Mus musculus
ctggccatgctagtgaacagttgtgcataggtactagttttagtgtgttgccattctagtatagctttgaaagactagtctcaataatacaacatgtagccctacagaggttacccacatggcgagatttaaagactggccactaagcatctcttaggtcaagaatgtgtaggaagtctcagaggccttccctgttctttgcacattttgatgaccaggccagcattcaatggcacctttatctcagctggccgcttagatgccaccttcagaaagaggaaggctttggcattgtcaggttccaggagtccaatgtttatgtgttgccttcagctgcagtaggattcatagctgtgttgaagggagagttggaagaggtctggacaaggtgaaccagaacccagggaatggaaggagcatctgtacccacacccgggtactcttatttacacacgtaagaaaacaaattcctttaggaggatgactgttggctggagtaatcagtgcttcgtaagcacccatgcacagacgcacaggcaacagagccctgcccacattctttctctggtgaagaattcccagaagcccaagaactctgacttctctatccacagcaagtcccagagggccctgctgttattgaattcagtacagtgccactccacttcctttcccttgctagacaccttcatttatgggactctgtcagagatgagagatacccatcatgggtatgctccattacatcatcagggaccagtgtcttatcatgccccctcagacctggggaccttttctagaaattcccatgcaggcaagattcaaaaacatgactcattatatcccctaggaatagaatcactcagatcctacagtccatattgtccatagatgcactattatacaggtgagtgctgacattccccctacccctgcaaaaggaaagtctgttggccaggagacatgtagagtgaaattttttacaccaaagcattcctgcccaatatgtcaagatctctcatctgctttaatagtaaagtaacactctataattagtacagtctcagggatgacataaccatgtgattataaccattgtgtatgtgccaaaagtcagaaccctcaggctgggtgtgatggggtaggggatatgaacctttaattccactccttaagaactccattgaggg

SEQ ID NO: 27188 - DNA, 1216 bp, Mus musculus
agtcctagagcgcttacattccttcctctgagctggaggtggggtgaaggttttcatttacagtttttggttttcagggttgaaacttaatttgttagcttttaagtgttcatagtatagtttgggcatgtctgcacagaagagttagtttggctaatactttggtattttttttattagatattttcttcatttatacttcaaaatactttggtatttttttttccattttttattaggtatttaactcatttacatttccaatgctataccaaaagtcccccatatccacccacccccactttggtatttttgatttacatttttttcctcaaaacattttagtttaaaattttatcccttagaaaccaaaccacagcatatggaataagttgccagtcaagtaaatataagctttatttttagaaaaaggtattttgacatttttttttctttcccatttagtttttccatggtttggcttggatattggaggaaccttggtcaagctggtttattttgaacctaaagacatcactgctgaagaagaaaaggaggaagtggagagtctgaaaagcatccggaagtacctgacctccaatgtggcttacggatccacaggcattcgggacgtgcaccttgagctgaaggacctgactctgtgtggacgcaaaggcaatctgcactttatacgctttcccacccatgacatgcctgcttttattcagatgggcagagataaaaacttctcaagtctccacactgtcttttgtgccactggaggtggatcatacaaatttgagcaggattttctcacagtatgcatcttttagcttatatacaatttatggaaatttgatgtttaaaatgatgccgattaaaagtggtagaatcatttccatttctaatggagcttgaatattcttaaggaaatgaacatatatttaaactaggcagtcaggagttgattgtgtagcgattgttgggtagtgtacttacctggtatattggtatatatcaacatagcattttaccatttctttagtatgaaaacttttgagtatgggataagcataaaagtgggataagagtaggggataagagcctacaaggaataacatcaccccatctcattaaggagttaagaaacaacattttgaaatttagtcctggcatagggagatggttcagttggtaaggtttggaggatctgagt

SEQ ID NO: 27189 - DNA, 1926 bp, Mus musculus
atatatatataagattaattaaaaaaaaatcttacttgtggtctgtcaattttcagggatattttggagccgttggagcactcctcgagctgttgaagataccctgacttaccgagaggacttcctgaaacctgccacagagacatctgtggatttttttgttttgttttgttaagagactcaagttttatgatcgtgtactactcaaatcagagcaagaaacaaatgtatttttctaagacatcaagataaattcttaaaattttgtctaaggacaccccatcccacccccgtctaggcagtatgaggatttgctgtttatagggtattctcagggcagcgttattaacccctgaggtgctttggaatcccagcatcacccacttgggcatacgtggagctttctggactcccaccagcagctgactgcttgtcctgttgaaatgtatgtgagaatctaaccgctttcatcagtatgccttggaggtcatctttctttgcgcgctggatcatgtttagcctatgttaacatactgaaaatgggttatttcaagcttctgaaaacttggcaggattgttctgcatctgatgttaagagatggcctgcattgtagctgaaggcaagggtgggcctgttcacagcagccttggagctggaatggagacctcgagctctggctgggaaggattctgccattcagccatgggttctggtgccagctctggggcaacagaaggctcttgttggtttggactatgggaactaggattggatttggctggctagcctgcttgatggttctcagttcccacagggatatagttggcttttattacatactttggcccattaggactaagggttccattgtgctggcagcacagtacacggggtgttgcagggatggtagttttccctcctgctaatccctgctttgcttctgagagatcctcaaaactgcacttttattagaaagtttctccatctggggcagggctgtgttcttccctgccatccctcaggtgactcctatttgacagttgtgaccagtgctttgtattcatggttctgtcttcctacattgaagctcctcccacagtgttagacgaacaagcctcaggatcacagagcccaacaggatgtgtggtgctgttgtgacccacaccatcactgtctatttctttcctcagttgtgctcagcccagggtcattctggggatgggttctatttcctttaaatagtgtctcgggtggtgagggctaacctcaaactcgacattaatactgtatagctgaggctggcctttgaactgcagatctagttgccttcacctccgaagtgctggattataggtgtgcgccactagtaaactccataaatacaaagggtttgtttcagagcctcatcttttccagttctcacctgcttccctggctgctgtctacactctgacagttccactttcaagctcaactgagtctcgccaagctgtcttcctgttgattccagcactatttgcagaaatacacacattccacctcacaaccacttctgaactgggagccacttgcagtgtctgttagaaccatcttgtcttttcttagctgtccaatccaggtcattgttttgatagcctaaagctccacttcacttctcccactcagaaaggaaggtttgtggccctggagcacaaagtagcttgaactaagatgggaggaggctggcctacgcaaagaggtaatgtcttgtgggcatcagtggctgggtctagggggtgcttgaagatacctagtttggttttagaacgcctggttttgagaacccctaaagcacgggtcatttgggtcagagacaacgcagaggatgtatttatttgtgggaggagttagtgaaccccagagcacaagaaaataataataatcgg

SEQ ID NO: 27190 - DNA, 1155 bp, Mus musculus
gggagtccaagagcaaacggttatagagatgggttacaaggttgcttggaggtagctccagggttacgtgtgccttggtgaagccatgggctaaagctgagttcagagccgctcaccacctggcattagggttagggcaagttctgggaatgtggcagactgtcaaaggacaaagctatatacatcaagccaccacaaatgcaatgcatggtgtggtgtggcctgatgcctttcccccatcagtgtgccacaccttacctcgccctagtgcaaaagttgacaggtccaaatacaaagtatttcaaaatttgctctttatttacacgtttgggtcgattacatgcatgttttatttttaaacaagtgattagcaaaaaatgcattaaagttttaaaatagcaattaaatatacaaaaatatagcttacaaaaaccaatgtttaaaaatattctgctgcagaattcttagtgtacaaacacgtctatgaaacctgaggctcagcatttcataaaccttttttgagggagttatatctagtaaataagccccatagggctaaacgacaagactaaagtgccattcctccaccttcctggacatgtcctcagacagaggcaatggccccaagccgtcacattctccaccacagcctggaaggagaggcatggacggcgctgagggttcaaccacatgagtcccttaacactggtgaggtcatgatctgagctacagcgtgtctttgaaacagcaggggtagcttttcctgatcctgtgaacaaaggaacgaagaatttggatacgtgctgagctaactggaataaaagcatcttgaaataatttgggttctaaagctgaacttgaaaactgataggtcctgttaatcttatttaaaaaacctttacctggcattttaggtccctacctctaagattaagttaaatactttgatggtcccatttaagcaattttttaaaaataaaaatttatttttatgtgtatgagtgtttgcttgcatgtacatgtttgcacctggtacactcagatgccagatctgtaactgaagttacagattgaagctgagggtcacaaggtgggttctatgagctgaacctgggtcatcggaagagcggccagtgctctgagccactgaacaat

SEQ ID NO: 27191 - DNA, 1614 bp, Mus musculus
agttttagctgcggcttctcctgtccttggattcaaccactcaaaagccagcatcaccaaagccccgtatttctagaggcaagattgctcattagacttgcagataggttgaggtggttggtgtgcaacctgaatagtcaggggcattggaagaatcctgggtgctttgctctgctcaacctgaatgaggtctcctaaccttttctgctcagccactcttaatgtgatttcttcccaaaaggcattccttgggctggaagctgcagctgcaaagtatgtttctcatctcccttcttggccactgctcccacttctggcacctgccagccacagcaacccaatatttgctcctgatgtctgggtcccccctcagtgcttcctctgtatctgcagcattggcccaaacttacaatgagatcactctttccacaccattcctaagtttctggtaaccttttgtgtggatgtgtgaggatttgggtctactctcaagaccactgaactcttatgtgtctttaagtagctagaggattgggtgtcactgtggactgtagtgttagaagtggaacaaaacctatctatcctacctgggtcactgtaacataaaaaaattgacacctgcagcttttctttgtcaagtgtaatttagtttggcctattcctatttaaggttcttttaacatgtacttgcctaaccaggaagtagaacaaaacagccatgtagggacaggtagcctctgggcgagatctgtgctgaggaacaaggggcctcccaccattgccaaacactgttcttgacaagacttgacaaaaagatctttcccatggctctgttccacagcatgctatctctaacttggaatagccactctaagctgtgctaaatacctacaacacctactttctgagaatttgagactatatagagacgttcctgagagctctatacagaaatgcttggactagtttgaattggttacttgtgcttttctgtaggtcaatctctcagaccctcctttctttagccaccacctaggaactagcaaggtttctagatgatctgccagtccagtctggtaggcacaggcacaggggagcaggagctgctgatagcacataccttcctggtcacaaactcaggaacttctgaactatgggactaactcctggctccaccacagtctctctttgagacaggttctgtgtactcccagttattctgaaactgtatagaccaggctggcctcaaaatcagaaatccagggccttctgcctctgctacaattaaaggcagagcaccatgccgagcctccacattgaatcttgacttgctcagtcttccttgagtctttgaataggtaatccttataaaattcacacatcacaatagttgccttccttgaaaaactatcccatgagcactggattcatttttgtttctttagtctccttttatgggaatgtggggtgggggtgggggcagaggctatacagagagcttacccagaagtgtattgagtgtattgtgtgtgaaaggtaagcctgaagtagaggtttttgcatttacattcctttttatatggcttccttcacagatccatccctcagtatccc

SEQ ID NO: 27192 - DNA, 1164 bp, Mus musculus
gtaggaaagcccctagaacatttgtttggtgtttgatgggggagggcccagcccagtatgaatggcacccctgggctggtaatcctgggttttaaaagaaagtaggctgagcaagccagtaaacaacactcctccatgtcctctgcatcagctcctgcctccaggttcctgccctgcttgagttactgtcctgacttctttgatgatgaacagtgctgtgaaggcataagccaaataaaccctttcctctccagcttgtttttggtcatggtgtttcaccatagcaataataactctaagtcagacaggcttctgagcccttggagctcacacaccactggcttccttactgaattcacttataacagatctgacattaagttactagctcttccttctactgcatgtttggaagtaatccatctgcccatactgttgggaaaaaaaaataagatgtattgtgactgcttgtcaaatatgaagataacactcttttttttttttttacaaaaacaacaaactttgacatttccttcaactttcaaggtagagctgataagatggggtctctgataaggctatacacactgggcttggtaaaaacagcaactgcaagggccagatatgctcttctctctagataatagaacagctgttccctagaggaagatggcatgtcttctggagtgacttatgccaacatatgccaaagtgggttgaaaggaaacaccaacacccagcttccctcaagcaagcctgcagagaaggttggcagttcactcggagtgatatagaggcctgctctgccgtcctcagacaaatggctgaatgaccttgggcgagtagctaaaaggttcccaaattttgtttcatgctctcatctgagggtgatggtgccgacctccgtttgtgtgaatttaagataacagaagaagtgacaaaatgttcatggtaggttctctgcaaatacatagcttctctacctaagaatttagttcacaattcacactataaatagttgaaatccaaaccatgaacaaagggttttctgactattgatgctgcccttaatggatttctctgtggtaaccataagggagttaagaaacatctagcttaagaattacatcccacttaccagtcatgtctttgggtgagttgtgt

SEQ ID NO: 27193 - DNA, 1103 bp, Mus musculus
gccttgcttggattgaactaggagatcttgactctgaggagagccagccctgtaaaaagcttggtcctcctgtgacgggagggatggttaaggtacaaaggctagaaacttgagtttcttcatttctgtctcacaattatcaaaagctagaattagcttctgccctatgtttctgtacttctatttgaactggataacagagagacaatctaaacattctcttaggctgcagataagagaagtaggctccattccaaagtgggaaagaaattctgctagcattgtttaaatcaggcaaaatttgttcctgaagttgctttttaccccagcagacataaactgcgatagcttcagcttgcactgtggattttctgtatagaatatataaaacataacttcaagcttatgtcttctttttaaaacatctgaagtatgggacgccctggccgttccatccagtactaaatgcttaccgtgtgacccttgggctttcagcgtgcactcagttccgtaggattccaaagcagacccctagctggtctttgaatctgcatgtacttcacgttttctatatttgtaactttgcatgtattttgttttgtcatataaaaagtttataaatgtttgctatcagactgacattaaatagaagctatgatgaacacctggcggggtttgttctctctccaatgctccgagtccactgtttatcgccagggtggcttgggctcatttcacatccctgtccctgaggggcctcgggtcttacctctggtcctgtcttgtttccactggctttgcatcttcccctaagttatacttagccctgctgaaacacaaaagcactcctggggaggaggggtggggagaggagacaagggggtggggagtagagttctcctgctcgggaagaggtttgtttccttttcttttcaatgtgtatcagtgtttttgcctacatatatgactgttcaccacatacattgccctcagaggtcaaaagacagatcagatcccctggaactgaagttacaaatggttgtgagccactgtgggtttggggactcaaactaggtactctgaaagaacagccactgcttcaa

SEQ ID NO: 27194 - DNA, 4500 bp, Mus musculus
ttggcatgaacattattaaaaagtaccgatgcttcagctacctgcccatcagccccacctttgcaggctacacttggaaaggctttgggaagagtgagaacagccggagttcagacaaagattcccaggccacagtatagcctttgctgtgccctgtggcctggccacagtgaggcatgtatctgtagttccttgctgaataacaagaagatatatgtttgtatatctacatggcatcctgcacctcagagctaagacaggttgcacgtcactcttctgttgtgggtggtgattgtgtccaatatggtgtctcgcttgtgtccttattggtcccttaccctttctgtgtccattgctggccatggtcactgaacttgaaatcacagccctgccattggagtgggcgtttggaatccctagtgctcctgctttcagtcccctctgccttccagtgatctctttcctacaagctgcttcgaggtccaggggcctctgcttcttaaacactatgtcccagtcttctcatgtgacctcagcctgaaccctgtggagacctcctctggccagggggccactggtgtcctcactgtgttgggattctgttatccctgataccccaggagcctattgacctgactgagaatagtgacatgtctgtcttgtgaccagatatgagtgtgcataaggtcctgtctagccgagactgactgggggggactgtataggagactgacggggagcagaaaggtcctgactccctccctccctgtcaccctggacccgtccaggccagcgcaccttctttcttactagtctgttttactggctgagacaccctatttggcattttcactgctggctggtgtgatgggtgtagagtgcccacagatgagtctatggatgtcttggctctgctgtcctgtacttgcgtgtgttttattcctatttaatgttattgactatagcggatctttgaaatcagtgttttccgtgtgaatttccaaccttgcaccccgttccttgtccttactcttgactccatccagaaaagaaccagcatctgcaaacgccatgggtgccgtcagcgagcgaagcctctcgtgtcggctgataaaagccagtggcagctgtcgtggctgtgctttgtactgctctctaccatgaaagtgtaaatactgtaatgtctaatctatttatcacaactgactactggaccagggcccagaaatgtgggtcaagttacatgtgaatttgtttggtgaagaagggaagctgggatggtaacagagcgtcaccacataggatgtgccattatctagctaaagtcattccttccttccttctgtttcaagtcattgctgccagatctggcttaataagacttggtgtggcttatcaggtcacatgtccaccacatcttgattcttgcaggagggaagatttgatcccttagagaaatagcctgtgggacttgttaaagaagatagatagtaagaaaagcagccattgcgtgccctctgtgaagagttctaacttggagaacaaatctctcagacaaatgacttgtactaaatttggctttggtttccaagccaagggaaaagctgaagacatgagtaatgatcttgcttcatgagattgtacctcttaagtggctgcggacctggctaaactgtgggtggcagtgggcatccccatcacccttagcaaggtgtggttctcagtgcctgtcattgatgtgtgttcccgtgcccaggctgtctcagtgtcatcatgttgccaggtctttgtgtttctgcagcccacatgatccttgagagttttgggtttcggtaacacctcagggccactgcattgttttgccaaaatcttactccagattaagtacagaacttggtttctaaccgtatttagttttatatgtgtattcagacagttagagttttggaagcacactggtgagtagctttttgcccctccttccttagcaagcccgtttgattgacagctctcctgctctgagttcactctgtgcctccatttgcattttgcttagttgatccggtttctctgttctgacaaggtggaaaactggtaagcatctcagatctgcagtattgtggtggtgctccactgagcaggagtccactcagaagcatgagaacggcctgtaatccaggccgtgtcctgccactatgcctgtattgctgagtgccacccaagtcctctatttggctgtagtctgctctggggctttcactgtcagtctggggcatgggctgagcaagtatttgtgtggtcaaggaagtgctatgccaacatctcccattggaaacagggtttctcctccttgcttcatcagagccaacctttgatattcttggaggggacaggaggtgggaacacagagggagtagcctgcgaatgtgcctccagtcagtgggatactttctgcaccactctgagtgattgttaccttgtaaccactagtaagctttgttcatgcagctcatagtcctcccaaacatatggggaatgtgtgtttatgtaccagatggggagtgttgaggggatatggtggctctgtgatctgtttgtccatttgtgtccagtgttgacctgcgttactggaacttggagctaccctgtttggttaccagtggactgttagaaagtatttcagatacgagcatcttacagggcattccatccctagttctcacagtgaacacctgcctcctctctctcctgagagcaagcatttgtgtcagccacaggaagcagaagtattaagggaggaagtgctggtagctgccctgtggggagactccctaggaaagtaacgggcaccaggcttcgtgactttcattctcatttataagttagacattcattcactagaacatttatgctcagaatcttccttaagagggtgtccagtattaactttgattgggattaatccaggcaaaagaagagactttatcagagagtggagtgaagcattgtgggtactacccgtgtcccatgttcacagtaacaaattcacatgcaggatttactttatactgtagaatactgactttcatgatgacaacttgatttatgcatgaatatcaacagtatttccatatagtaaaataacatttctgcccaggataatagtcacagttttccagggagggaatgatataattttcatgacaatgtcatgtgctgatagaatttctccattgatgaacctctagtatgtgtgtatactttatttacccatgtgtatattttatgatcatgatctaagctgttaattctttcattcatgtccctgctgagacactgatattagcaacttagagttggtgagtttaatcttcagtcataccagctccaagagatgaggcctcagtccagaacccatcttcatacaaaagcttcagtagcctgtaggcggctgtacttggaacagacatttggctgccagtagcaggcctggcatggcgtgacgggaggggcctaattacctagctgttgctggacaccagctgtgcatacctgagcatgcccagtgcatgttgggtccatgcacaactcctggacccgagctttcaccaagctctggcctccagggagctgtgtctttctctgtcccattaagatttgggcacagataagacatcttccactttccatccttcctacagttagagccccagtagtgcgagaaggccccatatatggcagcattcagctctcacccaacacttgtgctgggcttcccttcagcagcctcccagacctccccattcttccaggatgctgtctgccaggtcaccactctgatacccagcgttctctggttgctctctgtttccagtgattaaacacccataaccaacgttgctgtctgctgccactgacagtccagtgaatccttttctgtctgttcctaacaacttttatttgacacattaaaaaatttctgactgtccttaagacagtagagatgtctctcttttatttgagtttgtgactgactttgcctatatatctttctggggttttgtttgtgtttaatttttattttgcatactgagggtatttggggtggggttgttttttgagatgtgtaattcttttatggagtttttaaaaagaattttcatattgttttttctaacatggcttcattaaacgtttaagtattttaaaactatgtaatatttggaccagatgttgtgaataacagtagagaaagctattttattctgtatttttaaaactgttccgtacaaataaaagctctcctggatgtagttctgttgtcatttgcctctttcttgggctggaattcaattaaaagtcacaagtagtaaggttcttaagaaacagagcccccgacacacatacagcagaggactgctgggtctggccgcagtaggagaagactcgagcctaaccctcaagagacttgagaccccagggagtggggagggctggtgg

SEQ ID NO: 27195 - DNA, 1202 bp, Mus musculus
tctggttgtgtccttatggtgctgtctgactgggtgcatagtctctcacttgctgtgagctggaagatgggccagaggcatggatgattcagggtgaatgtttcatccaaactgccaagtcggtgacatcatgacctttagattacgccatgccaagcagcacataatagctggttgtagcatttcccacaaataaaaagtttactgcctacgttactaagaaagcatcttaagtagtgtggtgaagtggaaggccactgcaaacccggaaggaaatgaccttgaaagacatcatttctagtcagcttcactgggtgactagactcaccatagacgtggtggcttggattcctttgtaccacttaccagccatgagaattcagccacactgcctagctcctcaaagaccattcccccggatgaaaaataatatgtagcatgttaatgagtgttgtgcacggtagtgcctgccctgctggtgccgtgagctgtcattattacctgggctctggaagggaggtagaagtttggtggagcagcgtgtccctgatgactattacaggattgggtgtgccccctgctcacacaggcagcgtcctgacttggatggattagaaaacagcagcggtcattcgacccagctcctcctgaggcctgagcccgtccagcctccattgcatgtttgctggggcagggatgctgtccatgtttccacagattactctttatcgttgttgttttaatcttcaaggtgtcagggattaaaagactgcctgactctttgctatttttggatttaacaaattttgttccctctacactgttttttggtgtgtgtgtgtggggggggggggtttcttaaaacagggtttctctgtgtagccctggctgtcctgaaactagctcttatagactaggctggcgttaaactcacagagacccatatgtctctgtcttctgagtgctgggatcaaaggcaggccacatcaccatctgtcttctctacacctctttttatttgaccatgagatatgctagcctggcacattccccataccacaggttgcccattctcttccttgatgcttctcctctctaggctggtggctaacaagggtgaaaggagtcaggttctcaccagatgttaggggaaggaagcgccttccacttcacacagctttgagactgttacccagtagcag

SEQ ID NO: 27196 - DNA, 1224 bp, Mus musculus
ccaaactggggaccagttgagattatgtctgagattatgggagacatctcattccaaccaccagagatatgcacctcagattctaagaaatgcaattaattatttacagagtcttagaaactagagcaattttaagactccatggaaagaaagacagggtttcttcaagccatctgtttagctgatgtcaagactgagtacttgctaggctgagttagttatcttggtggtcttgacttttagatgcatgcaatacttaacattttaaaaatctttattgccacataaagtattagaaatggttttttttttttttttaataaataaagccaaaaccaagatttcaagatttgggcagagactctggtcagggttggtgctcttgggaatgaggcaatgtcatgggagtcagagccctcgttctgagaattatctctctgaggtactcaaaggacagaatggctacaccagcagaaggtggttctgggcagtagagggttgtgctaagtcaaacggagctaacatctttccgggcagtgactagcccctcttttctcccctcaattccagagctctcttgcagagaccctggacagcactgggagcctggatccccagaggtcggatatgatctacactatagaagatgttcctccctggtacttgtgcatattcctgggattgcaggtgagatgattcttctagggtgtgtgacctctggcctagagcttatactgtttaccggctaaatgtttaagatagtcaatgtttaatttttattttattatttttagtctgtgtattatgtgtaggcacgtgactacaggtggctgtggaggccataggtgttggagtctcagtgcctgatgggggttctgggaactgaactccagtgtcctgcaagaacagtacatgtgattattaaactgctgagccatccctgtagtctccaagttttattttaactaagatttattgtaaatgtattttacaagaattgtgtataagaattttcaacattaatttccgaacagcagggaaaaaaaagacctgggaagtaaatgctcagggagtgaaaaatgatacagggggggtggggtgggggtgaggtggggggtgggggctgcaggggaagcggagcgggggaggggaggcagcagaaacagaaaggggtcagtagccttggcctcctacccggccttagctatccacaatcctggcaag

SEQ ID NO: 27197 - DNA, 1149 bp, Mus musculus
atgggtcgtggaggaaactttggaggaagaggtggctatggtggtagaggtggtggcagcagaggtagttatggaggtggtgatggtggacataaaggatttggaggtgatggtggcagctatggtggtggtcctggttacagcagtagaggaggttatggaggtggtgaccaggatatggaaactagggtggtggatatggtggtggaggaggaggatacgatggttacaatgaaggaggaaattttggtggaggtgactatgctggaggtgggaactataatgactttggaaattatagtggacagcaacaatcaaattatggactcatgaaggggggcagttttggtggaagaagctcaggcagtccctatggtagttgctatggatctggaggtagaagtggtggatatggtagcagaaggttttaaaataaaacagaaacggctacagttcttagcaggagagagagcgaggagttgtcaggaaacctgcaggttactttgagacagtcgccccaaatgcattagaggaactgtaaaaatctgccacagaaggaacgatgatccatagtcagaaaaattactgcagcttaaacaggaaacccttcttgttcaggactgtcatagccacagtttgcaaaaagtgcagctattgattaatgcaatgtagtgtcaagtagatgtacattcctgaggtcttttatctgttgtagctttgtctttttcttttcattacatcaggtatattgccctgtaaattgtggtagtggtaccaggaataaaaaattaaggaattaaaaaaaaaaaacattaatagcagtgtgtacttccttcctgggttaactcaagcaggtcccctgaggctggctaagagtacagccaatataacatcatgagagacggttgatttttcaatgccacaatgttcactgaaaacacaagtgttaaagtgtgtcctacgtatactccagagaagaactgcaggcaggaaacactcttaccgggagagtaaagaaattcgagtgcttcgcctcctcttcatatttgccttccgtggagcccccagcctccactgacttggatgccgtgttcttgccgatacccatcatcaaggaaggctgagcaacctacacagcggttggcctgg

SEQ ID NO: 27198 - DNA, 1158 bp, Mus musculus
gagatgacaggaacctccatctaagactccagtgtccctggtgctgacgagctgcctctggtcttaaactcctggcttgactaagccctccctgtaaccactccaggccaaccgctgtgtaggttgctcagccttccttgatgatgggtatcggcaagaacacggcatccaagtcagtggaggctgggggctccacggaaggcaaatatgaagaggaggcgaagcactcgaatttctttactctcccggtaagagtgtttcctgcctgcagttcttctctggagtatacgtaggacacactttaacacttgtgttttcagtgaacattgtggcattgaaaaatcaaccgtctctcatgatgttatattggctgtactcttagccagcctcaggggacctgcttgagttaacccaggaaggaagtacacactgctattaatgttttttttttttaattccttaattttttattcctggtaccactaccacaatttacagggcaatatacctgatgtaatgaaaagaaaaagacaaagctacaacagataaaagacctcaggaatgtacatctacttgacactacattgcattaatcaatagctgcactttttgcaaactgtggctatgacagtcctgaacaagaagggtttcctgtttaagctgcagtaatttttctgactatggatcatcgttccttctgtggcagatttttacagttcctctaatgcatttggggcgactgtctcaaagtaacctgcaggtttcctgacaactcctcgctctctctcctgctaagaactgtagccgtttctgttttattttaaaaccttctgctaccatatccaccacttctacctccagatccatagcaactaccatagggactgcctgagcttcttccaccaaaactgccccccttcatgagtccataatttgattgttgctgtccactataatttccaaagtcattatagttcccacctccagcatagtcacctccaccaaaatttcctccttcattgtaaccatcgtatcctcctcctccaccaccatatccaccaccctagtttccatatcctggtcaccacctccataacctcctctactgctgtaaccaggaccaccaccatagctgccaccatcacctccaaatccttt

SEQ ID NO: 27199 - DNA, 1214 bp, Mus musculus
agctaagagcactggctgctcttccagaggacctacagttgattcctagcacccacctgacagcttacaatttactataactctagttccaggggatccagcctcctgtcctctgcagcacaaggcatgcatatggtgaaggcatgcacatggtgcatgaatacagacaaaacaatcatatttatataatgaaataataaaaatttaaaaagacagcgcattataaaaattaggaagacatatccttgagcctgccactatggacatttttgtgtgtttctttctctgtccgtttgctctcccgtgtaatgttttctctgcttaagccattgtcattaaataaatgcagattatattcctacaccttatgtgcattgatgctggaggcatcaggtccatcattgtctttaatgggcatttgccaagtgtatcaccagctcagcttgtctatcatccctgggatttgcttcattaaatacacttccttatttctttttcctttttaagattgatttattttttatgttacgtacatgaatgttatgcctatgcatatgacagtgtcccatgtatgcagtggaggccagaagaggaactgcagtcgctgattgtgtgctgcctgccatgtgggagctgggaactgagctttactgggagagcaacaagtgctgttaaatactgggacatttctttggcacatcttccttatttccttctttttcacttggttggttggttggttggttgcttgcttgctgagacagcgtctcactatgtagccctggctggactggaactcatagagagccacttgcttctgcccttgggtttatcaccaccactccttacttaattctgttcctaatcttgttttttcttccttgcctaatgttttttgtctagctacttcccagttgtcaagagtgctttatatttgctcttaatagccatggtttttatagattgaatcattaagggatcaaaatatttagaatagggatggaaagatggctcagcaggtaagagttcaaactggtctcgcaaattttccaggttcagttcttgatatgcatatgatggctcacaactgcctgtaactccagttcaaggggatttaatttatcccttttctgacctctgctggcatgtggtgtacataaatacactcaagcatatacatgcacataatatcaaatattttaaagttttagggc

SEQ ID NO: 27200 - DNA, 1293 bp, Mus musculus
atctcctggccctggctaaacttgacaagtttttccacatgagtgtgcatcatgtaagagttgtgaagctaactgtctgggaaggcagcctgttctatagtggaaggtgttaccctccttagagctgaacctttcttttgtcttccattgtctgcttggttttgtagcataatgggaaatgtattgtctagtttcttattactaagtaatttatttttaaaattacctatcttatctctcaccctctcctctaccattatatcctagtaaaattaaagtatctgtcttaccttcatatgctcctccaccttcatatcccagtaaaaccaaatatctgtagatccatctctaattggctttttttacattgacagcaacctggaatttttaaaccatgaagctgggtattatgatcccagtacttgggaggcagagccaggtggatctctatgagttcaaggccagcctggtctacatagagttttacgacaactagggctacctagtgagaccctgtctcaagaaaagggaaacttcctctggtttctccatagtttgcctactacaaaactcaggtgaatctgtcctttgtaggtcaagagattgtgtgaatcatacctcaaggactagactttggctgtttcttcgtaaaactgtagataagtgtacttagagtttatagccctactgctggctggtactatgatatcattctgctaaagattacaagacttggccaagatccctgaaaatgtattaagtcaaatctggttctcagcttataaaaagtgacaattttttctaagtgtgtgtgttgttattgatttttattttatgtgtgtggacgtttgcctgcatatatgcttgtatgaggttgtcagatcttgggattacagacagttggaagctgccatgttggtgctgggaattgactcgggtcctctggaagagcacacttagtgctcttaaccactgagccatctctccagctcaacatgtttttgttttaattaaagtgtcataattcaaattatagatttaaaactatttaactttaggtatgtttttgaaaagcgttctagtaaatcccagtatttaggattacctctggtttcaggtagctggcctatgagtcagacttggctttgcagtcggtttttttcctccaaggttacagacttgggcatccagagttctagaggtgtcatcagctgggatgtggaaggctgtgagaagggaagttttgggagaaagataacttctggatgcattgaaactagatatctacacctg

SEQ ID NO: 27201 - DNA, 1099 bp, Mus musculus
gaacatgctactaatgcaagcttcaaaatgtcagtagctttgactgtcagggactacacatttgaaatttccatgtactttgcagaatagatggtttcttggattttatgtgaatttattgtgaggatttttgtatgcattcatttaaaatgttgactgggttttgagttaatagatatacacacaccctttgactgaaaccatgttgaagatatcttcatgaagtttgtatatttgtctatgtatgcatcccaggaaaacattaatgaggaagggtctgcagagcacgtgaccttgatcaactttctcctttctggtcttgcagaacacataatctcctaagtcagttttcttcctgggtttggtgaaagagccatccaaagaaggaaggcttgaatgtctccgggagaacctgcctttctctgcatctgtttttgtagagaggaggcagtgacagtgcccagaagtctttgaggttttcatcccggaagcaggagcatcctggaactgtgcagtgactgtcacagagccccaatcttctgagacccagaccaactccagcttcttctaggaaattctctggactcttgcagcccacttccacatctcctttcttccccttgctcctgtggaaatcactgtccacggccccgttaggtggcgtctcctgctgtcttctcagcacatgctctctggagttggattcctgacttagatttcttcagctgccgcaggggttaggctcacagggttggctttggtcatgcactcctttcccatggctggacccagttcccagcacctgtggcttgtcaggaggttgaggttgagttggtgctaaatcagctgtgaagattagcaacgacttgggcagtgagagccaggcctctgacttagtttgatatgcttagtgactgatgtgttgtgaagcacaaagaaaatcggcctgtgttttattttagtgctgaagtaccaggtaaaatatgcgttaatgctacattaacacaaccctagtgtttcatttaaaaatgcgtaggatttaagaaaatcaagtggttcaaatatttaactttttgacatacctcagaatggtaattaa

SEQ ID NO: 27202 - DNA, 2011 bp, Mus musculus
ccttgacacctctcgttggggcttctgcaggcatctctgtctgagagcagtgggggctgccctctgtagagctgtgagagcagtgggggctgccctctgtagagctgtgagagcagtggggggctgccctctgtagagctgtgagagcagtggggggctgccctctgtagagctgtgagagcagtgggggctgccctctgtagagctgtgagagcagtgggggctgccctctgtagagctgtgagagcagtgggggctgccctctgtagagctgtgagggagaggctttctgatcagatgaacatctgtccaagccaaaattctgcagagggcaggtgagctttgcttatgtagtttgctttcaccatatagactgagagaagatttcagacttctttttctcagaaagcatgaagaatttatgaagtatggaaaagaagcccttacatattccagatgtgtgcagcagggggcactgtcccagccctctctgccccagccaggcacagtggcctctagagggtggtcctgtagaccgcaccttttagagtcgaggcctctgtggttgtgccgcgggtttgctgctgtgctgagtccttctgggggagccctaagaggtggggagcagaggacttttgctcagacaccctttgcctggaagcccacttgtgttgctgctgtgttgtgtatatagtattctcgagatgagcgtatgtgtgtctgtttaaaagtcaccttgtttcctacatgattttagtcatacccaaacgtcctcagaatccctacatcctgcttagaactgtggccggcctaatctgtcaagaggcttggctcttcaagactcagtgtccactttatcaaatgtgaccggtgtagctgtagtttgtactttcctggggaccttctgctggggtttgtgtaagctgtgattctttcccttcctaataggttgagcttgacatggaaaggagcagttggcagggaaggaacttattccccaagagtggtaactaacccacagccctgctcggtgtgcccaccgctgagaggctgcagtgacttccccaagtaccgtggtctgtgctaatttgttttcagattagtcttcctgtggcctccaacactcagccagccctcagagtgtccgctgtgcgcacgggggcggggcggggcgggcagctccttgtctctcagctttgactgacttgtccgcattggggatttttgttctcagctcccaggccgcactgaacacagtgttgctgccttcagtttggttctggccatgaggcccctagtgggagctttgcccttagggctgtcctctgacttgccctcaaagttcaccaattcggcaactccatggagacggtcgtgtcactctcagcccctgttgctattaagtcatgtcatgggcacccggaaaaggaaatacactgaggtgtattttacaattgctccttaagattctcagtggagattaggagcaacactgcacttctgatagaaaaatggccttggatcactaaactaggtagagaagggcacaccacaccccagcgccccaggagccaaaactcacgctcgggcagcagcagctgaggcttgaggaagctggtgtcctaagacactgaaacccagtgctcattggagctgccagccacaggtttctattctgagttctccagtcttgtgaaagaggagaatttcccagtcaggtagccaggagaacagtgccaccctgcgattgtgccaccctgtgattgtatagcgtgttgtttgttccagtaagcaggcaggcccagagactgctttctcagcaccgcacagatctcagtgggtcacataacttgctttacactcatcttgttgtgtcagaaataaagtgttcgtgcttttccttgtcaggagtcccgtgtttgtcacttgttgtgtggttttatgtttcccgctgtgtgagcataaacactgtgcagttttcctgcttgccagcctgtgtgccatctgttct

SEQ ID NO: 27203 - DNA, 2556 bp, Mus musculus
ttctgctttataaccgcatttaaaatgtattcttaatgtgctgtagtgtgtgtgagccggtgtccagaggtgtgaaatataccatgtaatctcacacaggtggactgtggaaccgtttttatggattttgcccctgcttgctttcatcctgtaacctagcctgtattatacaagaaaacttgagcaggacatttcaagagaatatgttggcctaattgttgggttggctgggacctgctctgaagggatccctcagttcaccgattggcaagccaaggtcagtccttgctgttgatggagctgggaggaggagggacctaaggactcaggacagagcatctcacgcgaagttctgtgtggcagtcaagtgttcctcgtggagtcagcctgaggtagatttccaggaaagccttttcctcgttaccagtgtgtgatgtcacaactgaaacttgtgttagtaacgtctaaggccatgttgcctttgtctttagagtaattcctggctgtgcctaccactcctgcatactgtgcttatgtgcgtgctgcgctttgatggggaggagggcaggtccctgtgcagccagggttcttgctccttccatggcaggatgagaaggaaggcctaagaggctggccaggggcctggtgtagacacagtagaagacagtcaactatgggcgcattctgtctggagctcccagaaggagctgtgtgctgctggagaggaggctaattgttggttcagactcctccgcttgggtaaaagactccccttatcactctcctcacagttgctctgcatctttaaagagtattagcttctgcttccggactcagtctttgttgagtgggccacttccaggggtgtgcccggggttaggcaagtggcagacgagggttcttatttgaggctttgctaggctcatctgctgtgtcctgggtagtccactcatattcttgcagggtgagtccatgctcaggagaatgcggtccacctttctatgtactctagcttccctctcttcaggttgatatagcgacattacctgggctctgtgctgtcctgtgggtggaggccattatcactgggctgctgctttcctgggcaagccactctctatttttctgcaaaggtcaaaagaccctggtgttgggggccctttagagggtgtgctttggacgctgacctcttagggctttaggacagagggacgatgttgagtctagaagggcacaatatgccagagttttatggccagtgatcctcaaatccattggctgtttgaagaccctgtcctcacttctccttttttcaggtgactctctgcttggctctttatcttactcttcagctaatgaagtagcaacagtgtgttactaatgattgcaatcatacagtgcttaatatgtgccagacacagtgccaagggcttgcatgcattatctcctttaatccacaagcagctctggcgaggtggtattagcccatcttacagatgggaaaactgaagttctgtgctagagattgagaacaatgtaaagacttgaggcttaggtagtgctctatctggtcaggctataggctgcgggcagccttcacttccaaccagccgctgtgaggatttagtgagctaacgcatgtaagcatttagcaaggtgcctggcacatagtaagcactcaataaatggtagtttttttgttcttttaaactgagctcagcgagtttggcccacactggtgggctgctgggtattcagccaccacactcttcactgcttggacctagttggtgtttgtgttctgtaaagtgagcacgttgtcctcccaagagaagcacttcagtggtgcagtggtaagagcccacagcattgaggccagcctgactgaaggatgatgtgaggctgtttgtcacttctgttcttttccccgtggttgagactgcccacaggaaaagggctggctgctctgacatggtggggcgtctcctggggcctggctcgctctggaccctgctctccccagccacgttctgtagtctgttgtacatctcaggaaccctcggttcctccacggatggacgactgcagaatagagcagaatagagaaagtaagcctgaagctgagtgcctcagccacaaacctaaaggagctgcctgtgtctgacagcacagccattccatctcttccgtccgtctgtctgtctgggttgttttgttttgttgttgttttgagacagggtttctttgtgtagccctgactgttctggaacttgctctgaagaccaggctgacctcgaactcagagatctgcctgcctctgcttcccaagtgctgggattaaaggcatgcgccaccttcacctgggttttctttcttaaaggaacaggttagagcaagtgaccgttgaggacaggtgatgtgaatgtttgttctagatttaattcagttttctgaatggacacagggagttgggagtatgtgtgtgtgtgtgtgtgtgtgtgtgtgtgtgtgtgcgcgcgcgcgcgcgcgtgtgtgtgtgcttcaccttgattgagt

SEQ ID NO: 27204 - DNA, 1099 bp, Mus musculus
accgtcttagccctttgttttccttactagagtatctttcccgcacccctaggtttgtattctggttctactggcttttctcagtgggacaccaaggtagaaagggagtaagaatggttttccagtgagttgaatgtgcacacgtttatgagaggcctttgggtgagctttctgctcattccttggtttgtcttgggtcccactgggcaggtgtctagcactgagagggagagtgtagacaagggagccacggaggtactggaggcagcaattcctcatccagctcagggactcctgacagccaaggggacagcaagaggacccagagcagggaaaggggtcggggagtcacacaaccaaaggtagactcagaccagttcagtgctcctggtggccatagggaccagaaagcagcttaggaaatctatccattggcccttttagagtctctgtgtgaacccaactctactgaacttaaacaccttccaaacagtggcaggggccacagtggcagacagggtagagtaccccaggcagtttctcagcctcgtccgttgtgtggagggaatactgaattcagttatctcacctgactgctttcctgccctcagacctggacactgggcctcagcccctggccgtgtggaatccatgggatcctcgggactccccagacaggcgtgtgtgagtgtgttctgtcatgcagcctcagcccaggctaacccagtcagtgttttcaccacgtctgacctttctctctgcacttaggattggtgtccacttgtagatttctttcaacacagtataagaatgtgatatattgtatattggaaagtatttaccttatttatatacctgaatgttcctattaaacaaataaacatatactaaattctagattgtgcgtgttttttgatgggagaagcccttttaaaacgattttatgtgtatagatgttttacctgcatgtatgtgtgtcctgttgcgtggacaagccagaagagggcatgagatccccctgaagtggagttacaggtgggtgtggggaattgaacctgggtccccggaagagcagccagtgctattaatcactgagcca

SEQ ID NO: 27205 - DNA, 1134 bp, Mus musculus
agttggagcgcctgaagcaagaattgccagagcttaagaactgtttgtgtcccactgttagccacttcatcccttcttctttctgtgtggagcctgatatccacgtggatgccaacggcattgatagtgtggagaacgcttagttcacagtgcacagaggacatttaggggcacaccgctgccctcatgtttagttttcaccatcgagcactgctgttgcctcttaggtttttcagtccaatgaagcaataatgaagtattttactatttcattacaggtcccgcaagaatatcaagtatgctatttgtcacttgtccaggtataattaccaatcagtctctgtacaataagaaaatatactgttaaacatttcagtgagatatctaagcctataatggtgaatcttcattaaaagttggaaattaacgatataaatatctcatacttaaagttcaggcttttcatttgattaagtcttaaatcttcagtgcttgagaaaaatgattgcataattatacctgaccatggaaaaactaagtacctcaatgcatgcatttgcactggtggctccagctgcacaggtctgtgtcatccatgtacataggtatctttacatggttgataggaacacgcaccattttcctttagtataaacctcagattgctgccatttctcacctgacccaagccagcctgcagatgaacctcaaaacttgtctcataaaccattcaaagatattaaagttccagaatgctgcagggtaacttaatgtataaagtatttgtaagaagtatatattgcatatatagtagtgtagatcagaaggtatcaatttgactcaatgcatgctttaggttttaagcatgagattgtacatgtttactgttaagtccttgcatctggtgctaggtgagggagatgttaaggacataaaatattttgtcgcctaaaaaacaaagtctgttttagacactttgagtatgcttatttagtgtctcactacctagtaaacataagtgtctcactacctagtaaacataattgctgtgtgttgcatagtagttaaattcccatgcagaaaaataaatgtcctgaattctcaaattggtattctttattgtttaatatatat

SEQ ID NO: 27206 - DNA, 2804 bp, Mus musculus
cacttccttctgaacgtactgtcctatgaagaagcagtcttcttaaaacttagtcattgtaaatcatcaagtgatttgtcatctaaattctgatttttattatattgttgacatagtttgtaagaatgcagaaatgcataagtgtcgttttttctgtcttggttaggttctgccagatcggagtcatcccaaattattgatgagtggcggtggagggtaccttctgtcagggttcactgttgtctcagacagccttcgggcagaccccagcctcaagtcctgcacaggcgctttagacccacacaaggctgaggagccagcagctaaaaaacagaaatgcatggaatctgcctcttaactcttaggagattaatgtttgttccaaggcattctgcagctggtaattacactttaagtgtcatcactaaaattttctccttgtcctaagagtgtgtgtacacctgttcctgggaagaagtaagcctttcgtttgcctctgttgcagaaggattagtcagggctgcaactctgatggacagtaatggattggtacagcagtcctgtatcacagcaggctcggtacttaaaggatctgcagattccttgggaatgtcaacaccttgaaaatgttgatgtgtaagtctttgtttatattttaagcaaagatgataatacaaactagccacaacatggtgagcagtgaaaggaaatttcctctcatccactcttcctcctaagcaatatggatgtgtgtgcctgtgagatttacagtaccaaaacgtctacccttgccctgcaatgaaagaagcttttttttagatactagattttgttattttaatagtcaatggcctgaggaagatccaggtatttcttttcctgcctctccttttttggtacatagaaagggtggtgggtgctcctttgcggtgaaagggtctcctcagttctgggtgaagtgattggaacttctgtgtactattaaacaattgggtttttctctctctagacacagacacacagaaacctgtatcagtgttggtatatatgcatacacatagatgtatctatatgtcagcatggacagaatgtactacctgtggtgggacagagaaggaatacacgtttatttgaactgtggtaaagacttgtgcaggacagagcagctcttggtgtgttgctgttactcttgtcaagtatgtttcaagtgccttctggggatttctcacactggtctgtacatgtctgctggtgtgaggtgggtgtctttatctgctctgaaagaagtataatcaaattccttaaccatctccattgtaaggaataaaaatgtctagagtaattgaaggctcttgttcccttgagagtcttgtcctgttcactaggacttgtgcggtgttcttgtcatcatagaagcctggccagcgtggagcatcttggaagataaaaatgctttcctaataacttgtgctgttctgataaaggctgctgtgattaccaactttggtttttattcctttttctctaaacaattgcttttaaagaataaaattttcctactctgagccataagtcattaatgatacaatgctgcatttattacattgagctgacggtgacaagtctgtgtgtgacgacacatgaagtcacatttaaggagaaggtaagattggacagatgagactctccagtaggactggtcactgttaaaaatgatctcaactggtgtccaggacttgttccattctctgaatcatttaatctgccctccaaggttggggggcctctaaggtctgagctactggcagatcactagcaaatagcttgaaaaatcaaaaatagaggaggggagatttgaaggagtgagctcaggttgaatcgaagtatgaacccatgaaaataggagagtgtttgcatgctgtttggaaatattgattgtgaacactgaagcagtgcaaatgctagagacaccatcctaaacccccagcatttgggccttcatcttatgatgcttggtgtgtggtgccaggaaggagagtggacctaacacctggaagtagctctaggataatactcatttttacttaaaataaaagattacatgagccagcagtatggcttagtggatgaaggtgctcgctgcctaagcctgcgattggagttcttcagaacccacatagagtgaaaggacagaaccagctccacaaagccacacccacacatcatacacgagttagtttttcttaagttacaaattttatttgggcttaactatgagcacaggtcagattataaggaacaaactgttagctatcctgttaacatttattaggtacctacagccttttgaccctttatctttgattcgttggaataaatattttaaccagatctaaggtttttcaaataacaataacatgatacctcagagttcacagttcagtgttctcatcccatgtacttcaagctctttgtacatgttttattgtatgtgtgtatctggtgtgtcagtgatggcacagacatgtcatggtgtacatgtaaaggttaaaggataactcccaagagtcagttcccctttgcagccccacattgggcgccacctgtagctgtccagcaaccatgcatgaactgggtacctgaaagggaagctggaaagggctggtggggagaagaattaagccaagacaaaagtttctgaccaaggctcaaactttaatatttacactgtatttatacagagcccatagacccgtcctttgttttagctagattatgttacaaaacaagttcaacagatagtc

SEQ ID NO: 27207 - DNA, 1150 bp, Mus musculus
tagtgattgctattattgacatttccctttgctctattcatatgcatttagtgctaaggaagcagagtaggtacttaactactttgatgccaacactaatgctttacatctccagtgataatacagagccatgcacaccagcgggccacttggcatcaggcaggcctgatataagtggcttcctgtggccacgtggcactcgctcttggtcttccctacctgtcattcttcttagcctgcaggcactagcggctctactcactagtcaggtcttcctaacctgcgggccttagctgttcgtgctcgccgctgccgcgcgggggcgccggtgagcagagcggctgggtgtcgtgaaaacgtcgtgaaagctgactcccttggcggttcaggccacctgtataagcggaaagtgccagagtgtagaaattagtatggagctgtccatacggcctcggcaccgctcgacttctctagagaagctggcagccggtgccaggggcgtctgagttctcgactcttggactccgtggaggccacacggccatgttggcttggcgcgtggcgcgcggcgcgtggggccctcttcgcgtggccctccggcctccgggggcgcggctcggcaggggcggctcccgcagggccctgctgccgcccgcggcctgctgcctcggctgcctggctgagcgctggcggctgcggccggccgcgttcgccttgcggctgcccggcgccggcccgcggacccactgctcgggcgcggggaaggcagccccggagcccgccgccggaggaggaggtgccgccgcgcaggcccccagcgcccgatgggtcccggcgagcgccgccagctcggtacgtgcgagggagggtcggcgggacgcaggtgacgggctcggcgctctgtcgcgacactcacccggtgttctgggaagttacgggcagccagggcgttcgatcttggtgaacttcaggggtcccccgccgggtacagtctctggccaagttgaaacccactgtaatccccttgtgtgcacacccgttgctgggaggtgtgtctacacgttgcataggtaaaaacaaccatcgctcgtctagttaatctgtttttaattttttgaagtgaatcttcagggttaagttcggcggaacc

SEQ ID NO: 27208 - DNA, 1186 bp, Mus musculus
gccaggcagcaccccctgtacaagctgacacctggcaccacctaccatgtgtgtgtactggcagccaacagggctggcctgagccagtcacagacctcaggctggaggaggtcatgtgccactttcacaaccaagcccagctctgtggtcatcttctggggactgtgtaccgccagtggcctgttactggttagcaccctggtgctgtctgtgtgtctctggaggcagcgctggaagccacacaggcagttctacgacacacacctggtggccttcaaaaacccagccagagctgaggaagtaactcagtgggagtgacttcctagcctgtacaaggccttgggtttatccccaacatccaaatcagacacatttgaggccttgattttccttccagcaaccagattaaacaaaccagccttggccacctgcagaggctccagaacttcaattatccccgtgtctcctatttgaaatacatctgcatgcagaaacatgctgatgcctaaggacaacatgagcttcaaattccctgaagccaccatgtctcaggctcacacagaactacactgtgtcctcctctgttgaaggaatgagtgtatcacccttcctcctatagttgttctcactacgcctgtcttactagctcctgtcattctgtgacatcctttacattggtcagtactccgtatatccctcagtaccaagtgagatactacactgaaggagatgggataacaaagcagttgtaagaaggaacaactcctttagaaatgccatctctaagtttcttgcatggacgttcccttgtggcccgattttagcacaatgagttctgttggccttgagctgatagccaaggtaagagctattgttggtttgctaaggccttctggattcttacttgtatttcagggtgtgtcaaaacatgtatttccagagttacagttaaaactggccttctggtaacatttgtgagacacaggcaatttgcttccaagtctttctgtatttcacccatgttggtctcaacttagatccttctgcctctgtctttccaaatggtgggattataaacatttggagcggaggcaaaattgaactcacaacagtgcttatttctattgtaaggaaaagttgtttgaattcatctctcatcttcaaaacaggctgtagcacaaacacc

SEQ ID NO: 27209 - DNA, 1220 bp, Mus musculus
tgttcccacctctgtagcaataaaagagccaaaaaggcaaggtggctcctttgaacacacttcacactgatgtaatggagatttgatttattccttttgaaagatagtagtaagctgtttggtaaaagaaaaaatgctattaagttcaattttacccagtttctttaccaaagtagaggtaagaattctgtctgtgtgaatgactcttggtgaaaattcttcactaatctacctctcaggtaagttagtataatctctaagtatagtaagtgggattctctttaatcctgctaatttaacattagttgccctttggaaaatcttttgccattagaatgtagagtgttttagtgtcactggtggggccctttcctggaattgaatggtagagaccatatgatagatgcagaaaatatcagtggtgcaaaagaacaaactgtcaggctcatgaagttataaatcattgaaacagtgactgcctttttagcccatgctctctgcacatgtctcaggcacataagagattacaggttggctgcttgattattttgactaatagcaatattgtatagtgtattttgtttctcatatccttaacatctttgtcaaataaggtgacaagccagctgatctgcggactcttgtatttactggaaaagtagttgtcacttgtctctttttaaatagtttactttgtatttggggttttgtgttttgaagcaaggtcacgatgagtgtcccagctagcctcagatttacaactctccagacttagaatttcctaggagtgctgtgatacatggcatgcacttctctgactagcagctgtattttcaagtagcataaagtagaatgattaaaaaccaagtttctattgtctattaacctttgttttaaaactgtagatctattcttatgagttagcaggaagataagtctcttgccaagtaaggtcaattcaaataatagcctcaagaaaccatctacaactgtgagagctgggagaatgaccacatttataaaatgaggacaataattcagggtttgacaacaagtcagagtttcgtgtctattaaaatgggattttgataaaaataatttttaatgtgactctctaaggtatacttagtaaatagtgtggtagaaaataaaattgggagatagtacaaaaattatctctgcattacaattagatacgttggctactatttttaagggga

SEQ ID NO: 27210 - DNA, 1748 bp, Mus musculus
aaggtttattttcaatactttgttcatataaaattaaaggaataaacaacttaagattagataaacatttaatacatttttgtgtacataataaatttaatccagaagtgaagtgcatgaaaatgtgattttctaaaacaaaaaccatgcttcccttccattgccatacctgctatttaattgtagattgctattttctggatgttaaaatctggtgaatgagatagcaattgtggaatgagggtgtatagtgctttatgcacagatggatagagaaaggtgccttgttcttcattggaatatctgaaaattccattacctctttttatttttttcttaacccttcacctccttaaccatgctgaaccacactgacttgcttagaatcccatgggagcgatgcacaggcagttcacttttctgttgttgttattgtttggttttgaaggctaatcatggaacatggaagagatgtctcattcactacataggccattgtgctgtgtggcagtcactgcagtctcatcctgtacataggatctgtacctgttatttataataactagtgcaatggaaggcaaacaagcttgacacagatcagctttggacagctgaaaagctacactttgaccttttagggccaactcctggctgataattaagatattgccatgtggtttgagtatatgtaagcttgaataagtgcactgtgtaacatcttttggggaggagattaaaatgctagttaagggaatatctgccatgtggcttttgcgagtttggaaacaatggaggtcaaagggaagttttaaagaattgtaaagggtgaaagatatttcagcattaaaatcctaagcatgaagtgagggaaagagagagagaatggagcttttgctggtgtgtacaggttttctgtgttcttcctcttagtgtcctgctgttattcctgccagtattgtacatttgtgattgactagcctgtcaaatcattcaactgtttggaaagtatttgtgtaaatctttgtgccaacaagaacgctctcagtgttgtgtctctttacctcattgacttgatccttgtgagattgtagcttctgacagaagccaaggtggagtctcatgaaacctgctaggtcagttctttgagcagctacccaaagcaggagactcaactgagaaaccttggacagcttcagcctagcatgttgacctcagaggcttattctctaaagtttcgtgtagactgtgatgttcacctgtggctttgactcatttctaatgtggtttaattttatttgtctttggaaagctttgtagaaatgcaatttttatactaatgacactgttcatttgtgagtcagtatattataaaatggtgtgtttttttgtaatagttttgattgtttagcccagtgtatttattttccattacctatgtattctgtgctctcaaatagatgtgtagcaattgaaatgagaaatcagttcatcatttcaagtactacattgcctgcattacaaattctctgatcacagaattgtacataaccctgagcctatgtactgccatttgattgtcaggttccatttgtgtcaaaacctaaagatagtgatgaccaagtgaaacagagtggtgtattgctttttcatatgaatattttcacataaaagcatttgtgaaagcagttgaaaatattactttgttaaaaaaagaattttcttctgtgtttattctctgagtgttcatt

SEQ ID NO: 27211 - DNA, 1064 bp, Mus musculus
acttcttcaagagtttctccagccacatcctttgtttttctgaacccagagtgctctaagccttgtcactgtaaggtatttttataaagctgacttcaggtctgtggtggttagtttccatctcaagaaacctctctggaaccactttaataacaactgaaaaggcatgtcggctttgcttttagtgatgtgcttttggtgaaaaaacaaattgatgaaagtcaatttcagtaggtaaaagattttatttgtttctatctcccttgatcctctggagaattgtgtgattataaatctctccctgctcaatccaatatcagtatcaaggaacccagattccttattaaataaaaaaaaatctctatctcctctcttaccctctcaagtctgagaataaatccataaaattagattctagctatatgaaggatgactaaattcaatcttattcccccttgggttgagtcagaataatgagtacaggtttgtgaaactcaaaatgtttcatcattttaaaaaggggtatgtagtgtatttctctggctgcttagataacgttttctttgcattagctgccaacaggagggtcattgttagtggaggttcagaatctgccttcctgtactgcacaaggctgctacaaaccttgcacaaagaaagattttattgtgacaatccattctttatgaatgtttttgtttcatctttctaacttagttaactgtcagttcaaggctgaggccatcacagaactggagaccttactgcccttccatgtttctgcccttctgatacatccttactcaaaagtgtcatggttctgtggtacttttcatcttcctaatagagctgagctgcaccttctcttctgccagtatatttccttccttccttcccttgtaatccttccttgatgcatggagtgtttaagcaatagtaaatccaagttcagagtggtgggaaagggacgacttgcatctctgttctgtgaagtaccctcctccaaatcgacatactgggttttaatgggatatttgacaagagggaaagcttgaaggattaca

SEQ ID NO: 27212 - DNA, 1196 bp, Mus musculus
agcttgttttaatggtcaggatatgcaaaaatgcataggaaatagagtgcaaatgtattactactatcttcaataaattttaactgagtaatttcagttttattctgacagtaataaagctctggttatattttagtttgtatatttacttcacttagttatgttttgtttaattcttattttcttctaaggagaataagagacaaattatatcatgttaaagctaataaaatcattgttaaaaggtcttaagaaataatattatatagaaaaactatggttttagagagtgggacaaagaacattaaagcccagcagtaacaatgcccatggctttgttttactttaaagggaacctgtctgtttataattttgcaaggcaaataacagttgtgtcctgaaattttgtgttttaagaatttaatatttttctggaaatgattttatttaactttaagcaataactaggaccataattaagttttaatcaaaatgaaggcttgcttcaaacaccatgaaagtgtttgatcacacacacacacacacacacacacacacacacacacacacacacacttactgagacgagacataagggggaaatcacatcccctttagagatgattgtattttatctgaaggaccaagagtgttaattaacttactaaagcttaccttccactgaagagagatctcttgtgaaccatttaacttttgcactttgaaggaaaggaaaggaattactcagaaggaagtgagacggtccaaatggaatgctgaattttacaaacacagtcacagactgttggaaattggagaagagtgaacggataacaggattcgaaaccaaacacactggtggttatggcaggacattggatttcatcatagtccatatagtgaccgaggttgaataaccttgactttcaaatcctgttttggtagttggacttcattatcttggtgattctagtcattttacaatgttttgtatctggtcatttactgtaatcacattttttatatctgtacagtgacactttttgcagttgtggggtagtgtgtatcactgtgcatcttgcatcatcgaaactactaccatgatactatccatcgataatattaatattacttgaaaatagacaaaggtaaagaaaaggggtctatatgatgtgcagttttgtgcctttatgtac

SEQ ID NO: 27213 - DNA, 1165 bp, Mus musculus
gcaatatataaatatataaaataaaatatataaaataatatatattttataggtcttttgactactttgatttttgtttttgtttgttgttgtttcttttgtgtggatgtgtttactttttaaaagaatgaacataaagttgggtaagaaggaagggcagggagaacctgggaggagtagggggaggggaaaacaaagtatattgtccaaattttttctaattaaaaatataaaagatgaacgggtgttttgcagggctgtgtttcatctcagcgatcaactggttgacctatatgtgaggtgagtggaaatcccctgctgcacagagtgaggctcaattttgtttttaggaagaacaaaatatatcatttaaaacataggaaatgttaagtatttcctaggtttactgtttgacattaaatattcttagattaataataaatacaacattttaaatgcagactttgcaagccgagtgtgatgatcctgcttagaatcccagcatttgagaggctgagccagcaaattgacgtaagttccaggacgaagaatgagattctggctaaaaatgtcagagtctgaagaggtgcctcagtggttaaaattgtatactgctctcgtagaggaccagagtgtggtacccagcacccaggttggatgggtaatacatccatgtgtgcaaacacacagataaatgtaaacttataattaagaagaaaataaaatcttttttaaataaacagacaaaaaaattacccttgctgtaaaatatctcaataaagttatgttacctcgggtaatagcataacaaggttaaaaaccttgattttgaaaaattaatcatctttaaggcaaaaactatcagaacagcctcagacttcctccagtcatgcgccttgctggcagtaatgtatacaatgatcctaagaaataaaagaaaatgaaaacaagccttctacacagagctgagcgatcctttctctatacagcaaacatgcagacatcttgacataaaatctttaaggaatatggatcttataatcccttttaaaagaagttattctggaagcagatgtcaacaaatgaagatatgaatggagaaaatgcaataaatgagccattgctgaaaccatttcactgtaagacttagattaattcaaatgcc

SEQ ID NO: 27214 - DNA, 1142 bp, Mus musculus
ccaggacgacttaaggggtatttataaaatggtgtcaatcagtactacttaatgagtgactcagtataatgtgtggaatgacttgttggttctggtttcagccacatagtagattccgaggccagtggggtttttgttgtttgtttgtttgtttgttcagcaaatattcattaagcccccactttgtcctaagttcctttcagcaccctgggaattgcaagcagatgaacatcggtccctgccctcaagaaagcatgcaatgattttgtggcatggcagagagcaacggggatcctaagtgttcaactctctagagagagtgcttatcacatcagctccacctgtgatgggatattacacatagataattaataaaataaaaaggttatatttttactttggccaacacttaaactctgagcccaaaatcattgtcttgctttggggaacatggcgtagatacattcaagcctaggcaagaatgtgcttctctgccttcgacattgtctctggcgtctctgcctttgtgagttcagcagaaaggaggccacctcaggaagcagtcaaaaggagagtttcacttctgattttatcgccagcatcttttacagatctacttgttttttatttcatgtgcgtgtgttggcctgtatgtatgtaagtgcacggcctgcaagctgggagatttaaggggccaagagggtgatgaatcccctgaaactggttacaaggttacaagtcatcaatcatgtggatgctggggactgaatccaggtcctctgtaagagcaatcacttagccactgagccatctctccagccccttgtcattcaaaagaagaacaaaagcacaaatatcaacagacctttcgctgttttcaaggagccgactttatggagggaaaatgttttcacctggttcctggatggtacttcatctgtaattttccagagaacgtaaaccttctctgcagttgacttggctccaggcctagccagagaccatctcagccaacacttgctccatctgttgggtgtctttgtacagtgaaaaacttgtcccaccaacatgtcatcctgcctaatcctagaaaagatgttctttagtgtttgaatctcaggtggctctcagaaatcctgcat

SEQ ID NO: 27215 - DNA, 1101 bp, Mus musculus
agctaggtcccacctcctaagggtgctatggcctccaaaattggcaccaacggctggggatcaagggtttaaatcctggtacctgtagtaaacattttagatccaaaccacaaccataacagtatccttattctaagcccagattcttctagcggtatagtccacccccatccctcatctgtcaatcatgtatattctcttggctccagcaggtattctttacaatggtgctgggttgtttttgtttgtttgtttgtttgtttttgtgtgtgttgttgttgtttttccccttccatgtaggagtttacagttttcagagagacacacaaacagctactttataactttacatctttgcctatgacttcattcttcataccagctaaagaaatctgcacaaaaaaagcctttgagcattatttatataaaaaaaaacctcctccacaaatccccagggctttcacgattaatttctgtttccctaatttgccgaatgcaagccatccttggtctgaactgtgctgtgaaattttaactcctttatttgtataacctgtagtaagcattattaaactccaagaagctaaatgctgtggctgctgtgtgcttgttgactttgaactcctcaccctcctcaccgctcttcagagactctggatgagggcggggctttatccctcccagcccgcttagattccaaccccagtgcgggtgggtgctgcacctctgcctccatgtcaactgctcatgttttagctacaacatgacttgtgcccagaataaaatgggtgcatgtctgggactaaatgagtgtgtccttaatgagtgagtggtaattgccaacattgcaaattctgcctgtggagtacattagagaagaggtgagtgagcgagccaaaggagcgtcacaggtaagagcaggaagccatctacacacttacaggggaatccctgggtgctgacagatggcccagtaaccattttggaaaggtgatcagtcatctggaaatgctgcggtcattatttctctatcagaaactaatgtcataatagcaaaccacgcccaaagatgttccccacgacacagtccatctttcatct

SEQ ID NO: 27216 - DNA, 1202 bp, Mus musculus
actccagaatttgggaaaggtacttgaatcaagttagggggatgctggagccgtggggtgggagagtatgggtggggaagcactctatatagacaaaaaggaggggagagggcagatgtgggatagggggttggtggaggtggtaacggggaagtgggataccatttaagatataaacgaatggaatcattaaaaaaaaaaagttaggactgaaccaggacaggccacaagtgtttctaaaggggatgaatgaacacttactggtttttgtttttcttttatgtgtttgttgtcctagcaaagtggatatgctttcctgtggtctacctcagccaatgacctccaacaccagctatggggatttctcttttcgtttcgttgtggaatcatttctgcagtagactccagttgtgtgtcccgactgtatcaaaacagtacacgatcacacaggagcagggctctgttcctaagaccatccctgccaaggctcaggtgcttttacctgggcttagtacatgttggtcaggcttcccccagcctctttcttggatttgaataatttgcccaagtgctccacagaactcaagaaaacatgtacctgagctccttggagatacgcctagggtgagagctgaggaaggggacgtggaactttcatgtcttccctgtttgctccaactttcgggaacttggaagtattcagctgtctggaaactgaagtctgcccttctgggtttctatgaagacttgattacaaaggcacagctattgatagactgggcctggcttggccagagtctttgtgcctaccaccgtagcattcgtctctctagactgtgagacatgctacttctgaaatgatgttgagggtcataggaactagttagatgtactgtagatccgtagtctttttgtttgtttctttttcttgggggtaattagaagacaaaaaaggcagtgtaaggttagagtttctgtgatctgctttggtaaggaaaaactctaatttctcttgcctactgtaggctgggagttatgaaccaggaagtgtgaatgaaaactaaaaaaaacatgtattcatttatttaggtcacctcagggttttgaacatatgcacttatagcaatagattgacaacgtaaaagatactgccacaccactctttgtcaccttaataattaaccccatctgttgtcctactg

SEQ ID NO: 27217 - DNA, 1469 bp, Mus musculus
aattagttgtacgaaaggaaagcaatgctatcctgaaagtgatagaattatccaaaaaaaagtcacgtgacactaaattaaacagtttgatttgacatcatctaagtatctggctcaagttcttttcatgtggtttttcccagaaatttgtaggccagattttcccagatttttgtgtaccataaaagtttcttgcaagatcctgttgaaagaacgattcagatcctgtggcttttaagcaacctccaagactctgcatttctgaaaataacccctagaacttctgcggctgccggtccgcttgccatttatgtaataaggatgggtttagcaggaagagaggctagggccagtgggaatcttcggaagggaatttccatgcataaggctgtgtttctggtgttgtaggcgaaggagatgcagcagatggtgaaattggaagccgagatggaccgcagaccagcaacagtagtatgaaactccagagtgcaaactgaagctggaagaccatgcaacaccagaagatcatgcccagcttccaaacacagactccacagacaaaagctgttttctttgtgtttcttttatgtatagacacggtgttacctgaaaccacatggactggggatgaccaaacgctcttatatttaacaatttgagtattgaatttctttggccaaccaaaagtagctatgtacacatacacacacacacatacacacacacacacagagagagagagagagagagagagagagagagagagagagagagagaaatcccctattcctgacaggcagagttgaatcatgatatatgacttaaacatgtttgctatgagacagcatcacaagccagtgggcttggtgataacaactctgctttgtggtgcattaggacatgtttgagctgctgctgctgcaaaacaaaacaaaacaaaaaaattagtgcattagtaacttaatagtaagcgcatgcactagaagaaacacctctgtctccagttcattagcagaagtggccgtctgctatacaaatcacttcgcagaattttctacacctaagttacctcatcagtaagtgccatgtctttaccatgccataagatgctaaccttcctgtaaatgttgcagaaatcgttaggacaatagagacacaaaacggtgtatctgtgccaagctcatcaatgctcccagggggactcggcaggctcgtttcagaaagtttacagctgaccctgctttgtaggaattgcttctgccgattccacatattgcaattcactctacactataaggatcgtcaagtggttattggcaaatgtttgtaaatgtgaccatgtacaaagtatttatactccttaattctcacagttatagctcaaagtcatctaaatattaccacacgacaagactagtgagcaggaatcatagacgtaatgttttgcatgatgcacaagcaccaattat

SEQ ID NO: 27218 - DNA, 1184 bp, Mus musculus
aacttcacttgtatacttgtgttcagttattaaaaaggatctgaaaagactttgtcttaggaagcttacagttaggtaaaggagagaccacaaggtccagggttacatggcctctagtgagctgagtatgagggtagaagtgtagctgtggccaagggagaaacaattcaattgaaacagacccaaagcactctaaggaacaggtgggtccactgttggatgttgggctatcgataggatggtactttaagagagagcgttccatccttcagtatgtgtaggaagaagtagaagttcctatagctccgtcatcaaagacatttgctatggaatacttggccagattctcttccttgaaaggatttgtattctggcattatttattccttgaactaccattcaatttaggatggtagaggcctagaaatagaagagaccttgggggtcaccttgctaattgagaggttattttccaccatcctgtggatcaggaatactttacatgtggggcctgcactttgattcagtaggtagaggtgctgaagcataggcctgccactctctgtatcccacaagttggcaggaaatgggagattcctgacagttgtcctatggcctccaggtgcagccatgttgcacatgtgtgcatgtgcacacacacacacgagagagagagagagagagagagagagagagagagagagacagagagagagagagagagagagagagagagacagcagagacagacagcagagacagacagagtctgggactgagaaaacctctctcaccccctgtactggctagttttgtgtcaacttgacacagctggagttatcacagagaaaggagcttcagttgaggaaatgcctccatgagatccaactgtaaggcattttctcaattagtgctcaagggggaaaggtcccctgtgggtgggaccatctcagggctggtagtcttggttctataagaaagcaggctgagcaagccaggtgaggcaagccagtaaagaacatccctccatggcctctgcatcagctccagctccctgacctgacctgcttgagttccagtcctgacttcctttggtgatgaacagcagcatggaagtgtaagccgaataaaccctttcctccccaacttgcttcttggtcatgatgtttgtgcaggaatagaaa

SEQ ID NO: 27219 - DNA, 1198 bp, Mus musculus
cagtcctgacttcctttggtgatgaacagcagtatggaagtgtaagccgaataaaccctttcctccccaacttgcttcttggtcatgatgtttgtgcaggaatagaaaccctgactaagacacatatttttgcctttctggagccactctggtattctcttctcccctgaagctacttcagaaatactaccaaatgcctcttgattgctagctcagcattttgttttctttaatctcctttctgagacttctgccctgcttattcttgtctcactactacttgtagtctcctctttgttgtccttgactggtgtgtgtgtgtgtgtgtgtgtgtgtgtgtgtgatctttgtagatgtgtcctccccctgcaccgggtaaaatgtgctaggctgtggatctttcttaccttttggacaggttgtcctcagtatatccccacatgacttcttccctgaaacccattttgttttgcattggaaatagtcacttagagatactcattggttcttctctaaagttttgttcattgtcttatcagctctccataaaccccatgtttcttgccagctaccatttatctaagatgaattcacagaggtgaaacacacatcaccaccatagctctgcacactacgtcaatcaccagacgtctctgactctgtctctgaagtatcccttggctgtgtttccatttgtcattttcctggactactgaggaaactcactttctcctcattggctttgttaaaagcttaagccaaaagtcaagttaatggagttcatttaagcatagaacaattcctgaatgaggcagtgctccaaatcacaagtggttcacagagccctccctggcaatgggagtaaatggctttataggatgaacatgcaaacaaatggaagaaaactactcgattaggtaggcattttctttgagtataacttaatggaaattctccagttatataacagattggttacttggattcctgaaattggcataaaatgcaactaaaaattaatcagttgcaattaatgcatctaaggtaaatttgttgcttgcttgcttgtttgtttacaaaaaacctgtgcaagggcatctttgtaaaacactgaatgtttttattgatgtgggggagggaggccatgtagatctgggcatgaagatacatatacttataatcctagtgtttgggatcc

SEQ ID NO: 27220 - DNA, 1180 bp, Mus musculus
tagtttctcttgaaaggatgggataggctttttcccctgggaatactgatggaatttttttttttttttttttttttgtacgacgtcaggtgttgaaacacttccttgatagcatcactttaagtttaagacacattttaaggactgactgaggcagattaagaattgctctagaacaggtttctttctttcttttttttttttttttcctctttctttcctgctttagacttgaaaagagacaggcaggcgatctgctacagagcagtcagttttaagggaacagactgagctatatgacttatgtagccagaaagtgactggttgaatctcattacaaatatcaaattaattgtgtgaagttggaagcatcccaatcttactttgtaaattctgatttattttcaccattcgttatgtaatgctgaaccacttgtagacttgatttcgttgttgttgtctactgcatttagggagtattctcataagctagttgaatacttgaaccgtaaaatgtccagttagatcactgtttagatttgccgtagagtacactgcctgccttaagtgaggaaatcaaagtgctattaccaagctcaagatcaaaaaaaaggcttataaaacagagtgatccaggttcaccaccgggactggggagatacttggtgtttgttctattagtgttatatgaacagaaaatacatctttgatgtgttgttcctggcaataaattttgaaaagtaatatttattaaattttttgtatgaaaacatggaacagtgtggagtcttgtgagcttatggaatccttgctggtttttccatcctgtggttgtttggcactgctcattctgctccatgtagcatctgaaaggggtgggggtgtgggtgggggtggggttgaagcaaacagcaaaatttctgagttctcaaaaaacccgtgaggctgctgtgtaggtgcgagctgtggtgggggagcccccgattctcttgtcatttgacaagtgtgaatactgctgacatagtgctactggattgcagtgtggagatgaatggtttcggagcactcacagggaatgcccattgcacaaacagtggtttaaacagcttggatttggcattgagctgaaggagtgagacttggcgccttctcactttttggattggattaatagtgattc

SEQ ID NO: 27221 - DNA, 1137 bp, Mus musculus
actctgtatttagttccttatgtgtatggattttatgggtaagagtaacctgcatgttgagctgcatagtgtaaacatttcagccatgatctgcacacagagactgcatgctagcgaagcattgttctcatgcacttgccttgtctttgaagctcactggatccacagtttgttattaggaaaacttaatagcacagtttcaactcattttatattgagttctcagtagtcagtaaccaaaaggaaagaaaggcttgacctcctggatggtgaatcctgtttcctgtaggttcagccattaataggcatgccttagaaaaatacacccttttctaccttgttgagggtctcctttaggttgtttgctctttcctaagccctgtgaaaatctttggttttattattttttaatgtactcatttatttgttttgttttgtctgttttgaattgctatctcacttctctgtatcagctgtttttgttctgttctgttttgttttgtttttatgtcatattcctgttcgttactgagggactaactctggaccttggctgctgttatattttaagtctctgcatagagaagggtttctaataaaaaccacctcccacttttttaatgtttgttaaaggaaaatgtaagtagtttaaagtcaaatgctttgaatctgacttaggctgagctacctgcctaaatagcctggaaatccaccaagttcttaatctcactatcaacagtgcaaatgtggagaaggttcccagaagcaccttcttaggaggagggttcaggcttcaaggagctgatggcagctggcgaatgtcagccactgcccttccccttgcttcctgtcctgctgtgaagactgggttgagagctgctgcttcccctcgccctccctggtagatcagggccgcaagactcttgcgtgcttgaagtgctgcagtgtcttggaaatgaactgttctcaacggggccaggagtggagagaagggtgtgcagtcgagccatccccacatgacgccacaggacgccagcacataattagtaaatgcatatagctgctttatttgagtataagttccagttaatttgtcacttcccattcacgaagtgtttgtgtgagatccgttcatgt

SEQ ID NO: 27222 - DNA, 1810 bp, Mus musculus
tgctgttcttttacattcgttatttctgggccttgcttttatagtctttgtatttcaagttcatatatgtgttactcactaaacagttcagactcttgatgtaaggaattagatatttgtttaggccatgattccaactacaaagcagacttatattctttcaggttagaagacaagataccagaatgcagaccgcttccttcagaagtgatgcaattggaaaatgtcattgttgatagaaagaaaggttgcaaacttgctaatttgtactctaatgggtaaaagggaagcctgaaaatgcctatacaaccagcagtcagtttaccagtgagaaagaaggatatacaattcagaaaagccactctggcctggtagttttggaccccccacaaatacacactcacacacacactattggtttgttcttaagtcttactgcataggactcccgtttctcctcccccctcccctgttaaaagaggaccaaacagttctttagaggtatggtatggagtaacggttttgtagcactacttgtcagtgtgataaagtactttttatgctttttcttttaaatcgaaacattctttatctgatgtttgaccatagacgatcttatttgttgattatgaacaagcttctggactgctagaacctggcctctggccatcttaaagtgccaatatatgactgcagggtttttgaaaaatggttcggagtgacactgggttataccgagtattcacctcatcagcatcacatgcagttcttatttgtccatgataccatacgccaagagggaaaagctcgcagacaacttctccttttccatgatggctcctgttggcttagtgcctgtggccctggtagtgtccagtgtagtcacttgaagctgaaatatccatgtgtttctgggcagcttttctgctcagtgtgatcctgagatggctccctgccacccagagtgtggtccctggccgcctccttctcctgctctgtaagccaaagttgacttatctggagcaggggctagtcctggggtgtgtgtgcctgcgcaatatgtgcatgcaaatgtgcttgccaactcaggaactgcctcctccctgcctggctagtggtgggtgtgtcagaactaacctacacaccccctgccggtaccagcaatgcccagtgaagtgactgcttttactctctgggcttctgggccatttcttcccttggagatatgggcttgtggcctttggccagcttccctggtggaggagagcactggattatgggaaatgttttaatcattttgccattacatacatctgttaacatagttgaccaaaagctgttattgatgacaactttccaaaattatctcttaattgcttcctaataaaggggatgacaggttgtagttttggcaaagcatcaatgagataaaggtacattgtcaattaaaattacttcaacaaaggtttttgctttacaattatggttaaacatttcagtaactcatagctaccatacaaattggtatggtacatgcagagtgactagaaggcacttacttttaagccagaggagaaggaactttgtttagcacagattgcatcctgtaagatagttgggctgggtgtgatagccttaaaggggcagtgtctatccccaactcactcttactgtgactgagccaccctccatgtggctgggcaagtgcagttcactgaggatggaagaacttaactttctattaatcattattatgtttccaaaaagatatatccactttctgacttggcctatgccaagaactgtgggt

SEQ ID NO: 27223 - DNA, 1921 bp, Mus musculus
aggggtactctgacattcagagggcacctttaacaccccctccgtatgtaaaaaaacattcgagagacccatggggtggttgctctaaccaaagggatagaagtatgcttcgaacccatcccttctatgtctgccccgggccccaccgaagtcagtccctcaatccaacgtgtagaggtaaggctgacttcttttgtaagagctggggttgcgagacttcaggtacagcccgctggaagccctcctcgagttgggactatattagagtaacagccaactattccctagcgtcttatgtacctggaggatttgacttagacgagtgtactgactggtgccatccgctccgtgtcaccttcactgaaccagggaagagagctctgggatggacaaaagggtatacctggagtcttaggatttacaaggaaagatatgatgagagattattgttcactatcagattaaaaatagagaccccctacaatcccttaggccccccaaccaagttcacacccctcacccatacaattactcagcctactccaatgattgcggacccccttaatatggtcgctatcacccaacctcccactcctcaggtacctctaactattacccccgagattccttcaagacagaagatgtttaacctagtgagaggagccttttatgcccttaacagaactgatccaagcgctactgaggactgctggctatgcctgtcctcgggtccgccttattatgaaggaatcgccttcaatggaaatttcaacagaaccagcagccatacttcctgctcttggggtacaggacaaaaactgaccctgactgaagtatccgggaggaatccaggtctctgtataggtaccccaccttccactcacaaacacctatgcggacaaattcagtccgtgtccagaacggaagctgattactatcttgtaccttccccggttagatggtgggcttgcaatacaggacttactccctgtgtatcaactaaggtttttaattcatctcatgatttttgtgtcatgatccagctgttaccccgtgtatattatcaccctgcatccagtttaaaagaaagctatgcgggccggcggtcaaaaagaaaaccaattactttaaccctggctgcattcatgggaataggtatggcagtaggagtggggacgggagtgtcagctttgatagaaggaagacaggaaattcagtctttgagagatgctgtcaatgaagacctagcggcaatagagaagtccattgacgctttaaaaaaatctttgacctccctgtctgaggtagttttacagaacaggagaggtcttgatttgttgttcctaaaggaaggaggactgtgtgctgcccttaaagaagagtgctgcttctatgcagatcatacaggaatagttagagactctatgcagaaactgagagaaagattagagcgaaggaaacgggaacgggatgctcaacgggggtggtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaagattctatgattagaattagtctaaacagaagaagaggggaatgaaaggaaataaaactgtaattcatgtaatgtatgttaaatagcccaaagagttgtttgtgagctttgaaacctggggctgagaacacagcagaacagaccaggacatgcccgggcaagcccatcgcctccctagctcccacccctctgacctaagttaaatg

SEQ ID NO: 27224 - DNA, 1224 bp, Mus musculus
atttcttaagattaacaaacttcagaacatacagaacataacaggatgtggttaccgtaaccttgctctgagtcaagtcatttttctgtgtcaatgattagcagacatattacagtaactatgaaatagctgacaggcatggaacataatggctacagctatgctggtggtacatggggcaggtcagatcataacattttgaatgctctgtggagagtgaagcactttcacttactatattccttgtacctagaatttggtggctaacttttagtggtcttaatttgggtaagattaagagtgataattagtctgagtaataaacattactcttcttaagtctgtgaaatttgtaccttaaggcacctgtgtccgacttgccggcctcaggtcacatatggccaggtgtgaagccccacataaccacagcttcctgccacggtgtcagtgtgcggtggaaatgctggccgatttctatgaactcggagcgtcgcacatgttttacacctttgccgagtttatggtttgtttgagaagctggttttcggtgaatactgtctcctcttggtttcacaggcaattgagaagctacaggctggtgctcttgctacagatgcagtggctgctgctctggtggaacttgaggtatttcttttctcttttatattttctaacttacttgtgcatttacattccttatttttaaatggcattgaggtggtgagctagtcagccataagtcatataaccagtgtttctcactaatactagcaaagctatgtaagattttattttcattgaagacattcctgagtagtaaaatagttggttaattctttgttcctcttgtttttgtaggattcattgctataaattcattggtgataggtattttcagtaagacacttttgaagttgacacctccaaaatgagatatatctttaacaaatatatgatttcagcttcctagaagtgtctaaagtgggaagacagtttttatcacagatgtaacagatggaggtcctgaagccatatgttgtgtgttttgtgaaatcaactttgttccagtggattttcaggatagttctaagttttagtggtcattgaggagttgagtcgggagagaggctcttggtagtccatgagggactctcagtttccgtgactctggagtagtagtgagttcgaggcctttgacaaggctggaatgtggacaggagggat

SEQ ID NO: 27225 - DNA, 1181 bp, Mus musculus
gtaccagcagtgcttgtgattccaaaatgtcccagaagtcagctggtttgcgggggaaatgaaggaatagttacactatgttgacttacttgactatgggtaataggaagacaaaatttagactatgttggttttttttttcttttagtatttgtttgtttgtttgtttgtttgtttgtttgttttaaaagacaggctttccctataaccctgggtgtgctggaactggccaaacagaacagactaacctcaaactcagtgaacctcctgcctctcgggctctggtaagggtgtgtgctgccacacccagccaagatcagaactttttatagtaaattattttgtttttatttcttcagacaagcactgttgctggacagagatttaacttgtaaacttttcatgttttgtcgttattatccagttcaataatcttaaatatctattttccaaaatatttgtgcatactttttgtaagtaatgtatatgttggtaggaagaaatggaagtaatcttgtgctgtttttctccaggttgactccctttgcacagttggatggaaggatgctcttttcctgatagaagatgatgatcttggagaatgatcatggagaaggggatgaattctggagaaggactgccttccagatcatctcaggcatctgctgctaaagtaacagtcaaggagttagaaacacagcagccctgtaaggagaaacgagggggctttgtgctggtgcatgcaggtaaggctttgcaggtgaggtgggatagaaagggaaataacattttccttttcttgctttgaacaacactgaggactgcacttgtgtctgccagaggagtctgttagctattaatggagtgaaggccttctctacaccctgcttggaaagttttacaatgagacttcttccaatgtcttccttatttccctttaccttacatacacaacatacatatggctagttcagtatgtaaaaaccaaagtaatctttatttatttatttatttatttatttatttatttatttttgagacagggtttctctgtgtagccatggctgtctttgaactcactctgtagaccaggctggcctcaaactcagaaattcgcctgcctctgcttcccaagtgcccggccaaagtaatctttaaatttccatccatccctccatcca

SEQ ID NO: 27226 - DNA, 1167 bp, Mus musculus
caaattgacagtgaagactggtgctaatgattggatagctctcctaccctttgtgctcttcagggatagaaacacccctggacagtttagactgacccccctataaattactctacaggggcccctctccactggtaaaaatagcctctgtacataatgctgacatgctgctttcccagcctttattctctagtctcaaggcgcttgagtgggtgagaccttgagcgaagaagcagctccagaaggcctgctccagaagacctagaagccccacatctcttccaagttagagattcagtctacattagatgcctccactcagaaaaccttgagactcggtggaaaggcccttatcttgtactcttgaccaccctaatttctacctttatgagaccccttttgattttgcttctgcttttaattataagtccatgtgtgttaaataggcaagtcgcctttattagaacaagaattaatgcagtgcggcttttagttttgagaaaacagtacatgccctaaaggatcaagtgtgtcagggagaagatagtgtctagttctaagattagaactactaacaagtaggaggggggaatgaaagtataacgtaaaaacaaaattctaggcctttaggctcaggtttgggaatgtgacctctgtgacttaatgctccaaggtatgtcaatcataaaacagatagcaacattcctccacccacccgcttcctgggttcaaagagtgttcattcaaagaaagttaccctgaccattgccggaacctgctatgcaaatgtgctattgttaggggctcttacaaactgtcttgaaagataacctgcacaattaccaggtattccttgtgactcttgtgactttgcacttccttgggactcttaacttgtatctttggtattttccaacaacaccctccccacttccttgagttgtggtttcttcctttaaatacccccttacccagctactcggggcgccaaggtcctctacccctccctgtgtggtgtatgaccgtgggcccccgagctctcttgaataaaaatcttcttgcagtttgcagcaaaaaaaaaaaaaaaaagattgtgtagtacttcactacttcacactaagagataccctctcaaaagtagagatagtgatggttagaaacagaata

SEQ ID NO: 27227 - DNA, 1100 bp, Mus musculus
ttccagcacttaggaggcaggagcaggaggactgagcttcaagattatccttggctacatctttggcaaattggaggatagccctgtctaaagtagatggtgccttatcataaacaacaccagaggagtaaaggcagtgtctgtagcccactaagtctgcggttagtgacatcaggtctgagtcctggctataccattccacatcctttcctgtccctcacctttcctccctccctctcctcctcctcgaaaagttagatatgctctctcctggtgagctgcacttattaattttgttttgggctcaatatttgtttgtaaaaggagacaattttgttataaaatcggaaagggattttgtatgtaaaaagcatgctagaggacacatcccatgccctaaacagaatatttttaaatattactcattttaaatagaaagtcttccttttagcttaattctctctttacattagcctcatccattcatttgcataacgagtctgtatagttctttctgtctactaggctctgtaccaagcatgattcaagtattttctttgattcttaaagatacttttaatgtgaaattgagttataaacaacctaaaagcacccccaagaccatgctgctgggaagtaacagctggctggcttcagaaccatcgcatttatgttgcatacttgcttgtgtcacatccttgctttggttttcctattcactgtcttgtttcttctcagggagattgaagaagtcttgtgcaagctcgctctgctttgccttttgcggagctccaggcctgccagaggtagcatgtttttgtcaccagggtgtgctgtgattccaccaatcagaacttactgcaggtgctgtgaagctggctggaatctctccatgtctctgctgctgcttagggatcacaggtttttcagcttagagctttcttatcacctgggcaactgcggaggaccccccaagtcattttcttcctgttctaccacccgtccatgctcattggcatcctcctgtgaagaagggaactggtgtatcttgctggcaaatggctgtagcatgcctcaatgtttccaaagagctctgtcgt

SEQ ID NO: 27228 - DNA, 1101 bp, Mus musculus
gagtccttccctgacttccctggatgatgaactacaagctgtaagataaaacataacctttccttcccaagttgatttggatcatggtgtttaatcacagcaatagaaccctaactaaggcaggtgatgagctcgtctctgccacatgttcctaccaccatgatataatgcctaagcctgttgggtcaagtgaccatggaccaaaccctctaaagatataaaccaaagcaaatctctcctgcctcaagttgtttctttcaagtatctggtcacagcaacaagaaagatagctaatacatactttatcttatattggatttatattggccacacaattgtttgctaagctactttgttacttaatgccatattgagtttaacattctgggttaatatgtattttattcctatatcatagattctaatgatttataatatttcattgtgtctttacatttattcttagtattatatatttatgtggttttctctctgtgcccttcagcctttgcctctcttctccattctcttttctccctctctccttccctcccctctttctatttctggctctggttctctctctttttctttctctccctctcccccatccctccctccctcctctccctctgcccctccctccccctctccctgtccatctccctttctctcccctactccctcccccttttcctttcttggcttggcttggcttgtctctcttttagttggcagttacaaaggatgcagctgaatgcgtattactgtggcagttctggtagaaacaatagaggcatgtgactgaagcctgcctgtgctgccatatcctttcctgggactttgagttctcactgaaatactgcagaaagactttagcttagtttctcatcgctttcaatcgctgttcttggcattcttctcccttttcctataatcctacaagatcctgcaaatccttccattgagtttccatattgcccaaggcagccgttgcccattcctgtttactatcaaaaaatctctagcaaatgcaatcagggaacatgtgtaggtgatagaatactaatctgacttttcaacactttaaactaattaaag

SEQ ID NO: 27229 - DNA, 1071 bp, Mus musculus
ctcgttggcatctttctggttcttcctttgttaggtaataatgatggtttgaacctggaaacttgagtgttgcattacaggacataggtttcattgcggttctctgatgggaaattgtgataccctccctcttgcagcaggcacgttctcccattggattcctgcctaggtgaggaagaacctaaactgtgtaggctgtgtctgcagcaccggtgctggttcagtgtcaaagcctttaaattgctattgcatatagcagtgggtcttccagccctggctggcctggacctgagcagatctctgccccttagctcatctcttaggctgaacatgctcctgaggcctggggctatgtgtgcacatgtggtggtgaatcttggaattcctgctgtgtcccaaatactttagtttttcgttgatcctcctgtttctctcttccatggaaattggagttttcttgattctactctttcttctacattgtgtaactatacctgtatccagggcgaaggatttaaaggacacggggaaggaaaatacagccaggggagcctgctccaccgccctgggtccaatagctcagagacctgctgctgcttccacttgccaccagtgatctcctggcttcttatccagactaaagcagaggttttctcctggagttctcacttcataccagtaagcatgtttgagtttcctcttagtctgagccaagaataaaaaaatggccattgtcagtttggttgcactttgatatccaaacccactctaatctccatagcagtattaaatgccacaaagcactgctgatgttaatgataagcttgtattgaaaacactcttttagtggttttttcttttttctttgtttctttctttgtttctttgtttctctctctctctctctctctctctctctctctctctctctctctctctctctctttctttcgttttcttttcttcttttcttttctctctctttttttttttttgaattgaaatcagccaagattctaaaatgattgactcctagttgacagatcttagtaccgtccctggtgccttagt

SEQ ID NO: 27230 - DNA, 1195 bp, Mus musculus
cagggaataagcaggttgcttttacacagactcccacactggtagtttccttgaaacgtgtactaattgcataacagtaccttgaagtttttgtttttttgttttttgtttttattaaggggaattattgtgtatcttatgcccagttggtgtttgctctgctgaatgtagtagctgggccatatgtgaacccacatgaatatgggatcagaatgcaaacagtttaattttgaattgtactggtggctcactggcattcatggctgggatggggaacatattaatggtggggcctttactcctcccaagcttcttaagtaaccgagaatataataaaatgcaaacaggatcttttcccggcttaaggttttctgagtttaaattccgtggagaagcatgctacttatgttttatgccagagtgaatcagctgagctgcttgtctctgcaagattatagcggtctataaaagagttttccctgcttctctgcaattccttgcatgaactgcagagagggtgaatttggagtaggccaataactgggctattgcttggcaggcttgcaatatggtaggtttgcaaaatgagtttcctgtggttctctgggtcttcttggccagggcactgggtcctctgctttttggaaagcctactccaaaacctgggaagttgcttctacttttcctatgattacatgactatgactataaccacaaccacaaccacaaccccaaccaccacaaccactactgctactacccccaccaccaccacttcctcctcctcctccacctttggtggtatcttccctgttcttggcataagaactaatgtatgggatatgatattatttatggtctttgagacattacttgtagccatggaatataggcttccttatcaaaagttgttttaagccattccatgaagagttgttttaagccattccatgattcaaaactctagccagagacattgaaacatctaggatttgtaatgtgccagatcagaaagcgcacctaggggttttgagtaacttatatgtatggctcaaaacaccattcgatcgatgggcacagtgttgtcattatataaaaggagaaacaaggaactatgtttaaaagatcttgatgaccaggctcatatcaagtatcatttattcctgcaagttgaaaggtatgcaaatcaatcttg

SEQ ID NO: 27231 - DNA, 1151 bp, Mus musculus
gtaatgggaagattaaagtttaactacatatgggcttgttttaaattagaagaattacttcctggtactcattatgtcttctagaagcagttggaataaaggaaattgaaattagagaaatgagatgtcatgttttcaaatgtctcactacaaaataatcacaataaatgtctataaaagcccctttccacaggagggaagtgtatcttctgtttgcacatggcaaacaacatttctgtgtgtgtactgggtgtgtcagcttcctcataatgtgcaaagattaccagcccgctataaaattcctaggcgtatttgctcagttctactgggtacagcttggcacatcgcaggtagatttggctcgtcttttctttaaccaaggaatgcatttgcagcatagttttatggccctctggaaagttgggatgtcgttttgccttgagctagagttaaggaatatgccataatctaacctttcacttaacatagatgggactctgctccaacaaactgagctaactgacctggactgcattacaagtgtactctactacttggtaattaggaaaaaaatacttttaacaattcagctaaataggttggacatactttgtttttttgaaacagggtttctctgtgtagccctggccatcttggaacttgctctgtagaccacactgccttcaaactcagccctacctgcctctgcctcccaaatgctgggattaaaggcatgggccaccacgttgtttgtagccggtttaccatgaaaaaggagattgtagagcagccattcttgagtctgcttttgggtggtaaaacccttttgaggggtggtagtttgcatatcagatagttagttactttgcagtttgtaacagtagcaaaattacagttttgaagtagcagccaaaataatgttatggtggtggaatgtcataacctgaggaaatgtgttaaaggaaggattaggaaggctgagaacctctgcctgaagggatcaatactgcctgcaaatcacttttcatctttaaaattagtaattttgaagtgttaagtagtaaagtatatcggataatgatcccttttatcaaaaacaaaaacaaacaaacaaaaaaaacaatgacagttttgggtgttatcaccgtagc

SEQ ID NO: 27232 - DNA, 1854 bp, Mus musculus
acggaatgtccacttgtgtttctggttgctttcaggcagcattacatttgttgacggggtcagtattttgttgcatgtgcttatccatgatttcttcccgcaatcggattctgttctggaaaactgtaaattagttttggtaccttagagaaaggaatacgctgctgcataatcctaaacagaatttgttcttctctctaggtataaagcatgagtatcaagcaaatgggccagaagacctcaatcggacctgtattgctgaaaagctaggtggctccttaattgtagcctttgaaggatcccctgtgtagaccgccagtcagtgccacgagttgaaagcttccatactgaacactatcctttcactatataagtaaagcaaatatattaggccaggatctcactgaggaatttgtcttgtcatcttttagagtaaactaaaaattgtatagtgtctgcaaacactaccctacctaaatccagcctctaaggtctcactggtgtggaattaaactcttattggccaaatgcctgttttcatgaggtgacttgtaaagattttgttaagctcaggatttttaataacacagttcacaaaacagtacaaggcagtatgacgagaactcatctttgctaacctcagcagttactttgtttcttttgtttagaaaagtgattgcaatccgtgtattttgaccaaagttctctatttttccttgactaaaacaagataatgagacataattttctttataatgtgtacaacacctaatatacactaacagcagtaagactaagccaggcagtcttaaaaaattctatcagatgtgtcatgagactgtttcagactcatgtctgcttaaaattcacgctgaccttgcagagcaccagagcatggggctggcatgcaggaagtgccctgtatctgcagcaggaggctctgggctgggacatggcttagagtgactttctgtcttagaaatcatggtatatcctcaggagaatgttccgtgtctcgcaacaactaattatattgcaaattattagggcttcattgtaatctactttattaatgaaaaatgacaaagcagtgtactgataagccaaggtgcttttgatctgtaatttcttctctaaaactgctgcatctggtacagtagactgtggaaggtgttgattatgtttcctctggggcctggtaggatgctaatccctagagcagtttaccagctatgtgtgaaattgaagcaggtaccatggatgacacgggactgcccaacaacacttggaaatgattgttaacatcacaggcatggcaccgaacactgtagagatgcacagtcagttgaacttagtagcaacgctggctttgtgtaataaaggaagcatttgtaacttaccctttctttgtgtggttatttgtgtatgagttggacgtaaagaatctgccttctgtctcagtttgtttttctgttgctgtgataaagatcatgtccaaaagcaacttgaggaaagagttcatcttacaacttccagaatccatcactgagggaagtcagaacatgaactcaagagacatgaaggaatgctgcttactggcttgctcagtttgttttcttacatacttcaggaccacatgcccagaggtagcaccgcccacaattggactgagcccttctatgtcaatcatcgctaagaaaatgtctccaaagacttgctacagggcaatctaatgggggcatttttgcaactgagattcccttttctcagatgtatcaagttgacacaagatgaaacaagccagtctaccgtccttaggcagtaagccttccaggttttggcatttgctaggat

SEQ ID NO: 27233 - DNA, 1174 bp, Mus musculus
tccaggtgcttggtgttgcatttcttgcatttatgctgctcacagcccagttctacctgctttacacagccagagcttagacttggcagaagtcatgtggccagcagatggcagtacagggccgccacggcagtcctcctcagaccccttcccatcctccagacagttaactcttcaccctttttttcaggctgaagccaccaggtgtgtactcaaaacaagccttggtaacctttgttctttgacgctaactgtgtgtcagggtttgaatctctgaacaaaaccctaggtgctttgagcacctttgtgtaagagttcttcaaaacccaagcccccattttcttgccctcttcccacttcttctctgtccctctgtccctttctacctccaaacagaatgtaaatagatcccccagggaagcaagttcactgtgagctgctagctggcattcttctggaaatctccatttagtgactgctggctgtggcagtgctgggtcttcagttactgtccaggcttctgtggtcaagcccatgataaagccatggtctttctctgtgggctctaacgaaaatcttgactgctgctgaaactgtctcgttggtcttcagcccctctgcctgaaagcccaagcagggagcttgctttccatagttgtcttaataactgttgtgatgtgtgcatttttttcaggtataaaattgtttctgttgaagtttggagaaaagaaaaataagtataaagaggaaaatagtcatttagtctgtagggtaccatttaatacacatatattcccagtttggttatagagtattctttcctccatccaaggggaaagccgtaataaactctccacagcttctgtgcttgctgccagggcactggaaaccccacatgtgtctgtgaccatttagggctcagatgtagctgttcgtcattggcttgcatgctctgggaagggccacctgatctgggagtgaaggctctacttaccatgctgcccagagcctgtcttggctgtggatggaagagggcagggtgtgttctagttcctttgagagccttgtactttcctatagatttcttggtcacagtttataaatgtctggttggggagaggctgtggtgatgttagacagtccttacctttgttattcccaggatctttggttg

SEQ ID NO: 27234 - DNA, 1253 bp, Mus musculus
cgtggtcgaggccgcggggctcgtggaggtaaagctgaagacaaggagtggatccccgtcaccaagctgggccgcctggttaaggacatgaagatcaagtccttggaggagatctacctgttttccctgcctattaaggagtctgagatcattgacttcttcctgggtgcgtccctaaaggatgaggttctgaaaatcatgccagtgcagaagcagactcgggctggccagcggaccaggttcaaggctttcgtcgctattggggactacaatggtcacattggtcttggtgttaagtgctccaaggaggttgccactgccatccgaggggccatcatcttggccaagctttctatcgtccctgtgcagagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgccaaggccacctttgatgccatctccaagacttacagctacctgacccccgacctctggaaagagactgtcttcaccaagtctccttatcaggagttcacggatcatcttgtgaaaacccacaccagagtctctgttcagaggacccaggctccagctgtggttaccacataagggtttttatacaagaaaaataaaagaattaagtctgctatatatatatatatataaagaggccctgactctgggcttaccttcttcagcacctgccactttcccaagctcttcctgtctcctcctctccccactttcagccaccaactgagtgtgtatcagattcttggagtcactgtaagaagtgaccagttttcaacaatcaaaatgtattcttagacttcagggaccatgagtcccagagcaagaggttccagggtcatgctgtccccagaggctcccgagagagtcttctggtttcttcctgcttctggtaactccaggaggctctcagcttgggcttgagtcagtctaacaataagaaattgggctttccccctctctgacctgttctctgcccatatgcaaggtgattttaagtctttaacttaattattctactttttcagataaggtcacattcactggggacttaggataaggatgtgtgttttgaatta

SEQ ID NO: 27235 - DNA, 1811 bp, Mus musculus
gcaacctggacaggcggccttcatcaagtctgcctcagttttcaacattacagaacaaagtgtttagggcaatttgggattggggtgctgtagaaggagaggccaccggatttttagcctggagccctctgactagcaggatgtgggtggtgctagggagttgtaacttagaggttcatggaggagagtgtcagcttggtttggtcacttttcagattcagagttcatgagaaagctgtatctgggtttatttcattaatttcttccccctccccctttcttttagaacaacgtctccctgttgcagagctgcatcgacttattcaagaacaactgacctgtctactctgaaggacaccaatgtgaaagccagcatcacttgcacttaaatcattactgcaaaagaaatagctttgactagtttaaaatcatgtgaataaatattttgatttctaaaaatcttaacacttaaccatgttggtttaaaaatattttcattgcatgttacttggacataactaatccttttcttatgcatttaatacctcaaagtaggtagaatctaacagattctcctatagactgtcaggaattactaagaaatggtatggagatgtgtgccttctggaaatgagaagcaatagcctggcccatgtctgtctgaacatttcctgtgtctgctcctacagacatgtcaggtgtgaattacagcaaacagtgactgcttgtgggcaggtggcagacactcttctttatttaggtagattttgctccctcttgtcaagatcacttcagatgcttgtacggtaacaagcaagaagatctcatatgtctttttacatcctttacagctccatttttgtaactgggatataaatacttgagagaaaggagaatctagagttctgacactccctgatggtggggcatgtgtgtttgtgctttggatgtttttataaagtatataataaagataatccatgttaccatatggagtgcttttgtagaaaactagacctcaagaatgctggcagctccacaggtggaaagggttcattagctgccctcttgtaacctttactaacatcttagggattgagccagggctttgtgcaaaccattgacagtgcttagccctcagtactcctttgaaacaggatttggctctgaacccaggactccactgactcagctttacagcctctggagttctgcagttatggtataccaacatatctggctcagtcccaggtttgaagactgagtcttggctctgtttgctgtatatgaatacttgggggggggtgggtcctatctaaactggtttgtttgtattgattccatagcacaaattgatggaagtctggatttatttaagaaaagatttcacaacaaagtctggtttctgactgttttcttacctgtcactcctagactgctcacaatggcacacacaactttccatttcagtggtagtgggtacctggactctagccacatgattatgtgatcataccttggccttgttcctctgtcaagattggttgttgcatgtaagggtcttagatctacctcctgtctggaatgcagccagctgaagcttattagttggttgaacccttgcacagttgtaggtagacttgtttatgcagtgttccttggttggtcccagcaggcacagactgaatggaaaccataagtatacctatactatcgaggctgccattgggtgggttctcacaggatgtcaacataattcagctggcttcagagtaaggcttcctgagtgcttgggatcccagacattaact

SEQ ID NO: 27236 - DNA, 1320 bp, Mus musculus
aagtattcaaaggtagtgtgattacaatcttgtgattatctcaggtttttgagaagacagttttcattctttgggatcagaaggaaacttcaggacagttgtaagcttaagtaatatctagcttggaaacattttctttttggtctgattttcctaaaatgactttttgttgccaacacattaccacttcttggtttttgtttgttttcatttttaagtttgtgttgacacttgggagtttgtcttctcccatgtgggtcctggggatctaatcaggcttggccacaagtgccttcttgctggcccaaacacctatttgcttttttaaaaaagattgtgtatgagtgctcttatctgcatgtacatcttcatgcaggaagagggcatcaaaactcactctagagggactctggaggagaaacccccccccccccttaagctattgaaggtctaaaagggagaaatggagtattttgcaattatttgaaaatagtccagataactaaaaatttcttgattcagcatagtacctgggcttgcagccgtgtgaaatgatgattctgtttatccattcgctgagtacgctgctctgaccttcttcccagtctcggttcctgttctgggagcttggggctgagtagccaccagccctgctctctgcagtgttctattgtggattgcttgtgtgctggcaggctactactggtaagaatggctagtgtcagcagggatggctcctctctgggttccatctcaccaagatgagtggtgcaaatctgatcacttcctgcagcccttctagttccttgttcatgttattttttacatttatttattatgagtttacacctcccacttgttgagccatttaaagggagagttggtatagtgcttgtgggtgggtacctcagttgcttgttaggttttagtaacacagaagttgcccaagaatacatacagatgagtttggaataggagtaaacaatagaactgataatttgatttaattctaacatttgaatttatttaaagggcaaaggttatggtagtagaatttctcataggactattcctaagtatatgtgtttcataactatcatgtaggtctttcacatcttagtacttcctttggagaaaaaaaatctgacttatgaggtgtctgcttctttttaagaagattatgccggcagtgatagtgcacgcctttaatcctggcacttgggaggcagaggtaggcggatttctgagtttgaggccagcctggtctacaaagtgagttccaggacaaccagggctacacagagaaaccctgtctcgaaa

SEQ ID NO: 27237 - DNA, 1242 bp, Mus musculus
aggcgtgcgccaccacacccggctcttgtgtgattttcaatttgatggttttaatatagaaaatgtcttaaacctaacaccacttttttttttttttcagatacgaacagaacacacttttaaactttccagactagagaaaagttagaggggcgaagtctaaaaatgaaactgcctctgaccttctgcaggctgcttagcaggttaaacagattttctgtaaaagcaagccctcctgtgagtttctccactttctcttatttgtgtagccagaagaagaaaaactcttacgaagcagtagaccaagcgaagtactctcgtttagtacgctctgtcttgtccagaggcccggcccagactccagagtcgttgttcaaggaagatgatgtactgtatggaccagtgagtaagcataaggctgcagagccggagccacaggccagagtcccacaacactgctttcctatcttcaatgaagagagaaccgggaaaccacacacagatgcttcttcaagccctttgaagatccctttgcaaaggaactcgatacccagtgtgacccgcatccttcagcagaccatgccacctgaacagagcttctttttggagaggtggaaagagcggatggttctggagctgggagaagacgggtttgcagaatatacttcaagtaattatcttgcttctggttatgtgtggtcactggtttttaggagatagagcattcctgtcagaagaatggagcttaaaaaaaaatcttactgaggaagtactttcaaatagcatttcatgtctgctaatttgcttaatcttcgtagatactattaactgtagttcacacttaaagaaatggaaataacagagatcaaattatttgacaaacttgcataatttataaacaacctatcaattcttttccatctcttgacaaaagtctagggtttttttggttggttggttggtttttggtttttcgagacagggttctctgtttagccctggctgacctggaactcactctgtagaccaggctggcctcgaactcagaagtccgtctgcctctgtctcccaagtgctgagattacaggtatgtgccaccgctgccctgccaaaagtctagtttttaaatagtttttcttgctcagaatgtaatggttacccattgttctactagtcagtatcatttgactagccacaatccagaactcccaatccccgcttatagtttggtaaattgaactg

SEQ ID NO: 27238 - DNA, 2063 bp, Mus musculus
ttcaaaaagaatgtttttaaagataagctaggatgtggtagtgtatgctttaatcccagcactcaggaagcaaagttctctgtaagttcaaaagcagcctaacctacgtaattctaaaacagccagaactacataatgagagccatctcaaaaaaaattgcattattgagtttcacaggaaactgaatatagctgggcatagttgtacttaccagcacatgagactgaagaaagagaatctcatgttcaaggccagcctataacacaaacaagaccctgcctacaaattcaaaaaaagggtgaaattttgtatctaagggttttccatttaaagataatttttgtataatttaaattatttctattatatgatttatatagcatttcattttaaatcctgctttggtttggttttggttagctctgtttttatttttttctccatttctttttagatgtgtttttacaaggcaaacagttccataaagccttggaaagcatactgtcaccccaggagaacctaacagggggagaagagcacccccagtgtggctacatcgaaagcatccagcatattctgacagaaatcagtggtgtgcaagctctggagagtgccgtccagcatgaggccttgaagtatgtagggctgctggactgtgtggctgagtaccggtaagtaaccaggtacatacccgtgcctccttcagtcactgtgggtgaatgggtgggccaggattgtctatggggctgctgtctcttaactcctacttcaagatgtgcttaaggaattgtggccttagccgggcatggtggcgcatgcctttaatcccagaactcgggaggcagaggcaagcagatttctgagttagaggccagcctggtctacagagtgagttccaggacagccagggttatacagagaaaccctgtctcggaaaaaaaaaaaaacaaaaacaaaaaaaggaattgtggcctccatctttttaaggtaaaaaggggagagcagggcaggaggtaggagaggcatgaggcataccgaggaaagccacctcctctgtgccaataggaaaatcaaactggtcaggggtatggcttatcctccagcctgtcccaggccccaatgtggctcctgaacgctcttctctatttcctctttaaccactgttgtgttcttctggctttcttctccccctcccccatgctttttttcctgttttcccaaagattgtacagtgatctgttggccctgaacatcaactctcttcctggcttccaggcagtggctgatatgataaggactctgaaccagctaaaacttcctatcgcttctaagttgctgctgttactgtttttcctagtcattgcagattccaagagttgctgtcatctgcagatactccattccaaatacaccatgagagcaataccaggatacgagggaaagagtgtggaatctgggtgacggttgaacctctgcctacgtagtaaggttttagagacaacagtcgcactgtgtagctctggctgtcctggaactcactacatagaccagtctagcctagaatttccagagatccacctgcctctgcctcccaagtgctgggactaaaggcgtgcgcccacatgcccagcttctgaacttaacttttatggatgcccatggatctgacgtcatttctgaccctgactttgtttacttagcatactcttttattaatccatgttgttccaagtaacagaactgccctctttgtttctaattatttatttatttattagttggttttttttttttttttttaatggggtctcactacgtagcctggactagcctagaactcaacatgtgtatcaggctaacctcaaagttatggagatatgctagcttctgcctcttcgagtgtctgggttaaaggcttgcaccaccaaacctggccccacattctgatcttctaaatatgtatagttagtaggtatagtatcacaccagaatggatcgagtgaggaagtatctgtctatataggaacttttaggcaagggtccaggttttcttacttctatg

SEQ ID NO: 27239 - DNA, 1215 bp, Mus musculus
ttaacacaagctgaaggtgtggtgggttgggatgtacccaccgagaagccagagagtctggaggtcagcgcctgactcaccagctgcacgacctctggctgtttctcacctgagaggaggacactgggattggcagctgcccagggacttctgggctcccttgcaaacctctgtgtccctggcaggatgcccagtctttgaattgagatcagaaggccaaatgaagcatcatgtgccacacatgtccctagagttctcagggatgggaggggccctgcaccctcagggtatacagagagagagagagtgagcaagcaagcacgtaggcatcgccaccacagtttcctagaaggtgttttatacactctgtgtcattaggaaaaacttatttcagcctaaggaagcctggctgcctagagagctggggcaggcaatacatcattggctaggtccttttccttaccagagaagccccagcagcaggaagcctgagtgtggaagtcaccgtcgctagggtttgggtatctatttctggtgtcagcaggccatggactacaaaaaatactgttgtggaacttgttaacaaagaggaacaatggtaaaactttttttctgtgtttgataagtaacaacaaaaaaaaaatcattggctgttcttgggagacggttttctgttttataaagtaaatctagtagcattaaaattataagttacacaatcacatttagttttcattagtcttaaaaaaaaataaaagatatttaactgattcctagtctttcagtggaccagagttctgttcccagtacccatgtctggcagctcacattgtctatgaggtcagttccgggggacccagcacctcttctggccttttgaggactcgtgcacagacatacatccacatgaatagtgagcttttttttctgacttctctcatctttatttattttctcacatgttacaccctaaccagtttcccatccctcctctcctcccagttcctcccccagcctctcacctcttctctccccctggttcactcctccccagttccccttcagaaaagggcaggcctcccggggatatcaacctaacatgttatatcaagttgcaataagactaggcacctccctcatatgaagcaagccagtaggaggaaaggggtcccaaaagcaggcaaaagagtcagagacagcccctgctcccactgt

SEQ ID NO: 27240 - DNA, 1808 bp, Mus musculus
ataatggatactgacttgctgctatgaaaacatttatttatgaagacagaacacaaagcagattgagtttaataaagtttaattgggaagtctcttcttcagtaagtaaaataccttgaaggtctggaaggcaaggaaaagaagccagcaagcctatgttgaccaagtactgagataaaggctggaacgagaagatgttcactagagttgcttcattgaaaactcatcggggttattaccaccatttgtttggttgtttttgggttttgttgagaagaaattacaagtggtgcagacaggaacagctgatggcatgtgtgccatcttggggcctgggtagtcaagtgggcattcctttttcatgccatctgttgctcttcaccccaggactctttcaggggagtgtgcctccataccgacctcactcccaaatgctgttgtacaggacgtgtttccacatcactgttattccatgctaaaagaaatagtctcactgttccttttttgttaaggctatcacttttctctgtatgccttaattgtattatttcctgggtttttttccagattctcattccatgcctgtagtgtgactctctctaccactagtgccaaattcaaattttacagtctaaattccaggacagccagagctatatagggagagacccagtctcacacatacaaataaaaatagaacattgcccttcattcagtctctgagggttggtaaccagtatttagctggtgcccttttctcttattcttcaaaacactggtatgacatgtctgagcagaaagccatcactgtgtactttctcagtcctggctgttcggccctggaaaacattaattggcgtgctgttgtacagaaggtagcctctgaaggatctcagctcgtggattgtctctttctaaagatttatttatctgtaagtacactgtagttgtcttcagacactccagaagagggcgtctgatttcattacagatggttgcaagccaccatgtggttgctgggatttgaacttgggaccttcagaagagcagtcagtgctcttaatccctgagccacctcaccagcactcccctcccctttttgttttgagacagggtttctctatgtagctctgactgtcctagaactctgtagaccaaactcagggatctgcctgcctctactgcccaaggactatgattaaagatgcgatacccgcacctggctcttttttccatttttatctctcttacatatttaattttctagtaaggtaagactagtgcttatttgataggtcaggcagatcggacattgttaccatgccgcacctcacaagaggtggagggaaaaaaaaccctgtgttttatatataatctaacacttaaaatagctggtgtcattgaatgcttactcttatagagctggccatagacttcatctgataaaagtgaactagtgagtttgattttactcaggtaactaatgatgctattcacttagagcactgtcagaaggtggtagaactcagctccacagaggatcccagtgcaaaccctttaagttggtccatgcttttggcttatataaaaaacttagtacgatcaaacaaccttagacacgaagtaagctgagtatagtggaaagcctttaatcccagtacccaggaggcagaggcaggcagatctaggacagccagagctacataaagaaaccctatcttgaggaaccaaataacaataaaagagagaagttatcttctagccagcctggtctacagagtgagttccaggacagccagggctacaca

SEQ ID NO: 27241 - DNA, 1330 bp, Mus musculus
cactttcagttcccacagaacttaaatcttcctgaaaagctactaactatagcagtaggtttcctgtttgataagggacacagagtttgtttacctatcctgttgatgcagagagagagaagaatccaggacttgacggtcatggtggtgtgtccctgtaattacttcagagaaagcaggggatcaggaagggaaggctagcttgaccctgtctaagaaaagaaagaacaagacagcccaggtctcctgagtctcattccaaattttaactcaataggtttagcaagatgcaatctacttctgaggccccagtacttataaacgtgaggaaggtggatcttgaatttgaggcctgtgtaggcctagtaaagtaaaaccctatctcagaataaaacaaaacaaaaccaaaaaacaggttttcattcaacttatatgagtgacagtttttcctttttgaaataaaatttttctcttactggagaaagaaaacatgattcgaggccccgaatgttattagaactcaaaactctagctggtctttcaggctggctcaagagagtaatctcacacttgggtcttgatcaccgacatccctgaccccactacatccccaggtctttctgacaagttgagagagactgacatctatggatgttcagtaaggagctgtatgggcagatatctgcatagcctgtcacctgggtatcagctatatatgactggcaggattaggtcatggggaagtactaaaatatagacacataagcactcatgtccttttttaactgggggaatatgtatgtatgtatatacaatccctacatgaattatggtagctggcaacagcattgtaattcaaagatttgcaaatgctgcaagataaagaccaggtcatccatttgtgagttggaggtaaacatttttagattctctatgaatccaagaaaagcctaagacaaccaaaatgaacataatagtaaaggtggaagacaagggagcaacctgtactgtgttattaagttctaagtgtcctcaaaagaacctttttctagaagaccagatttcaattcccagaaacgacatggtggctctgtaatgggatctgacgccctcttctgctaagtctgaagacaccgtgtactcacatacataaaataaactatgccaggttaattctatagagttcagcctcttgtagagagtattcaagcaacactgccgagtcttctcatattcactcacataaacaacccctttttaatactactttttatattgtatatattcaatgtataaaatggtttgatgattccatttccactggtttata

SEQ ID NO: 27242 - DNA, 1253 bp, Mus musculus
gttcaattcccagcaaccacatggtggcttacaaccatctgtaatggtatccaatgccctcttcttgtgtgtctgaagagagcaatgatgtattcacatacataaaataaataaataattgaaaaatgaagacaaaacctaaatctaaccagctaaccaatcaaagaactgtgttcagtaatttgatgtactatgttttttaaactcaaacactagggttattgtaggagacactttggtgaaaagatatttgggtttacatatcataagttgctaggttgttttgcacagtgaagtgaggcaatgtgatgctgtgtttttgtgtgaatttgaagtgatgcctttagttaattcttaatgtttctgggcctagtggtatgttttaaaagcaggttttgcagaccatcttattttctctttgttccttttagcaaattaccattgggcagaatcggatcctgaaaaatcaagatgctaaagcccctacactgctttaagaattcgggactcaaatatgaaaagaaaatcagaaataagaccctgggaacctgaatatccctgcagaaaaacaccaaaggaccattttattttgtgtattgctgtggtctgattggggtagtgggtgctgtgggatgggagagtgcttgtgggttcacacccatgccctccccatggagagggggccattggttttcttgctttctaccatgtcttggcttgcttttggaacaggctggcctagcatcatctgtcctcatctgtggtgtactgtgagtctgtgatccatctccagcacatgcctgctgtccaccatttccatcattgagtcacaagacagggctggtgttaggcaaccaataataacatattgtatgagactttgcatcttgtacattttctcttcttttctaaaaataaataataaaaccataaatctcaatgaactactttattattaaattctgctgtgtctgtttaatgatgttttctgtagaaatgtgttgtgtcttaatccactggatgtattatacttcatttcagataaggccttgcaagtggctcccataggcctctggttgcaaagtcagaggctgtgttaatttatgactgatagcattctatttggaaaagtggtggcagggaaggaaatgcagatgggccaggaatctttcttcagaacggccagagcatcctaattgagaatagatgcagctgcgcataagcacttgtcctgcattggctctgttgtggat

SEQ ID NO: 27243 - DNA, 1200 bp, Mus musculus
aactacggactgacaccacgggaaagatggatagagtgacatctctgtatctccgatatggagtacggtcacttgtcttcaaagtgtgtgaagagtgacatttgtatgtagtcagtaaagggagcatcactaaggtcaagagcaagaataagcttccctgtcagacagggtagggtacccagatggggtgaagaaatggcagaaaggctagagtcatcagctaagttcatccagtgtgtgtgtgtgtgtgtgtgtgtgtgtgtgtgtgtgttggagtgaggcacatgtgcacacagcgatctatgcaggcatgtgtttgcatgttcttggatgtgtgaccagggagcacacatgggatttttctccccagccactatgagttgaacccaggcccttgagtattaggccagggttgtactgctgagtttcagcatcagcctgtctttatttttatttgaggttgggttacactaagttgcctgggctggctttaaattaatcatcctggctgagcctctcagtgctgggacctttgctcccagaatgtgtagctctcggtacaatttttaaactgttttctggctcaaccttttaaaagttgtgtgtgtgtgtgtgtgtgtgtgtgtgtgtgtggtgtcgtatgtgcagtgtgtgcatgtgatgtgtatatgtggtgtgtgtgagtgtgtgtaatgtatgggggtttggtgtgtgtggtgtggtgtgtgtatgtgtgtagtatgtgtagtagtgtgtgtatggtggtatggtatgtatgtagtgtgtgtgatatgtgtgggtagtacatgtgtgtggtgtgtgtgtgtaggctacttcctttgggacagaatcttttaccaccctgaagttcaccacttcagtagatcggccagccagggagcctcagaccctcccgtctgtcttccccacactgggattgtcagtaccagcgacagctcttggcatttttatgtgtctcctgtagatcactctcaggcccttgcatcttcaaggtgctgcgttactagcgatagaacctccagccctaacctgcagagttcaagagtctctatgccacctagctgttcccggagcacacagcgagcaggaggaagcacaggagttaggaggacacacggtgagtcactggagcacaaggagttgaggaactcacccagggtgaaactccaggttaaataa

SEQ ID NO: 27244 - DNA, 1170 bp, Mus musculus
tatacttttttttttttacaaagagcctttgtgtttttatatatttcatagaaaattttatagcagttgcaggtaaactgtcaggattggtttttaaaatatttttgtaacttttaaaatattctataagtatgcatgtgatttaacatttaatatttgaagataaatctcttgctggatttgagagtactgcattttagacgcctcatagataatctctcttctataactggatattttcggcaaatttgtggggagagacttctggttgtcttaaagaaatccctgacgctggccacaggctgcctttgaaaaatcgggtgtactgttgttacattgttgttacattgttcacttttagcggtgtattgttacattgttcacttttagtgctggtgtctgtttatgtttttaagcaatcgaggctgagaattagaagagaaatgaatgtagagagaggtagagagagaaacacagactctaagggggggactgaggaatgtagtctgcaggttcaggctcttcgcaagacgttggaaaaggagtcagtactgtaaaatatgtgctgcggtgagctttgacaaagatctgttccatatgctatctgctttggggaaaagtaaatcaaggataacgatccctctgacccattttgtaagccgacactaaggacatccatttatttggaggcagaaaccaagtcatgtataatacgagtttagttgagttcaatgagatgttgatggggagagaatgcactaaaaccaaaaccaaaccaaaaacaaaacaaaacaaaaaacaaaccttctgtatttggttggggcatggtagagctaacattcacacactagcatgctgggttccatcctcagtgtgacaaataatgagcaaaacaagcagaaaacatggatgtatggtgaagttagacttatgttgtataagatgagtttatggacacacgtattccagaagggtcatacatcagtgtaatacagatcattgcaaaacaaaagcagaaagccatgttactatcctgtgtaaggatgttcaggcatctgatctggaggacctcgtaccctgtacaaggcttttgttgtcccagaaccctcccttggcacatgctgggttgtgcttccttttgtaaatgattttcaatggaattttgcacat

SEQ ID NO: 27245 - DNA, 1099 bp, Mus musculus
tcttgggttggtaataactctggttagagacctaagagctggagagtagggattctggcaaccatctttgattgcattcagcagctcttgttatttagggtagaaaattgaaatgatcaagtttggtgtttccttttgtcagttagaaaagcaaatattgtgttttcataataaatgtcttttagcaaaattgctaagggtcactcatctggtgagaccctccagagagccacttgtcacattagtattagtaggtcagccatctgtgataaaagtgtccctaattaccacaaagtgtggtaagactctctgggctcctgcagggcctggccagaacccacccttctctacatgctgacctcccaatgtctataaagagggaaactgatgtttatagtcttgttgattagactttcatgctgtaaaaattaaaaaaataaaaataaaaaagtaaccccacaaaacttggatgttttaaaaatagccagaccttcagcagactgaagaaaagaaatgtagcctggtgagtgactcccagagtcctcagcagccacactggcagatcttgagagccccaggaatgaaccctgactctgccaaatgctgtttagtaggacccttagccttataaggagatcacacagctccagagagccatgcaaaccctgtcttcctgactgtcctcaggtgtcccttccttttctccactgacctgtggtggaggtttgatgaactcactaaaccttcctgtgtgtcttacatgtagctgtatcactccatacttcctgaaggggatgtcacatctaagggaaactcacccagagacacccatacttgtatttgcacccagttctatgtatatgacgtactcggtaagcaaacatttccttagtttcaggtctacaatatttagtatgtgtaaatagggagacatttgatcgagatgataaattaagttatagcatgtcatttgattgttctgaggtctcttgttatttaacttcccagagctgcataactaagttgttctgaggggcgtgtggttgggtgaacctccaaacctgctcccccttgtcaggagtgtacatgtgcactaggg

SEQ ID NO: 27246 - DNA, 1948 bp, Mus musculus
tatgggcaatggagacgcctgaagtctctaggcagaatacagtagcaaaaggtttggggcccacagggaaggggcaaagggcacttgtctgtatcgccgaatcattttcctttcatttatactcccaagcttgattcccaaaagggctgacaaaataactgtgtaattgttggaggaatttcctccatactgattttgctaatcctcatgttaggatttatagtttactcaaaatttcatcattatggaagctggctgtccccagagtcttttcccacaggaagtttcaccttcaccattgaaccttttccacctggagctgaggccccactgacttaagattctcctgacaactagagttctttcaggtgatgttccgacacagagcgagcagagggcagggggcagggggagtgaccatgcatgaaaatatgggagtatccacatgagagcactaagcagatggctagcacccttgcccaacactgcctagcccagcaccacacacatcaatacacaagattagtgcctgctccagctccagggctgacccaacacccccactgtgtccagtactcctgaaagctcatctgcagtcctcttcctgactgctgttcagagtccaagacaggcctcagaaacagtacttgtcacatgagttttagggtacagattccaggcaatagatttgatccttacacacacacacacacatatcaaattttatatattggctctaagaaaggcatgttgtgccttttagggatgggaaggaaggaaggagttaaatgtgccccttactggacatgaccatcttggaccttagaatctggcaactaagcattcccagggaagacttctgtgtggtcactcacacacccatgcttctgtcctggccctggtgctgtctccgagctccagttttgcttcctttcctgctctacttcagagcaaaacagaagatgcagcagagaccttcccttgctgcctggtcctgctacatgacgccattcccagggcacatatctagatgagcccttcactcaaagctggaaagcagccatagaggatagactcaaggggctcaggcatgggagagtgtcctggctgtggccacctctctaccttcctctgccttctgatctcacacctagcctgctttcacttctctcagcctgcttacccacctcatcagtgtccattcccagagaagccagccttttatatctactacagagctgatttggctgctactaatcttggaagaaaaaagaatggagccagaagccatattcagtcttgtatagtgagtgagaattctgagagtgagatgttctaggagcaccttcccactgcagggagaccccgtcctcctgctgtgaagggaatacagcagcctctcatgccaggcccacagacagaagcaccacggtcagagagagcagggcattgcaaagcagaaaaggggccctgtgtgctgtcttcttagggtccaggatgttcacttattggaggttgatggtgatagaagggaaatcggctgtcatgacatttcccattgtgtcagtgaaaccttgattcttatctgtgtgtctgtgtgtctgtctgtctgtctgtctgtctgtctctctctctctctctgtgtgtgtgtgtgtgtgtgtgtgtgtgtgtgtgtgtgtgtgtgtgtgtgtgtgtgtgtgtgtgtgtgtggccaatattgctcagacttctattattgatttgttacttacctggctcctgcagaaagcgcttcccaagtcctgggcactaaaggcccccgcagcacaggtcataaagtaccttctgcaggaacacttatcttcaggccccataaacccctgtggtgaaattcctgccattttggaagtctttcattttcttctttttcagtcgtaacagaacccagggccacaacccaggtcccaga

SEQ ID NO: 27247 - DNA, 1196 bp, Mus musculus
caaatctcacagagtttacaatctccatggtagagatgaaactctaataaagaggaaaggaggagaaatgaaaaaaaaaaatccaaaggacatccatgaacactatggtagaaatggatccagcaaaagaaagccaagcttctcttaaaagtagaaaggaaggaagataaataatgtaggatcttggaagcagaggatgggtgattcaagaaaatgaagacgatatgtaggagagtggagtgaaggaagtttgtgtaccaggcactctaccatggcacaggcatgtggaaagaataatgccacgtctgtgaatggcagcagaggtaatgtggaggcactggatcatttaccatttacaaggccttgcagaaagttctcatggaggaacctggtgggacaatactgtgctctttgacttgaaagccctcaacttgctctgaaaaagtttgtctgtctggaagacagcctgtgtattcatccccagtcttctgctgcaagtgcattctcttatctctgcctttactcctgctgagtttgagcataggctttttttctgttttgaatcctcaggttccattctttgggcccctgttcgatggagcgatcgtgagtgggaagctgctgccaagccttatctgtgccacatgcatcaatgccagcagagcggtgaagtgcctcatcccactctatcagagcttgtatctttttgctgtaaatgtgtaacttattaaccctccccagggtgagattcctggcaagctttcaggagaggtaagtgggcttcaggcccaggctgcagtactgtttgttgatttctatgaaatacagtgatattgtgctgcatcgaatatagagtttgttttcctagttggttcactagtctgtgtctgaaaggctgcaactgccgtgatgttcaagctcatggcttctcgggatttttcccaggttcagtctcttctatctagagtcacatttcactgtgtggaaagagggatgtgtagcaagttgttgaaatcttattcggagcgtcagaaagcagaagcaaaggaaatgactaataaatcagaaactgcacacagcacctgacaactgcagagggttcggaagtatggaggaaggagcagttatacctgactcaggagagggagtcgtttcacgtttataagtgttctctcaagcactaattggcaagtaca

SEQ ID NO: 27248 - DNA, 1176 bp, Mus musculus
taatgactaccactgtacatctccaagcaggaaatcctgaggccattagaacataaatgtcatgtttgaacaggcagattctgaataaggccttcaagggttcctggaaagacagtgttgctcctaagaatgtatggacttgagcattgcagtgagcatgccacatttacagtattagttaggacttcagacacagggaacactattctgctacagattgaatggcagcattgggtttttatcttgagtaatatttagaattttgagaatgtttctactttcctttagatatataattctaaagtataaattccagtggtcaggaccttgtaaacggcacaagcaatatcactggcttagaggaatggacaatggcttgctgaaaatggatagctgctctgatgagggttttttttttttttttttttttgcctgggctgaccaggcccgtgggaagaaagaaccctagtgggaatggtaactgtatcacccacctctctggcatgtagtccctggtcatagcagaactctgtgtcacggcaggaacacatgatccatagtatggaggtggagtgagtgggggcagggtatacatggctccagggatgtgttaggaatgcacactaggtcacttggactgctttctcttcagtacctagagcactggtggtggagaaggaggggctcatatctgcaggatctccacaagttgcttttcacaagtccaaagaatggtccctttttgaaacccctgtcaaagctgcttcttccatgggcttccatgtttccttctccccaaagaaaactcaccagacccatccacgtcctccaaacttttcgctggtttgtgagggtcgttccctcatcaggtctggccttcgtgggtgggccgtacagtttcttggacattgatgtgtgagtggtgcccacagtgcaagacagagctcacttaggtgaatagccaagtgagcacactgttttttttatctcatgagagggtaagactaggtttattttctctcctttctgaaaatgtttgtgaatcctaataatgtaaatgcaaacttctcttttcagataacgtggatgcaagcgatcttaagcagttctttgagaccaactattctcagatatatttcatcttctatgaaaattttataacactggaaaatagtt

SEQ ID NO: 27249 - DNA, 1128 bp, Mus musculus
taatgccaaatgactttgtccatgttcccattgcttgtttttcaccaatcacgaaggcagtgtatctgtaacctctgcaatgtaaaatgaactttgtgcactcgtacgatccctgtctctaggattcaggctgtctagacttgagaaaggtgagcccagggccaccacctgagctgaaatgctctgtgtgtgatacctgagaatgattgctttccaatgccagttctgagaaaagagattatctgtaggccccaaatatttttctataaatatttataatttggatttttattttgttgataagcactttattcctgggcaagcctgagtacttcttcaagttgtttataatactgatctttggtctccaaactgagcaaaataggtataactatagcaaattgtgtctgtgttttaaagttggatttcttttttctttttttttttaaagatttatttattattatatgtaagtacattgtagctgtcttcagatacaccagagtagggcatcagatcccattatggatggttgtgagccaccatgtggttgctggaatttgaactcaggacctctggaagtcagtgctcttaacggctaagccatccctccagcccctaaagttggttttcaaagtagcaattgattccatttaaaccttgaaaattttaaaaaataacaaagttactaaactactaaattaagaacaattaatatgtagacgtagtaaacagttacttatcaagttgtcttatccttgagattttaaaaattcaatttggaaactttgttttgttttaattagtatatgaagatatgtgtgcaattgtgtatatatctgctgtgtatttagatagtatggtataaggtcaaggcttaggattcagtaggaaaagcagatgcttaaatgatgaaatttttgcacagtgtttagagccatacagtggaatgggaaggagctatggaggtggtcaccattcagggaggaactccaccaagcctcctggaggtgttgggagtgcttacaaaggaaggtcagggctgagttgggatatgaataatagataaagggctttgcctggtggataaagagtggataaggacattggtggagaacagaactacaa

SEQ ID NO: 27250 - DNA, 1139 bp, Mus musculus
tacctcatgcaaaccatattttaaatcaaatatgattggtaagtatatgttgtacatgctcaaagaatactgcacatactatttaattatcatcaaaatagcccaggttgacctcgaacttctagtcctcctgccttacttagtttctcaagtctgagagtagggattataggtatacaccaccatgactagcttaacaccgttttaaaacaaataaagggataaattcttctaaattgttatatttgtttttttcatatcattgttcatttcttcagtatgttaataaaaatttctaatgtgtttcttcacattatcagcactgtgttaacatcttctcatagatgtggtgttaattttcatttttacagaaactgagacacattcagtagcttatccaaggtcagtcttccatgtttctcgttaccaagaaatgttttagtagaacagaactcatcagactatttcctctgaacataatataaagccacagcacatcaaaggaaatgaaagattagcctccacttctggggctctatctgtagttgcagcagctttccttctggtctgtacacatggaaggttggtctaggactaccatctgtatcctcttccttgctctgctgttttatcattttcttgttcttatcctatcctcaccaagaactgttattaccctgactttgtgaacccagaagtaagagacattttgtttgggtttttgtgggctgggtgggtagttttagatactttaacatcacccctgaaagaaaaagttaaagataagcatttatagaatcattaattcattgttatttagggaatggaactctttatttttggaggtaggatctcactatatggccacattggtctgtaacttgcactctttctgcctcagcctcccaagtactagtgaaggaaaccgttttattctcctaagcttctttagctaataagtggtcacagcttattgctcatttctatacccttgtcattctcaatagtcagaccttacaagacagagtaggaaccatttttactttaccaaaagattatagataatagatggtggtagtcttatgagagtcaggtttttctaatccttagtttagagcatttccagtgtactattttgg

SEQ ID NO: 27251 - DNA, 1335 bp, Mus musculus
gtaggggaagggaatgaatataatcacaatacatggaaattctccaagaactgatacaaatataaaaataaaccccactctacacacttacaagaagcatttcactgttcatttgtctgcattttagggagtttcctagatgtggttgttattaatgctgtggagttagtgttcaataattcaaactttgtttgggtcttcagctttgtttgaacacacacttttgaagactttacatgggatgtaccttaagaaagagtctgcttcttcatgaggaggtgctcttccacggagagtaaatgtctacgttaggtgttattaatccagaagataaattctttcttttgtttactttcagggatatcccagagaaggacggaaataccctttgccaccaccctcgggaagatacagttggaattaggcttttgtaaagctttccacattccttttaccagtctacatttttatgctatttgtggaaaggtttctttctcaagtagtagtttttaataaaactacagtactttgtgtatttcttttatctgtgtgtatatttttactgatctgatctcactgtttcatgctgctttccagagatgtgtatggcataatacagtgggtctgaatttattattgcttgtaaacacatttgacgaaattaggagtcctgggttttcattatggttaaaattcaaaacagctctatgctgattttaatgcacattaataattaggtatggacattgagctgcacattctgcagacgagcatatattgctcaacatttctttgaaaacatttcattaaagtacttgacttacagaaatttgtggactttagtaaaaaaataaaaataaagctaaactttaaaaatgttggtgtctggtgtctgattatctcagctgaaagtcttgacttacggtgcctgtgcaaacttatttacagtgccaacttagacagaagcagttcctacaattaaatgtcaagagccagtcagtgtcaaggtatgtcttaagaggatatgattagcacttcaagagcagcatttattagtattttactaataaatctttgaatatttacattttaacaaatttcatatttgtggtttagttttaagggcttctaaatctcttatttagggatcatttttaaaaattcaagttgaagttttttagctaaagaatcaatactcagcatattttaagtgatatttcacagtggccttcagtctggatcttctccctttcgtttgagcacactcactccctacgtgcatgtttagagttgacacagctattttcatttcattaccaaaacaaacttaggctg

SEQ ID NO: 27252 - DNA, 1178 bp, Mus musculus
gggtgtctatgtgctgggttcagtccagagccttattgaagccatgctgttgtctccctagttagcatcaaccagtgaagctccacgttgaagcttcacgagtctccacaagatatcatcccaacacacacagaagaagggagccagatctagcaaagacagatatctcttattaaccaagccttccacagctaagcgcgttgactccaccctctccacaacatccaatcagagctccctcaaccggatcttctaggatagtgcctaacccggaacctacactgtctttgccgccacacctgggcggagccaagttttctactggctcgcgtagctgcccgtcgcggggaggcgggagtcgacgggaaccgggatgctagcgcctgcgcacattgcagcttgcggcgcgcgggaagccactaccggcgcttaaccgttcctcgcctcctggacgtcggcttctcaggcggagcctctgggaggaagaggagaacaggagagaaactcttctggcccgggaccgcgaccggggcggaacccgggaccgagtcgccttggcggcgctgaccgagatcgagcaggtaagtgagcgctcctgcctggccgtctggcaacgccgcggcaccagggacctcttcccttttcttaggctcaataagacatggatgttgtcctttcctccacgtggtgtctctgcaacctggcatcaggcttttttatgtgcagaaccgtggcggtgagtttgccatacccggaggagagcagcagtttggggccgggggatgtaagaagcgactcccagctggaaatgaggcccggggcacggctgccgtttctgaggtccaactccaggaaactacagtatgaaccatgggagtggagcatctttctgactctcactctactatgtttcggtcgtactgctctctccttaagagagaaagatgaccgggttctgtgggtagctgaggaccagaaataggggtgatcatctttgggggcgtgaccaatgttagggcgaagcattgtggcctaaagaagtggggatgaggtggttggacagagaaatatggttaccttggagaacattgttaagccagcatccctagagctgttttcatatagaactgctttcaaaaaaatcctggaacttagtaagcatagctctgactcccttg

SEQ ID NO: 27253 - DNA, 2042 bp, Mus musculus
tgcttaccacttccatcagtgcccttggtgagctcaccccacaggcagtttccatgcctgcacaccttccctccttgaccaatatggagtgagaacttgaagttgtgtgccaagcagtctgtgtaattgctgtattccaggtgatgccaggggctgaggaaaagttgtctgtgcaaaaatgtaggcaagactggccttgcaggtttcttcagacttccatgaccttgcacgtctctttcacacttgaacattctgttaacattctgatctgcatgatctcagctacatttcatcagcaaacacggcagttagcatagctcatttaaccctggtgtagccgtacatgtcaatcacactaatgcttgattctcttgacgtctaaaccactgcttgtcttaatcatagagtacacagcattgacccagcttgggaaagtgctgttcgtggtctcctggtctcgccctgccttatgcttccatgtgtgtttacttcactctggtccctttagggcgtttttctacagggttaaagtagaactggggccacttatttttagctgattcttcctgagataaaagcaaataagatttattctgggaaccctagaatggggttgaagaagtagatgattccgttcgtttctctccaacccccttttgtaggcacgaaaagatgaatggcgggtggaacatgttcagggtagtaccttagcatgtgtacaggtaaggagtctgtcataacatccaatttgggatgagctgttgaattttgttccctaaatcagattaagtcaaagctgtcctaccaaagaatccagcagacagttgtctctctacagaagtgtgagaaataaagcctaggtgtcagagcatttagctaggtacattttcacaaacagcatgatgagtgagcctggcaaatcttgactattttgccaggcttttttataatgtccagagctccccaaacccccattttcacaggggaagatgacacaaactagtaactgctacaaattcacctctagaagaatgcaagactctagagcagtggctctcaatgaccctttcagaggttgccctaagctatcagacaatccaggatatttaattatgattcttaacagtagcaaaattagttatgaagtagcaatggaaataactgtatggctgggagtcaccacaacatgaggaactgtataaaagggtcccagcattaggaaggctgagaacccttgaactagaggggaccagaagccttggtatgctcaacttctatgccttaacaagcggatcataaggaaccagggatgttgtttcaaatgttcctttggctttctcatgctgaatttagtaattgttcaacaaatttcctatgaaaaatgcattttatggtacttgctatccctgatacatggttgcagggccatggatgggtatgtggaccctgtgccacctgtgacccttaagcattaattttaagagggccttaaagggggaattcttatgctttctggttgcctttcctctctgcttttactaaacttgctgtgaaaacactctggtttctaagggaatgactcctaatgttcagggtgaagatagatcacacaatgatagaaactgagagttctcactcagtgatcactttgtggtactaccctcaggagctggcgaggccaccaaaaggggttccaggtgctggtaatgtttcccacttgctcttgaaagttcagggctgaattatttcacattcggttatgacctggcaatctagttgtgtttacagacaaaaacagacaaaaagactagtgattggcatatgaccattttatctggtaagagaaaacctgcccagctgatgtactgtgttatggaataaagtcatcttgatgagaaggaatttaaacaatagattattttgttacctattggaagaactgtcttgaatttgtttctttagaagttctaaataaaattgtttaatgtgctaataatgtctgctttgtaaaagtccttctaaatttatttacattataactt

SEQ ID NO: 27254 - DNA, 1197 bp, Mus musculus
gaaggccacgccccttccccctcctccagggagtccgggagaacgcccggccctgcccagcagcctgctgggaactgtagttgtggtctctgacaaactggcattaaggtggaatgtaggactacagatcccgaaaggccacgcgtgccgcgcctgcgtgtccgcacctgctggagggagggctaagtcgtcccgggagcctagctagtcagcagaggaggctttggctgcagcgggtgacatggacaacgcagggaaggagcgagaagcggtccagcttatggcggaggccgagaagcgagtgaaggcttcccactctttcctccgagggttgttcgggtgagcgccagaggtcttgcccttaggggtcttggtgcccgatcccctgcccagccggctgccaccgcagagtaccccgcgcaactgcttagggttacgggattcccagtggcccacgctctgttttgggtcccgtagcatccagggcctcatcgcatcccttgggccgtgtctggggtgtctctccagtcagcacacactgcaagccccagaaccttttggggatcctcaggccttggacacccctcacccacacccggagaacctctagctcacaatccccaggcacccttaaacaacccagaacacctacgcgtcctcggagatctctgtggtcccccaagtcccatgcgtcgccaacggtccggtgctagctccagggtccgcgccaagctgcctcttcaaggatgccacccctcctggtggaccagatttattcatttcccctggttgggcccgtaaatcccccgggggagccaggactgtgaggttctggaattcaacctggagtttggcagcagctggtggctcgtggggagcgcgaagtctgcgcccctgtatcccgggcacttgcccgctggccttggctcaagggccttgaaatcatatcctccttggtgtgtttttcatttgccagagtgacttgtatccgtagttcaggcttcccgtttgatgaactgtatgtaacattgctcctttttaaagtcagagtatcctttgggaatcccgtgattttgttaattcttacatatcttggtagggaagggtttggtttacattctgagctttcaaaaagcaaaacctgccctgagagcttgtggaagaattctgggctgttgattatgcgaatgattcagc

SEQ ID NO: 27255 - DNA, 1281 bp, Mus musculus
ggagtcttctgtgcctcttctaccatgtctgcagggatgtgacaccatggttgtggtgatagctacattttccttatcatccttccctatacctttgccacttttagagatgtgtcctatgcctgggcttctttcctggtggccctcttagtacttaggtggagggctcatgggccctgagccttttccactgccttgacctctagggctcccacaccttaaaaggctactccttaacaagctgtgctggggctgaagaatatggtcttgtggaaccaggaaaggggacacataccatccaataatagggatgaacagaccctgctaagtgtcctgggactcagaagggagaagggtttagcttccatcattgcatacacttgttccatcatcccggagtgggtatttgtctttgctgtagcttcacactgattgtttctctttgttcccttttgcagaaggcactctgctccttccagatctacagcgtgccctggaaaggcacacactccctgacaaaattcagctgcaaaaatgcctaagggctgagtctagaaggatcatgcagactgttccttacttgtgctccttccctatagtgtttcatctcgcagaagggtgctccggctctggagggcaccgccagtgtgtttgcaccaggagacagtaaaggagctgctgcaggcaggttctgcacatctgaacagctgtcccctggctccactcttcttgcagtacctgccatgccttgctcaattaaaaaaaaaaaactcctttggctctgtttgagttgtttctgtctcaggataatgcagcaaggaaacccagaaaacaagtgtgtgtgtgtgtgtgtgtgtgtgtgtgtgtgtgtgtgtgtgagagagagagagagagagagagagagagagagagagagggagagagagagagagagggagagggagagagagagagagagagagagagagagagagagacccagaacccacacagcaccaattcctatactattgggcctgggtcactggtgtctatggggtgacagggatactcccagcccttctatgccctgatataacacaagtcttttcatgcagcttcaggggagatttaacccaaatgaaacagacataaagtcaattccaacttacaagtagggagttttagttaatatcaccttagtgccatgattgcatagatctggggaggctacaaggttgtataaaatacaagtcctcatatcctattgctcaatgtccatccccatgtcctccaatgtaa

SEQ ID NO: 27256 - DNA, 1099 bp, Mus musculus
atggtaacctcttgaaagctacatcttcgagtgcttttacattagcattctactttttatatagtgtatcatctccctagatcactctcagctatgtgagggggtattatgtagaatcccaagtgaaaagctattaaccttccatagggaatatcaatagttcactgcaactgacctagctactactgttttgttctgctctagttgtcatggtcacgagggcaaagtctaggatggcttctgtttttcctggaagaaaaagcatggcattagcctgtttggggaatcttaagtatttctgtgatggctaatcttggttttcaacttcagtacctctcaaattgactaaaaacccaagtcattggggaattcttagtttatttgattgcttgaggttagaagaccctccctaagtttaagccgaattttcttgtgacagcctagataaagaacatggaagaaagaagtttttgctctttgttggcttgcccccactctcacttcatgggtattagagcctatctcttcaggattcagatgtacgctgaaatgtggacttgtggaccaaacacctactgaactcttagactttttcttcagagagagccattattagactagcttgaccacagactgtaagccgattggctaatctccctttatttgtattccctaggtttcataagtaataagctgttgtgtttatagagaggagcctagcataactgtcttctaagaggctacacccagcagccaatggaaaaatatgcagagacccacaggcaaacattagatggagcttggggagtcttattgaagagctgggggaaggactgaaggaccagaagggaacagggattccacaagaagaccaagagagacaagatacctggacccacgggggtttccagagactacatcaccaaacagtgatcacctgctggatttaggcccctgcacacatgtagcagatgtgcaacttggtctttatataggtacccaaacaactggagttgaagctgaccctgaatctgcttcctgccagcctatagatccagttcccctacctagaccatatcatctggcctcagtgggattg

SEQ ID NO: 27257 - DNA, 1141 bp, Mus musculus
aagccttttcgtctccaagtggattcctgtatcataaacgaacacatactggagagagaccatatgaatgcaatgaatgtggtaaatccttcatacatcgcagtaattttcaaatgcataaaagaacacatactggagagaaaccctttgaatgtgaccaatgtggtaaaagctttgcacaaaacacttatcttttacaacataaaagagtacacactggagaaaaaccctatgaatgtaagcattgtggcaaagcctttgcatattctaataaactccgagtgcatgttagaacacatactaagtagtatggtaaagccttttcaaatgtcacaagtctttataatcatgaaagagaaaccctatgagggtattcagtatgtttaaacctttgcacatttctataatcttcatcatgaacatattcatactgtagagaaagtctgtgagtgtaagcaatgtggtcaagcctttgtgtaatagggtcctctgagatccaacacaactcaaactcatgtaatgcaagtgactagaatttattgtaacgaagctgctactgatggaacagggctagagaacacacttgaaagctgaactgtgacagtccccacactcaccttgatactgaaccagagtgttatatagagagtttttatgtttgagaaccagaaacatttgtgccaaattacagctacattttcccaccactcagaattaatgataggggctttcctcatgtagtcttctatgtcagctgatacagaatgagggtgctacaatctaatcaatcatatcaatttgttgttttgtgattaggaatagacattgttttgatgaataaaagatgcatagaaaaagaaatggttaggaacagtcatggtttttatgaaccaaagatgcataattgaagctggtccactatttgtaagtctccagctcctctagggcctataaatttgaccttaggttcatcttatgattaaattgatgccgataacaaaaaggcaattcttaggacaagattcatttgcttatttccaagatttgcatactacagtcatttttgaatacataagaaaaaaatccacattggagagaaacccagcaaaactaatcaatgtgataacgatttttcacaaca

SEQ ID NO: 27258 - DNA, 1092 bp, Mus musculus
atgaaaggaagtgtgctgctatggggtgtggggtaaactccaggatgtcctagagtcctgtgatgtgagaggctttcaggactcaatggtgataaccttagctgaaatgcacaagatgggggagctggaacctgaagagacaatctgcagtaaatagacagggcccccagtggagagatggagtcacccacccatcttcaaaatgtttaactcagaattgttcctgtgtaaaggaatcagacagaaatggagcagagaatgactgaaaggccatccagttacctgcccaccttggcatccatcctatgggcttgtaccaaaccctgacactattactgatcccatgttgtgcttgcagacagaagtctagcatggttgtcatctgagagcctctaccagcaactgacaaatgcatatacttagagccaacgattgtactgaggttgggtccaatatggaagagttaggggaaggatataagctgaaggagatgccaaccacataggaagaacaacagtatccactaccctggacctctcagagctcccaaagactaagacaccaaccaaagagcatacatggtctggtctgtggccctagacacatttaccagaggactgcctggtctagcctctgggagtagatgcacctgaccttgtagtgacttgataccccatggataggggttccgtgggatggggtggggtgcaggggattcttgtgggtaggggaacattcttttaagaggaaaagggtaggggggatggggtgaggaactcttacagggaagaacaaaggcgatgatgcccccctttattttgtttgtacttgtaaatgcaatactcttcaattacatgaaattacttatccaggtgtaaaactatgggtatgtattcatgtcttttctctcactgtgataaaacacaatgtctaagacattataaaatattttaatttggcttgtcttttaacaggaggattggaccaccttgaaattgacaatgctaatgtcacaatttccctttaaattctgggctatgttatccagcctgcattggatgtcagtcattagtcaaggctacattttatctc

SEQ ID NO: 27259 - DNA, 1200 bp, Mus musculus
actctttgggaggttctcaggacccaaaggaaggtacctttgatgaaatctcctacagtggggagaaggaacttgaagagcccacctctagcagaaagacagggcatcaagtgaggggtggggttgccatcttatagccaaaatctttgacccatcattatttctgtctgacagaactgcagggacaaaaatggagaaaagcctgaggaaaaagaggtccagcgacaggcccaaattgggatccagctcaaggggaggccccaaggcctaatactattactgaggccaagatgtgctcacaaaaagaggcctatcctgactgctctccgaaagacccaacaagcagctgaaagagtcagatgcagatatttacacccaaccaatgaacagaagctgctgacccctgtggttgaattagggaaaagctagaagaagctgaggaggagggccactctgtacgaggcccagcagtcttttaaatgacctggatctcagacattgggccaccaacctggcagtatacaccagctaatatgaggcccccaacacatatatagcagaggactgctgggtttggactcagagaagatacctctaaccctcaagagactggaggccccaaggagtgtgtatgtggggggagttctggtggggtagggggttgaagaggtaaggaagtcctcctggagatgggggatatgagacgtgcagtagtcagaaggtggaccgggagagggataaaatctggactgtaaaaaaagattaaataaaataaaaagaaacaaaaagcagcacattttggggagcatcatccacaggcaggcaacagagtcagggactctccctggtccagttgttggggaacctgtctgaataccaaactgcacatgtagtacacgtttatggggtatgtgtgtgcagtatcagcctatgaatgccctttggttggtagtttagtctctccgaacccccagaggtccagatcagttgattcttggtctgcttgtgaacttcttttttttttattgggtatttattttatttatatttccagtgctatcccaaaagccccccacacgctcccctacccacccactcccacttcttggccctgtcgttcccctgtactgaggcatataaagtttgcacgactaatgggcctctctttccactgatggccgactaggccattttctgatt

SEQ ID NO: 27260 - DNA, 1191 bp, Mus musculus
ttcttggttgtctgttgccaggtgtactgcctggttttgtgtgtcaactggacacaagctggagttatcacaaagaaaggagcctcagatgaggaaatgcctccatgagatccagctgtaaggcatttcatcaattagtgatcaagtggggagggcccattgtgggtggtgctatccctggttctagtagtcttgggttctataagagcaagccatgcaaaccaggtgaagcaagccaataaagaacatccctccacagcctctgcatcagctcctgctttctgacctgcttagttctagtcctgacttcctttggtgatgaacagcatcatggaagtgtaagctgaataaaccctttcctccccaacttgcttctcagtcacgatgttttgtgcaggaatagaaatcctgaccaagacattgttggtaccagcatagtggggcattcctgtgacaacctgaccatgtttggggaaggagtgtagaaggactttggaactttgcactagaagagctattgggatgctaagaactctgtggaatgttctgtaggagcttggaagataaccttgagaacagtgcagaagatggagacctggcttgtgaaattactgagggaagattaaagtctcttatggattgttgctattttgattgtgaagattctgtggttctggttatctggggctgaagaatcagctgtgataaacaagataccagaactactaaattgaaaactttgcattactgggactattgatgctggttagcttcagctaagaaattagtgatgattaggaagagaccagcatcattgaggtaaaaacttctggaaagtgttttcgcagagcacaaagaggctgtgttccagatagagccaaggttgttctacctactgctgcagctggacatggtaatgtgtaagaatcactcaggtggtaataggttttgaaggggtcatgaagagcagctgagactcagcactgtgaggccatggaaggccattggtgaaggtgcagcctcagttgcaattgatggcccagaactgaaggggtcttgcaaaggagttgaatcttggaaccgtgaagagctcctataataggcttttggcaaagcctagttgcagctgaagacaacagtgttttggagatgccaataccatgagatgaccaccaagaacagcagcagcat

SEQ ID NO: 27261 - DNA, 1145 bp, Mus musculus
gcctggcctcatggccgggacccagctctttcggttccgggaggagccaggtcccggaggcgatcgggcggtgctggaggtccgcgtcccgcaggtcctgcatgtccagtatggaatgtatgtttggccctgtgctgtagtcctggcccactacctgtggtttcacagaagatctctaccaggcaaagctgtcttagaggttggagctggagtgagccttcctgggattttggctgccaaatgtggtgctaaagtaatactatctgacagctcagagtttcctcactgtctggatatctgcatgcaaagttgccagatgaataacctgccacaggtctaagttgtaggactaacatggggccacatatcaaaggacattctgtctttgccaccacaagacatcattcttggatctgatgtgttctttgaaccagaaggtaagtataatttatagcaaacttggctggatgtatcttagaaaactcacttaaaaaaccaccccacccctccccagattttgaaagcaatttagccacagtatacttcctgatgcagaagaatccaaaagttcaattttggtctacataccaggtccgaagtgctgactggtcacttgaaggcttgctctacaagtgggatatgaaatgtgtccatattcctctggagtcttttgatgccgacaaggaaggcatagcagagtctacccttccaggaagacatactgttgaaatgctgatcatctcctttgcaaagcacagtttctgaatgaattgtacctcaatatgttctgggacagtgtcaaaatggaataacctggcataaagctgaattatctgaggaaactcaatgggtatgaagatgatcaattctgtaagccttgtggctgtgatgtcatgcctaggatagcattcaacataactttaacaaaattaaacattcaaaaaggcttaaaaaaatggaggcagaactaaacaagattcttgacagagagatcatgaataggtgagaagcccttaaaaaatcgttcaaaatccttagtcatcagggaattgcaaatcaaaatgaccttgagatttaccttacaccaatcagaatggtgaagatgataaactcaagtgacagcacatgctggtgaggatgtagag

SEQ ID NO: 27262 - DNA, 1216 bp, Mus musculus
caggtggtcacctatgtgagtgaggcgcatgaacatgatggatacctgtacctgggctccttcagatctcccttcatctgcagactcagtctccagtctatttagccagcccagcagctgcccccactgtgcatgccagaaatcatcacactcagtcacataggtctggaaggagccatggacatatagctctgtccctgtgttcctgctagtccttggaagtgtgggagtagctgctgtaacctggagaaggtatgaaccttacccatactttctcccaagacgtgcctctcacctggacttgatgtcatttttagagggaaatagtgtatctgctatggggaagacaaatcatggaaagccatttctctttaaaaaaacatgctaagtacaagaattctctagtacctggaaaatttaatacacctgtgacagggctcagggtttgatgattagagcaggggattagctgtgcagggacctttgtattgccattggctctatctgacacttgtatcttcattctaaagggggtcatgcttttgggggtggtattgcggtatgccatggaagtggtaatgcatgtgttgaggcagggattattcaagctgaaacttgttctcaggggccgtgtgagatgtgtgagaatacctggacttctggtatttctccacagaaaaggtgtgctctcccaccctctacaagcctctttccatgccagagggttttcaagactcctgttttagtggccaggaggatttcattgggtttctttctgactgccttctccactggaattgggtgacccagtgagtttgtacctgcacaggggtgttttagaaatgcccttttatggcttgattccttttagacctacagatgtgattagtgaactgttgatgtaatgtttgtgctaatgtaataagctcaaagttgcttatttcttggcaagtatgtttatacactggtcttaattttgataataataaatcatattaaacccacttttctgctgattattactccttttgataaaatggtccagaggtttcttctctactttaattattgtatttttctacttaaatgccttaacagtgtcagtatgaagactcattctgtaaggatattattttagggcaagacagccatttaatttgcttagaagtaaagttaggggacctgtcaggataccaaaggtcccaagtggcatttc

SEQ ID NO: 27263 - DNA, 1661 bp, Mus musculus
gtataatgtgaacatttagttacacacacacacacacacacacacacacacacacacaccgtgggaagaatctcccttcttacctccccagggatgaagataacagaatgcgcttttttttaaaaattttattaccattcaatgtgcttaaagtccaaaccagacatgtttgtgcctctggcacataactctcctgctaatccaagtcaccatgtccaactcctgcgtctatttcatatttggttcatttggtttattttatgatcgaacaaactggacaattcttacattttgtatggtaggaattgcactcagggcctcctgcacactaggcaagcaagcgctctacctctgagctgcacaccacacctctaactcccaagaagacggagtgaatgtcctctcctttacttgtgaaatcatttgggttcgtttctctaagctgtgatctggaaggagtttctttccccaaggtgcctcatagtaggagatcatattgcttcaaacgtgtgaggttgttcatggtagccagtgaaaactcgggtgtctttactaagcctctggtcccatctgaactgagatcctgaagactctgcctgtcctttcttttgtggttggggcagcaagaactcactgtggtccaatgacgatgacacttggtgctcctgagcaaggtctcttttgatgtgccttaagttctctggacattggtgagtgatgcaaatagtgaagtcatgaaaagcttattttgcagctagattgtggctaagcatgggagggctgaaggggaggcagctctgtgagcagggcccctgggggcaaaggaagcctgttctgtctggtccacagaacttagctatatgggtgtttcagggtatcttagctactgcacacttactgtctgtcctgacgtcttgggtaatggggtaaacatgctgacgctcccaggaggcggagcggttgtagtatgaacaaatcttaatagtcctttgttacaatcagcagtgaagagccatgtgatggacgtggctgagtatagttactgtgccctttgaaatggcctaggtttctaggttactgatagaagctctcggaatgatttatagaaatatccaaataaagctttattttgttcactgtcttcttatggggatgtttttggttgacgttattctattttgtttcttcctggttggggattgaatctagggcctcctgaatgctaggttagcactcaatcagacctttacccccaccccactcccaccctagccaacataatcctaagggaaaacgaaaaggggtccatccaactcaaaagatagtccacacacaagaaatgttggtgccgtgtattcgtgtgtgtgtgtgtgtgtgtgtgtgtgtgtgtgtgtggtgtgctttgaggccagaagataacctcatagcaccatctaccttttcttttttaagacaaggtctctcactaggcctgggactcaccaagtagctagtctggctggccagtgagccccgtagattctatctccatctccctagtgctggggttacaagtgaacacctgcctattctattcactcctgcctatttcccctcggttctgaggctagaactcaggtctcatgcttgcaaggcaagcaccttagtgattcaagctatca

SEQ ID NO: 27264 - DNA, 1767 bp, Mus musculus
taaccaagcctttcactctttatgtaaaagagagagcaggggtcaccagaggagtccttactcagactttgtgactttgaaaaaggccagtgacttacctatccaagaagttacaccctgttgccagcgggtggttttcttgcctgaaagctattgctgccataatctgtttgtcaaggatgctgatgagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgcgctgacattctggcagaagaaatgatctgaaggatcagatcagccttggcctgaggacagtagcctcgaggttaaaggtaagcagaaggcggggacagcagtatggtggtgaacagaaagcaagtgatctaggccagcagccttcctgagggacgtcggcccagaaagctgaacttatgactttaagacaagctctatgaatggcaaagaaaagtctacactgacaacaggtatgcttttgccactgtacggggcaatatacaaagagggctgttgacatctgcagaaaaagacctaagatgctgtggctaaaaaaaatcaggtggcagatctaaccgccaatcaggtggcccaaggagcaatgatcctggcagtcaaggagcctaaagattattatgacatcagagagaccagctttagatacaccgctgagcactatcaagttatggacagtatttgacttggcctgggggccaagaaattcaaaggtgtggttaggtcctttgactactatgttacaggactctctgacttggcagaagaaatagtcaaaagctgcaaggcctgtgctatgacgaggtagaatttctaaaagaaaccttcccaaggtaattggatccaataaaggacctgtctttgttgcccaggtaaatcagggactggccaagatattagagatcggttagaagttacattgtgcacgcaggccccaaagctcaggacaggtagagagaacgaataaaaccattaagagacccttaccaaattgacagcggagactggcactaatgattagatagctctcctaccctttgtgctcttcagggatagaaacacccctggacagtttagactgactccccccctataaattactctacagggggcccccctccactggtaaaaatagcctttgtacatggtgctgacatgctgctttcccagcctttgttctctaggctcaaggtgctccagtgagtgagacagcgagcgaaaagcagctccagaaggtctactcaagaaaagaagacctgctacattagacatctccacgcaaaaaaccttgagactctggtggaaaggcccttgtactcttaaccaccctactttctacctttatgggaccccttttgattttgcttctgcttttaattataggtccatgtgtgttaaataggcaagtcacccttattagaacaaaaattagtgcagtgcggcttttagttttgagacaacagtaccatgccataaaggatcaagtatgtcaggaaaaagatagtatctagttctaagattagaactactaacaagaagaaggggggaatgaaagagtagtaaactcagtgctccaaggtatgctaatcataaaacagatagtgacattcctccacccacccacttcctgagttcaaggag

SEQ ID NO: 27265 - DNA, 1105 bp, Mus musculus
gcaaagtctgagtttggatccatctgagtttattgaatttgtgtcttggtttcagggttgcgagatcgtgggttccagtcccacctcgtgctttggtttcagggttacgaaatcgtgggttcgagtcccaccttgtgccttggttttacacctggcagagtgaggaacaagtgtgcttctctggttttggtcgtctaagtagaagtggacgacggtgtttgtagacgatggggtgatggggttttctgaaatgcgcgcgtctgtatttgcagctgtccttttgggccgtaaggaccggaggactgtggtcggcagacgtgctaggaggaccacaggctgtggccctgggggacgccctgggaggtaaggagagccagggatgcctggccgtctccggatcggtcagagggaccgagttctgttgaagcggaagcttccccctccaacatcgtctaattcttttgcctgcttgtggaggacaagaaagggtcgagtgtgtctggatctgttggtttctgttttatgtgtttttgtgtacgtgtttagagctatgtgaaaatctagagaaacaaaggtaattctcataggtgctttataccctgactagagatagtttacacctgagatgtgtgaaaatgggttttgagaaaagcagtactctccgactatctggagataatttggtaataaaaaaataaaataaaataaacagtattaattggtctttggaaccctgcacctgtagttaggaatctagtgtggctagagaagccctgctaggcactgattataaatgctgttcttatagggaccagcagcttctcaaagttctatggtaagggaacagatggctgtttttcctacaaaaattggattcatcaggtgacaaggtgctcctctcttgaaattacagctagaaaaaaattaagaattttgtttggtttaaatgggcaaatgtatatggccatttcatttttgtttctaaatagtttcaaaagtataaatatgttttatatgtcttggttatagattagtggctcataagttattggttatgattaaaaatttgtaacattggtaacaaaaagttgacttaaaactggta

SEQ ID NO: 27266 - DNA, 1301 bp, Mus musculus
tcctgctcctatccctgctttaaagaaacagcccagcactgtgtctatcctcctcagccactgccttcttccacagataccacccggtctctgcagctcagccctgtgacctcatcttctcctttcctttgtcttttcaagctggctcggaaaattgacaatgttgaaaccagctgggctctgggagctatttttcattacatcgactccctgaagagacagaaggttcctgccttgtagcagctgagccctagtccctgcctcaaccagaattccaaggctcccaactccatggacccctctgtcttggaagtgacaccatccttgaggagcctgcatctggctgagaccctctgtgcctgcagtgtcatctgcagatttgcctgggacatggcccatgtactagccctgctacaccacactagctggggcagggccagggtaggaatgctgcttggcctgaggccatctccctgccttacttacctccaagtgggcagggagccaggtggggcccagggcacatgcagccctgttcttattccatccctgtgcaggattgtggctgcttttatgtgtttctgtgacgtgagtcttgttttgtctcccagcccctgttccctcatgagccaggcctctctgccttcccagagttgtgggagttgaagtaacctgaccttgccacagtgcaacctcgaggggagcacatcttgaatgtggccatctcttcctcgggacagacatgtgaaatcacctggagatttgctgtcccacctttgaatggtatagcattaactgatgtggggacactgagtaggaagaagatggcccagtgcctctttacagacccagcgtgccgcctttgcagagaatgtgggtgtgagcagagctgtgagaatgttcagggccgttgctcaagtactaccttgtgagctgtgagtgctttatgttaaaactgagcccctcttctggacacaactatgtcccagtgaatgtattcctgctatgagccacttgcagaccagtggggcggatgagaaagctcagccctgaaccatactaccccttaccccaccctcctcactcggctgcagctggcttccccatggtcccctcagtgaatgtacagttcataaaataagctgagccaccactgttcaactcaaaataaaggtttacaagggtttctctcttttgcctcattagtgagcgcccagcattaaaaaacctgcccaagtgggacaacgggtggtagcagaaacccagcagcagtgacagcagcagcagcagcagcaggccac

SEQ ID NO: 27267 - DNA, 1248 bp, Mus musculus
gatcccaccccccaacctccccaaggactaattaattatcccacacagtgagagcagtggcttgcttagctgactgtgcccacgccagtcttcaggcactgcaagcagccgctggtccctgctatccgaagtgccatgcttccaggaaggaccatgggaatggttttgaggacctggatgaggaagaaggcgtggcatcctcctggcttcttacagaagaactgttgcagagttcacagcacagatgggcagagatggtccccacagcttcagcccatcatcatccccagaggccgagcagggagggagtggagctgagcccctgaaatcctgcacgtagctgagtgagcttaagcctttagtttggggtgtgaatagggatctgtggtagccagtgttcctatgttctgctagtacctgggtcaccagccatagggtacagccagccccagtgtgtggtcttgttggcctgctgggtagaacctttgcttcaggcttcatgctcacagcttcctgtcctttgcccttgactgtactgagtatgtgggtggttgacccatataggccatgcctctagccatctgtggaaccctgtgggtgtcaagtagaacccagaacccctggagaggagcactgaagagagagagacctttatcccgtaactgagaccttggttgaggactggcaattttatagagggttggtttagttctttgctttttcaacaggaaataacacttcaggaggaactgaaactagctaagccttcctttttagcaagtaaaccttgaacttggtcagtgtggatatttctgctaggctgacgactaagctgctggccctgcagagggtccagtgtacactccactctgctacagcagcatggtgaggacccaccacaggagctgtgctcctcagagggcagaatctacattaagtgccgcccaaaggagagtgcgttgtcatagaaaccacataaaactatccttccagaggcttcaccaccttgcactgctctatctggttgggggtgggcaggagaacccctcgctttccccaccatgggagcatttgctgggaagtgtcttttcaggacttaaatcaccggagccactgtggtagcttgtgggggtgggtgggcaggttctagggctggtcatctgctgccctgtgcatgaggtcccctgaagccgcaatacatgaccacccttctactacttgctattacctccttgtatgagaaatgga

SEQ ID NO: 27268 - DNA, 1147 bp, Mus musculus
ccgctgtgttgtgaagtgggctcccatcacaatagtctgcatcttttccaggtgcttgacgacctatgaggtctactgtcagggtcaagagcagactgctgttctatccaccagaaactatgacaaacaagcattagaacccaggctgacatgggaggattgaggggaccacttgtggctcagttggcagaactcatgtaaagacatctaggctatattcttgccttcgtggataaactgcagggagggacctagcacttgctgctactaaatctgcattgactttgctgctggaaagctggcttagatggggggtgagggggcgtggcgtgtaaagaataccatactgggcacaggagtgcctagagaagtgcttggcatgcctcatcaacagacttggcacacgactcgctttgggcaggctttatacgttacacaaagatgaagccatccaagagagtgtgaactgcccagcagcgcacccctggtgcatggaactgagctaccccttagctgttttcagaggaagggcactgtggaagtagaagagcagaaaaggggtcataaatggtggactttatggacgtggcaatgcctagcattcccagactctggcttcttggacctggctgtgtaggctgtaatgacagaagcagtgtctatgggcacttgggctgttctctggaggaagcaccagtctttattgaaggggagaggtcataggcggttctccgttgggctctaggctgattcctctctccctctcaccagctatacaacattgctgcaccatctcggagtttccgagacttcaaagtccagtttatcccctttcactcagaccttggctacagacataaatacatctacaagagcccagagcttccaaggatactgaggtgagacattctcttctaacccttgagcctctctggacagctagcctcacacctagctgtgcagcaagtgacagtcactgaagccatttgagccgctcagaagtgtgctgcagggtcagtgattcaagggccttccaccaacaccatgtagacgttacaacgtttgttctcctttcttctggataatatgatcagatggggcatatggtcttccggtacacatcgcacaaacgcacatgagcacacga

SEQ ID NO: 27269 - DNA, 1212 bp, Mus musculus
cagcctcacaattgctgggattgtgagtgtgggtcaacatgctccacttaactggactttaaacataagaatgcttgcgcctgccatgcatggagtcacacagaatgaatcgctacaaggagctaactgctctaataaagagcttccaagaactgggatggatggtttggcagttgtgagcagttccaggggagctgacccccacctctggcctacaagggcatgaagcgtgcatatgatacatgctgccaaagctctctaaagtaaagtaaatacatctcttaatgtttttaaagcttctactaactgagaagaacgaaaatcaaattgcaatggatactgtattgtacaaaggacctaattaaaaaccaaaatcacctcagtatctgaaaggacactcaagtacatttagtttcttctccctgctaaacccccccacccccatactggggatacaacccagggtctcaaaagtagataggcatttgctctaccagtgaactacacccctagctttacttttgatccttaattatagaacgcccaaagtacaccaagatggccatttctacccatcagactgacaacatttcatctgtggcaactgctttgcttttgaaggaagaaggatttgggggggtaatcactttgtaattacagatgaagattttgatctaagagtttgcatttaggaccgtcctagacctgaaataccttcgtgcacaaaactgtatatgcatagagtgattcattgtggcagagtttgcttgaaacaacctgattgctcagagtgggagaatgctttctcaatgtttgtcttgttggtctattgaggtaggagaagcaagaaagccatatgaattgatatagaaaaattcctggataatgttgtagaattgaaaacaaaaaacaaagacgaaagcatctagtgtggcatgcaccctttatgtttaagagggaggatttatttagagtgtgtgcttatgtagggaaactctggaatcagtccttaataaaaccagttatttctgggcccaggggtgacagtatagtataattagcagtcagatctgttatttgttcattttctctgttatttgggactgtggatcgttgagacacaaggcagggtgtgtctaggccttgctggcagcagggggatcagcctctggaggttgaatgctggcaacttctaactagaactgctttctt

SEQ ID NO: 27270 - DNA, 1153 bp, Mus musculus
aaataaatctttttcttaaaaaattatgcagtgacttttttaaaaataaaaactttactagtgtctgattagtggtatcagttttacttggctgtaacagcccattatttaaggttagcttttgactacaccgctgtacaagctgatgaggtatttaattagctgttgcttcttactgatgcaaactataattgagcttttctcctctttcttttctccttccttttacttgcagcactttttgcctcggtggaagtgtgagcagttaatcagacaaggagttctagagcacgtgctgtcctgactgtgtcctgtggtgacagcagctggatgtgaagctaagccaactcacagaaggaaacgtcctcactggacctccccctccttggttttaaattgacagacatgcattaacataaccaagatgggctggggtccagctcattggtagagcacctgcttaggatttgagaaacccagagtttcatccctagtacctcaagaaacaagacaacaaaaatcaaagacaaaaccaagaactcttggctaggagcataagctgccagctcttaagcctttgttacaggttatatctctagttattccattcccacagtaatattgtactcttataattgaaaataaacagtctttggtttgaatctgttttcacaatgggaatctcctggtagcttatctttggttgtttttggtagtgaatgcttctggaatacgtttctagaccactctgtcaagtaaagataataatttatcaccaggctgtgggaagggaaaggaagaccttggaattcggagtactgcagtggtagctcaacactacttgcaggctagtgggcaccagtgtcatgactttgttcttaaaatggatggaaactatacatttttttaaaaagtagcaaatatttatccaataggatataaacatcaaggggtaggggaataaatctatacttcccttagcagtgggataagcccccaggaaagttgttttggctaagtgagtttcagtaagccaaagatgatgctgagccttcaggagctgtgggaggatggacagtgctgagcaggtaagctatactgtgtagatgagcgggtccttgcacttctgacgagtacggcccagaggacaccg

SEQ ID NO: 27271 - DNA, 1076 bp, Mus musculus
ttaaccatcctaatgctgcggtttctcatgttgtggtgattccaacataaaattattatagccatgtctaattgtaatcttactactgttaagaatcataatgcggcggaaggggcgggccgggtacgagaagggctgggccgaggtgccttggggttgctggagggtcgtgggcggcgtgcaggagacatgtcggcgggcagcagctgcagccagactcctagccgggccatcttcactcgccgcttagccctcagcgatggcgtacagctcccgccccggggactacagcaccaccccaggctgcacgctcttcagcaccaccccagcaggaaccaggatcatctatgaccggaaattcctgatgggagtgtcggaactcacctgtggccaaaacacctcccaaaggacctgccagccattcctggggtcactagccctaccagcgatgagcctcccaagcaagccagtcagagctacctgcccagcagcccagaagataagccggcaggcggtgaagagtcacagtttgagatgggcatttaagggaccagccataggacgcaatgatgcttctggggcccccagggccctgggaggagagccgccacagcagtcaggctttgtaccaggcagacactgggtgtgggtcggccacccagtcctgctcctcactcagggcaccagctctgccttccattttgtgaacaccagcgcatacctccttgtgcctctgtctacagagctgctactgcaggggaatgactctcagtcacagcctccctgcatggagctccagcgagtggacacagaggagtctgtcagaatgatctagcaatcctagccccagcctccggagcacacccacctttctttagggtgggttacctgggaaagccacacttttacttctttccctgacaggaaataaaagccacatttacccttaaaaaaatcataatgcaatatctgatatgcaggatatctgatgtgcaaccctaaaggggttgcaacccacaggttgagaaccactggtttaaatgcatgtaccactacacctgtcaaggggatccaaa

SEQ ID NO: 27272 - DNA, 1108 bp, Mus musculus
tctctaatgaaaggagacaagaggatcttttttctgtaagatccggttgcagccaaccgcagctctcctcatcagggccctggtgaggaactgtaggctcctcccttccaaaactgtcatttcagagtataatgtaagtagaactataaagatggagcctttgggcttggcttttgtcacacatcaccattccctgaggagtttgggggagtctctgtgtagcaacagtttctcattattgttgaatgtcctgtgtgcttttctatgtcgtactatgacactctgctcttaaatatgtcagcagatctctccccaacactcgcagcgtccactgtaatgctaaagagacttaactgtgctagttcatgtccatcgtaccatagtcacattgcttccgtgatccaaaactttcacagtaagcagctgatagatttcatgtaactgtcagggtctttgtttgtttggtttgttttggcataagctagccactttgccttgtttgtagagtgaaggggttagagaatgagcctagcacatctctggtgacatcccttgatcagcaccatcagagatgtagctgagaagactggatagctggggtgatcagtgctattcctaatgtgtctgtgggcatggtgcttccctgtgggtcccattgtggggctcatggtgcttctctgtggagccaggttcttggaaatgtcctaggcagcaccctactgaaagtcagcacccaagaggctcaggtgtacagtgctccctgtggatcccattgagactcatgaaagcacaggtggccctctcacgaggcacatgtccagtcacgtggcagacaagaactcagggacactgctggggatagatatggaagtgtggtcttctgcagtcattcattagctctgttgaccccatgacactggcttttggaagaaactgtctcacaggtcgtccctgttctacatctaatgcctgcttcctcagggagccgtgctgtttggtcttatgttactttggtctgtgtgacttgaagatcagaagaaatttgaacaaaagggttggttagacccagtagaatcatctttgacatgaatatccctttatttttata

SEQ ID NO: 27273 - DNA, 1145 bp, Mus musculus
gcccctctcatatatccaatgatgtaagcatgagtgtcaagaaatggtttccctagttctgccaggacctttaggtagttagaagcttaggttcaggtttaaggttacatgctgaaagtccaggatccacacctgcctataagtctagcctgtagtgggcgcttactacagatggggctgatcttgggtttggccccccaaggctgagtggctgcaagtgctggaggaggtatttggctctgcctacacaggacctacaggaccgcaatgatgagttgcaagcagagctggaaggcctgcggctgcggctgcccaggagtcgacaaagccccgctgggaccccaggtacccatagaaggaggatccctggacgcggcccagcaggtaggagcctcgtctggagggtaagttgagagtggggctccaggacatgaccacaaagctggacatgtgacaccccagaggaaaagatgaggagaagagggtggggaaatttatctttgtagaaatcacaaaggttataattacctgaccccagaggagacaaatttgcccggggggcatgtttccaggttggatcctgtgaggttacaggcaactttgtgacagggctggacatggaaggtcactggcatggaaggtcatagcaagataggcatgggatattctcaactgagggaatcctgtctgctgggttcagtggaagtcacactgcagacgctcctgatcttggacaatgaggtccagacaaaggcccatgtttaagtgttcttggtcttttttagagaccgaggttgggggaggatgttgtggaggcgccatagttcttgcggaggacagtgggtacttagctagtctctgccttcccactggttgtatgaggcagtcaccaatgcagtcactccagctctgctgtcttcagcagtatcatatgacactcaatggccccatctctctgttgcccatggaatccagcagccctgactacccctccctagttaaactgtggcaacctaagcccctcagcgttgttctccagcctctgagagctcttgagtctctataccctacagctgtttatgttgggaagaggaaagaaatagcccaaagagatgctcttgggctctccaagaggaacttagtag

SEQ ID NO: 27274 - DNA, 1115 bp, Mus musculus
ttaagtagatatttttatgtataagggagagaccttgtatttataaggtttcagggttttttgtttgtttgtttgttttttgcttttcccgagacatggtttctctgtgtatccctggctgtccaggaactcactttgtagaccaggctggcctcaaacttagaaatccgcctgcctctgcctcccaagtgctgggattaaaggcatgcgccactacgcccagcaacagttttgtttgtttgtttgtttgtttgttttgtttttttaaagataggaattgtgcatagttcgtgctttttctgtttatctgttttctgctccactcctctcctcctcccctccctccttttttcctctctctttcactcctttctccctttcttatttctagttttgaaggtagaacactgttgtgttgctcagactgacttcagactctggggcccaagaagtcctctgccttagcctcatatggagctggcatggaggcacatgctgggtttcatctgttttctggttactctgtagctttaaaacacacacacacacacacacacacacacacacacacacacacacacacactgctgactgacggatgccttgggtccctgcaaagagaagctgattcctgtagctgccttcgaccccacaggggctcctagtacgtctttccagtgctagctctgtgatctgctgttgttcagtgtgtaggcctgagggaaatggggctaagaaacctagctaacctgctacttcgcttttctccttcgtgaccagcctgctatgggatggacaacgaagaagagaaccactatgtgtcacggctcagggatgtctacagcagctgtgacaccacagggaccgggttcctggatcaggaagagctgacccagctatgtactaagcttggcctggaggagcagctgccggcactccttcacattcttctcggagatgaccgcttggccagggtgagtggtggactcctgccgagggacactgcagagctgtgccacccaccggtgtgggcatttggtccacagcacccaaagaaaggcacttggggaggagaagtctccagcaataaaccgtgttattctagagattgaaag

SEQ ID NO: 27275 - DNA, 1141 bp, Mus musculus
ctaagcatgctggggttaagaaattttcaacttcctgtccagcaccgtctcccaggagtgctgcacaaggacatcatagcccttggaaaggctactgctccttagtgtgtagcccagtcaagactgggattctgttgcctacagctggcctctacctcagcatcctcctgccacaaagtgctagggttagacgaatgtacacccatcacacctaggctcattatcactttgtcatccaaaataattcaaagctaaaatctgaattttatttttcaggtttatcttaaatataaaacaaacctcagatttggggggtttgcttttcaagttatatataaaaaaaacctttttatattaaatagtgaatgggtcatttactttaaaggcactgagaaaattcttgagttgtgttgaatatctgtagtaggtttaggcttcacatccattcatttgagccacttacctgacagtttgataaagactgcacatatttcagtttgaagtgtaaacagtagaaatgtgctctcagaaaacacttcccagaagatgtcacctcaacgatgctggtctcttcttaatcaccgctaatttcttagctccaactaaccagcatcaatagtcccaataatgcaaaggttttgctttagtagttctggtatcttgttaatcgcagctgatttcagccccagctaaccagaaccacagaataatcaaactccaaaatagcaatggacctgaaaagagtctctaattttcctcctgaaatttcacaagccaggcctccattttctgcactgttctcaacattatcttcaaagctcctacacaacatctgacagagctcttaacaacgaatgaatcttctagcccaaagttccaaagtccttccacagtcctccccaaaacatggtcaggttgtcaagggattccccactatgctggtaccaatttgtcttagtcagggtttctattcctgcacaaacatcatgaccaagaagcagttgggaaggaaagggtttattcagctttacacttccatactgctgttcatcaccaaggaagtcaggactggaactcaagcaggtcaggaagcaggagctgatgcagaggccatagaaggatgttctttactggcttgctt

SEQ ID NO: 27276 - DNA, 1093 bp, Mus musculus
ggtcattataaacagaacaaggacaacagagtttgtcctgcatattgagttgcttggaaggaagttggcagcacctctatttctgcacttcacagggcccaggtcacacttggcaaatggtagggtgcatgggcaaggttcctgggaccatgctctaatgcccaggctttcctacataattcaggccccttccactacctggttttgcctacatcctcaatgatttgcaaagggtcctgggttttccccctgcctgtgaagtaaatatggatggcagctgcttgaacttgccccagttctgtgcctggcccacagccaaaggaactgcatagaatgggctccatgcccaggaaggctgtttccagcttcaggcttctgttctggaggctcaggtggaaacatctgtccacccagatgggctttcatcagatactctagggctgttgaactgagggcagttctccactgcatcattgtggatcatcctagcattgcatgacaagtaggggaatcacttgaaactaagtaggctgtgcttagcatgcattacaatgcctggacatgtcttgatctgtcggaagagtacttcttattcaccagagtaaaggtaagttaattatgatgcctgttgtgggggataggatcccactgtttgctctggctggtctggaagttactatacctccatgtcaggtttcatgatgccttttctaacaagtgcagttcaagcttgttcaaagaaacatgtttgatcttactacaccaaccaactcacaagtagagttatatacatctcttcctccttagaagatgattatggaaggaaggaaggaagcatgcaggcagggactgagcacattcttggctttagatgatactgccgcagttccttccagagtaccactagctgtttcctgccatcaatacaatagagcatgcccctctccgccagactcttcagggtgacttggaatttactaagagcaactggtacaaacataggccccctgctgctccctctttctaacctgctctgttctaaccactagattcaagacagctactatctgagaccctttctcaggcccaaata

SEQ ID NO: 27277 - DNA, 1706 bp, Mus musculus
cggaaacccagacaatccatctgctttttccagctatcagaattggcctggtcccaaaagacctctctcagctgctcaggacagggcttggcatgacagatgatattgtgactgtccacacagagagaacagagttgctggaacttacatattttctgttcccaacagatctgccatggaggaatctggtacctccagatgggtgcacatgaatccatggggagctcttcctgacgtcccaccaccctttgtatagacacctacccgactgaatgtgttccgtcactcagctttgcttcggacacctccatgtcctcttcccccctctgtatgtgtgttgacctaaactatatgccataaacctcaagttactttattttggggtgaagactcagtttctgtttcagatctaagtttccaatgaagtatattgtcaagtgttaacagcacaagcgatgggttaacttagaatagaaattggtgttggggggggatttgcaagaatttttattttattttattttaattttttggatgaaaattttatctattatatattaagacattctgctgctgtgctgcaaagccatagcagattcgagatgctgttgagggctggatttttctctagtgagggaggtcctgttaaactgaaagccctacccaaactgaggtgggaaggaagcgggggagagagccttggcttctgacagtccttccaccttctgaaactagctgccttttaaagcagatcccttcactgctatgttggacactacagtatctgtccctgggttggcagagacttgaaagcctttgtgacctggcttaatttgtttttcatcctatggtttttctaatggattttctggacttttgtaatcttgtaactattcaagctccactttctaaattttaagaacttcagtggaaagtttaaattgaaggtgctgtttgtagactcaccacccaacggacgcccagccaccacggcaaatccttgagtgttctctaagaatacgatgctggtcatcacagcttcagcatctcctgggttttgatgcttggctctttgctgatcttggcttcctggcttttcctccttcagttccttctcaccctctgctgtccttgtgtagtgatttggtgagagaaagcttttgtcccctgccctctgcactacatatgcggttcaagttttattattgcaataaaagtgctttatgctggcttttctcagctctgtgtcatggaggttgcttacacatgccttatgtcccttttagcacagagattggtaggtattagtgtctgttcttgacaatgcagcagtgaacagcctttcccccttggccgtgatgtgcatgggggcattaggcgtaactcaggcacagcctggggccaagctgaagcagtcatggtccttctcacatcccttaatgtagagaagacttaacctgcctttaacagggagtcagctgcagacgcgttgcaagcagatgtttgaaggattacgaagggaggatgcagggatttaaatctttgtcctttattgaatagatatgcaaagactgccttggtattttcttatcccccagcctcattctgtaggtgccagtaatgtttcttttactgagagttaatgctgatcatgaggatgccccaaaataccttgacaaacaccttgtaaaattgctctggagctg

SEQ ID NO: 27278 - DNA, 1094 bp, Mus musculus
tcactcagtgtgtggtctgtgtgtccagcatttcccactctctgtcctcactgttcatgtgattgtagcatcgacattccccatggctgtacaatcatagcatggctatgtcatatttgttaatttataagttcatggatgcttggattgtttctccttgcttgttatattgaatgctgttaacattcatgtacaaagtgggttttgttattttgcgtgggcagtttttaagtcattgaatgtatctggaatggattttcagggtcccataataacacgttaaattttttgaggaactgccagtgtttcccaaaacagccacgctattttcataccagaggtagtgctccagtttctctgtatcctcaccaatccttgcttgtacccaaactagtgatgtcaagtcatatcttgtttgtattgtcccatttgcttttgttttttaatggaaaaatttgaccaagaccatgcagagcagagtccacagtagcttgccctgttggctttgataacagccacggggcagtggctatgaccccatggagttggggttgacttctgggctggctgtgatataagaaggtcttttctctgggggaaattcctgagaccttcggacatctaataagattcacagtatcattttcacttggtttgaaatctcatagctcatctagtggcttacaaatagaatcaaggtctacttctaaatcattgtcttttggtgctaaataagaccactcatactatttctaggctacaccggcccacatcccaccttctcttcttggcttgctgtcttttctattcttagagctggctgagttttgcattgcgtttctctcctcagtcatgagcttcaagccaacctccaatctaaaccacgagtctcctaagacctcaactccaggaatgtaccaagtattaaatggagctacattcctgttagagttcttacctgttgacacacagctggaaaacaggtaacacatctgtccaacctccctccagaacccagcttcctcatgactttcgtcttgtcattggtgacattttatcattgatccatagctgtcttctttgcaggaggaaaa

SEQ ID NO: 27279 - DNA, 1798 bp, Mus musculus
gttcttttatagatgagaagggcaaggccaggagactgggtgtttaagccatggtaaaatttagttccaggccatctggccctagagttcatgatcttaaactccatgtcactctgtgggcctcctccatacggggcatgtttcttgcgtactcagcctcattctccaattcattagaccctctttacattgcagacctaaccctgaccatcttcccccaccgggctacgatgacatgtacctgtgaaggcctcaagaatgtaacagctcagcctcccttttactctccaggagctgccaccactggccccatcagcgtcagtattcttgtgggcttggggcagaggattctgcccatgtgtttgcaggcctgctggggttgcatccccagcccttgtcagagccgaggtgcctgctgcagcaccccaccaagctgcatataggtcccacggagaaattagtgtgtctcaatcaccagctcctccccacttgcaaggaagactccggcaacatcagccctccacccgatgcagtcgcggtcacagcgctataagaacagaacgcattttggatgttattattaagaaccaaatgtcaatacagaatacatgttgccagtcttccacgctcctttttgttaatgcacaaactcttaagagtgtgatactgcataggactacgggattcctacagggcattcttctcaagcaccctcgagtcacaagttactcttgctcctgacatcactaagatgagccccacccaggctttctgggtggaagtgtgattggaatccatgagccacaaggatgatttcaccaaagcaggcacactagaaaaactgccatctcctcccaagggcatgctcaaccagttgctctgagcagcctgttgactctccctgggctgcagtggcctgtaagtagaggaataaacagaacagacctgtaggctagtttcatagtgaccctaaagaagtcctttctcttaggagcctagtaacgacctgtgaaatcagaggtgccttcactggagctctgtagtgagctgtgtggatgggaatagccctaggtactagagaagagaaaacgaaggtacgctgtgtctattacctgctcttcatgtcctcctgggactgacaagagcataggaacatgggtccagccaggaggaaggggagcctttgtctttggaagcctgtgtccaagctctcccaatctgtagaattatctagatatttgaagccccagctgacaggcactggcagtgctctacccctgtgccataaagctggaagagcacaatggcgtactgttccaggagacaccaaatcaagtaccaagcgcttcgttccatggccggcagcccaaccatgtgtggctccaggatagatggggagatagactggactgacaggaccagggccagtctcagggaggctgggcttggggctcaatccagcatgagcaggctccctagctgttgaaggatcccatgggtcaggcactgaccaccttgaaggtgtaggccattctgtgctctgaggccacagaccatgcagagacaaggacaagacgtccattgtgcatcaacttcatccttgagggctggcaggtggatgtttgggttctgttggtaactgggtacctgcaaaagagcttaggacactttgctcattaaagcatcccttttttatgcaaggaagcattaaaggaacagtggctagaattctccagataggtttgggaatgtagataacttggaccctgatttaaaggaaaaggtaaaagttgaaaca

SEQ ID NO: 27280 - DNA, 1132 bp, Mus musculus
ctgtttaaggcaaagtcccatgaccaaaaatcaaactacttaaacggtgcttatccaggtactcttgacttgtgtgctcacgcgcggcgggcgggagtgggggtggcactggtgggtggtacaggcctggcctggaatacccagcactctggagaccgaagcaagagaatgaaaagttcaagaaatccagccaggaatagtgacacacacctttaatcccagccttaaggagacagaggcaggcggatctctatgacttcaagtctgcacagtaagtgagtttcaggcaagccaggaaggggcaaacagtgagagttgtcttaacaaaccagaacggcgtgtacacacacatacacgaacacgttcattgcttcctgttcacccttccaaagtaacaggaaatacagagacttccttcttggacctcaagataccgagagtcacaaaccacggtgcatctcatgccttttggttcaatggaaacagaacctgctcattttttttttaacttaggttcattagtactctactgggggtgcccaattatttgtccacatttgaagatactaggagcaaaatgaaaactaaaatctggtgatcctctgcacaggcagaggggaaagaaagcagtgttgttatctaaggaataagttgcaaatctggcagccatgggtatcacaatctactacagagatatgaacacaaaggctgggcatggatcgcaatggcagtgtgatcgcgtgatgcatgccaaagttccgtcccaataccgttaaaaagaaaaaacagtttctggacattgtaaacagaaaagtcctccctttacatagccaggtgggcatgacccatcacacagatactctcaaatatctaatgaggaatgctcaaaaaagatgactggacaaggccattggtcacacaggacattctgaactcccctggcaattgagtgtccatcattgtcagctgactgtctttatccaggctcatatctttatgacaggtattcttgccctgaagtaggcatctgccctcctcaggaggctaagtgaccaggtgcagatttccttgatattcttggtaaaagccgccaggtcagcagatgttgtgataaacaccgcgaccaacctgg

SEQ ID NO: 27281 - DNA, 1601 bp, Mus musculus
gctcctgccagcacgagccctctggcattttgccagttctcaagcatagtgccatgttctcactctgtgacccttctctctaggcggaccctgacagtgtgccccccatcgacgtcctctggatcaaaggggcccagggtggcgactactactattcctttgggggctgccaccgctatgcagcctaccagcagctgcagagagagaccattcctgccaagctcgtgaggtccaccctttcagacctgaggatgtacctgggagcatccacaccagacttgcaatagcaacctcctgatagccccctgcccctctccacatcagcaccactacccggcgctcagaagacacatgcagcccccagtgggcagaagctgtagatgggatatgttctctttattcttaagggaggtctgcctcttggtgcctctgcactagctcccaggggctagctcccaggaatgagggggttcagttcttctgtctatggaaagatatcatggccttgaccctgaaggagtaccaggaaggaagaaaggagatggacttggagacaaggactctcattttaatctttatgatagcactatatgaactatgtactaggaagtaaaggaaaacccaggtcaccatggcttcagtgagagaagctggttatccatccccatagcctgaactctggaaccggcagctaacacagcactgactaacacagtattgtgtcaacagctcagtgaaggcagggcttcctctcgggagtcctttggccttgtcctccttgctccttacttcgtagtcgctgttgctgtgtttctaggaaccgtgtctgtgctcaaggaagaaacccactggaccaacttctgtcagaaaggaaaaccttgttcaaagtttcaggaccctgttctttgcttatttgcacatggtcaccttggtctgagctagccaccattgtcacccacagctgcaaagaaagcagaccttaggaaacactgtcacggctgagtgtgactgccttgttcatcccctggactggtactgtgttgcctgcagtaccattgggatcccatagcaagagagggagagggagatgttagttagcctttgctacgaaccaagctgtccccaagctcaacagctaaacaggtattcatttacccatgattctatgggttagctaagctcctttgagcagctcctctgatgtggcctggtcctgctcatgagcccatagtcaattgtcacctcagctggggctggttgggctggggtcaccttcaccattgtggcaagtgttggctgcattggcttggttactcttgttgcctctctcaaaggtcagttcaggagaattctcaagatggcctcagggttccaagagagagtagtagtgagagggcctggagcggagactcagctgttaagagcacctacatggtgattcacaacactgtcatccctgttccagatgacctgatgccctcttctaggctctgtgggcacagacaaacacattcgagcaaagcacccaattgcttttcttttgctttttgagacacggggtttttctgtgtaaccctggctgtcctggaactcactgtgca

SEQ ID NO: 27282 - DNA, 1162 bp, Mus musculus
actatcacccaggtacatttttttaaggtgacaaggtttcttcagcccctgtgccaagaatgtgtttctgttggtcagttcgttccttagattcaagggttgcaaatggaccgagctctcagcgggaggaaccacaaagaacattgggctatcgttcatcacagatgaatcttggtgggcaagagacagaattcctcactcccacacataagtactcccttttcataagtttgtcacagaagcacacaaggggccttggcatgtcagcctttaagtaacggttctcaaaacctagaagtcatggcatggtgtcttcgagagctgggtaccccagccctaaggatgtctcagaggcacaatgaggtggataatgaggtgggcattcagaggggcttctgcaaacctagagtccaggaggcaatgggtgcagcagtgaggtagctatgccacacagagaccatagtcacttgtcattttcaagcctctgttttcccagctccatggtgaggacaccagctttcccacccaccgagtgtcccagaaaatgaaattggaaggaataagatgcatcgtggtgctggattgattcttgggaccaaaaagagactagggagagaaagcacattagcaggtcaaccaggactcataccttccagtttgggtaatcttatctctggggtgggctggatgaagaatgtatgggaactctagtctctgcaacttttctgtaaatccaaagtcattctaaaataaaagtgtatttaattaacacacacaccatgcaatagccttagcccaacagttttggttgtgtttgatgggacttgcccttggagctccaggaacatgcatttctagaaagttctcagaaacagctgggggcccagaaacatatatttttagaccaagcagctgctgctcagggaaaagagccaggactctagtcagataacacagcttgctttttgtgctgggcccttggatttgtccaggggacttgagctctggaccacgacggcaggagagtggaggggggcatggctctccaagcagacaggtggcctctacaagccctaactttgtgaccagggtcaggagagcagaggatgttcttgcaaagtgcttttaggtgggataactgcaggacatgtatcccacctaa

SEQ ID NO: 27283 - DNA, 1212 bp, Mus musculus
ggtgctggaaattgtattataaatgtttattgaccattgactatgttcttaagctcttcttggagagagtgatggctcaggcctgtaaccccccccactccccagaaggccgaggcagaaggatcccaagtgtaaggcctgcagagcagcttagtgagaccctgtcttgaaaagtaaaaccagggcaggacttacagctcatcagtaggacgcttgcctgccacaaatgaggctgtgggttctgttcccagtaccacacacaaagagcttcactgtttaaatgtgccacctatgttagcttgtttgtcctgtaaagtaatatatgttacaggtggggaaactgaggctctgtccagcagggagtccccgatagagcaggagtgtctcgctctggacctggtcagaacctcttctcagggttcttggcagctgtattcaagttccactacatctgatctgagaccattccacagatgaagaaactgaggctcatggagataaactgtcccagcattcccagagaacccagttctctgaaagacctccagaattagggtaggaggtggtattccttgtctctgaggacctaagagtgaagcgggggagtattctgtcccctagctcccctctcccctagctctggctattcctgccagagtctgagaagcccaagccccaggctctgctgggaccatggcctcggccctcaaaatagccctgtctgtgaatgaacatactgtccctgggcccagagagcctccagggaggctgggatcacatctggatggatctgccccaacctgggctggggctggggcaggggcagaggcagagctcccagatggtcccctgaggtcaccaccagatcagccactcccagccaactgtgacctgaaaatggggaggcttgacaggtcatggggttctccccagctcttactaagcaacgggtgtatctgagccagttactcaacactggagtcctcaaaagagggagtgctaagctgggcataggctcaggcttgtaacccagcactcagatgaaggaaggcagaagccagaggatatggagttcaaagtcaacctaggctacatagctacataatgtcagaagtaaaggaagaagacagtgccagggctgtgagctctcagtgagggtctaacctatgtacaatctaagcatattggtgaaaagggcaaggctgaaggact

SEQ ID NO: 27284 - DNA, 1175 bp, Mus musculus
tctagttactacaaatcagacttgcttagtagacctgaggctaaaagtacaggacacatagccctcccctatgtcttcatctccagtcctaccctggcaagtttgtccttccctgactttgaaatatttggccttagtttgttactggaggaggatgtgtaacttgcagaaagaaggaaagggttggatatttacttagattggtttttattcatagttgcaaagttaggttactctatgggaactttcttcgcaacaaactaacctaccatacctactttattttggcttttatgggaaacatcagagaagcagatccttaaaggggatggaggactagcttctgggttgcatggaagttgggtaactaagtggcaatatttccacagtgtgctttttttggttcttttgctctttgttgctgtatgcttgcttttgtgttttgagactaggactcctgtagtccaggatggtcttgagtccaagtgcctcagccttcagaggtattggacatacaggtgtgatcctccgtactcagcttcttggtactggctttatccctgaaaataacattccgtgtgtgtgtgtgtgtgtgtgtgtgtgtgtctgcattcatgtgtgcctgcatttttgtctgtgggtgaacatgaaagccagaggtggctgtcaggtgtcttcagttgctctcctcctttttaaaagtatgtatctgtgtgggggtatgtgcacataagtgctggtgccccaggaagccagaagagggttggacacgttggagctggaattacaggcatttgtgacctgcccaacgtgggtggtgtgaactgaacttttatcctctacaagagcagtacctactcttagctaccaggctatctcttgagccccactaccttattttatcttactgacagtatctcactaattctggaactctatgaacagcctgtccctgggatcttcttgtttctgcttcccgaaacctatgctgggatttttgtacctgactttttatgtggacgctgaagattgaatttaggtctttatgcttgcatagcaagtactttaccagccctgatcataacatttttatatcatagagtcaacttacactaaagaaagagaaggctttcttagaaatttgatttaaagactcaacataaggtttaggttta

SEQ ID NO: 27285 - DNA, 1155 bp, Mus musculus
agaaatcggtggatctcttgagatttcaaggtcagcttggtctacatagtaagttccaggacagctagagctatgtagagagaccctgtctccaagggaaaaaaaaaagttgccagttggatttattccttccttggtctgtcagaattcactgagtgaccagggccatgtatcttgaacaagaatagtgttgactgcttaagcctaaaagttttttgtttcctaagatggaagatttcaaagtggcatgccttttagttgttacctaatggggacagacacccacacccacacaccacgggtaagcaggactaaaagagaagtgtaggccaaccaactttacttgaatctttttgttttgttttctttaggtgggtttgtttgtttgtttgttatatggtttcactacgtagaccaagctgaactcctggcagtcctgctgccgcctcttgagtactggaattcaggtataaaccatcaaacctggcccagtttcttccttttttcttatcatttactaacttcattcattcattcattcattcctttgtttacttatttgttttttgtttgtgatagtgtctcctgtagcacaagctggccttgaatttgctggtatgaagttcgttatgcctagcttatgccactggggatcaaacccatgcaaaacttcatgcaaacagtctaacagctgagcccgttccctgcttcctagctagctatttgaacaaggagattcatttaggattattaacaaaaagtggaagctgcttggattatagatagaatgttgtgtttttgagacaaaaatctcactgtaactgacttgcctagtcttgaattgagagagatctgcctcctgagttctgggattaaacgtttgtgggtagcaccatgctcaccattctttccacttgtttttttgtttgtattacatatctcttgtagcccaggctagtctcagattcactgtgtagctaagggtgataggcctgaatcttatgcttcattcttgggtttctttctgttctttgttcctcaacctcccaagtgctgggatggtaggcctgaatcttatgtctagtctcaaatgcccctattttatctgctcttttaacacggtggtcttaggagcttttctgagttgtttttatt

SEQ ID NO: 27286 - DNA, 1082 bp, Mus musculus
tgcctgagcagaggtggggaagtccaccctctcctcgatgcagcttgcgcctgtttgggaggggtgagaacacttcagaagcaccgtgtctgaaccgttgcttgtggatttagtagttgagtcataaaaaaaaattataggctgattttctttctttctttctttctttttttttttttttttttttttttttaaaacgtggacttttcataactcaggggattccctgaaaaaattacctgcaggtggaatatttcatggacaaaattttttctccccttccaaattcagtttatcaccactaaagaacaaagataaactggcctcagtcccagctgctgcgtttgggtggaaatttcatccccttcccacgttgctctttccacattgtacactcttgtggcttatatctcatgttcttctccagagattgtaaactgtagctcatcaggggagggggggggaggggggaggacccagtccatcctacaacactgttctgctggctggccacttcatctcttctctccaggactgcagccctggcttactccggctctggtggaggtgggtctgtcttatttacatcaagatgttaaaagtctacccaatgtgcagacagatccaaagcttttttttctgaacgaatcatgtcttactaacctaaccctaaatgattttaattttagttgagtttctatttgtgatactttccctttctgggctcctactttggtctttcccttttcgtctccagacatgctatgcttcatagctgctaggagagggaaggcaaaatctttttcagttttctttgacttggccattttgaagacagttagttagtgggcataatttattgctttttaaaaaagaaatattgtccatataagtttcatgctagcactcttatgagctaatgggtgatgtggccgcactgggttcattttaagctttgtcctttctcccccctgccttgccctttcttcacatgccatccagtgaggagccctgctctcagaattggaagtgtgttttttgagaggcaggagcagagccactatctccagtgaaccagagat

SEQ ID NO: 27287 - DNA, 1869 bp, Mus musculus
tttatacaaccctcatttgacccatggtactgggcagggcagagaggccttaaaaaaagcaccacaagccaaagcgtctctggggattaaggatcctttgccataaaactcattctgtgtctcagcattgcagggattggggataggaaaggcgccagtttttgtgtgtttgtgtgtgtataaagtggactttccactgtaatccagccacctaagtttatcaggtgcttcactgaggaagcctagttttttaagcacaatagcaaaacatcagctctgtattttctcctgttatttcattacagtagctgcctgtggggactaggaaaacaaatcttccaacatattttaaggcctaaaatcttagttccccattctcctacctttttagattcataagcatttctcacctggcatcatagataaaacataattgtttggggagttgaatttaattaacttacctaactttgtaacccatcttggctttagtaactttatcaaggtggtggctttagcgaatgtaatgataaaagtagaggatgctaatgcttttcttaacatttctcaaccatagagagagctaaaaggactgcagagtgagtttcttctttttggccacttgcagtgactatttattgtactcgattcttgtgtgccctagcgtgctatgagggtcaccatgttggatttgtgcagagctgaaagcaccaggtgtgccagagatgcagtttgtgattatgtttgcactggatcgtgatttgaacaagacacttagactgatgaattctttcttttgaggtggaaaggaaagttgtagatcaggactctacaccctgctcacagctcagaagtgtaggtgtgtctgaggctggtgtggaccgctgtggataactgggcctcctcacacatcaaacctgtgcaagagctgagggtaatgcagaggactctggtgtgccaccgaagagccctttaaataaatcgaagcttaaaagaaaaaaaggagtcattgcagaaatgtggagagttttaaaagatctgagtgggtggggggtagggagggtcagggtttacagagtaacaacttctgtgttgtaaattacctcatctgtacaccttgtattgggacactatttctcagcacttcctgtgtctgtattgcttagacggcgggatggatgccaatatgaaacagctgtgttggcagttactctgaaagtattttttaactttgttttgaagtgtgcccttcccccctttaagtttaaagtcagaattcccctccttgatttattggctgtaattgtattgtatttggtatgactaagacataactgtgctgggaagaagttgtgccatgaaggtctttaatttttttttttaaataaaaacatttaaatcaatgaaatgtccatgcagcctgagcaatatgcttctccaaccgacaccgtgtgtaataaaggatggtttagttttcataggatttgaacttaatacggggttggtggaaatgttaagtgggagaaatttaatattggtggaggaactctgaagttttggcactgaagtatagtggaagggatcgtcgtggtcctattcattcatacccctgtcacacacataccaggtacatcacatgttttctgacttagtcacatctgttagaattagggccactctgcttgggagagaagggagaatgtatgtcaagtggctgacatttgtctaattcctctggtcctctgatatggaaggttcgtctctggtcttcagtttatcgacaattcacagtgctttgtggcagaggcccttctctcctcaggacctctgtgtgttttaaggaaggaggaactaaatattgtctgaggc

SEQ ID NO: 27288 - DNA, 1986 bp, Mus musculus
gcaggaagtcctggactgtgactgtgacatggcctctgtccaccacctgttgtcccagatccctcaggacctgccctatgagacgctcatcagcagagcaggagacctctttgttcagtttcccccttctgaacttgcaagggaggcagctgctcagcaggaggctgagaggtgaggtgggcgagctgtggctgctgcagtggggcagttggaaatcagaccatccctggagtctacttgtctagagggtacggggttccacactgcagcgggttcttctctgcaggccatatagatctttaccagagagcatgctgagcaatggcctgctcagtgtcttctgcccctctgtgctaccttctgcttctttccacagaacggcagcctctactttcaaagactttgagctggcatcaactcagcagaggccagacatggtgctgcggcagcggtttcggggacttctgaggcctgaggctcgaacaaaagatgtcctgaccaaaccaaggaccaaccgctttgtgaaactggcagtgatggggctgacggtggccctcggagcagcagcactagcagtggtgaagagcgccctggagtgggcccctaagttccagctgcagctgttcccctaaactcagctcaagcagctactccctcacccagggcaccaagctctccccatttccagaaggagggtaaagttgctgtgattaaagggtttctgtcaggggtgttctgtctgccacccttggcagcttgttttttggctttgatggctggtggcagagctgcctgacactggcttgccggacccgagtgctctctgcacctctcctgttgaaaagtggctctggagcacctggttacccaagtcactgcctaaaaagttgggcccagagatgccctccttatagcaccatgtgtcttgagtatctttagacaaagcaggcaggatggtccagccttgggatgaaagtgaggggagaaaacattagcctgggagccagctggaccctcttaaaagcggccatattagctggtcagaatcagagatagactcaagctgggttctaattaaatttttatgatcccagcctagagctcatgtgcagaggaatgttaatcaccaggatgatgttgcccgtgtctccctgttctttctcctctacaagccacatgacaaaacctacaaagacatttttaatactgtttttatgattgtatactacacctaacatagcaagtagtcttcactttaaaaaaaaaaattacttatgtgtgtgtacaggtgcccacagaggccataggtgggcttcaggtttcctggagcctgtgtgggtgctgggatctgaatgccaggcctctggtgaagcagcagtaagtgctcttaactgctgagccatttctccagcctctttcatagttccttcatgagagaagctgtcagagcattgagtttctactgggctaagttatcccttttttggaggggaatagaacccagggccttgcacatggaagcaaaagtgttctaccactgcgctgccccagctttggtttttttcgtttttgtctttttccatttttagttttgagatagggtctacctaaattatccaggctggccttgaacttttgatcctcctgccatggctcccaattatcctggatgacaggattgcacctgagatactctccctgctcagtttagccaaagttgtttgtgaacactcccagaccccacggtgccacttcctgactcgctttccttattttcctcttcttacccaccttggcctgtctttgtgtcgatctcttccgctgctggtctcaggctgggaatgtccttggaaacttgccagcacgtagacagggtttggcaggaaccgcacaccaccagcctcactgtacctgggctcctccaggagaggtgtacaggatccatgggatcacttggtcttcctaggatggctttgttaaaagtga

SEQ ID NO: 27289 - DNA, 1429 bp, Mus musculus
gtagacaagtgctctgtggatgcgagtcaccggctgtgagtgcctgggtggtggcagtcagtactggtggatgcagaggcactgtacattttccttctgcctgggtgctggtcctcctacagctgaatccctttctctttctggcctggggaagaccatggagtttaagggtgctggagaggttgggatgggggttaaaggccttcatggctacctcactgcacctttagatgggccctgccttgggctgatagagtgactttggggcatagcctgttttcaccaacctgatatcctcttttctctatcctttagggcccaggggacaccagtggtggctgccgctgccgggtcaatgggattccatgccacccaagctgtcaaaactgccactaagtcgacgatggtggctctcatactgacccagccccacatgtatagcagtgaacagcagggctaggcaagggactggcctggtttggccccatacctttaggcttggtaagggagaaagcccgagctgtactgcagtctgattgctgtgttacaaggacccagctgagctgatgtcattcgcactgcctctgttgcttctggctgaccagacctcatggccctgcactagacacccgacccttactagccaccagccttaattaaacacggccttggcctaaggcctggctggctagtgctctgagtgactctattttccctgagcttgctccctgaggacccaccacagcctcatcctttgccttgctggctttctgggcacgtcttaaagctgatgtgaatccatccagggcctaggtagattggtaagtcaggaaacagcccatggggttcagctctgcatcctcctctttaagtgaattaaagtggttttcccagaagggaaaggtgtcatgcttgagggaacaatgtcctaggctgggtaccacacaggcaggatggtgagctctggagagcttggaacagaacctgaaggtgatctgttggttctggtggttgggggaataaggatggctcagctctgggacccctgtagcagacctggcaccaccatgcccaactcttgggacaaggttgcttgggcattattagcccagactggggaaatgtatcgagaagggcttgaagcttagagggatgctagggagggagggaggtcaaggcagcagctggaggctgggaaggaaggcttggctgctccctctgggtgtctaaggagaagagcagaggcgtttctgaaagtgctgaagccaagcagggaggaggtcctttctgcttgaagagcagggccatgctgtgatgtctggcctggtgctttctctccactccggcccattcagctcctctgagattattaccgtcttcccacaatgtgagccttaacagtaagcccagcacggggtcaaaactcact

SEQ ID NO: 27290 - DNA, 1185 bp, Mus musculus
tgcatccctggttgagagaggatcacggccgagtctctcctccacagtctgaccgaagggagatggaccaggtggtcccagatgggccacagctggaggaggctgaggaaggggaggtggggctgtacggctagggccaccttactggcccctcagctccaaggtgtgagttgagtacctgagtctcagctttctcctgactttttgggccaagctaaaccttaagtgcctttctggaggaagaaacagccggcgtgccttattcgttcctgtgcctagtggggtgatgctccctgagtgccacgccctgctctaggtgctgtgaacagcaaaggaaaaagagggagaaatataccttgctggccaagttgccacagtgccgcatgctctccggccagcccctgccttgggcacgtttcctaccggggctgtcttctctggtgctggttcatgggacagtcccttttatcagtgccccagctgccttctgtcttgtgcctttaaacaaaggaaacatctctgtgccaaagaccaaagtcctcactcaccatgtgcctcaggaccacaaatcaggccgggctgggattgtggcctccaggcaggagaacctgtttgaagaagacttggctgtgggattcaagccaaaaggatgagactccaataaagaggcatctgactcaaggaatagtctggaataaggatccgggtctgtttaccctggtagcctccggctgaagcaccaaagttggagggggaggaccaggcagggtctgtcctactgcctacagacaatctcaggccctgttctggggacttttagtacccaggcccacagtcagtttgatgactttggtctggttaagtgtgtattttcatcatgtgcccaataaaagagagctgtgtggtttgatatgtgaaacatccttggtgactttctcttcttcaacgctggccccaccatgaaagccaggtacagctcagcccctaccaagtggcttgtgaagaaattcctctactgatcttcctgtacatgccttttcttctagagaccttgggtctcaagtggggagctttctaagctgagcactggggtatggctcacgtgtaagcacacacctaacatattcagggttatgggttctgtccttggcccaaaagggcatcagtttaaactggaagaaacat

SEQ ID NO: 27291 - DNA, 1352 bp, Mus musculus
tggttggatcaatggcctggagttcaggatgtctttggtgaaggtccagagatgaaagtcacagctgtgagacctggtgagacttgggctatgggaccagttgctgtgactggaaggagctgggaaggagaagaccaggagagtgggcagcgtggccaccaaaggagagaaagaaaagcgggttgggctctcgccaggcatcctcgttggagtgacatcgtctttaaaccccgcgtggcaatccctgacgcaccgccgtgatgcccagggaagacagggtgacctggaagtccaactacttcctcaagatcatccaacttttggatgattacccaaaatgcttcattgtgggagcagacaacgtgggctccaagcagatgcagcagatccgcatgtccctccgagggaaggccgtggtgctgatgggcaagaacaccatgatgcacaaggccatcaggggccacctggagaacaacccagctctggagaaactgctgcctcacatccgggaacgtgggcttcgtgttcaccaaggaggacctcactgagattcgggacatgctgttggccaataaggtgccagctgctgctcgggccggtgccatcgccccgtgtgaggtcactgtgccagctcagaacactggtctggggcccgagaagacctccttcttccaggctttgggcatcaccatgaaaatctccagaggcaccattgaaattctgagtgatgtgcagctgataatgactggagacaaggtgggagccagcgaggccacactgcagaacatgcgaaacatctccccctcctcctttgggctgatcatccagcaggtgtttgacaacggcagcatttataaccctgaagtgctcgacatcacagagcagtccctgcactctcgcttcctggagggtgtccgaaacgtggccagtgtgtgtctgcagatcgggtacccgactgttgcctcggtgccacactccatcatcaatgggtacaagcgtgtcctggcattgtctatggagactgagtacaccttcccacttgctgaaaaggtcaaggccttcctggctgatccatctgcatttgcggctgctgcccctgcagctgctgccaccactgctgcccctgtggctgctgcagcccctgccaaagctgaagcaaaggaagagtcggaggaatcagatgaggatatgggattgggtctcttcgactaatcccgccaaagcaaccaagtcagcctgcttaatttgagaaagatggaaataaaggcttacttctcttaaaaaaaaaaaaagaaagaaaagcgggttggaattaacagtgccaaaaggaacggtgttagtctctttggtga

SEQ ID NO: 27292 - DNA, 2946 bp, Mus musculus
ccccccggaggcggcggtggtggcagtcggctgaaacccgggccacagctgccgggccgcgggggccgccgagcgtcgggaggacctctggggggcggcgcggcggcgccggaggacgacgacgaagacgaagaggaggagctgctggaagtacgcctgctggagacccccgggcgcgagctgtggaggatggtcccggcggggcgcgccgcccgcggacccgcggagcgcgcgcaggggccatccggcgagggggcggccgccagcgccgcctctccgaccctgtccgaggacgaggagccggaggaagaggaggaggaggcggctacagcagaggagggcgaagaggagacggtggtatctggggaggagccactgggctttctgtccaggatgcccccgggccccgccggcctggactgcagtgccctggaccgtgacccggacctgctgcccccttcgggcacgtcacatttcgaattcccggactattgcacccccgaggttaccgagatgatcgcaggggactggcgctcgtctagtatcgccgacctggttttcacctactgagcccaccgtcagcggggcgcgcacgcccccaaaccagctgtttacatacaggaatcaggtattggggcccctcggaggccgaggctggcaccccatctcccgcgcagcctcccccctcctagttgtgcccatccccccacaaatccagacatacccctcccccgcagacacaccccaaggcagcccaacccccactttctccctgacatctaagcccctccccattcagtcctgtcccgcgtagccaccagcagccagcccccctcggatacacctcgttcctcctacataccttaacccctccccctcactttgcacacgcccctcctcgtgtccggacggcacgccccttcgctccagaatccctccgccctctcctgggcctgccttggtagttaagggggcgctgcagtctagcggttcagcgctcctcccagtcccctcctcttctgggggggaagggagccatccctccccccctggatctcaaggccccacccctcagcttgaaccatccctccccccccttcttgcgcatgcttgatgcttcttggagggggcaggtcccagttaagctgcaggcctctgttgccaactccgaaagggagggggcgattatagagtgatctaagaaatcctttgatcccgaagcctgtagcttactctcaacccaaaggggcgtcactgccttaatgggaggcgcactcaaagggagagatagaaactagctagccctaaactctgcaagtgtcaaccccttttctatgaaggggtcacccacgcccaccaccaccctccaccgcgtgactgcctttacagcccatcttggtcgccggaaacttgatttccccaagtgggaatttagaattcggtctttggaaatccaccaagatgggattgtccaagagaactcagaaccaagacacctaccagtctggggacagagttcctgctgccccctcaatccccctcctcgggaagcgccctatcagctcagggcatcctctctgcctgggctcctccctaagtccatcaccccttcctatcactcaaatccagtctcagcaaccacaactgcagtattcagtgggagaaactgaagcacgttgttgctagggtttaggacaggcataccagcagccgggtggcaagaatgaggaccatgtctaaacaaacttggcttgaggagagaccaggccaggggacggtggcagagctagtagtggacttgggtgctttgcacctcggtctgcccttgtgagaaatggggtggcactgctgtagttaggaagctgtgttgagattaggttgccaagtctgctccactggtctcccgctccagccccgcccctccagcctccccatcctccctctgccctcactacctgtatctcaccggcgtgtgtccaccctctgggtggttcacacacactcattcacacacacacaaatctcaggaacaaacggtcccagagtcctcctcgacccctgccctgggtctctgcaggtctctgccccacgcgttcccttcgctgacaacgccaccagctgcctcctttaaagcttggtgctccggctctgggcctttcttgcgctctttctctatttctctttctgttttcttcctttttttttttctttttttcttttttaagaaaacaaaacaaaaaaaaagacaatgaaaaaaaaaaaaacggaaaacgtcatgtgagtgaagagatgtcactgtctgtggtctttggagaactagtctcgtagctgaggggaggggattccctcctctggggcgctggcacccacagcaggactcgccagtctgatgccaggactgaataaagtgtatttgccccgaccttgccctgtggttctgcatgtgtacttctcaccctggccagcttcaaagtgcctagagtatgggctggtgcagggagaacgggttctctttacccctggccagcttcaaagtgcctagagtatgggctggtgcagggagagcgggttctctttaggcctctgttatcctctatctcaggaatccctgccttcattaagaatggcaaactcatcttcacagtggctaagcatcgtaactgggaggactggggtgggtgctgatgtcacagtgcaagggtgcaagcctctgtagacagccatatattccaagagatgcaggaaaccagtcattgtgcttgttaagtctcattaggtcagacgagacaagcatgcatgcaggcaggactgatcatccggggtcaattccactgtttaataaaggattgggaagcaaaattggtagctttgctcagagcctatgttctgagcagctctacagtgtgtgtcttctaaggatcaacatggtattttcagtgggaaacc

SEQ ID NO: 27293 - DNA, 1543 bp, Mus musculus
cccagtgtcccaaagcagttcacaattccgtgacagctcagctcaccagcgtggcggggcactgaaggcgcgactgcctgccagggtgaatacactgccagcttacccctcccttaagtgccaaaactttttttttaacctttttttttttaatcgttttgaatggagatatttctaaaacctaccagagacgttctctctatgccttttttaaaccgcgtgtgctcctttttggcatgtttgaaatggtgaatttttgcccgtaagaactattcagaaccattgcatacagatatattttttttctcccggtttgtatttgtttttggtactttcgtctactcccctccccactctactttttattttactacctccctcctcatacatttaatccttaaaaggttttagccctttgggccgccttggtcattatgcctccagcccagggtactgggcccaacgcgggatagacactcttatcaagtctttcattgaatcaaaacggtatcgactggcttctgtcaaaagtgtctaccttttgcaactctctgctgggccctttttatttgctgcttctctgtggtatcagactttgtgaaaacagtgttgctagaagtgtgtattctgaataagctctgaatggtggccaagggcctctcgtggcaaaaaaaaaaaaaaaaaaaaatgtccctccattgtgacagctccatgtggtggctaagaagccgagtttctacaagatcacagagcctaggcttccctgctggaaaagacccaagaggtggtttttgttgagtttgggaggcgggttgcttttggttttgtgttttgagacagggtctcagtgtgtctcccgtaggccggcttggaccggctgcattcagagaacaggctagctgcaaacgtgcagtaactctccctcccgactcttgcctttgcctccccggacggtgttttaaactaaccttttggttttccagcagataaagtgaacccagagaagttaaattacagggacaaagtacacagcgcggtgcctcagatagcccacagtagagtcccctgaccccaagcccggtgctcatcccactacctctcacacttcacaacaatctcctcgacactgctgggcccaaagtccgctctccaccgtgcggaccccagcagtgtggagaaatcatcccgaaagagcccagaaagctcgccctgctgcttgggagctagggaaggaaggggccaggagcactccaggctgcttgcatcagccctcggagtaccacatcttgaatgttccagggccatccctttccactatcactgtcaccagtgagaaacggttcccctcagtaaagaaacttagcagacgtttacatttgcacctctgcctcagccactaggaaccctagagaagctcacccacaacgtttaacctctgaccctcaggagaaaggtggttctaacccagaatcacgagtgagtggtaaaccagaaagcgttcttggggaaacaggccaggccaggccagggcctgggtcaatga

SEQ ID NO: 27294 - DNA, 1199 bp, Mus musculus
atttatttatgtattttatgtatatgagtacacattgctctcttcagacacaccagatggatcccattacagatcgttgtgagtcaccatgtggttcctgggaattgaactcaggacctcaggaagagcaatcagtgctctgagtagtcagtgcactgagccatctctccaaccccatttagaatttctttctttcttttcttatttctttttggtttttcaagacagggtttctctgtatagccctggctgtcctggaactcactctgtagaccaggctggcctcgaactcagaaatcctcctgcctctgcctcccaagtgctgggattaaaggcatgtgccaccaccgccaggcccatttagaatttctacctcattactcccacctgtgggtcctacttgataagctggcagttctggagggtgggaccagtttacccatcctctctcctcccacactgagggcccaaaggcagcgagtgataaaggggactgtgggaccagagagccgctgtgctctagtcctgacacctcctcggatcgctcctcgaatgctttcctacaaacacgcctcctcagtaaaagcagcagcacctgtaggtctcagaggactgtctgctcccgcctttcttgttctgtctcttctgttcctactggctgcctctatgtcccaaacatataatagacctcaccaccagggggcctttaccctgcctctctctacctagcctctttgactgagcttacatctggtcatccgtcataatggacaacacttcctcagggaagccctctggactaagcccctgattggccatccaaataccacttggcttctttattggtacccctctgtacgctggtttactagactggccatctggttaacgttccttttcctaggccagactttcagattcacaataccagagttaactatcctagtcggctatctcattggctgtgccccagagcctgggacatggttggtatgcagatttattggttgaatgaatatcgttgctgttactgtttccctaaatccttcctctgacatttcagggtgtgagtggaggtacacccctcagatctgtcttcagaaggcttgttcaagtgccaggagtggcggagcacgtttgtgatcccagcctttgggaggtggaaacagaaggatcggaagttcaaggccctcctcagc

SEQ ID NO: 27295 - DNA, 1623 bp, Mus musculus
caaccgctggttcctgacgggcatgactgtggctggtgtggttctgctgggctcactcttcagtcggaagtgaccagacactgaccgtccactcacctctcacctcccaccctgcccccaccacaactctctcttcagccaccattgctaccaggagaaccactacatgcaactcacgccccttgccctatcacagggttgggcctagacggagtcccctgcaattagctttctaggatctaccacacttctgtgaaagccaccttccccccacatctcagttctcttggcctcaaaactcacaaggttttcccctaaaccagctccttggaggctggcaggagcagagaggggtgtgtgagggaggagagcctgtcttgttggtgggaccctaattacccctgagcctctcgggaatgcttttccagcagggagctcttcccctgaaggagactagcttgccttggttttgatgtgtgtggcctcagacgtgatcatttcccatcccgctgtgtctctgggtctccctcctccccatctccaccccccaagagccattgagtgaggtgcttttagcccttttgactaattagaaattcaggctgcttgggataatgagacaaggaccagaacctcctccccacctgtggcctggccaaaacccccacttgtggtctgaatgttctcctgaggcctctggctagagtctagccccacccagggggaggggcttagctgctgaaagtccaccttgctagagctagggtggctcttgcagcttagcaccccccaagatccttgtccacccctcccctggctcccatgaccatgactgagggaccaatgggcccaagataggtgccccagagctgttaatgacttcagctgcctcacttcctgcaagattggcctgtggcatctttgccttgggtgttggccacagggtcaagggactctggcctcagcccagaagtgaggggaagctatacagagcagctgtgggaaccccaggggcttccctacctcaggcaggaagggcaggaagaagagcctggagcccaggcgagggggacggcaagggcctgtctttgtgctctgccccacctagcctgggcagcagggctgccaaggtcagaatggcctggctaggagcccttcaggcctctctctcctctgtccacccttggcctgtctcatccctgtgggtcccagctcagctctggccaccccgggctctctgctgtacatattcgagactagtttttattccttgtgaagatgatatactatttttgttaagcgtgtctgtatttatgtgtgaggagctgctggcttgctgtgcgcgtgcccgtggagagctggtgcccagagactgacagcctgatgctccctccctgcccttgcctggggaagcccaccaggggttctggcttctgaggggcacctgtccctcctctcccctcaccctacacttgttccagctctttgaaatagtttgtgtgaaggtgaaagtgcagttcagtaataaatggtgtctgtgactctgtgaaccacagccttggctctgcgccgcatgagtaagggggaaactgctgggctctggctctgctgcctgggatgggg

SEQ ID NO: 27296 - DNA, 1197 bp, Mus musculus
gatgtgatgttcttctgagagcatttccacagtatgcattaagatcccccaactcagcatttttacctcattagaattattttagagaaaaataaccaatatgtacagaatattagctacaagaatttcttctcaaaagttttttggttttttgtttttgttttttgttttcatttgagacagggttcttctatgtagctcaggctgtcctggaactcactctgtatgtagttcaggctgactttgaattcacagagcctcccaagtgctgagattaaaggcatgtaccaccactgcccagttagaagtatttttaaagtggaaatattgagaaaaattccaaaaaaagggggtataaataatttctacatatcattaggtaatggtatatgctcaaatttattgccatggagtatttgtagaatatatgaaacagattcaagatgtgctgggactgtagctatatctgactttaatgtgcgtttactcactatgtagctctgtctgccttagaacttgttgtatatatagatcaggctgactttgaacttgtataaagtcatccttcctttgcttcctgggtggtgggattctaggcataagctaccagaccttgttttgtgtgtgtgtgtgtgtgtgtgtgtgtgtgtgtgtgtgtgtgtgtgtgttttgagggtcttaatgtaactcagactagtcttaaactcccatccctttgactctacctcctgagtggtgctggtctatgctattacacctggctctggtttagtttttatataagggtttttggtttaaatgaacatagattttataaaatgaatttttacaggcatttagagaaagttttttttttgtgtgtgtgtgtttcatttttgaggcatgtttcgctatatagctctggcttggtctggaactcagtacgtagactatgctggattcaaactccaaacctgcttttgtcttctattgtgtgattaaagacatgtttcaccacacccagcttaaagaaagtttaaaaaatattcttagctgggtagtggtggtgcatgtctttagtcccagcagttggaaggcagaggcagttggagctctataaatttgaggccaactgggtctacagagtgagttccaggacagacctacacagagaaaccctgtcttgaaaaaaccaaaaccaaaaccaaaaaacaaacc

SEQ ID NO: 27297 - DNA, 2446 bp, Mus musculus
tgtgtgtgtgtttacgtgtttacacattcatgcactgaacaacagtagccacctgcttgggcttcatacttctccttcccctgaatttgtagttgggatctataaatcctgtccccacccttctcccctaacagacagaacaactgtgcacatagatgtgtgcagtccacctcaggaaccctgtttcttattctacaggtgcacaaggcaaatccaatacggaagtacgcagcagtggaggtgaaatctagcgagctgcctctgactgtgccggtgtctcctaagttctccactcggttccagtagaagctgcatctatatcacaagcatggagcacgcgtcttcagactcacccgccatgtgtggaaacacacctgataactaatggatgccgggtgttttgaagatgactctacacagcaactttgaagctaatgagcctccactcatttagactttaaccagacttcttgtagttatttccttcagacattagccggccctttcctgttggtcttaacgctggctaggatttcaagaattcgttttggcatagtctacttttcacctaatccccccttattaccccttatatatgtattttaagcataaaataaaggcagtcaattcctgggttgtggtttcagtcacagtgtaagtgagaagcagccagtctattggattccttctctgttcaaaatgcgtttataaaggaaccctgtgctgcgaggtaggaagggaacctctgtaatggctccaaggaagactgcgcagactccggaagaccttacagagctgctgttgtagcatgttctttattgttggtgctgacaatgggatgccacagcctatagtttccaacctcacttggataactttttttttaaggtcacaagaatttatttaagctcactgttttctggaatccagtccatcctggagggggtggtgagatgatactgttcagactgtgtgacagattggcaccttcaaagacctctctccctgttggcttacatactccagttgagccttgcaggcaaaagtcctacaacttcccaaggcagtgccaggctatggaccaagaaacactagcctatggtgggcattttatacctacgtgatagcattccacctgtgggtgctataggctcacggttattgcccagtgcaaaggcatgtatttcaacttaagaagaatctgtaatgtaattttctttctgagatttcttgattttatatatttggtttttagaggcgaggtttctatgtagctcttgttgtcctagaacgtgatttgtagaccagagttgaccttgaatgaattttttttttttacctgcatgtatgcatgtggaattcttacctaccctgtgccagtggatgtctgtggagtgtgtcagatgccctgggattggagttacagatggttgtattgggaaaccctgctcataatgtcagcttttgacattaccagaaagcctagactgaggtcggtgcaaaatggtggattcctttcgtcagcaaggtttccttttctctacctgagggatcccggaccacacacctgtggaatatcacatagccttggttagatttcaggtccgacttcttttctacttacacgaacccgttggagtagcaccggagactgctggatgtcggagtgcctctgtgtgtgtgatggtttgtatattcttggaccagggagaggcaccatttggaggtgtggccttgtttgaataggtgtggcctggttggagtaggtgtgtcactgtaggttgacttcctagttgcctggaagtcagtcttccactagtagcctttggatgaagatgtagaactctcagctctgcctggatactgccctgttcccaccttgataatggactgaacctctgagcctgtaagccagccccaattaaatgttgtttataagacttgccttggtcatggtgtctgttcacagcagtaaaaccctaactaagacagtgtgctaacaaggcatctcagtaccctagccttcagccagtgacctttgcccaccctgggtattcctacccacttcccccaaacagtataacacttgattcaccccaaagaaaattgatctgtcttcccgatactgatcccagaatgtccctttcgggccaacgactccagggaggaccaaagctgtgagaccccgtgtgggttctcagaactaatcctgggtcctctgcaagagacattcattttgtgactaggaagtcctcagcattgtatgtgacattaagcctatttttatattcgttttttgttcttgttcatgcagtgaccacttttaaaatttattttatataagcctttgtaaattcagctggaagtaacaaagccagatattgtttcttacaggatgtgtgtatgatcttggtcctggagacccacaaagcagtacaaagagcac

SEQ ID NO: 27298 - DNA, 1164 bp, Mus musculus
ttttgttcttaaaactgggtctcaccgtgcagcgcaaactggccttgagtgcatgggtcctcttgtttctgccttttcatatgctaggagtcaattctcagcctgacttactaggcaagtgctctaccctgagctctgtcaccagccggcctttgggatcagagacagatcacccaccactccacactggtgattttttggcttactgaaaaagtcatggcccgtgacttggcacatgtagcaatgctaaagtatgaacactgaatgtaggcaccatcctgccttcctgtgtgtgtcacaagcacagctcagctctccatggctcttcaggatcacactctgttcctctcgccagcatggtgcctggcccatggctggtgttcactatgtgctggtttctctagcgtgtttatcatgtgcttgatgaagtgatgggtgagtggaaggggaaggcattggaatgcttgggtttctaaagtaatagatgcctgaatgatgagcaggtggaaggagccactgttggccatgctgcctgattgagtggagaggggtccatggatgtgtggggtgaatgtagagagccagctgctgtttggatggagggaattagactcagatccttctctctctccctcccccatgtacataactttttattcctgaaggcccttgggaaagccagggccctgggtgagtcttgagatagctataagccacagtcaccttctgtgctcccagcttccactcaaccctgatagcaggtggactttgagacccttgcagagtagccctgcctgggggaattgtactggtcactgtgcgagcagactgggtctctgtctctcacagacctcaaaacaggcgagaagagttcatgtaccctacccgagggtgccaactccttaccccaagaaattgaccccactaaggagaatcagctgtacttcacctactctgtgcactgggaggtgagacagaacacctgctctggcctggggaggagggcttgctctgggctgggctcctctgtccaataggagacctgacgctgcttcctcatgcctgccaggaaagtgacatcaaatgggcctctcgatgggacacttacctaaccatgagtgatgtgcagatccactggttttccatcattaactctgtcgtggt

SEQ ID NO: 27299 - DNA, 1223 bp, Mus musculus
ggttataaacaccatgaccaaaagcagtgtggggagaaaagggttttttggcttacacttccacatcatagtgccatcattgaaggaagtcagaagagaaactctaacagagcaggaaccaggaagtaggagttgatcaagaggccatggaagaatgctgtgcagctgggtctcatggaggcattttctcaattgaagatccctcctctcagatgactctaacttgtgtcaagttgatgtaaaactaggtagcacgcacggggtctgcagtttgccacagccaccgctgcctggcattgaccatccatctccctttctctgccttcgccccagctggacatcgtggagttcatcccttccctcctctactttggctacaccaccctcatggtcctgtccttctggctgctcacagggaccatcggcttctacgcagcctacatgtttgtccgcaagatatatgctgctgtgaagatagactgagtgggtggaccaacgctgggcccactggatcctcgacaggaagccaccctgcgtggggactgcaggcacacaaaataaaataactcgtgctcatttggaatgtaactcctggcacagtgttcctagacccccaggctgcatgggggacaggagggcctgtagataacccttccatttccttcatctcatccagtctgtagggatacatttttctgtggttggttttcttcagctaagagtcgctgtcagcaggagctttctgacctgttaattcaggttctttttggtttaggttgggttttttgttgttgtttttcggttttggggttttctttcttcttcttcttctttttttttttttttcaaaaaaaaaaaaatgcaaatccgggatggataaatgtagggttttggtcactgtccccatcggctcctcagagttgttggccaccctaccactaactggaagaggaaacgctggggctgcagtgagggctccaagcttctcagtgccaaccacgccctgccagcccctcctcccattctcttccccagcctgccctctgccgccccgaacagtcaggtctttggtcatcgttttaactgggaacacttggtcactacaaggacatgtcctggttccctgggacagcaggatcccctcctcaaagcagccagagtttactgaacaccaaggaagaagtgagacctcagtgactgttctcgtgccaagaagccctggg

SEQ ID NO: 27300 - DNA, 1106 bp, Mus musculus
gctctctctcctcacagcccttggccccagcatttattcttgggtcctttagccaaacccattccctcttcctcccatgcaagttcttttgggaacacccagaaaacttctctgagaagaaaaatggaaggtaagttgagttgctcctttcccagttcctaggaataggcaagaagccagtctccccaggttggaagaggatcatgggcctggcctagctcctccgccctggcctagcccagcaaaccctgggcgagtcacagagtttgctcttaagtagcaagagaccaaactcaccttgggtgtaggggtcagtagcagccactcgcccttgctccagtcctttgggagcctgtcaggagacaaagctcaggatgctgcttgtgctaggaacacaccctgccctcactgccccacctcctggggccccaccgccatcgtcagtcaaatcagtgcacctctcaatctgcctcgcagtgacttcgcagcactgagtggcatccaccaggaatcaggctggagaaatgggagcccagagagtggagagtgattgggagttacttgttcattcaaatcttgcacccccccccccaaggttctcattgttggagagggtgggggaaaggttcaaacattgtcaatttttctgactttttaaatcatcatcattatttttaattaaaaaaaaatgcctgtatgcctttttctggtccaattgtaaataaaatgccattgtcctgttgtctcaactcgaatgcaagggtgcggattgaagtgtgatggtttcaccaggtgggttgagtggctgcttttgcagctcagtgtcccacctgggctctctaggtctcaggcctctgctattctgtgcctactgcaagctcctgctcagccctccgtgtgggtcacaggcattgccctctgaagagcaggaagtagcaaacaagtaggacacacatgaaaatgaagcctggcctggggttctgaatttgcttcacgctgtatcaagtagcattctttcaaagcaatagaaatttaggctcaagcatcctagaaagtgggaggcagtgtgggttggatctctgttgagtttatggccacttagagct

SEQ ID NO: 27301 - DNA, 1974 bp, Mus musculus
tgtctaccacaacactcacttgatctctgtagttttgatgcaaagccatgcatgactacctgaaaactcccctttgtttttaaaaatcagtggagtccattagcacaaaagcctaaagtgaccttataaatgaaatgcagacaaagccaagaagcaagtgggcctattggctgctcttctgggggtcccctaaagggccctcagactttccactgccaggcccagccactgccatccctgggctcctctgttgtgaacacagcaggcaggagttagcagtgctctgaggacaggtatgtgctcccaccatgggtggcagtgtccgggcctcagcagtatcactgcacaagtgaggctggcagggtgcactgaaagctgctgtctctaagaccctcccagcctctgctctgtggtctcagccctcactgcagctgtcccctaaggactactcaccaagcctctgacatgtccgtgcacagaggccatgtgaagccccaggttgggagcagtctttgtccctccagccagtgtggtgaggtcctcctgatgctgctgctctcattcataagaagtgaactctaggtgacgggccaagtggtcctagattctgccttgcacagggacatttagaggctggagccccagtgggtgaccatgcagaccaccctgacgggcacagcatttctgaagagcaggtgctgggctctcgtctgtggcaagcactgtactctttgaccccgtttctcccctgtaagtgctgagtctggtgggttctaagcttcacgtcagctcatgagtgttgtaaacctgggctagaacaagactcccatgtggccattgccgagtgtaactgttgcttactgccaggcgctgtgctggggcctgaagggcatcctcttacttagtttgcccctggttttatccttttctttctgaccaaaaaaaaaagtgactgtttagagacattttctcccaggcagggctgcatagctgtgggtggtaagccagacccactggactctgtgtgttgcttcccaggacacattgtgcactaaaggacactaggaaaatgatgagccacccgactgcctctgcatactgctgttggcttctgctgccagccctattaggaagcgacataaaaaacaggaagctctgggtagttacagtacctgttttccttcaggaagtgttcactgatggcctactgtgtgctaggaaggagggtggcagcagagaaagcttaagacccaggattgctgtggaagggaagagctgtgaagaatgccaaggggaggggctcagggaaactgttttaaaggaatcaccttagggagtggaggaggacttgctcagctgaggaggctgcacactccctgcagcaagcatggcacgtgccaaggcactaaggcaggaagggacagcaagggaacatctggagatgaggtgccaagatgacgtcccagaggggagctggtgctgcctgtgggtgagaggctaggccattgtgctggaggtgggagaagaaatcacattctgagtatatcaagttatttttgtatttcagtctctttttttaaaggcaccagcctacatggttgtgcagtatattccatttaatgtcttgggttttgtttttgttttttttttactacataaccacacatcctatttttcctgtgtgaacatagctgaatagatgcttttaattatgtaagcttccactgaggagtgtttcatagtttgtgactcaccttctatgagatcaatccccagctgttactattggattttatccccaaggtttctttgtgtaccccttgctgtcttagaactactcactctttagaccaggctggcctctagttctcagagatcaccaacctctataagaaaattcaactgtgctcaaaaattgtgactttaaaaaactgagctcacggtattaacaatttacttcagcagctagttcat

SEQ ID NO: 27302 - DNA, 1808 bp, Mus musculus
tgggtggagaggagccgtaggtgctggcaagaagaggctctgagtaggctcagaggggagtccacacctcctgtttacatagactagtttggtttataagttttagttcttcatgttacggcacctcaagctttgctttatgttggtcattaggtgacagttactcattttccccaagagaaataaatgcatgagtgtgtggggctgcctgtgcacagtagtgcctgtgctctgggtgtgtctctaagagagactgaaaacttgcccggttttagaaatactccagcgtccagtgtttgcctttgtctgtgtgaaaggcccacagaatgactaatccaggctagaagcacgcaccccccatgaagtgtcttgagtccatgatccaaacctgaggggacagtctgagtcctcaagtctgccacactggtgtaccttgctggcatggtgcctcaggaagatggcaactcaggtggctttgagatacgttttaactcagctacttggtctccaggtacatttctggacagagcccatggaaggaggagtaacgtgcaatgtcttgacattctttatcacatcacggagatccatggatcttcttggtagcttcctttctgagcccagagccctattcagttcctaggatggaatggaacctgtctcatcttttcttggtctcaaaccctgcttcttccttgtgtcctaagagtttgcttgtttgactaggaaccaaatgaggagacatgtgctctaaggtggctgtttgctggtgacacttgtctcttacatttcctcacagctagtctaaattctggaggctgaaaacatttgtgtaccaaaacaggggattgcaaacttcaggtacgatcataccttaatgctggtgtcgtgaagtggttaatgttcgagtggcgggggttaagtgacgcatagaacttttccaagaagacaaaaggaaaaaaaaatctggaagacatgattattaaagcaagcctgccctgtcctctgctgggttcctacagtggtctgtggacaccaagtggaaggccacccatgtggtgatgaagctgtcccttcccgggcagcgtctggtgcttctcttttctcaatacggatccgatactgaagagagcagatggtaaaaatgtcttgctgtccccagaatgctgctgctctgagttctgaattgagccaagagtctagaggatatgacaagctcactgagggaccaaagctttatgctgttagttatctagctgagattctggaaggcctccatgcctgcagtagctactgtagtctagaagcaaatctttaaaaggatctaagaagaccatctgggaggagtttgaggctgcgcatacaatcctcttgggactctcttcctctgttcagtagaatgtatctgaaattgtaacagctgacacaatttccagatccttacactcagaatcagagtccccaaaccataggcatgaagcactttgtaagactgacctacattgacttgctccctgtctgatgcctgcatgctgcctgaattgttccacctacatctccatgaccatggtgccagagtgcagtacagctcaggcacaggccacttgtctgctcttccctgaagtcctccttcactgaatgtagactctgccaagtttctgagaagcgtcgaacccctgctaacgtaggctatcagttctgcctcactttggcctctcgaatttgaggggtactgcgagcatcttggaccatccagacaccatctgtgaatgaaatgggctactgatgtactccaaaagccataatga

SEQ ID NO: 27303 - DNA, 1176 bp, Mus musculus
tgttttaattttcagtttgtgtgtatggcatatatacttggttacactcggaggccaaaagagggcataagtatcccccgtagctaacagtgttaataggttgtgagccacccacactgggagtcaaaatctggtcctctgtgaaagcagtcagtcgactcttgtttttgtttcttcaaggtaggagacaagtttcttcactctgtaggtcaggctggcctcaaattcagagatctctgcctcctgggtgctagaattagaggtatgtgccaccacacctggtctctacattttttagagcttggttcgtattgtcaggaaacactaaagatgtgcttggtgtgtattgtgaattgttatgctccacaacctagactctgagtgggacttctatgaattgcagttgtttatcttcactgctttcacaataggtttgtgaaaacattgcttctgtttttgctttacttcctggtttggaaatgaattagaggagctggatatttggtaagtagacgccaacttttgtgatctatttctgttttttcactctttgcagtgggacatcccctcttgcgtgcctcaatgccatgctacattccaactcaagaggaggagaagggctgttttataaattacctggccgcattagtcttttcacactcaaggtaaaatgatttctcagtgcagtggtcctcaagactttgtgcataagagaaacctggtgggtttggaatggtgctaatggattgattgtctttcctaataccagtcaggtatcactaatgtcttggtcctcaatggtactctgagatgctgtagtctttttttttggggggggtggtggtggtttggagacagggtttctctgtgtagccctgggtgtcttggaactcactctgtagaccaggctggccttgaactcagaaatccacctgcctctgcctcccgagtgctgggattagagatgctgtctcttaacagactattaggagttactaagttctatcaactgttgtttctgttcagctttgcttgtctgtaccttagtagatacatgcaattgaaagataagcatgtgtagtgatgattacagatttgccttagtaaggattttgtttgtaataatattgtcagggataattactgtgcaactctaatgaacctactctatgggaa

SEQ ID NO: 27304 - DNA, 1195 bp, Mus musculus
gtacatgcttccacactttactctgtgttagctgtgcaacaagccatcccacaacttaatgtgtagaacaacctgttattttacttacagttctttggttgcttggtctggtcacctatcagcacagatgatctggaagctagatgagttagaaagatctctcaaatgatctctgataacctttgtccttgagtatcctctttcctatggaggagggtggttgtaatttgtgttcagcaataggataagcaaaggtttagagtctttgcacatatggttgactgtaacccaaagatgtttgtctgggtaggcctgaatcagttatatgtgggtctgatgttcagagatggaagatttgaacaagtctgctggctttgaagatgtgtgttggcatgcgagaagcctagtggcaaggactgaaacactgagagcagaaagtcaagtctgcaccgacagtcctgggagtgactttagtcctataatacaaaattctctacagtaaccatgtacatacatttcgagagttcctgagctccagggaggaggtaacccctactgacgcctgacttgaactctgtgcacccctcagcaggagctccagccatgcttgagtccataattctcgtcccctagaaaactgagataataaaaatgtgtgtttaggtctgtggtaatatgtcatgtgaggtagcatgtaatagccctcttcccttgtatgcttgctggctggagctactgggaaactgccacatgaatcactaaaaggttcctactatccgcaagagagcaagcccccatatgtacatcttaagcctctgtgtcaaacagcatagtttacagccaaggatggttttgattccccatatctgacagttctcactatggaggtggggagtggagagatctttgccgtggaatagggataggccagctatactagagcgtccttagtgtgttgtgcttctgcaacaaggaattagttatctggtccaaaaccaaaaattgtcaagggtgagcagcctacctacatcaatctgttggtcatatcagctccatagagcaggaagacatttctctttctgagaggaattgcagtcatattatggaagagaacattgtcagaaccgttcttataacttaccatgtgacttttgccattcactgtgctgaatgtgagatttatctattgctgttg

SEQ ID NO: 27305 - DNA, 1131 bp, Mus musculus
agtgagttccagggcagccagggctacacagagaaaccctgtctcgaaaaaacaaaaataaataaataaataaataaatattaaaagtgtacatatctcaggatagctattaatggtgcctaagacatttatagaccacagtcttctcacagtgtcataggttgggcacataattgcagtacatttaaactaagaagttcacactggtacagcactgctacttccagaagagccttatcgagtcagtccatctgtgtgttcttgttaagagcacagcattggatgcagtgctgtgttcaattgttttgtctccttatctaagagctcttgcctatgagtcatattcatatccataatctactagttatatatccttttatttgaagccttgtaacaatcaaaacttttaggttatcattttattatggggcacttcagagtgtcctggtgtgtttgtgggaggcagaagacaacttgaaggagttgagtctatattgtatggaacctgggaattaaactcaggttgccatgtttggttggaaagtgcctctacttactgagttatctctctctctctctcaaaactattctctaaatttactaatgttaggctttgtgtctggtttcttacttaaaataatacttttatgattcacttgtaggctgagagtgaaggtggactcctgtaatcccaattcttcaagggctgaagctaacctggtatacatagagagatctaccctgacttaacatggaaacaaatgtaattatgttgttgtaggaatgatttttgttccttaaaataaatagatcaggtaggtgataggtagataggaaggtaagtagaggctgggactagagaaaagtttaagaatgcattctattattgcagagggcctgagttaggtccccagttcttactgactctaagtacaggtcaagggatctgacaccttcctcttgcctctcgtcgtgggcactgtactcacataaacaaacacacatgtaattgaaaataaaaataacctttttgttgtagtggtggtggtgttttgtgggtttttttgaaacaggatttctctgtctagacctgactgtcctggaattcactctgtagaccaggacagcttc

SEQ ID NO: 27306 - DNA, 1203 bp, Mus musculus
tttgtagggacaaaggcagttggcatccagatatctgccattcatatctttggttctgtaggcatagattgaacaaactaactgaggattgtttaaggaggaaaccatggctcagtgtgcatagactaacaactgctggatgtcacacttagtgagactaggtctgagagacataagggactcagctacccaacgctgggatagattagaccattataaagtatccaggagcatatagacaggttatgttacaaacaggctgttttgtctaagggatttaggcatctacaggatgtccggtataccaagggacagatgtagtatgcacataaaagcatggaactgactgccgcttgacagtgaagctattgtggttttctgtgcttagtgctatgcactatgcagatttgtttcatctggctaagttatctgggtgtatattgttcatagaaatgagtcatatgttctctggcctgtagttgatgtgagtttgatttgcagattgggtttgaccaaagaagaatcactgcagcagaaagaggtccaggaggaggccaaagtcaagagtggtttatgtgtctctggagagtctgtgcggccgcagcgtgggcccaacacccgtcaacgggacggacattttaagaaacgttctcggccagatctccgaaccagatccagaaggaatatatacaaaaaacaggagccagaacaagcaggggttgctaaagatgcaagtgctgcaccagacgtctcactctctaaagatactaaaaccgacttagcaggggtgaacagtacccctgggccagatgtgtcctcagcaacatctggacaggagggtcccaagtgtcccagtgaacctgtggcttcccagatccaagcagaaagggacaacttggcatgtgcctctgcatctccagacagaatccctaccttacctcaggacactgtggatcaagagacaaaggatcagaagagaaaatcctttgagcaggaagcctctgcatcctttcccgaaaagaaaccccggcttgaagatcgtcagtcctttcgtaacacaattgaaagtgttcacaccgaaaagccacagcccactaaagaggagcccaaagtcccgcccatccgggtaagagacttggtacttactgtcttgggtgtcagatttctttctgaggagcttttgggtaggagcatgcatgaggc

SEQ ID NO: 27307 - DNA, 3650 bp, Mus musculus
cccacttgtgatgcacctgctgcatggtaatttgcccttggagaaggttcttcctccaggtcacagaagcagccgactagagtcatcacagctgccacttagagaacagagccaggatagaggcactctacaaggtacaggggaaaacaatcgcctagctgccagaatcaaccctggttctgcacaaacattgaaagagtctattctggcccagagctatggagcaagtgctggtcttgtcagggcaatggcctccaaggctcctgcaatgtcccagaagattgcgaagatggttacaagtttagactcacagcatccagagacagaactgacaccttcctctggcaatctggaagaaatagattccaaagagcatctctcttccttcctttgtgaagagcagaaagaaggccattccctgtctcaaggcagtgatccaggtgcggccccaggccaatgtctaggagatcacactacctccaaagtgccatgtttctcctccacaaatgtgagcctctcctttggatctgagcagacagatgggaccctgagtgatcagaacaatgctggtggtcatgaaaagaaactatttggtcccgggaatacagttaccacccttcagtgccccaggtctgaagagcagacaccactacctgctgaggtccctccagtgtttcccagtaggaagatagaaccaagcaaaaactctgtgtctggtggtgtgcaaactacaagggaaaacaggatgcccaaaccacctcctgtctctgctgacagcatcaagacagagcagacatttttgagggatcctattaaggcagatgcagagaacagaaaagctgcagggtacagttctctggaactagtgggtcacttgcaagggatgccttttgttgtggatctgcctttctggaagttacccagagagccagggaaagggttcagtcaacccctggagccttcttccatcccttcccaactcaacatcaagcaggccttgtatgggaagttgtctaaacttcagctcagtcccaccagctttaattactcctctagctctgctacctttcccaaaggccttgctggtggtgtggtgcagctgagccacaaagccagctttggtacaggccacactgcatcactgtccttacaaatgttcgctgacagcagtgcagtagaaagcatctctctccaatgtgcatgcagcctgaaagccatgatcatgtgccaaggctgcggagcattctgccatgatgactgcattggaccttcaaagctctgtgtattgtgccttgtggtgagataataaattatggccattggaaacattgtacatttagtgtgtgtattttaataatggttgatcttaaatctgtatacaaaatatcactgatataatgaactctctctctctagacaagataaattttgcctccccatgagatttatagtgctgaagccctctgtcacttgacacccttctagccttgttggaagggttttcagggagatgggggcactatggttgcccaagaccataaaccctcttgtagtcaggcagtatagtgtagcagggcaatctgtctgacacctaaatggacttgaaattgaagcaggaaggttgggttctccatggatggaactcacctgcctgaactgagcaggaatgtcagtcttccactgcccctccctgccatcttctgctacttagcttgggagttgatggttgcagaagccacacagggttaaagtaaattctgtctttgcccaccaggggatcaaacccctgctgatcttgatatcatatttctgtcatttgccagttgatggagccaagttgacctttggttctggtgcttcacccagtttggaactttaatctgtaacccatggatccacagattttcttgggagcttgaatagcccttcttggacaatggggtctggaaatagggctgtctgcttatggaaatgccatctgtagaccttgagagtcaactgtacagatgtttgcaggtgactcctgcttgccacccacccatcatatttgattctgtgggagtgggcacccatacacctgtgtatgtgaaagtcattttacatttccaagcagtctgtttcttatttttatattttaactctattcttggatgtataaagtgaactttttcgcttctgtaagtatgctctatgcacctctaacgttttatcctgtatttatatgttgtacacagtactggccaattctgtaaatggatgtattgtacagagaacacgaacgtctcttccttattttacgtcttcagcacccttgattaaaatggtgtcgtttacttatgtgcaccaattgtcaaaaccactgagtgctgtgctgcctatgtgagaagaaagttactgacttgtgacctatgcttggccctgtgcctagtcacctgtcaccagggattctactacagtctgcgcgccacagatagttgctcacacaccattgagcaaacgtgtcttgttccttgtatctcttttcttccagccctgagtggctgcgctgctgccatatgtgacaagtggtcctcaccagtgttaagtgcttctggattcatgggtgagttccttggacgaccccagacaggcttctggatctggctccagggtcatcacatgtcaaagcaatattggggattgctaggcttctttcaacttacttttcacagtaggtttcaggggaacaaagccatgcctgctgcctgcctctctcctaacatggttccatcaagtagacaccctttgtatttgacctcttcccagttcctgccctgtttctgtatctttacttgaaagttgggagtccttgtttaatttaggtctgtcttcttgtgtgactgtttctgtatgaagtataaaaatttgtgtgccttgagcaagtctcattttctttgtaagctgcctcttccgccatttcatctgaggttgctgtctttttggtggggaggggtttggggaacccatcaggtatgagtgaggagccggtagtgaattcagtattggccaagtccatgttgtgtgctcagaagtctctttaccaaagaccaggagcaggagccaagcatgtccagtcctcttctgagacctctgaggtctcagaagagaaacttgacagtgtctggtccatggggctgctcagaaaagcgctgctcttgtatgtctcattggtattggaaaaataaacctgtacaacctgcacttgtctccttgtcatctgtggctgcctgtgggtgtggggaggtggggttaagtgcagagctagatggttgcatcaagtagacaccctttgtatttgacctcttcccagttcctgtgtgcagtgaattggcagctccactggtctttggactcttgattttggtggatattaccaatgggtgtagtagagccagaaagctaatgggagtgatgggagctataatggtcaaggtccctccttccaggaactcatctacaccactcgtgacctcctggcagtgactagttctggccttgttcatggtgtgaggcagatacagggtcactactgtttgaacaagcctaaatggatgcctagtgcttcagggacaaccacttcaggagtgcttaagtgcagggttttacaattg

SEQ ID NO: 27308 - DNA, 2530 bp, Mus musculus
gggggccagctcactgtcccgagtgcccagcatacccttgggaaggccaccacactccaccactaggctgtcttgttgcagatcccagtgctgccacagggacactgccaaacagagggacctcaccaacactcactacaaacaaaagcagccacccatcccatccgacagagtcccagtcacacggtcacctgtactctacctcacactccagcgtgggcttttccaggacgtgctccaagtgtgttctgaacggctgtctcccccaactcccacacaatgtagctatcttctgggaggtaaatgagacccagtgtccaggagccagagcccagaggggcttggcccttaaaaccagcagcttgccatagcctgggctcttggagatgcttgacaggatagtgtgtctggagctggtccaggtcccacacagcccccaggtaacctgctgaggggccacttctcttggccaggcatctgtgtgcccaagggtgaattatggtttccactcctcacctcacgatgggagtagagggatcagatcgttggtggaagtgcagaactacttgcattctcctaagatcaaactttcttctggaaaggcctgtcctgtaagaaacctagtccctggagtgtgacaagggacaagaaaaagctgacctggtttccttcctccctgacaggcacttcctcttgctctgtgcaatacctaccagtgctgctaaaaccagggattcacccagacctcagcaggccagggggcctctccctcaacactccgtagccatgacagcagcactctgctgcctgcccctgcccagagatggcagaagccctgttgcctttcttccctcagagctaggaggcctcaagggagccagggctgagtggacactaagctaaccacaaagagccactcttggtcccagagcgagtgccccttcccaaactggtctatggcagggactgcttgtggcagcctgacagactacccttcaaacaggtaggcaagcagtgccagtgcagataccctacctgttcagattcagggctgtaaggcagggttccccaccctgcacacttccacactggggttaaatgtggtctttcacatggcctacaatgcctacccagccacaccacctctgccttcatgtgcccgctcaccaggcctctggactgggccaggacacctgagccccttcatacagcacaaactccagtgcccaggcctccccacagctggccaaacatgtgcccagttccccacctgctcagtaggactcctggatgtttgaatttgtgtaaatatttatttttgtgtgtgaatactacaaagtaatcagtagatctttttgcaaaatgttactccaggcaatttgtgaaaatgttgaaaattggcagagacaatcgccaccctagaatttctgttatcaattgcttaccgcattctgtctgctcccagaggcagtacccaagctagacacaaatggcttgcatttttggaagaagatagaagagactaggcaggggctcctccctctatccccacaggacacatctgtaaggacgagcataatctatatctaagtggtattttctaactgcaagcagtcttgaccagccactagcagcctgctcctagagtacggtgtgagcataggttccatgtgttttgctttcaagagaaataaaaccaatgccagtgctgatggtttccagaggggctgcaggacagtagtagatgctggcatgctgacctgggcttcttcccagagaagtggtctccaaagcctcagagcagccataccaggagcaagtcagtgtggacacaggattccattacctagttaagtcagggaacttgttctgttttccttttgttttaaaagatgcagcgtcaagcctcccttcctgactgtggcccgccttttcccaggaggagcttcccaaagccttgtcctgcagccactgcagtgtgatggaagcctcaggcacacagtagtcattggtgatctcaagtcatagtgaacatgccagtgcaggatgcaccccccctcacccccgagtccttacaggcagatccctgcaggctatcaagagaagtggtggatgatcatctgttagaccagggatagtatacaggacccatctgaaagcatttttttttcctctcaccactcaacaaatggacagtttattcccaaggacggtgttggggagaggcaggcagggccaggagggtcttggaggactttgaacaggtggaacccatctgtccctccctatttctcaagggccacaaatgactccacaggtggttataggattaactaccagttcattctcaaaatgctgctttgaactcagagggttgatacttttaatttgtaattttttgtaaaactttttacaagatagtaaagtatttcaccagaataccagtttcaatccgtccgtggtctgattttatataatttagtggtgctttagagactttgttttgttgtttctgagcgcaacagctcaa

SEQ ID NO: 27309 - DNA, 1175 bp, Mus musculus
tggatgggagaagtcaaacctggagcttctctgaaaccctgggttgaggggctgcgggagtggggggggggcgtttatgggtggttttgttttggtgatgttgttagaacccaagacccgtgcctgctgcactcgcaagccttcaggttgacgctgatgctttcttcgtggaggtagagcagtgcggagctggaggcaggggctgatctgaggtagggggctctggcatttgctacccggcagtcttgagggcatcctctcatttatcgcatggaatgatgggattggctagtgtagcacagtggtcttgctcttacttagcatgaacaaggtcctaagttccattcccagcaccacaacatattgatctgtgtgtttgtgtgcctgtgtgagtttatatgcatcatacgtgtgcaggtgcccagggagattagagtgctgaatttgctcaagttggagttgcaagtgtttgtgggctgtgtcatgtgggtgctgagaaccgaacccaggccctttgtaagttctaggttagggtatagagcatctaccccagggtgatggccatgtaacaggaagctgctgtcagggctctggtggactgaccagtgagcagctgagccgcagccctgcccacagacctctgggcctctgggctcagtggccagcctctggctgagttcttaactagcactcattcagtgaccttgagaaagtccctgcctcccttcaagctgattttctgttctgtgagtccagtggtcttgcctgtgttgaagctctgggaagtaggggagactccaagcaaagttctcagccctggaattaagagctgttctctgctgtgcctgtcctgtggtaagcagcagctgcaagggactctgggattgagggtcaaagacaaagcagcgggccaaggtgggagagagtgaggggtggagggggtgcagggacttgggcatggcagggaggggctactaggaagaggacatcagcctccagggttgattgggacctggttcctaggtacggagttgtaggaggtgagctggttggaaggtgtctctcaggaggtaggaggaagaaccagacatcatcctggaatccaggctgcccattaagacctgtgtgtatccctgacctgggggcacacacattgaatcctagcacttggggga

SEQ ID NO: 27310 - DNA, 1835 bp, Mus musculus
cggccactggcctgggcgggaaagggcctctaatgctgtagtgtaacactgtaacaggcttccactgagtaacaacaggctttgaccttcagtgggatacctacctccctcagtgttctttccttttcatcctagcccccctctctcccccttccccgtccccctttccctctctccctctctcctacctccttcttccttctcctcctcctcctttttttttttcctcttttagacatggtctcactgtgtagcccctggctagactggaactctgtatagactaggttggtttcaaacttgcagagatctgtctgattatgtctgtctagtgctggggttaaaggccagagcccgtgtggcacctgtttctcagtaggcctactgtgtgcttgtcactgtgttgagtgagatgctgcctcagcttgtggaaatctcacagcagcttagaggccaacactgctattatcatcacctgacagagacgtaaactgaagcttagggaacttaggaaatttccctaggccatactagtgagtgggtgggccttgggactgggtactaacacatatacatttctgttctgactctgaggaatactgctacctaacttaatttaaatgtctaagcctttcatgataggcccttacattttagtctgaatttgtttagaagaatacctctggtcaagatgtctggtactgtagattggtgccatgtaagatgtctggggctttcctggacacaatgggaaaagcttgggggagaaaggtctctgttaccctgggtctccggggactttggggacagagttgacagtggtgtctggtacaggccccatttagatttctcaggagtggcagaaggaagcctttttattaattaagcatccataatttgggtaacagggtcctagaacctaggggaggcatttttgagctaagtgccatttggatgctgagtgccaggccatgactttctgaggtttcttctctggctctgggttgctcctctgtggtggggacaatgtgtactcttcttcctccactaagtagtctgccctctcctttgtgacctgaggcactaccttcctgtccagaaagccagaccttgaaactgctcctgggagccactggtgggtgggttggaagcagttggagtgtggagacctgtggctagggcttttcgggcacaaaaggtgccggcttcagacaagccttggcttcaatgaggcagctcttatcttagagattataccactgatgacactgtacatgagtgtgggaccatgggctagaacatatgtgcgcagtgtacatacacacgtcagctccgtgggtatgcctatcagcgtgttggctgaggatgctggcgggagtgtgtgtgtgtatgccggggtacgggtgcatgcaggtggagggaggcagtatgcttatgatgtcttcggctgtgatcgtctgtgttggcagatgtgggagcacctggggtgctgcgctggcagaccatggtgtgactgtgtgtgaggttctgatggaaagccctggctggctggtggtatgctgctcgtggtgtgtgtgtgtgtgtgtgattatagccaggctagcccaagtggccatcctgactctggtgtgtccctgttggccagttgactcgaagtaaaagagagtgactggaggataaggccttaacagccccctcccacccccaggttcaaagtccaattcctagggcagaatggaggcttctgggacagggtgtgaataggaactagacgtgagtagattagatcccatggacaggatctcggtggtacctacaggttcccaggtgccctg

SEQ ID NO: 27311 - DNA, 1755 bp, Mus musculus
agacacctgtttgcccccttgaaggactactttgcctgtgaatagttctacccaggactggggagctctcggtcagagccagtgcccagagtcacccctccctgaaggcacctcacctgtcccctttttagctcacctgtgtggggcctcacatcactgtacctcagctttctcctgctcagtgggagcagagcctcctggcccttgcaggggagccccggtgctccctccgtgtgcacagctcagacctggctgcttagagtagcccggcatggtgctcatgttctcttaccctgaaactttaaaacttgaagtaggtagtaagatggctttcttttaccctcctgagtttatcactcagaagtgatggctaagataccaaaaaaacaaacaaaaacagaaacaaaaaacaaaaaaaaaacctcaacagctctcttagtactcaggttcatgctgcaaaatcacttgagattttgtttttaagtaacccgtgctccacatttgctggaggatgctattgtgaatgtgggctcagatgagcaaggtcaaggggccaaaaaaaattccccctctccccccaggagtatttgaagatgatgtttatggtttaagtcttcctggcaccttccccttgctttggtacaagggctgaagtcctgttggtcttgtagcatttcccaggatgatgatgtcagcagggatgacatcatcacctttagggcttttccctggcaggggcccatgtggctagtcctcacgaagactggagtagaatgtttggagctcaggaagggtgggtggagtggccctcttccaggtgtgagggatacgaaggaggaagcttagggaaatccattccccactccctcttgccaaatgaggggcccagtccccaacagctcaggtccccagaaccccctagttcctcatgagaagctaggaccagaagcacatcgttccccttatctgagcagtgtttggggaactacagtgaaaaccttctggagatgttaaaagctttttaccccacgatagattgtgtttttaaggggtgctttttttaggggcatcactggagataagaaagctgcatttcagaaatgccatcgtaatggtttttaaacaccttttacctaattacaggtgctattttatagaagcagacaacacttctttttatgactctcagacttctattttcatgttaccattttttttgtaactcgcaaggtgtgggcttttgtaacttcacaggtgtggggagagactgccttgtttcaacagtttgtctccactggtttctaatttttaggtgcaaagatgacagatgcccagagtttacctttctggttgattaaagttgtatttctctataacgtgctgtgtgttttttatctgctgatgtgtactggcttgaggcctgctgccatgtttgtgagccactgtctttactcccatagttctctaatacagaaccaggtgagttccaggccagcctggacaacatcgtgagtaaaacagtgacctgctggatcccatggccttaacagaaggacagtcataacaaataaacatgctgacctgtgtcgttcttggttagttaccaagaatcatgagacttagtgagtaatttaagtttaattgtaaaaactgtgacctgtagtcattggttggtaaacgtggtcaattataacaatgccacggttaggtgtgtgaggtgtaagtgaaatggttcgcatctttggcttagttctg

SEQ ID NO: 27312 - DNA, 3349 bp, Mus musculus
gaaggctttgtgatacctgatgaagggggcccacaggaggaacaagaagagtattaagcagcctggaccagcagagcaacatccgaagtcttcactccaaatcatgtgcttaactgttaatactcccttttattaatcttagaggattcactggtttcttttcataagcaaaaagtacctcttcttcaaagtgcactttgcagaagtctcaccttttccgatgagtttgagttaggagcttttgccttgtagcagagcagtattaacatctagttggtttaccaggggaacaagaggccaaccatggggctcttcatgtggatgctggtcacactgactgatggagaagggggtttataatacgagaggtgacaacctcagaaatgcaaagactgaattgaattctaagctaatgtgaaattctggcagagaacgttttaataaataaatgccttaagagtatttaaaatatgcttccatatttcaaaacatacagtgtaacatgacaggagattttatgtgtctgacattgtgtctgggaaggaagggcagactttaggccctttggaacctgctgtgtaggcctttcaaggctgcttgaatcttatagatgtcgactttggcccagaagtaaagtttgaaaagttctgtaaaaccattttgtgtcaatgaccagttgcacccctgctctaaaagcaagcagcatagttgcttgtgtgactagagggcgtctgggccctgcagtgcctgaggcgaagagctcagcttcccatcgagcagtcctctggatcttttcaaactctccctccagttcctctgtattgtgtttctgggacctgcccacgtctctgggatttgaatgggggtggagtcccagcacactgtcttttaagtttacagttacacttctctctctgctccctgtgacctctggaaactcctctggctccttaagtttgctgctgagcattgtaattacagcaggcaggtgatcgtgctgcaagttcttgctggacctctggcaaaggagtgatcagtgaaggccagtgtcacctgtgctctgtgaggctagggtgctcgctgtctgctggtcactgctccccattgtcacctgagtactttgccagtgcactaatctcttggagataaaattctctagtgtgttactaaatgttaaaatgtttttttttaaagaatatacagtaccgtgactgaaatattaatatttaaaatacttcattccttaattctccctcaattgctttacccatagcctattcaattcctttgtttggcgaactctgcaaaatgtgttacccactactgagattgttcagcccctgatgtgtttgtactgatttgtttctggtggtagcttgtcttatgctgtgtgtaggaaacaggtattttatgacagaatgttatgtagtgcatgctctgtggaattcagaggaaaatccaggctcagtgattaacaatgccaaaaaaagaaaaaaaaaaaacaaacaaaaagcaagtaacgagccattgttcaaacgacagcggtgctgtttctcctctgtggcctttcagacttctgttgcccccaaattccattttattgggaacccattttccacctggtctttcttgacagggtttttttctactttaaacagtttttaaataaaattctgtatttcaagagtgtcctgtcttctgaaatgtgtcttgccttgggtataagcttttaattctagaggtaagatagctatgcatccatctttggctgagcttagacagaggctgagaaatgattcccaccgtcttaaataggactaatcttttaaaatccctcacttttctcaagctaactaatctggctctccccttcctctatcctcctttctccttctcccttccttcctccctctttttcctcttcctccctccttttggtttttaagacagagcttttagtattgttgtcctgattggcctcatatttgtcacagtccttcttcctcattctcttgaaagattatgtgtgtgtgccatcgtgcctggcttaaaattgcttattttgaattctttttaaaaaaaaaaatcacattacatttttcagtcttctactgctttaaattcctgttaccctgagaaggttttcctcacagaaacagaaagcctgacctagttgcttaaggctcttaggaatgtagttggccggtgtttggcagatgatttaattggaggtaattgtttcattgtcctgaaaatgcatttacaaagtcagttagtacactcttaaactggagagtaaagttgttgcttcttaaaactgttctataaagtcctacacctttgagaatgagttgaaaatatgatcctctcctgttgttgtcttgaaatgttaaataggcagaaaggtaattcatctgctcttgagagtaccatgtacagtaccctggctgctgtggaagtgatcttgagagtaccacgtacagtactctggctgctgtggaagtgggacttagtgatttttgtgacgtttatattcactgctgcccctggaggttgataatgattcaatccagaatcattaccagtttggggaataatttggcaccatctgcattcatcatctttaagaagaaaccctgaagggatgtatgttgtgtgctgttagctgagaagttattaggtaagaggtgaagtggagactgtatccattgacctggcttagctgtataaagccttaatgtgactaattcaggttaggaggatggtgcagcctgaacgtgctgttggcaaggtctgtggtatgtagaggaacaggctactgcagataggtttggattcaggataggttcttcaggccgaattgatgtgattgcttcccaatttcttgggagattggtgtagaatgtttagaagttcatccccagaagttctttttttttgtttttgtttctgttttttgagacagggtttctctgtatagccctggctgtcctggaactcactctgtagaccaggctggcctcgaacttagaaatccacctgcctctgcctcccaagggctgggattaaaggcgtgcgccaccactgcccggccctggaagttcttgagctgggagattatgaatctgcattttaaggcccctcaggtggcctagacctgggccctgcttagatgaagctttaagtcttatcgtgtcagtgagacatcagatgtgagggttctaatccacctcttactttgctttattttgtttttttcttgtttgcaaatcaagggctctgatgttggctgaagggcctcacactctgcatgttttttagaatccgaggaaactaacaggccaagtgc

SEQ ID NO: 27313 - DNA, 1102 bp, Mus musculus
catttctaacctcctgaatccagagccttaaatcttcttgttgttttgaggcagagtctcatctattccagactggccttgaacccactatgtatattctagggtgattttgaatgaatgctgggattataggcatgttataccatgcccaacatcaaacccaggccttcatatctgctgagcaaatatcagccaagccacatatttagttagccccatgagtgttgttttattttgaaaaattgtaactgcttttgaggatggtaagctatgtggtttatttattttatttttatacagacaggtatagatgccaagtatgtgtcacctcacacctcagtaatttatttcatttttgagagggtttcactatgtggctctggctgacctggaacttgtcatgcagattaggctggcctggagctcacaagtgctgggatcacaggtgtgcaccatcattcctggcttgcatgttaaaacagcattggtgttgctgaatgtgaatgaagaagtatctgtgaggatctgggtctgctgtggctcctgccggcctgagggcccttttggtgatcagcatgcccttggatgagatcatattttcaaaggtattctctaggttgtaatgtctgaatccttttcaagttggctttgaacttttcctgaatcactatgctgagacttatctagatttttccttctatatgctttcccacataaaaaaaaaaaacttgttattgattatattttgactcttttgaactttttcctaaaatgaatagaatacactgtaactaagtccatttctcctcccaccccatttttcttccagataaggaggaaattatatcctagcatattttagttatgttaaatactgatagtttagtcagtgaaaataggatataatttttaaaaaccctaccattaagttagtgtgtgtcatgggaaaattagaaacagtcataaaaatcaactttctgtaggaataaaaccaaaaaaaaaaagaaacattaattttgtgggttttttttttactgtaaaaaaatctctagtttcaggctgatgagatgtctcagcaggtaaaggtgtgtgttgtataact

SEQ ID NO: 27314 - DNA, 1099 bp, Mus musculus
tgtgattgaaattgagagacttttatgagctattatgtaggtgcatcaaacctgggtcctctggaataacaatcagtgctcttaacctctgattcagttctccactttctgccccaccccctgcaagttaaataaaaataaaaataaaaatttctagcttcatacctaaggaaaaaaatctatctgaaaggatttttgtgccccacccccttgtttcaatggctttcttcccttgacctttcctatccagcggtgtgttgggtgcgttgatttagatacgtttatgttctctgtttaggcccaagaaggaagctttggtggtggtgtcttgacacttgggtcatgttcagttccttacagtctggtgcaaagatctagaatccatggccctagcagaagtctccctcaaaagacctgttagcagctgactggccctggtgaagggtgatgcgactaccacgtccaggtcatccctcatctcggatgctcttactgactttctctgctcaaataatgggctggtgcagaacttggggtgtgtttgtgtcaaagagctcttgtgatatttgctctctgaactgggagaaccagttggcctctttggtttggtgaagctgcattcccatagggctccctggttcccttgagagggaggctcagtcagtgcttgtccggtgggttactttgtattcacatttgtcctgactctctgctgttactgccctctgtgagctcaatttctttaataaaaggtctcaaactgggtgaaagaaaaatggctgtgtttggtttatgggttagattctgacattacctttgtggttattttgtgtggaatttcctcagttcccaaatttgactggttgactctgcggtcagaaaccctctgcctctgactcagggatctcagccaagagttacaaatgtagtgagttgttaaaaactggtagcagttgggtcgagcttagctgtggagatcaaattgggtcagggtgaatgccctctggaaagtggacaccttggccttcagtcagtggcctgactctgggactgagtgggaaccagaagtatctcttcatttctgggacatattccttag

SEQ ID NO: 27315 - DNA, 1806 bp, Mus musculus
tataaaatctctgctccctgtgatatggctgaggttgtagatatgagagaaagaacaactaagggagagttcagaacagactggacgtggccagggctagggaagcaagaggctaggagagagtagtggagagagcgacatagcaagagatagagaatagaacatgccacagagaataagagaataagagagtaggtaggagttatagatatagatatagatatagatgatatagatataggacagacagataggtagagaggatagtgtcttaaggttttattgctgtaaagaaactccatgaccgcttttccgtctggactggaggcaggcggctgcgagcggccggcgtgctccgatcggtcggagctaaccgctgccaggccggctgccgcggcccggcgtacgccccagtcgagcgaagatggtgggccggaacagcgccatcgccgcgggcgtgtgcggtgccctcttcatcgggtactgtatctacttcgaccgcaaaaggcggagtgaccccaacttcaagaacaggcttcgagaacgaagaaagaaacagaagcttgctaaggagagagctgggctttccaagttacctgatttaaaagatgctgaagcagttcagaaattcttccttgaagagatacagcttggtgaagagttactagcacaaggtgactacgagaagggtgtggaccacctgacaaatgccattgctgtgtgtggacagcctcagcagctgctgcaagtgttacagcagactcttccaccaccagtgttccagatgcttctgaccaagcttccgaccattagtcagagaattgtaagtgctcagagcttggctgaagatgatgtggaatgagccagataccaacaagataaaatctcagtaaaataatttaacagttagcttggaagctggtcagctctgggggattaagggcaaattatgctgtcatgaactgtcccacactgacgtctgccaaagcgaatatgaactttggtagatccattgtctgttctatttatttttccagtgaaaagtattttgatagagcttttcattttataaatacactgagttaaccaaatatcatggatttccgtttgttcttaagacatgcaattcaaatgtaaatacagtagagtattacttaggtagaaactcgtggtgattttaagattggaaaagaatctgaggaagagttgaataacacacattctaaagactagaacattttattgtatgttgtaaaattgggtagaaatttgtgtttgtgaaaactgagcattaaaaccttacagagaccgtttctcgtttacttaaaaaaaaaaaaaaaaaaagaaactccatgaccaagataactattataaagaaaacatttaattagggctggcttacagtttgcagatgttcagtacattatcatcatggcaggaagcatggcagcatccaggcagatgtggtgctggaaggagctgagagttctacatcttgatccaaaagcagcaacaagagactgtcttttgcaggcagccaggaggaaggtctcttcagcatctggccaagcctgagcagaggacctcaaagcctacaatgacacacttcctccaacaaggccacaaacccctccgataaggccacacctcctaatagtgccactccctgtggccaagcactcagacctccacagagtgagaacagcctgtgtaagaaggatgagcggctgtgggagggacccctgtgtgctgcgggggttatagggtagaggaggatgtgaggagagctgggatgctgtgtgtact

SEQ ID NO: 27316 - DNA, 1186 bp, Mus musculus
acaaagtttaagcaagccagtctttagtagcaagtttcctatgcttagctgatggcaatttgtatttaccaagaaatagattatcatacatctttttttttttggattatcatatatcttatgtcttacttttgaagtcttgttctcctgaactattctctacctttttttaaaagatttatttatttattatatgtaagtacactatagctgtcttcagacacaccagaggagtgcatcaaatcccattacagatggtttgtgagccaccttgtggttgctgggatttgaactcaggaccttcggaagagcagtcagtgctcgtaacctctgagctattattcagcccctattctctactcttataatagattattcatctttatttataaccctctcttttcatggtacgcaccaaaacctgtggccacatctctagatcacaaggtccaggagctcagagcctacctagaaagaatgttctctggtcattttttgtcccaagcctattttcctcttctgtgtacagttccgtgcttgtaacccaggaaagctcacttggctccttttctaccctgcgcagccctctctattctacagtgacgggcgggcacgttctgttcgtgactctaacttggttgtatctttctggcaaaacaacttaaaccatctctttaaaccttctatcaactacccaaactttctaaaactatttaagtcaaatcaggaattccataaaatcattaattcatctaaacagcattatctcatgaaagttcgtcttcatgttgatctgcaggaaaattgcccaacagagtgggctgtcatccaggaagtaatcacatcaggctatagtgagggtcaccccatgcccagtcacaccatgccagatatctgaggaatatagcaatgatagacaggagaaggcacagcagtagcaggaagcagtcctgggacaaagcctctagggctgtgcctcttcaaggtacagccatcacagctgtgcaaaacagtggcctgtctccaggaagctcacctgcccactactctttttcctgtgtggtgtccgccagcaactctaggttgggtcaatttaacagcttcaacaatggggctagagtggggagatggctcagtggctaagtacatatattgctcttccacaggacctgagttggtttcaact

SEQ ID NO: 27317 - DNA, 1129 bp, Mus musculus
atttattgttgtgtatattatgatgtaaaggctcctgagacacagtgtgcttatggaggacagagaatgatggggaaagctgtttctgtcctatgattcgagtccaggggatccactcagggcctcaggtttggcagtaagaaagtgcctttacaggtgaactgtcttgttgggctactcttctgcttttttggggggtgggggtgggggtttgagacagggtttctctgtgtagccctggatgtcctggaactcagaaatccgcctgcctctgcctcccaagtgctgggattaaaggcgtacgccaccaccaccctgctcttctgctcttttaattttaaataatggaggtgtcaactatgttgaaagcttatttttcttacatttaaaaagcttacttttcttacatttaaaaattggacttttttgttatatgcattttgcctgggatttaaggtgtgagccattatttaaagataggttcttctagcccaggctggctttgaactccctattatctgaagatggtcttgaactcctcaaccttctgctttagtgcaagctttataagagtgtgccagatgctgccacacccagcttaaagttgccaatatttgattgtgaactgggacagggacacaggggaagtcaaggcaatgttaggattattgattaaggttactatttaattcttacggaatacttgagtaggcgtgggtaggattacatttcactactgatttccttaaagtgaagatagcgttcgtttcagagaaagctgcaaatgctctataataaactaagatagttatgtggttgactgcttcatgaatttaccaaacaacatttccatagttcattttggagttacttgcatcttgttgaattacctgttacctgtggttttcattagcagtagaaaaagtaaacaatgaacccatgaagttctgtaagtagccacaactcttctggaagtgtaagtcagtccctttctgccatttgacacaggaagaaaagtgtcaggaagggaagtcttcccaggggctggaaagatggctcaacagttaagtgcttgctgctcttccagaggatggaagtttggttcttagtacctatctttgaggttgac

SEQ ID NO: 27318 - DNA, 1189 bp, Mus musculus
ctttcagttgtttgtattctaacagtaacctagcaaatatctcataggagattaaactagtcttggttgtgtcagtaacttggtctcagtgtagaaatatgtaaagtaacagctcagtaaaattttgggatatttctttttttcagttctggggatcaaatctagggctttgtctgtcattattctcccttggtttgttgggattggatctggtctcactgtgtagctctagccagcctgctattagccatgccgcttaggctgccttttttttttttttttttaatttatataatttatgtgcatggatgttttggttgtatgtcatcatgtgcctgcctggtgtccttagagttcagaagagatcccttgaattggggttacaggtagttgtgagccaatatgtgggtgctattaagggaacctgggtcctctactatgctttaactgctgagactagatacgtagtgtttcattatgtggtgactggaggcccagagctgctgggaccaagtagtctttgtttgtttgtttgttttttgagacagggtttctctgtgtagccctggctggcctggaactcagaaatctgcctgcctctgccttccaagtggctgggattagaggtgtgttccaccactgcctggcccgagtagtcttttctgtttcatgctcttagatctgagccaccatgccttttgtctttttttggggggggggtaaagatttatttatttattttatgtatatgagtacactgtagctgtacaaatggttgtgagccttcatgtggttgtcaggaattgaactttaggacctctgctcgctgctgtctgtccagctcactccggtcaactcaaactcactcagtccctgctcgctccaacccaaaggttggtttatttctttctttttttctttctttcttttttttttttttaagatttatttattatatgtaagtacactgtagctgtctttcagacactccagatgagttacggatggttgcgagccaccatgtggttgctgggatttgaactccggacctgctcttacctgctgagccatctcaccagcccatttattggtttttcgagacagggtttctctgtttagccctggctgtcctggaactcactctgtagaccaggctggcctcgaactcagaaatccgcctgcctctgcc

SEQ ID NO: 27319 - DNA, 1198 bp, Mus musculus
tagtcctagaattcagacctgcctgcctctcctaagtactaaaagcacgaggcaccatgcctgggtgaaagttgttgttgttatgtggttggtttggcttggtttggtttttcacatttaataagaacaaaaggtttggggtatagctcagtcattgagcacttgattatcttgggtgctgacaccttggttcagtccttagaactgcttcaaaaaagataaatcaagaacagaggtttaaggactgatagggtgcaatgttctatgaacacttgtttggaaggaaagtatgatttagcagtcaaagataagggatgatgggaaatgtgtgcaggctgattggggccacagttgcaggttataggtaagcgttttttaaacaatggcaagtgttgtcattcaaaccagaaaacatctgagactattaacagtagatctttttcactttgtatttgaggattttgaaaagatttttatttatttatttttggactattgccccattatataaataacatcttgcagatctacatttgaaactgcttcaatattccttctgggccttcctaaataatgtctggagttacattggacttggtgtgttcctgtggggaacaaaagcacatgatcactgaagcctgtagcataaatgagaggcttgtgcgggtggtgtgaaaggcgctctcccagcctcacatgcctgggtgggcaagctaaactaatagttcccagcagttctgaatcagacactgtggagccaagagtctagcatttggaattccactgcctgtgctaagggcctgtcttttatcctccaaaccaccatttgttaaatggcactggacctgttgacaagaggggggagactggcaaagatcaagttaaaaggcaaaaaaaagttcaaaggtaggaaaataagaagggttagttatgtcttcacctccccttcccccaccccgtctctgtctctgtctgtctctctatctctctctgtagctgtagccctggctggctattatagacccaggctggcctggaactcagtgatgtccagcttgcctcccggggttcaatggtgtgagttactacaccatgtttttcctcctcttcacttatttacttatttgtttaattttagtaatttgttacaaagaaacttcatatctgaaagctgggtttgattgtgcactctttaatc

SEQ ID NO: 27320 - DNA, 2275 bp, Mus musculus
ttagcatattgtcaatagtgtcccacactgtccacagtagaggcctgaagactggtagcaggcttaggaggaggcccttccttcccctgtcttcaaacagttccttgagccccatatccaccctcgagtgacactgattggcctaaaagagacttggatagcacaaaagcagtactcaggactctctcctgagctgctcagagctgttaagatgctcagaaatgcaagaaagaagtcactgtttcagtaaaatctctagtaatgataaaaaattaaattagtcttcccaagcatcatggatcattttggacaagattttctaacttggctgtcttcgttagtttggaacccacctcttaactccagtgtttttcttgattttgcttgtgtaaaaaataatctccatcgcatggatcggtctgagagaggatggagccattgtgctagtcttttctctaagcatgttggccaaactaaaatattccgtggatcaccttggaaatgcagagcctctgccactgcttgactgtttaaaacagtcgccttgttgtatgtgtccttctctctgggactgcatgtctggatccttggggatgtcttgtgagtaggttctgtttggcacctaagcagtgctcctaaccctgatgggattattcgcacctggttttgacaccacctcataggtttattatcaggtggacatttgaggcatcctttttctgtgctccgtgtttatagtctccctcacagctcagagtttgtgaagaatgggaaccgtttttgaagagcctgacctgttttttttttttttttttttttttcccatcttcaggaacttttccaattatctgattctccaaatagaatttggagacatcgatctggtcattattggacctattgatcaggccaagtactgctcacatcttttccttgccatctaaagtttattagttgtcagcaccttgcatcggccactcagtatactccagaatcgttttgccctgtgcagtcaattgggataagtcattgcctttgatcctgttggcttttggaagctgtggtcactttttgtacaatgaacaagtctgaagaacaagtctgaatactaacacttgccccataaaagtatggatttagtgtctttgcacacagttaaggctgatttaaaaatactgagttcctatctcattggaacaagggttctcagacttagaaagtagacctttaaaatcatgttattttagcatagaatacccaagacccactgtttgccagacagcttagtacagcctggcctccctggtcccatcccatcagtctagtggggacaactttgacttactagatagagttagtaccagacagcacttgtccatactcagacacaaaacttcgggcagatcaggagcttctgtgaacatgagaatgtctcctggtgtgccctggtcagttactcagtagtaaaatggatgaacaccctttaagtgttaaatttttttgccacagaactactccagatagttggaataaagagctagaaccaatacattactacttacctggttggagatcagtttgtacagcaaactgggttacaaaatctagcctacctttgtgggctgtgtgattggcctgtccgattctgagtttctatagtgctgttggggactgctttgcttctgtgtcctacccaggtttgtctacacactcggacagtactttacactatatagttcagttctcagacttgtctctatcttgcctctggtcagcatcactctcggggttttgtttttggtttggtttggtttggtttggtttggtttggtttggtttttcgagacagggtttctccgtgtagccctggctgtcctggaactcactctgtagaccggactggccttgaactcagaaatccgcctgcctctgcctcccaagtgctgagattaaaggcatgcactaccatggcccggcttcagcatcactcttacgtgacatctgtttaggacttttcagatttaaggagttcctttctgcagttctccaactcctccctaggcaggagcagcagcagtaggagctggagctacaagtgattcctggctcaccgctttgtttctaagtctgcttatatgagccaccaggctgggagtgaacatagagcttcaggctgctcacaagtctggcctctgcagtaactatttgaggaagaaaagtagtcagggcttggtcattctgtaccaagtgagggataaaatttcaggaagtaaat

SEQ ID NO: 27321 - DNA, 1105 bp, Mus musculus
ggtgctaagttatgtgcagccatgggtctccatggaataacctgtctggccccccgaggtctatccaggcattggctgtcagtcttctgtaatgtagactcctttacccatttgatccccagggagtgcttcaaatcttgatgtcagctttaccgtcatttcttgtcaccttctcagagagagtgaagacatttttttctgagtggttctggaaactatctcagcaggtgtgtgaggcctcaacacaactgcaagtgtgtgttagtggttctccctagagcataaggagtgagcagatggccttcgttctgaaaactgcagacaggattgtgggttgaataaacctttacaaataggacacgtcttggaggcttacttcagaactggactggaaccaaggtttccaggctcctggctcaggagactaagccagtgtactttgatgaatgttagctatttgcagagaactgggtggtggcatgtttgaaccaaatgtgagaaaagccagaaggaactgaactggccattgtggaccagatggccagctgtggaagatccttgatccagcagctgcttagcagaccctggccactcaagtatattcctttaaagccaaaatgctgactacctgcttctgcctcatgttgacacccatttccaaagatgatggagccagtgtgagccaggaggaagctgagatggtggctgataatttactctaccatctccttccacagcccaagaggtggcacttcccgctcagacaccgtcttatcaggcctccagctgcccagtgtaaactgtcaatgcttataccaaaaagggcatgtgcagctggtgtctgccagggacagcccagtccctgccttgtggttcccaggaagaagctgcaacaattcagtgaatgattaaagggctgtttgataataaggccttcgttccactcctgtggctttccaagttcctaatgaggctacaaaggctccatccatacagaaaaccaataatgtaaataaaagccaatcctgcaagcatggtttgcagaggcgggtgatgaatgtgaagccacccgcaggatgcatttgagtctggtttttctgtgctt

SEQ ID NO: 27322 - DNA, 5610 bp, Mus musculus
gtgtgtttaaaaaacaccgtcagtcctagggaggtaatgttggacataaattttgaaccagggtcttcagtcttgagcttgactgattggagtggtaggatgctagcctcatgctgtgtccttcagaatctgtctctgctcgcacaccttagcatcctaacagacatcagactggggttgggataccaagtccttagctaagtcttctatggtctcagtcctggttattgggcaactttctgtgtttctgctacaggtgaaacggaggctggatctggagactgaccatcagtacctcgctggtagcagtgggccattccggggcagaggccgccacccagggaaaggtgccattgactccagcttctcaggcccagactgggggaggggtgtggacatggttgtacactctggggccccagtaggctgcccaacaggacttcctcaggccttggaggtggggagttgcccagctacaagaggaatgctttggttggcagacaacagccacagagcctttctgcttagcctgaggggagggagacatttgcctcatcttgccactcactctacattgctagggagacaggcctgttgggggcaggctgagtgtttgaggacccccgcctagcctaacccctgccccccaggtgtgaaatctccgggggagaagtcacgctatgaaacctcactaaatctgaccaccaaacgcttcttggagctgctgagccgctcagctgacggtgtcgttgacctgaactgggcagctgaggtgctgaaggtgcagaaacggcgcatctatgacatcaccaatgtcctggagggcatccagctcattgccaagaagtccaagaatcatatccagtggctgtaagtacttaccaggcaggtgggcaggtaacagccagaccaagccaaattgcttgcagtggcttcctgcattccccacagctgggaaaccaaggtcttaagagagttaccttccccggggtgatagaaggggaggaacgagcaagtcttgcagatccagttccctatagctgtacaaggtttcccgtgtgaatgcttgtgagcgcgcgcgcgcgcgcgcgctcacgcacacacacacacacacacacacacacacacacacacacacacacacatgcatgcctttctgagggtctcctgttccctctcccatggttgcccattcttagaccgctgtgctgacaccattccagcttttgctgtcatcattgagatcggccttatacatttgtggttttgtttctacttctctgctgtaccttctgcctccccaggcatcccgctgccttctctggcatatctgctttggtttttgatagatgattcttcattctgtattgttttctttttacttgatagtgtgtctccaaatcgtttgtatctaattcagctgtgtcattccatggcatgtttgtgctattgttttcttacctggctccttggtgggtgtttgttgactgatcaagcattttactgagcccgtgccagtcttactctaagcctacctggggagcagagccacagaggaaaaggagcttgccagcttctcacagaatagtggtggcaacagattgtcttgagggttagggctgatggatgggttgggggcgcaaggactgctaattcttcactggcttcccacagaggcagccacaccatggtggggattggtaagcggcttgaaggcctgacccaggacctgcagcaactgcaggagagtgagcagcagctggatcacctgatgcacatctgtaccacacagctgcaactgctttcggaggactccgacacccagcgatatccttggattggtcagggtgcattgaaggccgacttggccagtggtggcgccgcactactgagactatagaggttacctagggctctgatgataaaaaattctggctttggaaacaagacctggctctacattgacttaccatgtgacaccgaacaagttacttggattttatgggcctcagtttcacctataaaagagaggacagtaatatctatttccaaaattgtacatattaatagaaaaatagccagggctgtggtggcgtgcacctttaatcccagcacttgggagatagaggcaggcggatctctgagtttgagggcaggctgctctacagagccagtttgctgtctcaaaaaaaaaaaaaaaaaaaaaaaaagagaaagaaaaacgctgggcatggtggcgcacgcctttaatcccagcactcgggaggcagaggcaggcagatttctgagtgtgaggccagcctggtctacagagtgagttccaggacagtcagggctatacagagaaaccctgtctcaaaaaacaaaaataaaataaaatctgacattctcttctgctgtctgaagacagctatagtatacttatatataacaaataaatctttttttaaaatcaagtaatacattttaaaagaagccaaggactggagagatggctcagcagttaaaagcatttgttactcttacagaggacccaagttcaattccttgcatgtacatggtggctcacagctatctgtagttctagttatagtgcatttatgccctcttctgacctccaaaagcactaagtgcttgtgtggtgcacatacaggtatggaaaccactcatatacagaaaagaccaggctgagaacagggatacagactctgggggagcagagccatggggatatctgaactcaggctgctctggtccacatgctaggctagccagggctacccagtgagaccctgtctcaaccaaagaaggaaagcccagtgtggtggtatatacttgtaatcccagggccagggatgaggcagaaactaacactgaaggccaattgaggttatagagtaagacatgcaacataagcataggtcactggattacacagaccctgtcaccaaagagtgacaaacctttccttggtcattaatttagttcccgattgtagcttcaaagttaagactttaattcacaaaaagaaactattagaaagtgtgccttttagtgaatatcattatcagtaagattgtcaaaatccatttcccagtccagacctgttgagcatttgatatgaaattattacaggcagccatgagtttggaattggatgggtagatagtctcactgttgagaaagttgaagtttagtaatgagattctgggcagctactatgggccaggtggtgggatgagggtgtcaaaaaggagtgactggggaggcgtatgtgagtcagtggtccttgactcccccaaccctggcctatgtgacctgccaggaccttcgcagcattgcagaccctgcagaacagatggtcatagtgatcaaggcccctcctgagacccaactacaagctgtggattcttcagaggtgagactaaggaccctaagcctttccaagacagggaggctgggctggtgctcacctaggccttacctatctatcctgcctgctgcctccacccagacatttcagatctcccttaagagcaaacaaggccccattgatgttttcctgtgcccggaggagagtgcagacgggattagccctgggaagacctcatgccaggagacatcctctggggaggaccggactgcagactctggcccagcagggcctccaccatcacctccctccacatccccagccttggatcccagtcaatccctgttgggcctggagcaaggtaggtagggccagggtttgtagtatttggcaggcactcatggcagcccctctcctgctgggcctctcctaacttgtaatgcctcctttctccagaagcagtattgccacggatgggccacctgagggtccctatggaagaggaccaactgtcaccactggtggctgctgactcactcctggagcatgttaaagaagacttctctgggctcctccctggggagttcatcagcctctccccaccccacgaggcccttgactatcactttggtctcgaggagggtgagggcattagagatctctttgactgtgactttggggacctgacccctctggatttctgacagaagcctagggattcagggtgtctggagatgcccacctgtctgcagctttggagcctcctgccctgggccatccttcctgcctcattggaatagcacgatccataccctctgtcccaatagcttctagctctggggtttggttgctgccacattgagcagaccaaaatgggaaggatgttgtacagtgtgtgtgcatgcaccccacactgcgcactgtgtgcctggggtgtgtgtctgagtgtgtgtgtgtgtgtgtgtgtgtgagtgtgtgtgtgtgtgtgtgtgagtgtgtgtgtgtgtgtgtgtgtgtgtgtgtgtgtgtgtgtgtgtgtatgtatgtgtatgtgcacgtgtgcccgggaatgaaggtgaacacatctgtatgtgtgctgcagacacatcctggtgtgtccacatgtgtgcatggatccatgtgtgcgcattggggtgggggtgggctctaactgcacttttggtgtccttgctgcaggggccctgtgaggcccagggtggctgcctgctttcagaatcctgtgtgtcagccaggccgggtggtacagcttgcctggctgggtttgcagggcagcaagagcactgcttaaaagttttccgatcgaagctttaatggagcgtttatttatttatcgaggcctctggcaagcctggggggataagcaaagggtggggggcatgggtgataccttaagtccctgttctctgaagcaagggcaggatccctacccaagagttgctgaggcccaagcagtttatttattgggaaagggagagggagacagactgacagccatggatgggctggagaaacagtccctttgtaccagtactccagccgcatgtatccaggggatctgagatggggagggtacgtgagggccttggctgactgcggccaggaggggtgggtatgcgtccttcctatggctggagtgctcctctgctgtcctccccaccctccagtctgcactttgatttgtttcctaacagttctgttccctcctgctttgattttaataaatgttttgatggtgttagggctgggtttgaaactctccgccagccagagtgaggctagtgttggagggaatgttcactccctcttcctatctgacttaatttcctttcagtttgtaaccccttgagaagaaaactgacccaatggtgggtagggagttatgcttgggacctaagtacagaagagggagcgtcagagtcagcttgctgtgcaccttctgaacattagtaaagatgcaacacagtgaactgtgtttgtgtcgaatgctttcctgtgtgtatgtgcgtgggcctacgcttgcagctgctgttccctccctataggccttgtaagtagaagaccagggagagtttcctgaaaggtgctggggcagagatctgggagaaggaaggggtgattggcaatccatgacttgtgttaaagcatagatggaagtcctctgagctgagcatctacaaagcttacttctttacaacctgggggctaagggggaaggc

SEQ ID NO: 27323 - DNA, 1182 bp, Mus musculus
gcaggaccctcgcctgaggctgcccctggcaagccaccctttgagcaggacgctgtgttgtccattgtggtgggcggggacccggagctggtggtgcctgggcacacagagggtctgggctccaacctggcacttgccgagctgcaggctggaaccgagggagggtgtgccatgctcgccgtcccagtctatatccaagcctcagagtaaccaggctagacttcccggaggtgtgtgtgttgggggcggggagggtgcactagcacaatcccttttggaagttactgtatcagccttgccccaccgctgttcttccatgccccgagattatctggggaaacctgtagcactcacagggtctgaggcaggcaccatagctccagggcatagcagcggtaagagagatggccagagcatgaagtgctcagggcctagctgatggaggctggtacttgggcatcctttaagacacggtagggtggccccacccacctatccaggttacctggggtggcctcaggttgtgctgctcttcaggatgctagctggatgtggctggagtccttgtgtgttaaacacttcttgatgagggattcctcagacgactgtatgaggtgagcatgtaagaggcacttatcctggggcgtagactatagctgccagccagcccttgcttcagattcaccactgtgacctgagcaagcacatcacctctctctgttccacgttcctcacctgtgcaacaggacttcgtatagcactacctcctagagtgttccgaggacatagtatacgaaaatgtgcaaaggactgggcacagtacccatggcctggcaagtgctcaataaatctcaataaatgtttttaccaacctcatgggtccaaaccacccaggcctgagtctcagagattcctttcttgtcccccaggtggcaccactccctctaaagcacaggaggatactatgtagccctcctattgaccagaggagaatcagcaggctcacacggattacagtcataactccagcagcccacagcactcaggaagctgaggcaggaggattttgagtttcaggtcagcctgggttataggctgttgaccctctcttcctcatgggtgcaggactgaagcttgtctggtggttatcacagagcacagtctgtgcaaatggcccgtgga

SEQ ID NO: 27324 - DNA, 1433 bp, Mus musculus
caggacagggctgtgtgtgtgtgtgtgtgtgtgtgtgtgtgtatgtgtgtacacgtacacgtacacgtacacatacacatagagaagcatggctccagctcccagccaggcttcaaagagcatttttttctgtatccacagccaagaagaaggaagaggaagatgacgacatgaaggaattggagaactgggccggatccatgtaactgttccagcagaggctgggcccagacggactctggtggcctgtgcatcgggcaggcatgtgcgtgcgcagggcaggcaggacgcggtgcaggcagcctccatcgctcagctctcacccaaagcagtagccgcaccactgctcactctcgcatagcatggtctgtgcccaggggtgggtggggggaggggggcgggggggaggtgcctgctgtttataatgttgaatttctgtaaaataaactgtatttgcaaatccaacactgagttgctgggctgcgctaagcccactgctgcgtcctctgtggagggtcggccgtttgcagttgaagcgaactggaaatgtagccctgcagctgacgtgtctcactctgtaagatgtgtacggtactggcagaaaagtcgttttttaaaagccatagataggcttttccttgttcttagctgtaataacacatctagttttggttccctcaagagctgtgtttctgtctgtcacctgtgtactggccccatgtctaccatcctggcccttgtcactcctgtcccccctggtcttttggagtttgtgacacggatctgaaatggatgtgttctcttgcaagcgaataagattgttagagttaattccagctatccagttttctaacgtagctctaaggtcctcattgctgttgtgataattgatacatagctcattggaaacgtgtgcatacatttatattcagatgaaattatggtttgcaccgtctattaaatatctcgatttaattttcatatcgctgtgtgttcagtcaatctctcaccttccctgggagctgaccctttccaggccaacacttgtccagggtcctctggggaaacctgaaggacttgcgaagacggatcttctagaaaccgagagatcctggaggccacagagctgtggtcccacttagcctgggactgcctgggtccactgtcagagagatggtgcttatgcagcccagactcttccctccggtctgccgacagcacctagggcggtgcctgtgggagcctctgtctagtggaaactggtgccctcgtgagacacggcccagtcaggtggtgtgtgttcctacagcaaggacgtgtggtgggcagaggaccaatgtacagatgctcacacactccatttgcgtctgcagaatcactgcatctttggcccagcacttccaccctgcacttttctttatccttctaccctc

SEQ ID NO: 27325 - DNA, 1102 bp, Mus musculus
tacatttagcattgtgagtttaaagctttcagtccagggaaggttttccctggcccattttgcaggggaagaaaagcccctacccaggaggggctgctgggactacttagaaagttttgacagcttgggctccatacagtgtaagaccctgcctcaagaaaacaaagcaagctgggtggtggccaggaaagtgactatgtagcgagcttgtggccagcctgagctacatgagaccctgtctcaaaaaacaaagcaaatcaaacaaaggataaccaaacatacacacagatgaaagggctggcacggagctcagtggggaaagtgctagtctagcctgcattaagccatggattccgtctggtagtgtgtgaagctgggcatggtggctcacgtttataaacccagcacttagaaggtggaggcaaggtctgcgtggagccccggttgcgggtctctattccgcaggatgggtttgtgaaagttgtcaagaataaggcctactttaaaagataccaagtgagatttcgaaggcggcgagagggtaaaactgactactatgctcgaaaacgattggtgatccaggacaagaataagtacaacacacccaaatataggatgatagttcgtgtaactaacagagatatcatctgccagattgcatatgcccgtatagaaggggatatgatcgtctgtgcagcatatgcatatgaacttccaaaatatggtgtgaaagttggcctgaaacattatactgcagcctattgcactggcctgctgctggcccccaggcttctgaataggtttggcatggacaagatctatgaaggccaagtggaggtgaatggaggggaatacaatgtggaaagcattgacggtcagcctggtgcctttacttgctatctggatgcaggtcttgcccgaactacaactggcaataaagtttttggggccctgaagggagctgtggatggaggcttgtctatccctcatagtaccaaacgattccctggttatgactctgaaagcaaggagttcaatgcagaggtacatcggaagcacatcatgggtcaggatgtggcagactacatgcgctacctaatgg

SEQ ID NO: 27326 - DNA, 1120 bp, Mus musculus
gaaaggggttttacttaaaaatattacagatatttcagggttaaattcggggatcatcaaatgtatcttttactatataaacacatggatattgtttttatagagtggagagagatagctgaaaaatttaagactaatttaccaaattgtctgctgagttccattattatcttagagctgaagtcctttggggcagacttgggagcctaagactgtatagaacattacatttaaatgtaaatgaaaaactgactgtgaattccataataaaagaaaaatttaaacacttaaatatagcacaacaataggtgtgaaaaataaccccaaaacatgtttgttgttttgtgtgtttttttgagtcagggtccctgtagctctgattgtcctagagctcgctaggcagagcaaactggccttgagatcaacctgcctctctgcctctccatgataggattagcgtgtgtgcctggctcccaaggaggcatttttgcagttttagccttatgagataggtacccctactgtggacacccggcccttgaaatgacatctaaatgaatagttcagtttgtcaagccaaaatgattgctctactccaaataaatattctcttttaaaaagccaagtttagcagcttaatgtttttggccagtttttcttcattctggaggcatttatctggtatttagctatctcctgtttattaaagatttcagtaagcctagttaaaggcaatgtttgcatggtttctcttgatctgtttgtctagtttgatttgaaattctttgtgccagtgaaagcaatcctagcagtagaatttctgtaactcatttttgtaagtctagattttctttgtgttagatttgatcatgctatactgagaagtcatatgttgctgttcccacagaccattttcaggcttttggactttgttcttctaaatagcagtaagctacccctaagaaatggtgctgccaatataataatgagggctgtgcatgaatcagtggaacataagattaatttttcttaaaaccctaacgtctcaccttaaattggctcttcacaccaattgaaatagccctttctatagttagggtcatgaataggggtactgtgc

SEQ ID NO: 27327 - DNA, 1099 bp, Mus musculus
gtatgacttaattttgaatgttggcagctaacctgggattttgttagccagatttgtgtggattgatacatgtgagtgacctatgaagtacactattgtctggaaatgacatggctaaataggtaatggggtcagaaatggtaggctgttattggagcccttagccagaggcctggctctgggtttggcacttgtttccataaagagaaaaatgatataaaatatatacaagaaaaacttacttatggttttggcccaaaaccagagacaaagccatactcaatatgtctctgttttctccattgaagtgttaaaatttatagaaaaggtaaaaaaaagccatgaaataggcttatgtagattcatgtggttctcattgggttgaactgggacaggtgtcagtctgagttttaattctatttagtttttgtttaacctagtcagggcttctgagcagagtgtctatactgtcagcatgctgtttcttatagggagctgaggctgaaaaatccagttaagatttttaaaattttgagtgagttctattacagaaagaatgaagctaagagacttgatagtgtaggacagatcattctctttttgaaggctatactcccctctgcacagtcactgacatgtctgccccaaaatcccacacttaatgcagtagcatctaccatatgctccttagccaaggtgttctcttccttgagcttgtctgtcttccaagcaaactttttaacatttaaaaaaatttccccctgagacagtgtcttatttgcagtcatggctggcctggatctagtagacattttaattttaaaaactatttttgaaaagaaatgcctgctgacagattagtaagtggattgttggttgtttgacccatttatggcagatcttttggagatagaggagaaggttaggttagaccagtggttcaggggccaccgatcagagattctgcatttcagttatttacatcacagttcataacagcaggaaaattacagttatgaagcaataaaagttttatggctggagatcactacaaccataggaactatattaggtcacagtattaggaatgttgagaact

SEQ ID NO: 27328 - DNA, 1196 bp, Mus musculus
tgtttgcctggatttatttaaaggatttattcacttcttctttaagaacccctatcagctggtgagatggctcagtcggtaagagcacccgactgctcttccgaagatcccgagttcaaatcccagcaaccacatggtggctcacaaccatctgtaacaagatctgacgccctcttctggagtgtctgaagacagctgcagtgtacttacatatagtaaataaataaatctttttttaaaaaaagcaaaaaaaaaaaaaaagaacccctatcatattcaaaaaggctatttttaggaccttttcttgtgcttcaactatgttggaatattcagggcctgctgttgtaggatagctgggctctagaggagacatactgcctgtctgccttcagcctacttacttgctgccctgggaggagtggtgtttgggttagcaggggttgcctgctggagttggggtctgggaggaagcaacagattgggggagggaagttaggggaaggtctgtggaagatccatatgtgggcaggctggaagaaaggctgcagctggtgttgtattgcagtgctaggggtgagactaggggttcagtgttgggcaacagagagagagaggaggaggtcttagggcagcctatctggttttttggcaggtacggcctatagtatagcatgaagtgcctcctggagttgttagctgggatataatgattagtggtgggagggaagttaaagaggggaatggttgaagaaactgacaggaagtggatgaggaaaagtattaatgttttttgatatttagtcctttttgctagtatgttaaggggcactattctccattgaagaattactgcaacaatgatgttgtcttgttcctttttagtcttatgatcaggtgagaaagatttataacagagccatcagaaccactatttatataaagctcagggtcagaggcaactcccttgtggacaacagcattattcgtgctgcatcattcttccttttctaaccagcagatcttgaaattagagacatttctgcaaacactaaccagagagcatcaagctttttgttttgctgtgtttgttccagtgagcaggaaaatgagtaaacaacagatttaatggccacccaatgtttccaaacagttgaaggaccagagtcctggtcaggtaaattagcttagtgcagcta

SEQ ID NO: 27329 - DNA, 1118 bp, Mus musculus
attttcatgtatcctctttgctatggttctacattgatggaacaaaacaaaaagctgtagaaagttattaaaattaattttacagtggggtattaagtggactggtgagtctcagccttataatcttccaatgttggtttttcccacgtggtattatgagagtaccaaatgaaggaatgttataaagcacctagtataagattagcagccattgtcaactcctggtaaagtagcaagaaaacaagatgtatgaacagagagggatgggtgccatagggatgagagtgtgtagcaaggcaaggagcagtccaggtcattaaggatgtgggccatgaacggaactgagcctagcctgggaacccagtttcacattggcattcattctcttttcaggtgaacaccatgtccttgaagattcagaccagcaatgtaaccaacaagaatgaccctaagtccatcaactctcgggtcttcatcggaaatctaaacacagctgtggtgaagaagtcagatgtggagaccatcttttccaagtacggccgagtggctggttgctctgtgcacaaaggctatgcttttgtccagtatgccaatgagcgccatgcccgggcagctgtgctgggagagaatgggcgggtgctggctggacagaccctgggtaagctcaacatctttcctctgagtagctactaccgagattttaaatttccaacagatagaaattatatttaaaatataaattgagtaattcttaaatgagcgttaaataggggattgttataggagctccttttctgctaccttgctttctcagtgcctccagccccctttttagttgtgtttctgggcatgatagcacacgcctttaatcccagcacttgggagggcaagtggatatctctctgagttcggggtgagccaaggctacacaaggaaccctgtctcaaacaacaagtgagtgtgcatacacatatgtgtatgtgtgtgtgaactgtgatcctgtatggaggtcagaggacaactttatggagttggttctctccacttttatgtggattcaaggatcaggctgactagacagataacgtttcccactggcctccatagcctccctcccc

SEQ ID NO: 27330 - DNA, 1940 bp, Mus musculus
gaggaatatgtcacttgtcacacatgccggtcaccggacacaatcctacagaaggacacccgactctatttcttacaatgtgaaacttgtcattctcgatgctctgttgccagtatcaaaactggcttccaggctgtcacaggcaagcgagcacagctccgtgccaaagctaactaatttgctaatcaccattgatttttccaaaatgtgttggagatttggctggacaggttaccatcagagtggatgtaccattgagttaaaaacaagatagaaaaactgccaagttgtttggcaagtgattgttctgaaataccttgcaagataccgatattcaagctgttgacatactcgttgcctactttaacaactgtcagagaaacgtgatgggggtaaggaggtactttttaaaatcgttcatagacttctgtaaaatgcaagataaattaaagttattataacagtaattctttgaagtcgatctgtccttcagttttcttttctacaataaagtgttcgttaaatttggttaaaaacaaaacaacaaacttgattcctgggctgtggcaagttttctttgtcctcaaaactggcagatactggagctgggcagccatttttccttttagtgtctcttgaagctacatggctagaatagataggtcttcccttgaaagagtggttggaacataaggaatggggcagcgacctgtttttaatgtctagaaaatgatttggagggtttaatttccttttgtgaggattactgctacttcttcctagccaattcctcattctctcacgtgacaacagctgaaagtgccaggtgctagattcctcctccttggaattgtgttaggctagttggtcctctttgaggaagcatatagtacagacttcttagcacttaggaagcttctccaacctgtgctctaggtcagtaaaacttcgtcctctgaaatgcttttctgtactaaactaacttgaacgtgacctagaaaccaagagatactgcttcatgtgtggtctttattgggccacaggagggtcaatcttgtgggtctgtgctgtaatctgccttacttgcacccaccaggataaggacataaacggtgctcaacttttctgccaccagactgttaactttgctaaatggctcaagaacagtcagttagccctgctgtcttgactatgttgtttttaatcactgtgacctctgaattttcaagtataggccaaatgagccaagtaacttggctgtgaaatggcagaaggaaccttctctcaagcaggtaggtcaagagatgggccatatatatactgatatactggttgacctgccatcaccgctcactgccatgtgaatagaactgtttatgactgcaatttcttttttctttttcttttttttttgtacctctgcccatgatccccaatgttggctataactgcgtgaataaagcaaggatcagtgcctcctgtgtaactagtgctccattgcttttgtgtgttgtgttctgtacaattattttcttggtgggaccactcgggatgccatggtactttcactcttcagtatgtgctgcttgctgacttcaatcacaattttcaacttcataatggtgaccatttaggtgatttctaaagagcaaagctgggtgtagtagggcacagttgtaaacccccagcatttgggaggcagagtcagtagcattaagactttgtagccaacctggatcaacaaagtgggggacagggaaacaaagtatgaaagagactgatctgtttgcaacattccattcccatgctctcttttgtctttaaggattgcatgtatatggtatacatacataaagacagacaggtaaaacaaaacactcatacacataaaaacatgaaaacctttttaatctaatgtgaaagagtgcctaggcataccc

SEQ ID NO: 27331 - DNA, 1189 bp, Mus musculus
caattcgtgatactctctcttggtgcagtctactcaaagtgtagctgtcatgatagtattcagcagaaggaggtatggagccctctgaattagtggggctttggtgacagtggcaaatttgtggtcagggtcacatgtagtactttcccataaaaatcagtagaatgagctggggctggggcttactgagcatctgtaaagacccagattttggttaatagtttctgtcttcaagaagttcctagaagccgggcctggtggcacacgcctttaatcccagcacttgggaggcagaggcaggcagatttctgagttcgaggacagccagggctacacagagaaaccctgtcttgaaaaaaaataaataaataaagaagttcctagaacataacagaaattcatgtgtacatttaataaaagtaaatctgcttcattaaagcagagtatctcaaatagaaactttatattcttgttattactaagaatgtgcttaaatgccaccctttccttaaagttgctgaaccgagtgttcaacatcatgagagaaaagaatccagatatggttgctggagagaagaggaaatttgttatgaaacctccacaggtcgtccgagtaggaaccaagaaaacttcttttgtcaattttacagatatctgtaaactgtaagttcgctagtgggaacccttcattccaataaataccagatagacttgtggggtattaggaatgttaaatgtctttactgtagtatttctgtgcaaatgtaggtcatagattgagggaagtcagtttatgtttgtctgttctcagagctcattttatccaaagatgagaaaagtgagttagtgctgcctgatgagtagatcctgggggctggagagacgactccgcggcaggatgatgcacaggcaggcaaggtgcccacacacattatgggctgaggatgggatagatcctaaccacagagtcaagagtgaaaaggctacttttcattacgttcagcattattcaaaatattttactttcatgctgatgacagcaatagtgtatgtttactacaaattagaaaagtaagacacagtagagaaaattaaaagttatatgtaaatctaagtaggtagagataatcaaaacctagttttgcttttagtgttttgttctgctttcatgcttttaggcatgatacac

SEQ ID NO: 27332 - DNA, 1227 bp, Mus musculus
atggcctgtcagcagctctcccaccttggctaggcttggcagccctcggtcagaacaggcttcactttctacagcattatcttcttcagtgtggggagggaggcagctggctgatgggctggtgtcctgtgcaaacaggtgatgcctgggatccgcacagctgtgtagtggcactcgctgtgaggcgcacccacctgccagtaccctgtttcaggtgctgctttagagtgctgggcagagtcatgcacatcctagaccctctgggaggtttctgtgagtggtgatggcagcgcctccttggggtttgcacaagggaacatggggatgggttacagaacctggcacagcagatgcttcacctatagtcgcttctgctggggcactgtggctagccatcacctgaaactacccatcacagagactgccaggcccttcagacctttcagtgaggagcaagtccagggtcctgcctgatggaacccagtgattacaatgtcccttttggtgaagtcctgttctgtgtgagccagtatcttactccattgaacccaggcaggaggagatacaaaaggaaataattatttctagacacctacatctagcgttgtatgagacctctgtctcacttgacttatgctattgcaagccccatttatagaagaggaaactggtaaagtgaatttttcaaggtctagccggaaagttcagagccagccagggtttgagcttagatctctctagcttcaagctgcgcagttcccaccattgtgtgggtacaggggctggacatacctagggatgggagctaggaaggagatggtattggctttgttggtagagttctctagcgcctccctgcctgcttctcatgtgccgcttcccctgcagtgtttgcctggaagggcgagacagatgaggagtacctgtggtgcattgagcagacgctgcacttcaaggacggacccctcaacatgattctggatgatggtggtgaccttactaacctcatccacaccaaatacccacagcttctgtcaggtgcgcaggtggggtgggcactggtagcctgaaggtatcttgctccttcatagacatgaggcagtgggcctggctgaactcccagatccataggactggcagacaggaggttcctgcaggcaatggccttctaacttgtgatgtgaagccaggctaactgagggtgggggcagggctggctgagttcat

SEQ ID NO: 27333 - DNA, 1176 bp, Mus musculus
gggagatcctgtctcaaaaagcaagacaagagaagctgagaaaggcacttcacagtgacctttagcctctatatacatgctcatacgtaaagagaggctgttgtccttttataaaataatacacctgctggatttgacttttctgggaatgtgacctagaggtttgttgctggaacttccagccctaataagcccctataacagatacatagtttaaatatattaattacaaaccatatgcccagactggtcagatctggtactgttcttactccccagctataggacccctataaacttacttgcagtttctcccagacatttggttctggtccattgcagcttcctccatcctctctccttcttctcctccctaccaccccctctcaagcgagcatccagtcccacattgacaggtgacattgtgagatccatagttctagagctgattttccaaggagcacttctctttgttgtgagtgacagttcgcccagcctgaaggctgtagggttacacttgtattggtccttataaggtgaaggcacttcatggttaatgggaacaggttgctcatgtaacttacccattctgttcccgcagcggacatcggactggccgcctggggacggaaggctctggatatagctgagaatgagatgccaggattgatgcgcatgcgggagatgtactcagcctccaagccactgaagggtgctcgcattgctggctgcctgcacatgaccgtggagactgctgttctcattgagactctcgtggccctgggtgctgaggtgaggcccacgctctctgactccttcaagttgcttcccctctctgacctcagccatgagtgaagactgtactggtaggagacctagcttgcagagccttttctggtcaccttggttttctctccattccctattgctgctgctcttgggggcaaatagtctttcgtctcctgcctgagagtgctggtagaagacccccaccccaatactccgtttagtcatcccaaaacactcccattggccttccttgggccaagtgctttctggacagtcgtgctgctagaaaggtagagtgctttgattggttgagcctgtattatgtatataagatcttaaggagaaggggccctgctagagtaggacagccaaaataagagttcttga

SEQ ID NO: 27334 - DNA, 1195 bp, Mus musculus
ttatgggtatttttagtttctgtatttggtaaaaagcaagtcttttttttttttttttttgaaagaaaggcgattttattaaaaagaaaaacaacaaaagggagatgggaccagagcacaggttagtccatccacagagcacaggttagtccatctgggccttcagcgtcctggtgctgatcttgtctttctcaatgacgtggacgatgacgtccatgcccgacatggcatcccagtccaccgcgttcagcatggcctgagaaatagtttcaaacaggtgttctggatccatgttgggctcccagagagactcacacatcccatacatttgttcagagcaggtaccactgactacaaagtcatcagtcaccatgggacagccagtgaggtccagagagcaaatgaagagcttgaaggtcttcgggtccaggccagcaatgaagcaatgacaggctctgtgtagtagggaccgaaccgcttctcatacaggaggttggccaccatgctcatgaggagggtgtaaggcttgatctgccgacattctttcacctcatacaggttcagtcggaacttgagacgttgggcaactgtctggatgtcagtggcccggccggacaggcctatgtagagcctgtcacccatgggaaagatcttctggaagtccatggtcaccatctgggtctggatcccgaaatgcctgtctgcagccatggccacacagttctttcccttcatggccatgacggccccttcattataggacataatagtcatgattgcgctggagtggaagcccgatccccccgaagcaagtcttaatatcttttgttttcctctgtattttgtagtcagttaaatgaaaagcccttaccagaaggctgggaaatgagattcacagtggatggaattccatattttgtggaccacaatagaagagcaactacttatatagatccacgaacgggaaaatcagccttgtaagttttctaaacattataaatcaaaagcacagctaatttcttggatttccacagaagatttcagttaataaagacaaagttgtacttgaggtgggcccataggcactgtacactgaatcttggtggtttttttttttttttttttttttgcttggggatagggaagagattctcaccttgtaaccctgattgacctagaactcactctgtaaact

SEQ ID NO: 27335 - DNA, 2651 bp, Mus musculus
gattgctgaccactggtctacagtgggtagttgggacatcatgagaagactggcatttcctgagggtctgctaagcacctgcatggtgctgtgtgcttgtttctaagtctactacaggggtgggtattgctctcccagttgaccagagaagacactggcatgaatcttggaaaggtaaaaggcagttgcttgaaggctgcgtgattcaagggcacatcatcagacctctgaggtgcagctgtggggcactgcctgtgtgcatctttgtatctttccttttctcaagccaacaattctttctttcagttttaaccgcctggacctcccaccttacaagagctatgagcaactgaaggaaaagctgttatttgccattgaagaaactgaaggatttggacaagagtaattgtttagaccttaagccaccagaggccagggacttgtctgcagtgtctgtccccttccttctctgcctgttgcacatcttattgtaaacttggactgtgactagagagttacctgagagtaagtaaattaatgttatcgttgagatcttccagtcattctggatttctactcaacgtttccagaaagcagatctacaaactgtagtcagaaacttaacatgagatttaacacagcgaggaaatttccctcgtcttattccactagattgttcccttaacaacagtttgctgtatgtccgaagtctcacttgggcataggtctcttagtgggtattgtaaaggattctgcagggacatctcggaaacgcaatacacaaggtcttcctgtaaagcctcgctcagaggtgcaagcttaactcagtgtctgggcacatgagcagctgctgcttgtgctctccgctcgtcccagcctggcctgactgttgtttttcattcctggagcatgaatcagtgcaccattctgatgctattcctggaagtgatgcaggacttgcatttttctacaaagtagttttgtctatttgaattcagggaaaacttggtccccgccaacatatgaccatacctctcttcattcagtttgtaattgttctattgccttgcaaatactaaactttacaaacagtatcagcactgtggttccttcacgtttttagaaattaacctagaattaaaataagttcagatgaattcatctaagatcattcttgatttttttaaatcctacacataaattgaagctttatggtgttgaagtaatccaacaccttagttacatttcatttttgctaaactattcaagttgcaaccatttcctaacacaaatggaggtcagtggtgcagactctgcagtcacaacagcgtccagcagccacacagctgcgctgtcttcacactccactcctgacacaggagcagccgtgtctaccctcttacatggtcctgatctacaatatttttctctcccctaaaaattgtagatttcccttttctttccatgactcctttatcttaggctgctcctttagtaactgatgaatgcactttgaccttctctgtaggtcatttaccttggcttagcattagactgtgaggatggttgctgcccagactttatgggcagcaagatgaaacctcagccaggtgagtccctattgtagccaaatcccaaaattagccttatttctctaatggggaccttgaaatgtgttggtggcatagcataaagccaagaacaccaagtgtgacaaacccctgtcccataggaaagaaagtgtttctgtgtccctagctgctcatcctgttctcatcctgggacagtttgaactcgtgcagctgtgctccttaacactgccatcctcagcagagacgtgacagacgggttgcctcatgaagaagtgatcagtgaagggagagctcggctcctccccagccctctttttacccttataccacaagaaatacatgtcatctctagaagccctagttctttccaaagtaggaaatctctgcctttttgttggtagggttaaaaaaaaatgtatatgctaattgctttgtcttacagagcgaatgtctgccaactatccattcactacataggcctgaactttggtaataaatggctataaatattaagccttctacaaagacttcctattgaatccaattcttgtactaaaacatagttatctaccatattcactagagatttatgagattaaattaagagataatgtaagaaaatagactttgttgattctgcataatgcttcatgattcatttagggacctagaaatattatgtgaaaatgtataaatatcatccaaaaggctttctgccctatatttttaaaatacagaagttatatttgaagtagtcctggccctagttctatagggcttggctatttaatatttttatggaagaaacgtttagttctggaaaaggtaaatgcttgtatatatttttgcagccctggagtctcccaactccatttcttcctttaatttaattgatcacatgtatatgtcttccctgctgtgttagaaaaacgggggctggatatcccaggagtcagagcgtatataagacaatgcacctaaacagcaggcacattgaccagatgctctcaaattttggtccaaaatgagtatttgggaatagatttattgtgaatgttt

SEQ ID NO: 27336 - DNA, 4024 bp, Mus musculus
accagcctgatctgccagacagaatcagagtaggacttgtattggggggtcagggttttttccctgttctgcctagttacctgtgccaggtgcttaatcacaactctaattgtgattaaaggaagaatttgtacccctcagtggtctgccccgcagaaatagggtgtgggatgccaaccctgatctcttccctctctgacagagttgtactctgtttctgcagagagctggcgcctgccctccgggaacccagggccttgcaccacgcagctgctcctatgcccgctcgagctgtgctgctggagaaggctggccaggtgcggaggctgcagagagcccgacagcgggctgagcgccacacattgagtgctaaagtgttgcaacggcagaatcgcgcccgggagagccgttcgcgccggcccaagcaccagggcagctttatttaccagccgtgccagcgccagttcaactactgagcgcccctgctgcaccgcgaatccctcgccgactcctggtcccatccgcctcctctgcagcagccagtgtgctgctcgagggtgttggggggtccacccgcctccatctggatactacaacctccctccttcctaagttttgaggtggggtgatggccctctacttccctgtttatagtctaactcacctattaacctctctcatcctgggtcatcctccctcctttctcagtgtctgattctccaccctcacactccccacacccactctcccatgcttctttttaggacctctattcttgtctctcgccccttcaccttttccctcttagcccacccgattcctaagaccctgacttggcaccttctccgcttcagctcctactttccaagacttactcttctgtttgggatcgctcccactcttgttccctttttttcattcctggcaattccctcccaatcctgcaggtgcaacctgccaggcctgggccattgtcctcatcctgtagtcagggatcaggcatgggttttgatttcagttttccccctttctctgccctgggggctgggctccttattgctgcttaggcctagaaagtttaagtatgtggaagaggagagtgagttgtaagttagataaggtgaagggaatggagggaaacaggcagcctagtgggggccgcagatggggacaggtgggttgagaagtagcagggagcagggcatcttgggagctggtattgtgcttggtcagagtagctaagccctggtcttaggcctgagcctggagtctgcccccatttccttttcctataatcctgccttccagggttcccccctccctgaaatttgtccttcaggagtaacccctacccacccctgtccctgtgagtctggagtccgaagggcttgtaccttgtcaccttaccttgtcatgccaccccaggagtagaagctgggtaaggccccatcatcctgaccatctctgttcatatgcccaaggtgctagaattagcttaggagagatgcaggccagaggatttccaggcagggaaaaggaaacacaccccaaggcaagaatgaggaggcatgatgctaaggaggacaactatgaggtaaagccatccccagactgacagctctgcctttatcttgcctctggccttatatttcatactttgttcaatatggctggataataaacactcctgggtagaggaggccaggagcctcactgtcccaattcccaaatttttcttacagagattcagggccttcaagagtcttcttaatgttctcccacagggctctttctgagtgccctataatccctcccccctttctaattcaatatctggagtaaggaattcttgggtagggcacagggatggggttgccagcttcttctttcttgtggtggggctcagacaccagcaacagcctcttgggatgccccaagttgtttccggttctttctagctgtcctttttaaagtgtgtgctcttccttccttaaaacctttagatgtcctgttacactaacacaggtcttcccttccctccaaccccaggtttcaggtctcagagccaagccagggttggagaaaactgcattcctacgagggtaaaagtagctgccctctttgatcctttcttactaggcttcatgtgggatgggagaggatgtccccaggatggggacagaggaagccctgctagggtctcctagcccagtaagccaaatgggaactataagcagatcaaaattttacactagcttattagagccctattagttcctgtcccaagttcttcagttacaacctagtagtatacttactcttccaactgtcctaaggtcacttcccagccagcttaggatcttcagcatttttaagagctgaagctccctcttgcccttcttgtctactcctcactgccagttggggcctaggcttagtcctgggcaaatgtccatgatcttgctgctgtaggaagcttgatagggcatttggctcaaatttcagaaggcctcgctcctgacctaatttctcaaagctccggtagttctagacccctccaatttctcatctggttgcaaggcttatttttcttttgtactttcctatagatgctatagcatttgagtgtggcaatatttttgttgtgtatagatgtctaagaaccaacactactcagtctcctgctagtctgactcctgaagcatcagaccctgtcatactgtattgactgtgtatgtgcctttcaccttgagcatgcttcaggaatttttttttttcttaaaccacagaacttgaatacacaagggaaccagaattcacaaagtcctatgcaaccctagacaggaggaggttagagagtctgtcttgatttgtggtttcagagaccctagagaaatttgtaccagtttgtattaaagtcagtactaccagcactttgccaaaactacggatgtcagagggacctgtttctagagtgagtcccaattacatcaaagggcaacctgcgctttctccaataagtctgagtggttctcttgagctggtgtcactttctaacctttgccagtctagccccagcagggcaccgtgtgtgtgagtgtggtttggtgctgttttggagtgtgcctgccccccagcctggaaccctctgatcaacttgctgggacctataacgtcttaggtgcaacaaggaccctaccagagctcctgggtggctttgtgtgaggggactgaacgcagacaaaccacagcctgcttctaataccttctttccctaccacctagttccaaatggaaccaacaagttgagtgcatctctgttgggtgttttgtgttgagactggctgaagtgaagaatctttgactgaccatgttgtgatgtgtcgacagactcaaggacacaaccacctcgacctggtcatgtggcatgcctgtgtatgtgtgtaacaggattctgaatgttaggttgtaatgctattcctgtatgggagaaaaaataatataaacaaataaaaatctatttaaagcacattatgctttctgcctcagctgagctaaagtatgagaaacactataatttcaagtatcatcaaggcagaggatactattattaggctaatcttcgttctcctttgtcatataagaaagcaagaggacaaatagttcactagaaaaggacaatatagggtctgactcataaatatttttagaagatccttataaggcacatatatgaagatacctggatacagaaatgagaaagcacagcaaacactggtccactctttagtcccaagcactgggctatgacaaggtccaagagctacctagttaactgtagaactgtgttaagtgcatctcctgatggagcagcacaagcattgcgtgggaggaagcaccatctgtgttgctgacagcctctcacctctaaaacctttgatggaaggctggttctactttctgagacaaagtccaacctggcctcgaactctttctgtagccgagggtgaccttgaacttgtga

SEQ ID NO: 27337 - DNA, 1176 bp, Mus musculus
actcatcttcaataattcaggttatgaaaggatcacagccaagcacaattcctgcaaccccattgacaaccaacagtggcctgatgcctccctctgtcgcagttgttggacctttacacatacctcagaacataaaattttcttcagctcctgtaacacctaatgtcccctccagtagtcctgctccaaatatacagacaggtcggccattggtccttagctcacgagccactcctgttcagctgccttcccctccttgtacatcctctccagttgtcgctcctaatccttctgtccagcaagtaaaagaattaaatccagatgaggctagtcctcagacgaacacctcagcagaccagagcactctgcctccttcacagccaaccacagtagtttctccccttttgaccaatagtccaggctcctctgccaatcgtcgaagcccagtctcatccagtaagggcaaaggaaaagtggacaaaattggccagattttgctgaccaaggcttgtaagaaagttacaggctctctggagaaaggggaagaacaatatggtgcagatggagagactgaaggcccagggctagagatcacaactcctgggctaatgggaacagagcagtgctccacagagctggacagtaaaaccccaacaccctcagcacccactctactaaaaatgacctctagccccatgggcccaagctccacctcaacaggacccatcttacctggcggtgctcttcccaccagtgtacgctcaatagtaaccacattggtaccctctgagctcatctccacagcgccaaccacaaaaggcaatcatggtggcgtaacatctgagccacttgcaggtggcctagtggaggagaaggtgggatcccatccagagcttctacccagcataggtatgtacttgagcttggcatcagctcctcatgtcaggtttttgctggcctgtcccacaagagagaaagcacagcccttttctacttaaaagaagaaaaatggcagttgtagatttacttactgaaagtacattgaaaaatatgcttttaaatgccatgttcagtttatattcattaacatggttctttcctggcttctgaactgattcatgtttcattttcatgtgtatatatgttcctcagttttaaaaagcattttcatacata

SEQ ID NO: 27338 - DNA, 1189 bp, Mus musculus
ccttaggacctcacaggggcagacaggtggatagcaggtagggccagggctggctcaccccgccatgcactcccaggaaggattcggagctgagtcagctgaacctgcgggtggaggatgagcagctcgtgggggtgcagctgcagaagaagatcaaggagctgcaggtgggcattgtggccgtgggggatgccctgggtggaccaggcctggttcaggggctcatggagtcggtaccatctccttaggctagggccgaggagctggaggaggagctggaggcggagcgagcagcccgcgcccgcgtggaaaagcagcgagccgaggcagcgcgggagctggaggagctgagcgagaggctggaggaggctggcggagcttccgcggggcagcgtgagggttgccgcaagcgtgaggctgagttgggccggctgcggcgggagctggaggaggcagttctgaggcacgaggccactgtggctgccctgcgccgcaagcaggccgatagcgctgcagagctgagcgagcaggtggacagcctgcagcgcatccggcagaaactggaaaaggagaagagcgagctgcgcatggaggtggacgatctgggcgccagcgtggaaactctggcccgtggcaaggtctgcctccttcccgcctcgaaatcagttttgactctacactgaccctatccccccccgaccccccttccccaatgctctggtcacttcatgacaatactccgccgcaatgacctcctgacccctggatgtttaacctgatgtctaacccccagctccgcagcagtcctgacctctaaccccgagtgctcactttcattccttggcttgggttgctctggttcccacccaaacctcagcccttccaacaggagtgtgaccccagctcttgactcctgaattcagacttagcacctgccctaacactcttcttgtcccaattttggacgcccccacccccaccccaaaatcctgacacctgttcccagatctagttcctaatactgactcactgaccctgggatgggtcccgagactcccaatttgtgcccacagtaggaacccagaccctgaacctggaactcgagtctggtctcatacctagtgttctaggtcccagtcccagtctcttgcctggcagcccctggatcccccttggatgcacaaacttg

SEQ ID NO: 27339 - DNA, 1196 bp, Mus musculus
ggaaagagaataccacctacccaccctgttccccctgctgaggtcagccacctggttctgtccttggagccaccagtatcctcagaaaagagcctagacaaagttgcaggtttcatccacctgtatgcttgcttgaaccaagtgggtagtctgagctccaggccaggcctgagtggcaaacagatgagggtggggggcagacccatccactcactcaccctgtcccctgtttgacccagcacatcttatactgcattgtggacagtgagtgcaagtctagggatgtactccagagctactttgatctcctgggagagctgatgaagttcaacgtcgatgcattcaagagattcaataaatatatcaacactgatgcaaaggtagggcttgtccagggctccgtgctgttggctgaagtaccagctgtccgtaagctttggcctgcccatcttcaggggtggtcacacagttggaagagtctgggatctggtgggacagtcaggcttcaagccagaccctaagactattgggctgagaactttggctgttagagcatcttagcaggccactcggtgtcccatctgcggagtagtggagctggggtagaaggttggtggtgccctggccagcagcctgccagtaagcaccatctctgctccagttccaggtgttcctgaaacagatcaacagctcgctagtggactccaacatgctggtgcgctgtgtcactctgtcactggaccgatttgaaaaccaggtggacatgaaaggtgaggaggccaaggtgccagtgcacatggctgcagtctaactgccaggcacctggcctccagccaggaattgtgtgcctgggtcaggaggacagtcttgaccaaactcgatgtgttagtcaacttctccattgtgtcaacttctccactggtttgcttcctctaatgagcaagtatatcatcttagtaaagaaaaagctgccttctagactgactgcttggattgaacagggtcccttcattctgtttttctgcacaggactatagtatgcagctgtggtgggtgtgtcagacctcacctagaatcgtgtgtaataacgcatgtgcacatctgtgcctttttccctaggtctgtggcatcaaacagattgtcacaagtttatgaacacttccaaaagaggacagtgttcctcatggttgtcattg

SEQ ID NO: 27340 - DNA, 1178 bp, Mus musculus
ctgtgaggctgtgctcctcagccctgtaggttgacaacccttccttctatctgagcaccgaatctttcctctgccctcacagccaccatcagaggatgaaagtgctgtccctctgtgccctgggagcaacacccttgtgcaatgactagcctcttagctgcagagtccctgactggaaacatggaggctcccacctctacagtgaagtgtgttggctcccccttcccacttttttgcgatagtctctgatttttaatgattaagcttttagtggagaatgtataagaaaatgattgtccactataagggaaacagtgcaagggagggggaaacacgggattcttggccgtggcattagggtaaggacctgacgactgtgtgtgcacagaaaggtggatgcactggattggaggcctccatgaagggcccagaggaggggttctcaaggcagtgctggggcagcctgagttttcaatgttgtacaagttaatagaacatgcctgaggacagtgctgcctaggggcctctgtctcttatgattctgttttgtgagaacgtctgtggctgaaggcatctgtagttgacagaattataccgagtgtgtgtgtgtgtgtgtgtgtgtgtccgtccctgtcctagctttcatcagactctaaatcagtacttctttgtacctggcctagtggaaatactatgatccctgctgtcatgtagagtacatttgggagaggaagtttaccattagagaaggtcaccagttacagaatgcctgatgtcaaataggcatggtgtgtgggaacaaaagagcacactccgtgaaaggacagttgtcaagtgtcctgaccggctggcggtgctcagtgactattgcagaagcaatctgtgagcagaggcctgaccgggatgaagaggcagcgtgagagagttgagccagaaggctcccacatagagaagccctgtaggaggatatggcgtggtcatgaaaaccagagtggccagatggtgtggcaggtgtgagctgctcagtttgttgtagccacagaggtggcctggctgcacagggcctcaaagacatgatcactccctaggggttcacacaacagggtgtgagaattgggtaagcattttcaataatgacatggtcccagtcctgttttagaaatcactcaaggagctga

SEQ ID NO: 27341 - DNA, 1099 bp, Mus musculus
tgggaattgaacactggtcctctctggaaagcaccagtgctcttaactgctgagccatctctccagccccagtagctgagattttcggcctgtgctgctgtgcctcatcaactgttaagttgatgaagtgttctgcttcgagctgggtgggaggggatagatcattcagttaaatgtctttaaaactgggggctgaggattgacagctacgcactagaaacaagctgtaggccctattacacccagctgcagggagtcccagctgatggcctgtgccatttgtctctgctccactgactccattcttcacctcacagctttgtttctggatggagaagttggctttagtgatggcattgaatccagagcctcgtgtgtacttaatgccactctcaatgcgttacaccactaagtgacagttgcctatagataatcaggtaggggtgagaggggttgagcccctcctgctttgctgttgctatctgcctattggtcctgagggagaatgggcctctgggctctctctacccatagcacaccattggcagtcatgtgcagggctctctctagaaaacagaacacagcagcagtgttgtgcatcaaagatactccactcttcccttctttctacccctcttctgtgttcctgagccttgaagggtgtgacacggatgccacttgatggcattacactcaggcatcgtttgctctcagcatttgcacttagactccctggaaatggagttataggcaagcgttctttttttttttttttcaaaatatttatttatttattatatgtaggtacactgcagctgtcttcagacagacacaccagtcagatctccttaagcatggttgtgagccacaatgtggttgctgggacttgaactcaggaccttcagaagagcagtcgggtacccgctgagccatctcaccagcccctttttttttttttttttaaaaaaacaagcgttcttaatcactaagctctctctttccaccacacccagtgtttgaagaagtatttatattctgtcttgttcataagtaaaagagtagccactgtaagtactcagggatatgtttccttcttttt

SEQ ID NO: 27342 - DNA, 1186 bp, Mus musculus
ttggagccagtcattgctccttcccagctctgccaacctgctccctcaagccttcttattcctgtctgtgctacccaagtaggtgataggttccaccacgctctgtaggtgccttgatgttacatgtgtaactaaagtggaaatggtgcctacaattcgtgcagcaaacagaggattcatattcagaattgataaaaaattcctacaaatcaacctgaaaaagacgtagcctagttaacaaaaggggaaataggtgagccataaataaatgtttggcttcattgaaagtcagaaaatgcagatctttttttgttgcttttgttttttgtttttcaagacagggtttctctgtgtagtcccggctgtcctggaactcattctgtagaccaggctggcctcgaactccagagatccacctgcctctgcctcccaagtgctgggattaaaggcgtgggacaccactgcccagccaggaaatgcagatcttatcctgtgtgtggtgagagcagatcttaatgaatgtggagtgtaaatacttgaatgtgtacatgctgtgtgccagcacctagaggagcactgccccaagggctgaggtcttggtgggctctgtgtgacctgtgcctcagcatacctgtaggtaagtgatctcagaaatgaaaacatgcagccagagagagcctagcagatataatcacctgccatcaggcctgagaaactgcgttcaatctctgggaaacatagtagaggaagagaaccaacaaccgtgagttgccctctgacctccttttgtgctatggcacacacacaccaatatatatacaaacatgatatatacacatgctcaacacacacacacgtacgcacacatgtacacaagccacatacatatacacatacacaaacatatgcacacattcatatacacacaagtatacccaactctctctctctctctctctctctctctctctctctctctctatatatatatatatatatatatatacacacacacacacacacacataattatataaaatgtaattagaaaaaaggttttttggctttttatgtttttgttatgtttgtttgcttgttcttagagactaggtttctccatttggccctggcttatcatggaactcactgtagaccaggctggcctcaaattcagagatctgcctac

SEQ ID NO: 27343 - DNA, 1159 bp, Mus musculus
gcacacagtgagcacctcggtttcagtatcatgaatgattacttcctccaataccagtgatccacttaatccttagagagagcacgtctgtttttcagtctagtatttgtgactttttgtatcagcagtaatgaagagttctggaaaaggaaggcagttttggccttggcctggtctctgagaggcttggtctgggcacatcctgctctcactgacttttccttgctcctgtctcaaacgtggggagttttaggcttgatcttacacaggatatagtcagtctggaaccctggaacaggtggggttccaagtgtggcttttcaaggactgaactagaacaggtctagggtggggccacgtgtaccttgtaaaacagctcctgatatgtaatccattcctctctctgcagcctcacatgagtcaccgtccatgctgccgtgtgggctcctgcctctggactttggctcattttccatgcctgagctagtctgtaccagatgctggcagtggggcatggcagagctcggtagagctgaattgattgcccaacccttcacctgtgccatctcttgacaattgttactggaaagcctgccctgtcatgctggctttcagttcttgtggctcttggatgaaagttctgctatcttgtgccccaccccattaaaggactgcctcccaccatcctcagtgtgctgtgtgtgtgtgtgtgtggcctcagtttgcaacacctccttctacagcagttcctgggttgtggggaagttgggtgggatgacatgcagtgttttccctcaacaggatgggagacctgcagggggtggtggaacacaccagtaatcccggaggcagaggggatctccagttcatagtcagcctggctacacactgagttctagcacagctagggatacataatgagatccctcccacccctcaaagaagagatgaacaagaggaagtagtgctggcttctgggttccatttcaagccagctccagcctctcggccctccctggcctcagaatgagacacccagctcttctccctgccagggcctttgtgaggccataggcactcagctgcagtgcattctggtcctgcctgaatttgaagatggggtagcctccttgggaagccaggccgcctcctgtggctc

SEQ ID NO: 27344 - DNA, 1213 bp, Mus musculus
tagagtgaccagcagctccgcccggctcctgcgcgctcccggaagcgggcctgggaggaggcggaaacggaaagctagttacgggagaagttgttgcagcgtgtagacattggagtcgcttggtgagctgttgggactctgggcggcaaaagtcagttccgggtcgcagggcgagaggacttggggcaggagagccaggagggatccgtccgcacgcccgggcatctgaggggcccgagagggcggggtttgaggaggcgaggctggttgacccggctccggagtggatctgtcggcccagaacccgcagtcgtgctgccccccagcctctctcatggcggtcagagcgtcgttcgagaacaactgtgaggtcggttgttttgccaaactcacaaacgcctactgcctggtggccatcggaggctcagagaacttctataggtgaggcgagagcttctggtcccgagccgccggggcgggaagggaagggaggcggagagcgagaggtctgaaaagagcgacccaccccagtaagcagcgaatccgtgtttctacagtgtgttcgagggtgagctctccgatgccattcccgtggtgcacgcatccatcgccggctgccgaatcatcgggcgcatgtgtgtgggtaaggcgggtggaagacgccgagggacacagcgaagcactctgagtcattagtttcctggagcttacccccagtgatcgggggattcccaggctttcgggcccagtggactttggaatctgacgggtgtgtgggactcgaactgcagatcaagaacactgtctctcagacttgagagtagccggagcgaaataccattaagtgctggctatcattcttggtctcgtttttccttcacagggatactggaaagcatgggttgtcgctcggaactatgtgacttacagagtcccacacctaagggcggaggagaggatttgcatctctctcctgcctctgaatatgaacaagttgcttcttgtttttgagcatcagtttctccctcaggaaataactaaggtcccaggtcaccctgttcagctgcatttaattcttacaatttctttttttgtttgttttttttttgtttttttcgagacagggtttctctgtatggccctggctgtcctggaactcactttgtagaccaggctggccttgaactcagaaatccgcctgcgtctgcctcct

SEQ ID NO: 27345 - DNA, 1167 bp, Mus musculus
cttcatgtttatagagcaaatgctcttacctactgagccatgtccttgcccctgaaactgattcaatgctagactttatttaaacttatattttaatgtgacagcaatatcaaacatgtaatttttttcttactctgtctttgaaatccttggactagccatatttcaagtgctcagtagccataagtagctggtgactactgcactgagcagaaaaattctttgcccacattttaaaattctatagtagtgaacaaatatcttccctggctgaatggagaattcagatttgaccgtcctctaacagccacgtgggaggccttccacgtctgagggaagcatctgaggtagcctcatctgtgcagtgcttacactatcatatgcactgtgcaagccttttccaaactgcacacttgagatggacttttttttacagtgcctgtgtcataggtgtcttaaagctgtagctttaatatagtgtggatattaacgacaataaggtcactcctgcatttctgattcgttgtgctgtgctaaaatccctcctgtgtgaactgtgtgaattcatggaacatgtggttacccagcgactgttttgcttccactcaggatgtgtctagtccgaatgaagcaggaaggccggactgggaagtacatgtgccggatcatagttcatttcatgtgggaagatgtggagcagcgcggccgcgtcatgggggtgagtgcttccccaggtgctgccacggcagaatggctgagccaagcctggggttctttcagctttaggatagatttgcctttggaattctgtgaaatgttgcctaacgccagagaggcggctcagctatagtcacctttttttgcctcttggaagcttgacataccacggatactttatgggtttgtgcacattattgtggtttgtcggtatgaggacatcttgtatacagaagtggatagaattctggtgatgcggaggacggagtggggagccagatagtaatctagctgaaggacactgcctttgacattgcttcaatatttgaattagttccccttttacattagttctttgattggtcggttggttggttttgattttctttagacatggattcatgtaccttatgaattcctgattctcctgcctccatctaagtgctaggg

SEQ ID NO: 27346 - DNA, 1206 bp, Mus musculus
ggggacctaagggctgagtctcgggagcacgagaaggctgtgctggcccttcaacaacggtgtgctgagcaggcccaggaacatgaggcagaagccaggaccctgcaggacagctggctgcaggcccaggccactctcacagaacaagaacaagagctagcggcactgcgagcggaaaaccagtattcccgccgacaggaagaggctgcagttagccaggcagaggcgctgcaggaggccctcagcaaagcccaggctgccctgcaggagaaagagcagagtctgcttgaacaggctgagttgagccacaccctggaggccagcactgccgccttgcaagctaccctggacacctgccaggcaagtgcccggcagctggaggaggccctgaggattcgggaaggtgagatccaggcccaggctctccaacaccacgaggtcacgcagcacctccagcaggaactttgccagaagaaagaagagctgaggcagctactagagaaggctggggcccggaggagtcaagaaaatggaatccaagagaagcaaagtctggagcaagagagacaagaggaaacaaggaggctccttgagagcctaaaggagctacagctgactgtagcccaaagggaagaagagattctgatgctgagggaggcctcgtccccacgccacagagccctcccagccgagaagccagctctgcaaccgctcccagcacaacaggagttagagcggctgcagactgccctaaggcaaacagaggccagggagattgaatggagggagaaggctcaggacctggctctgtccctggcccaaagcaaggccagcatcagcagtctgcaggagataaccatgttcctacaagcctctgttctagagcgggaatcagaacaacaaagactacaggtgagtcgccatgtcggggagggaggacagggaacagagccattggctgagctcaagggctgcctgcctgtggtacctcagagagtgagaaaacagagaccgtgagtaccatacctcagagctagcagaggagaagagcaactatagtcagcttcgtccacgcctgatagaggaactccagtgtgctgtgagcattcccaggcctccaagagtgggcacaaaactgtttcctggtaaaagtgctgtttaagttaggtggaagggatgggtagaaaatcggccaggtaaagtggg

SEQ ID NO: 27347 - DNA, 1184 bp, Mus musculus
agctgaagagggattccgtgcgtgcatcccgggcaggatcactggaggccagagaaactatgacttcatcccccacacagcaggtttccctgactttctttttgcccttacttcgccttatccccaccctctgtctcgtatataacagcactcttctatatagacacgcccctcctggcttgattctgctctagtctgcccttacttcagaagggggtcctacttacctatgtaagtgtgttctcagggctagtgggcctgcattcttagttcagatccactcgctcccagacaagtgcctcaggttcaccttgtgtcagccagaatccctggtacccatgggttgtgtcgcttaccagctcttggcacacccaggagtgggtcacagctttgcagctctcagagcccttagttctgagtttacagttagggttcttgatatctcctggtatggaggcctgttctaagggaaggtgtttggagaggtgtttactcctcttagctgtcactgccttaggtcagcatgggagggagggactgctcctggccctgaacatctccagcttcaccccattccccaagggcagacactgtcttcccctttagatctctggctcatagcccaaggctgtcacaaaacagatccattgtgaacccttatgttaaatataaaaattcctcatagaggatattgcccatgtgctgctgtgggtcctcctcagcctcccctagccctggagccatgccccattgagcgtcagtctgagctcaggtacttctggccctcagatgttgcctagagcccaggagtgggatgacaagttcacgttgcctgcctggtggatagaccctggaagcctcgctggccttggagtgctgtggctactccagaccaggatagcccagttaacagggaccatatttgttttcctaggatgggagaggcagtcagaggggttcctcggacagcgtgcttgtggttgagcttcagagagaggtaggttctggaaggatccacttcctattctcctttccccgctcactattcaggcaacaaggtttagggtctgctacatgcttggccctgtgcatttccagcgggagaagggaagtagctttggcatccagagaacgtccatctttctgggaggcaaaaagtgctacagatccaactccacctgaag

SEQ ID NO: 27348 - DNA, 1120 bp, Mus musculus
acattgcacggtccgtgcagaccagccgtgagctagcaggcctgcatcacagcctgtctcactccctcctcaccgtggcccaggcccctgaggccactgttctggaggctgagacccgaaagctggatgagtctctgaatcagagtctgacatccccagggccatgtttgctacatcccagtctggacactactcaaaatacccacaggtagtagccataggcagggcaggacacaggcgagtcaggtgggacacacattggatgactgcagagaggccaaacccccccccccccccacgacccagctacaagtttgccaaaggcgagatttacctgttactcaacctgggagaccctagccagctgacagcccctggaagaaaacgagaaccctccaggctggggaaggtcccaggacacatgggaatgaggcaaaatcacatttgcttgctaacctgctacccaagaagtgccttgccctgaccgtggggcatctgttgtcttcccgccggatgaagcaaccacagtctacactaagcctgaagacctgacagcatatgagtattctgtcctgggcaggagcatcctgaatgtatcaggtacaggagtgtccatggcctgtttgtcttcagtgtctccctcatcttcccttcgacaataaatcctaggcctttgcgttagtccttggctgctgtctctgcttatgtagatgcttatgaggaagcagggcttcaagggcagtaaggaggattcactgattcttacatggtggcatgaacataccacacggtatggtgtctaactgggaaggttaattagaaaatcccctctgggtgatgatggtgcacacctttagtcccagcactcggagtggcagaagcaggatctccgagtttgaggccagcctggtctacagagtgagttccaggacacaaagaaaccctgtcttggaaaaccaaggaagaaaaacaaaaagcaaagaaaagcccgggccaccccaaagtgtgactgacaagacccacataacaagttttgtgagatggttcagcaagtgaaggcacttcctgccaagcctgatgatctgagttctgtccctagtcccacaagataggtgagtaa

SEQ ID NO: 27349 - DNA, 1167 bp, Mus musculus
aggggctgaggggtgggatataggccgttccaaatctcgctctcgccctgcagtgaccatcgtcagtggccttctcatgctcctgcttttcctatcggagttgcagtattatctcactacggaggtgaggggcgtggcctagagcgtgggcggggcctggcattctaagggcaggacccttaaaggtgggagaggggaggagaggcgaggagaggcataggggcgaatctgactgaggtagacatgctctaggtgcatcctgagctctacgtggacaagtctcggggggataaactgaagatcaacatcgatgttcttttcccgcacatgccttgtgcctgtgagtacccgattgtgagtggggagttggactcctggacgtagggtgggcttccagatttacacctctggccttagatcccagagtgaatgccaggccatcctcattccccgagtccatttcttcctcaagatacatctttcccatcaaagctcagctctccgggtccctggtgtcgtagcgccttagcttgcctctctgtttccagacttgagcatcgatgccatggacgtggccggggagcagcagctggatgtggaacacaacctgttcaagaaacgactagacaaggatggcgtccccgtgagctcagaggctgaacggcacggtaaccaggggagggggacaggtctccgatcctacagctggacatgcctgccttccacacatgggccgttgcaggctcagtgacaccgtagacagaagtcagctggcttgcttagggttctacaactattaaaaatcaagagtcagttgaatccatgcttctggtattggaacattgagtagaataccttaggggctggagagagggcccagtggttaagagcaagacactttgctcggttatcgtttctcaagcttgaacatgggtcttccttaggtaaaggaagtttgcttgtccacctcattggctagagtactgtcccccgttgcagtgcgagtatcctaagattaagagcttaaattctcgagtagagttgcctgggttcggatctagcattgtcttgcagtttgtgagcatgatgcagggctggatgcaatacagatgggtctcagcttacaacactctgacttggagatggtttgaaagcacgcctgtacaa

SEQ ID NO: 27350 - DNA, 2145 bp, Mus musculus
gcctcaaagctgcccatgtccgtgatcatcgtgggtgtgggcggtgcggattttgaggtcatggaacagctggatgcagatggtggccctctccgcacgcgctctggagaagcagcggcccgagacatagtgcagttcgtgccttatcgacgatttcagaatgtgagtggacaggaggtggcagggtagtatgggtttgagggccaggagataaagccttttcaatcagtgtctgggaaaggagtaaaccagggaaacttacaggccccccctccctgatctcgcctctcttctggcaggctccccgggagacactcgcacagaccgtactcgccgaagtgcccactcagatggtttcctacttcagagcccaaggctgggccccgttaaaggcacctccaaccccaggcaagggccccgcacaggccccacaggcataggcacccgtggaggagtaggctccaatcagtcctcagcctgcagcctgctccatcctcagggcagggaccaagcgtgcacattctttccatttcatagttgatacttttatatgtactgctgctgctgctctttgacattgcctgcctgcctggcaccttttcattcaggaaagaaagactagtaaagatatcactcctttcaaaattatagactgctagagagagccacacttgctttgaccttgggcttgttgagtagatccctttggtctaataaccccattcaaggattatgtttatgtctattcgcttcagtcacatactttgaaaagacaaagtttgaataattaagtaaacttgtggttgtcctttcctccggggcgagctgaactggggctgactatgaacacgatggaaggtgctacagtgtaagaggtagcaaatgagagaagacaatgttttagagtaagggctgttagacttcctgtgctagctctgtccctctgtttcttggggacatttgtgtagcccaggctggcctgcagtttaccatcctgcggcaaccttagagatgctagaattacaggtgtatgctaccgtgcctggagtatagtcttgatttttttacttttttaatatatgctctcatatagcccaggctggccctacattttgttgccaaggataacttgaattcctgctccttcctatttgagcttcccaaatgctaggattataagcatgcctcaacagttgccctttaccagctcaacagtttgatagcttttttttaatataatgaatgatttaatgcatgttcatttggggaaaactttataggacacatcctaaccactttgcccagactgccttttacattttacaactcaaggtcctggagtagctggaactacagttcagtgtctggtttagcaaaactggttttgtttgcagactggggggaggggagctcctaaatgcaggtatcagtattatataaaaatagaaaatgggaacaaagattggtggctcatggttataatcccaacactcagaagtctgaggcaggagggttgctctgagtttgatgtgaatttgaggtacacgaggagtttcaggtcagacagaacaactttaaaagcaaacatgtgtgctgtttgtatctggtttgcatttatattgggtgccttatccaccagaacttactgcctcctctttttcattatctgtccttttgtaagaatataccagagtttagcagttcccttcccaacagagattcgatttactgtgattacacacatttttgaagagttggtttttcagtatggaaatgagagattgcaggtgatatttgcagtgttagcagttattacaggctgccttctgtagaggggtgatctgacctctgataacctgtgggtcaccttccttccccagatctcatttctagtttccatttatttctctatattatttcatacacatttccttctcagtaacctgttcacaaactgtatgttagagcttttattttgttcttgacatgttgaaagtatttttccctcatctgttactgtttcatgtttttatattccatatgtaaaattatttttatatatgttacccttttaaaaaatatatctatgtatcaataaaattaatatatccacctcctcagtggccgctcttgttgtgtttggtg

SEQ ID NO: 27351 - DNA, 1127 bp, Mus musculus
tgttaatttggaggctttttggtgcagttgtttgatcatgagcctgttcacaaaaattctttatgcagagtcttaagtatcaatgtcagaagagagaattgaggtcactccgtgcattttatattcttttccttttggcaatcaggatactaagatagaatcttcggttggctaaatgtcctttcccttaaaagcatttggtttttcacatcttgttcactgacaccttacggctctttttctaaatttaagatgcttgaaagctgtttcacatttcacatgacatacagaattggagattgatgaataataacgggaaataaatagtatctttcacataatgtagctctggtttcaaacaccaatatcgagaagtctgcatttatttttaaaagaagcatttctcacatacattatatatattatatatatatacatgtatgtatgcgtgtatacacatgcacacacaactgtatgtatgtatgtctatgtagtgccttttttgtgttctgagggagtggtaccctgaggtctcgtcgtgtagttttagagttaagagtggcaacagtctcgtgtgtggaaagtgtggaaagcctctccaatactgcgatggtcttggaggagagacagtatggtggtctgttcagggaaagggttgtgcaggctttgaaaagtggctgcattgtgaatcacttgataactcacaaacacaatttgcttgaaagatagctactgcctcaaaaagcaatatgtttatatgtgatgttctttgttaaggaatcatttctcgtttgaagacatagtgtgaacgcttcagaactgttttgggcttcttattccaactgcaggtttattttccccattggaaactgactatattttagaaaaaatgattgttggaaggtgaaaattttttatcctttctcacaatttattttggttgtatcttcgtacatgcttattaaatatttcatacactcaattgcaactattttgttatttctacatcttagataaatgctaaaaagaaaaacttggttctcactgttcattaaataaattaagaaaatagtgttggtatagaaatcagagagaattgtgttccgcatcccttgaatcacaacaga

SEQ ID NO: 27352 - DNA, 1423 bp, Mus musculus
ccaaataatataagtgggccatcaggatttggggggatccctcagaactttggaaatggcccaggtagtttaaatgctcctcctggttttggaagtggaccccctggtcttggaagtgttcctgggcatttgagtgggcctccagcctttgggcctgggcctgggcctggcccaatccatattgggggtccccctggctttggagctagctctggaaaaccaggacctacaataattaaggtgcagaacatgccttttactgtatctattgatgaaattttagatttcttttatggttatcaagtaattccaggttcagtatgtttaaaatacaatgaaaaaggtatgcctacaggtgaagccatggtggcctttgaatctcgggatgaagccacagctgctgtcattgacttaaatgataggcctataggttcaagaaaggtaaaacttgttttagggtagccgttcacatcagttccttatggggtatatctttattttgctgtgattaatgcatccagattgttttcctagtagttccaggttagaacctgtggattgtttcaattgcagatagattggtttctataacacagagcattggttggctgttttacaactcacagaataaacattgcaatttgttacagtaaagctatctggagagaacacaaaaataattttggcatacagtagagaccatttgtaattctcgatgatcaaggaatctagattggttttcttttataccacatgggatgaagaaaattgaaacgtataaatagaaacgtgagtagagctcgtggagggggctcatgccagtgatggcattggaagttggctacttttgccatttgttttaaagctggacatacttgctttgttatagggtcaaagctttgtctgaaaccttcattttcttttaaaattgaataaagtctctgtatccagattcattgtatgtacctttattgcttctggagggttcttgctgtatagacggccctgcttcagtgttgctgcttcatcttcctaattgaccacttgtaatcagtacaccattttgttagtttttcattaatttctaatataaaaactccacacttgtggtttgtgctaaataaccctgaactttgtgattaatgtcacacttatgattgtgtgaaatgactttgaccataaaaataaactatggagtcctctactgacattatttggtttgaccgccaagttttatttagtttagggagtttaaaatttgttcatattgtttggatgacaatgaaaatcagaaaccacttagtaatcagtgtttaggtatttgatttgaaatcctttactgtgatggactaatttagcaaattgtttttgtcccaatttatgtgaattttggaacaaagagattcataggaaagagcattgt

SEQ ID NO: 27353 - DNA, 1485 bp, Mus musculus
accgctcctccaagcatggggacttcttttgggagcccaacgttcagttcaaccattccaagtacagcttctccaatgaacacggtcccaccgccaccgattcctccaatcccagcgatgccatctttgccaccgctgccatccattcccccaataccagttcctcctccggtaccaacattgcctcctgtgccacctgttcctcccattcccccagtcccttcggtgccacctatgaccacactgcctcctatgtcaggcatgccacccttgaatccaccacctgtggcacctttacctgctggaatgaatggctctggagcacctatcggtctgaacaataatatgaatcctgtgtttctgggtccattaaatcctgttaactctatacagatgaattctcaaagcagcgtgaagtctcttcccatcaaccctgatgatctgtatgtgagtgtgcatggaatgcccttttctgcaatggaaaatgatgtcagagagtttttccatgggctccgagtcgatgcagtgcatttgttaaaagatcatgtaggtcgaaataatgggaatggattggttaagtttctctcccctcaagatacatttgaagctttgaaacggaacagaatgctgatgattcaacgctatgtggaagtcagtcctgccacagagagacagtgggtagctgctggaggtcatatcacttttaagcaaagtatggggccttctggacaagcccaccctcctccacagacacttccaaggtcaaaatcgcccagtgggcagaaaaggtcaagatcaagatcaccacatgaggctggcttttgtgtttacttaaaagggctaccatttgaagcagaaaacaaacatgtcattgatttttttaagaagttggatattgtggaagatagtatttatatagcttatggacccaatgggaaagcaactggtgaaggctttgtagaatttaggaatgatgctgactataaggctgctctctgtcgtcataaacaatacatgggcaatcgctttattcaagttcatccaataactaagaaaggtatgcttgaaaagatagatatgattcgaaaacgacttcagaacttcagctatgaccagagggaactggtgttaaatccagagggggaagtcagttctgccaaagtctgtgcccatataacaaacattccattcagcatcaccaagatggatgttcttcagttcctagaaggaatcccagtggatgagagtgctgtgcatgttcttgttgataacaatgggcaaggtctagggcaagcattggttcagtttaaaactgaagatgacgcacataaatctgaacacttacaccgtaaaaagctgaatgggagagaagcttttgttcatatagttaccctagaagatatgagagagattgagaaaaatcccccagcccaaggaaaaaagggtctaaagatatctgttccaggtaatcctgcagtaccagtg

SEQ ID NO: 27354 - DNA, 1228 bp, Mus musculus
ggcatcctttcaggctaaagcaataaatagtcttcctgatgctagaaattaggaaaggcctgggactgagcaggacttacagaagctagaagaggcttgtttgtctcttgtattggggttcaccagggcaaaaggcagagaagcatcaaggacagaagggaaatgattgatcagggcctgagaggcagtgttacctgctgcttcctgtctaaccctcactcactcagtgcctcttctctttggcagtcctctctgggagatggtccaggatggcattgacctcaagagcatcaagtggacccagcattagaggagtgggctgtgactttgtgctggcctggctgttctggcctcactgatctgtgcacagccaggaacctcactgcctgacgtggtccatgctcaaagcagatgggaagctctgcagtgacttcaccacagaatgttctctagtgaaagctgaggctagctttcttagcctcggctcctgtgtaggcatgtattccgtaatcttcctcaggagttcttctcttgcctggcgtggccattcttatctgagggcctggaggcactgccttgttactgccacagggaggacctacctgtgcagagatggaagaactggaagaaggctctaggttcaaagactgcttctctgtgaatcattactctagctgctcagctgaactggcgccattagggactggcataaacaaactttattttaaccttttttgtggctttgaaagacatctctttgtatcgacttcagctgaagaacaccaagttgtattaaagtcttgtttcctttggggtctcatcttctttcctctcttttgacttaatgtaagtagaaatatccatgaccccaatcattattctaataatttacttaattcattaaacttaattcaataaattcccatttcctgtcctgatccttgaatttttgagcatctggagagaactctgctggagaactgtagaccttccttccacctgcctttctcagacaactcagtccacttgcttttcatccaacagtttaaaggatttccaggacacacatttcattctgggtattgggatgcactggctcataggaccaggaaaggcacactgtcctcagtgagcttttatattagcggagagatagaaactcagaaatagagactgtcatatgtgggacagtgctacgtgagaaaggagagtgtttcaaggcaatagt

SEQ ID NO: 27355 - DNA, 1563 bp, Mus musculus
tttaattaatttttcttttgataattttagggcaatgtgtatgtgaagtgcccatctattgctgcggctattgctgctgtcaatgcattgcatggcagatggtttgctggtgagtaactgctacgaagactttatgttgaaacaccaagtgattaacattgagtaaaaactgcttacccaacttttttctttttgtcaacaggtaaaatgataacagcagcgtatgtacctcttccaacttaccacaacctctttcctgattctatgacagcaacacaactactggttccaagtagacgatgaaggaagatacagtcccttatgtatatagcttttttttctcttgagaattcatcttgagttatcttttatttagataaaataaagaggcaagggtctactgtcatttgtatacaactcctgttaccttgaaaaataaaaatgttaacaggaatgcagtgtgctcattatccctaactagcaaatcctactttatgcaaagctgttctcttgttctgctgttttaaatgtccatgtagaaaatgacattaaggatctatagaatagctctaggggaacaaatgtgctttctgtataaaggcagacaggtcacgttttaatgtttcagaaacctaactttttacacagcagttacaattcacattcatgtatttggctcatggttcagcaaaggtttccagaatccacatttagtgtgtgaaaagtctaagtggctgtatggctgcttggcatttgatcttgattatttggcaagaatgggatttcaaaataatatttctcgatggtaattttttcaattaatgtctctgtaaaagtttctttgtaaatactgtatgttttagtgtgtcttgagattccaaacaaaatgatccctgcatttcctcaaggtggctgacgtaacagattgagtaagcagtcttgggcaagagatgggaaatgcagaaaaaggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaattctctgaaaaaggccacaagaaaattttcgtttttcaaatgttttcatgttacaaacttaagcaaaggctatcacaatatcctttgggtttctttccttctttttttcaagttagtgtttcagcattacatgcctcagatctaccaaagactgaatatgttactctcctaacctctgggctgctcggaaaggggagctgtgtgtgtcagcatacatgcctagactaagcttatttcattcttagtgatagacatcactgttggttgtctaataccactactaccaagtatgtcctctccactgaagaaaacaagttgccccttgaaaatgctctcatccttctctacgtgtttatcattgtctttagctctatagtttacaaagtcacaaaaaaatacataagcactaccattcctaactcgacaaaaatag

SEQ ID NO: 27356 - DNA, 1191 bp, Mus musculus
gtccttttccaatctggacactaaaatttttttataaattcaggcttctagacatattgttacactttaaatcccagaaattgggtagttggaactcaaggccagctgcttcttcacagtgagttccatgcaaaaagttacaaaatgacacttggcctaaaaattaaaaaaagcttcaaagttcccatgttcattaagatgtccttcataaaaatatggtttaagccaggtgtggtgatgcacacctttaatcccagcacttgggaggcagaggcaggtagatttctgagttcgaggtcagcctggtctacaaagtgagttccaggacagccagagctacacagagaaaccctgtctcaaaaaaacaaatcaaaaaagtaataatgatctaattttatacatatattgtaattttttcaggtattttttgcactttccacatattaataagttaaaaattctgttgtctattctagttttctgactcagaatgtgccaaaaaggctttggaacaactgaatggatttgagttagctgggagaccaatgaaagttggtcacgttactgaacgaactgatgcttcgagtgctagttcatttttggacagtgacgaactagaaaggactggaattgacttgggaacaactggacgtcttcagttaatggcaagacttgcggagggtgagtcttcaatagagctattgatttatcatagtggtagaaaggaaatttagctatgcaaactacaaaatggaaaaaaaatactgttatatttttggtattactgtttatgtatacatagttatctttaccattgtcttattgaaacaaatgtcctcattttggtatatggaaacactatagattttttttttgctttatatatcaccagactccttaagaagtgagttgtgattattttccttggcttttacaatttttttagagaaagttactattatttcctttattttgtgtgtatttatatttattttgatggtatatgaatggcacaacatggattggggaggtcagagcactacttgaggggaaaatgttttatccttataccatacatgggtactaaagagtactacaggttatcatctttggtagtaggaaggtaggtctgttagtgcagagacatatcgcagacatcccttgagtttaccacatgaattcccagtattt

SEQ ID NO: 27357 - DNA, 1163 bp, Mus musculus
gctacaggtctgggataagtcatgatttttctaagttctgttctttcctctttatagttgaggtagaaaagaagcagcataaacagtgttagaattgttggggagtccatgaacttgatcttagcaacacacccaaaacctgtaactagtataatttgtgtttttggttttttttttatttttagctccggaccaaaatttaacagtgccatccgaggaaagattggattgcctcatagcatcaaattaaggtttttaaacatacttctgaattggttaaattatatttcaaggaactaatgtgatttttttggggtaacttgtgaaactttttatccttgcagcagaagacgttcccgaagcaaaagtccatttaggaaagacaagagccctgtgaggtaactgttagctttttttcttttgcttttttaaaatttttttctagtaaagttctacaaaccttattttcttgttttttgtttttgtttgtttggtttttgttaaatttttttgtttgtttatttttgagacagggtttctctgtgtgtagctctgactgtcctggaactcactctgtagaccatctggcctccatgtcagaaatctgcctgcctctgttccccaagtgctgggattaaaggtgttcaaaaacattgaccagctaaatcctgataattttaaatagacttcatttcatatagaatcaataacatgaaatattctcattgtaaaataacaatcacaagttttactgcttgaaactgtttcatgaaaagtacatttcatcttatgtatcttaccaaattgaatggttatatctgtttatgcctcagtaagcttccaactgtataatgaataattttgcttcagagcacaattttgtcttctggtttacttcactaaccaggttgaccttaactagaatatgttaaatttattttcattaatctatgtatatgaggacactgaagctatcttcatgcacacctgaagaaagcatcagatccaattacagatggttgtgagccaccttgttgttgctgggaattgagctcaagatccctggaagagcagtcagcgctcttaacctaataagccatctctccagcccaatgaatttatttttttaggcagggtataccttcatagtcataggagacttg

SEQ ID NO: 27358 - DNA, 1150 bp, Mus musculus
aactccagaaggcctcatacagatttatttgtaatcatccaggagagatttgttttcaaaatttaaggtcccaaagaagtaatacaatttggatttttatttcttggggtgaggatggtggtggtggtgtggtggtgctggcattaaattccctgagattcttctgtctctgcctcccaagtgctggattaaaggaatacatttgacttggagtttatacaaatacacttgcaatcccaatacccaagacacaatcctggcctacgtatgagacctggtctccaacaaaatgaagcatgaccaaatagctagtggatagggtgtagcttagtgatagagcccttggctggcatgcaagaaactgagattcagtggcctgcagtggaaataaaacagcaacaaataataagctggatgtggtgagtcactcctgaaaccccagtgctaggactttgggcaggaggattgacaaaagttcagtactagcttgggtaacatagtaatatctaggccggctaacaagaccctgtttcaaaaaaacaaaactcaaaccaaaggtgattctaattttggagctattgcttctgggcacatgtctctctagagagtaactgcctaccccactcacttgcagacttgtacagacatgctggctaagatgacaggctttcctagtcaagatgctgggtggatggaatagaaagtgcctgctatgcttgatgctcctgccttcttcctgttgtctgtcagcagtgtaccatctgtcccaagcagcaggcgggccttccctgttcttgcagcaagcacagtgaaatagcttctgtctgctgccttccagatccttctgccacattctccctactttatttctagttaagtgctcatagtttctgttccacgtagaaagaatttaaaaatctgatttgtaatgtcctttatttttggtttcttttttattatttgtgtgtgtactagctggttttgtgtcagcgtgacacagctggagttatcacagagaaaggagcttcagttgacgaaatgcctccatgagatccagctgtaaggcattttctcaattagtgatcaagggtgggagggccctgtccattgtgggtggtgccattcctgggctggtagtcttgggttctat

SEQ ID NO: 27359 - DNA, 2144 bp, Mus musculus
cttgatgtaatgagaatctacaaggaattccaggaggaagcagtcaggggctggaacccaaaggacagcattttctacccacttactaatttcaactgcttcccagttctatttaaagttatgaaaaaaagtttcccaaaattttcgaactcttttactgtaaagatttgttacaaagaaggtgggaattaccttactttatgtctcatccgcaaacttgcaactctgttgcttgtttccctcctccctggaggctggggtagcagtcgccactccagccactccactctttcaattccccgtctgtgttactttatgagatgaaggtaattatgctgcttatggtccaggtacaacctctttgtaccttcacagagatgtttgtgttgtttcttgtttcgcaggttctggttccatgtgtcattgctatgttgtttgcttggttttatcttattaggtgaaatgtaaaaggttccgtgctgtgaggacttcattttcaccagtttttgtatcactaacggtaaactttgtttgatttattcatcaacatccacagattcattatcagttttgtaatctgtaatgttctaggctgcaaatatttactatgtaaacattaaggagccaatgtcggtagctaccaacagcagcacctctcgctgccttaggaatggttaagtttcaggcctaacaggccatcatggccataaattcaggcttgtgtacagagaagcttcagggaatgaatgcccttatctaaagatctgttcaccatctgatacaaaatgtgctgtggagcaagcatgaggtgacctggcatagcttagggaatgtgtgatgtgtaattaagccaacacagtcccttacaagaggctgcttcccactgctcacattgatgtcttcttgtgggaagaagtgctccaagagtacacatgccatcacggttctggataatttatcatagagctacattttgagacttgtatgatgattgtctgaaagggaaagaaacaagatacttaaagctacaactgtgtgaggtatgatgattgttagatactaatttggggccatcaaagtggcttagttgggagaggtgcttgccaccaagcctgctgacctgagttcaagacccaggaccgaatagagagaattgacaccttcaagttgttctgtgacacacatacacacaaatgtaataaaggattttaaattgaggtttttctttttatgtaactactcttaagtatcacatctggggaagctgtaaccttgaaggcagtcagttttgtgtggttcaaagaaggaagcagaaactgaatgatgctaatcttgccgtgtggtccttactgggtttatcatttaggttttgtaaaggacataatctggtttcattattacttgtttttagggaaacaaagcagaaaccccatattctgataacctcagttcttccctaacttaaagccatgttgaggggctccactcccagttcctgggtcaaagtgaattcacccctaagttggagcactggaatctgttgcaaacaatgttatcatttagaaagatgtgcactacctatgttctgtctgttaaaaaaacctatccacctatagaaagtcaccttgacaaaacagttctggtttgatcagtcattctttagtatgtatgcaaggtggatcctggctgagccaacattgcactgtggatacgtatctgtgtttacacgctattagacagaaggcactgtacatatgagtgttgctttcaagcaatatttgcaaaacatgcaaacttctgtatctggaaaaataaaaacaggttcttgttgctatgtgtcagtcacattactgaagtataaaaggttgtgggctttgttggtttagtttagtctcactatatagccctgactggcctagaactcccagaaatcccgtctctgttccaagtgctggttttaaagtcctgtaccaccacacctggttgttctttaaacaaagtcttgcaatgtagtccaggctggccttgagcttatgcaacccaaagttgggcttcaaacttaaaatgatcctgtcttggtctccgagtataccaccataacccagcaaggattaaatgttttatgcattatggtgagcttgagg

SEQ ID NO: 27360 - DNA, 1197 bp, Mus musculus
cccgctgtcccacccagggcatccgcccaagctccgacaatcccctagccaaccatcaccctcctttacccaggactgtcagcgctacccccagatcctgcctggtcaagtagggaccagcatctaccctaggaggcgcaggtcacctgcacgccagggcggtccttcggttggggtgtctccgcctttatctccttaatcgaggccggactctccttgtcttcctctgatctggaatccgatcccgactcagatttcgactctgtcgtgtccgacttgtccgccggctccaatggggaccttgcagtgccgccatccttagtgtcagtagagctgatgtctacggacttccccagatcaaacttcacgtgactggtagaggaggcggcttccggattcgcggatcggttcatttccggccaccgaggagcttcgcgggtcgaggtaagctgggcttgcccgcagcctgtcctgagtccgcgtcccgctggggtgcccgggccctgcccttcagcggccctctgttacctccttccggtgcagacgcaggcgaggcgccggactgcgaaacaaagggggacgccaacagccgtagtcatggcggcgccgcagcccagccaggacccccaaagccccgcggcgcctcccgagcagcaggaaggagccggcgactgtgcggccccgtcgcccgattccgggagctccccggccccggagctccccggcgcgcccgcagctttgaacacggcgccctacgctgacgccgccctgcggcccggagcctctcggcccggccccgagacctttcgccagcgcttccggcagtttcgctaccaggacgcggccgggccccgggaagccttccggcagctgcgggagctgtcccgccagtggctgcggccggacatccgcaccaaggagcagatcgtggagatgctggtgcaggagcagctgcaggccattctaccggaggcggcccgggctcggcggctgcggcgccgcgcggacgtgcgcatcaccggctgagcggcggagcctggggctccctggactgacaccctacccctgagttaataaaagttgaattttgacagctcccatgtctgctgtgtcttgcgttcgttctttatttattgggtttattttacgaacttgttgcccacctttccagctgatagctagaggattctgggaacc

SEQ ID NO: 27361 - DNA, 2927 bp, Mus musculus
tttgtctattggtttgaagggagaagaaagtgggtcgaagcccaaatggttatgtttagaagatacctcagataataaccattgctttgcatacagttttatttaccagtgccatgtcaatagcagataagttcttacatgaaacatctagtcttttagatatctgaaagtgcttgatacatttaaaggtacaggtaatagaataatattttgtgtatatagtttttttaaactggagaaatgctgtgtgtagaagtagaattgttagcccgcctctgagaacagtgtaccggctgtgcttgttcagtggatcaaggaggtgggagggaaggaactgcaaaaagattccatttgtgtgctagacatttctagcttacccatccccctgtgtgttgtgtgcatctcatgtaactttgctatgctgtatatattgtacatactggacaaacgagtcctatgatatctagtctctaggtattaaagaggttgccaatgtatgacaaaagtagttagtaaactcacacattctgtatactctgttagttcatagcaaggttgtcttctgaagagttgtgaaagtgtatcatccaagtgacgagtgacataggcacccgtgcctatgtcacgggacacaagatgggctgaaggggaagaaaggtcggagaccagaatgtcctcaccagaagacacttggagatctaactagttacatgtgtgtggtttcagtactactatgtatataggggacaaattcatgtcctcatctgaaacatctagtccttctaggtgtttagaagtgcacaaagtatgttaaaagtagacatagtaaataatacgtgttgtagattctgtttaaactcatggtgaagtgttgtcttttggaactagaaagagaaactgcttctgagcaatgcagccttgcttgtgcaggtctaggagggaggaagaaaatgaatgaagagcctaatgctgatgcaagtttggtaatacaaggttatccattgttgcttatatctgtgcatcttactttgcaatgtatagaaaacataggtccaaatttgcagcacccagtcttcctagactgtaaaggtgccagtgtgtgacaaagtagagttagtgaaaagacatatttatagattatgttaaaatttgtaggaaaaaaaccttaaaaccacttaggaagtgaaattgttaatattccacaaaaacatgacagatgcatacacatggcccctggggggagagaactggaagaggggctggaccagaaccttgctgtttagaaggcagtctgaccacagcctttgttaggtgtgcagtgtattcactgtggtgtacacatgctggggaaaccaaagtgcttactgggaacatctggtctccagccttttaggtgcatgatagacctgatgtggtaatgcatgcctttaattctaggctgaggcaggtggatctctgttctgggtcaaccagggctatagactttgtctcaaaacagtgagaaagtgtacataacggattggtagggtggctcagcatgtaaaggtgcttgctactaagctggtgacctgagtttgatttccgggatccacttgataaaagcgattcacagcttgtcttttagcctccacacaagtgcagtggcacatgtgcacacatgcatacagtattgcatacatgtaaaaatagagggctgacaccactttgttaacgatgattttgttacaggaatggtcacactgggggaatggaggttaagcttggcctttgagcagatgctgttaccaggtgatggaggtgggctagggcaaagcttagtgctcagaaagaggcactgtagctgttggttggttcgagttgtctagccattggttgggtgtgcatttcacttaatgttgccaggtagtagaggtaagtcccagtgcctaaaggatgttagaagtagcaagagtcactaaaggccaggctcatctttggggagggctgttttcttggtgtggcctttgttaatcctctcactagcatcatctgcacttaggagttgtgcagtgaagaggatggctgagggaaaggctgctagtgcctctgtccaggggacagctctacccaggggtcctatgtgcatcgtggtaaaatcttgtgttcattatgcacagttgtcatctgaatgttacatcctaaaggaaagcacatggttaagagtagagctaatggctatggtggaattgacaaaagggttcctcttgaacatggaactgctaagccatgtctggccagtgtggggaaattcatgttgctaggctgactggagggacacaggttcacaggatgaggtctgcaggtgtgttgagactgacatcctgagagcccctaccgtaggtgtgtctcccagctgctccgtgtggaatacatttgttgagtgggaagatcccttctacatatgctagtatatagatctggtgataagcttaggaatgctatacttagtgtggtctgttgctttgtgtttccttgtaagctgagactgagcgaatgcagaatttaattgtaactttgccagtacatctatctagaggcctgctgccatttttgtcttctatgaaatttctgttgccaaggaagacaggattacaattttgtctgacagattgagatggcatggtgtattcttggttatcaaaatccctgtgtagtgtggggtttttaattggtgaatattcacaatgtggggaaagcatggtacatactgtataatctcaattacccaagtgtgtgtacgcttgcaggatctagaacaatacatcgagctgagctgcttgtgactgggtgactttgttcttgctttcttgtttcctgtaatgcatatactaaaaaaataaacaaaagcttctttaaagacttgggcgtctctactgcttgtgtaataa

SEQ ID NO: 27362 - DNA, 1377 bp, Mus musculus
cctttcctaccatttgcacagccactggggatgtgccatttaacacgaacaaccgtctctttcttccagtagtccagagactctgacagacaactgagataatgtgcttggtgctgggaggtgcacccgagagctgtgggtgcccgtgtgggagcccagacctggggaaagcaaggcagctacttcccaggaggaagacagctaactgggcctggcggacagaaagcacagccccgtggccggcctggtggacagtggactggccccatccacccagttgcgtcctcttcagcgttcactattgcaagagtcagtgaggtgacctcattaatgagggagttactttaatgcaatggtgggcgtcttcccgagcagtggagtatggagcctgtgccccgtccagactcaggcctgcgtggagacctcattctgctactgcgagtttctgtctggtgcttcttccctcaaggccttgattggtccatctgtgaagtggaatcagggatggtccttacttgagtgagagcaaaggcaactgtaaaagtgacttctatttgtctgatgtaactgtcgtctctgaggcttttggcctcagtctgtcagcctaggcctagtcctggaagcttccagcctcttaaacactcttacctaggcctagtaagcctctgagactgactgctgagtaagctcgccctttctagctctttctggactctggctggctggttcaactcaactgttctggctcaaacccttctccaagctgactgattcaacccagcttctcttggcttgtgactgaattgctctgcttggcctcatgctaactctagcaatctgttctaatcttctggctccttctcattttctggcttgtcctgtcttcatctgtgtctagcttgttctctctctgtaacctgtctctgtacaactgtcccagtaaagctgctctctctctgtctctctgtctctcaaccgctccttcttatgttggctctctttgctcaatactatgcctggcacatagtaggtgatttatactactgagtagttagaaccatgatggtgattgatatttagatattgagatctggtggggccatcgaggccagtgatggtcgtgttagtgttggtagtttcatatgtgtttggcacttggcagttcacagatcatgtgtctctccatcacagtacatgcgcttctgaagagtcgttaagggaaacaggaggcggcagcagctcccttgtgcagagggttaggccaatagctcctcatgctttcagctcgggtctccctgccttgaaagcttgatactcacataccagaagtgcacactggcctgaagtccgtgtgttcagagtggttgcagcaaccag

SEQ ID NO: 27363 - DNA, 1147 bp, Mus musculus
cgccttctgcagcactccctgcttggtctccagaacactgcacccatctttctggccccctctggctcttcctgaacccctctggccttctctttcctttccactcctcctctttccagtgttggggctccttggcgccctgctacagttattgatgtttctctaatacctaatgaaagtaacacaatattcagagttctgagaccagggggaggggggagtcatgcctgggggtcatagggagcttggtgtatttcctcccaactctttcttttctggttccttacggagctgtaatcccacctgtgccatcccatggttggcactccaggactctgagatagtctgtgtcattactgagtgtgccattggcacacagtggacatatccctttcctgttgacggccttgcaggttgtctgtagttgtgtggataaaagagacccacccggaatatgctgcagacatctctctttctgtatccatgggaggtctcttggggtaggcctctaggaggcagaggctgaagtcgccatacatagtgacttgccatcctgtgcagcattcagttctctgttcctagggtcagggggataaacagaacctgccttggacttccctcagcctgtagaacctatttcctgggatgaggatccccctaccatacccctcctagccccccaccacaacccagggctgactgggcatgaggatatggtgttaccctaccgctgctgccgctgccgccgctgccgaggttcaaaccaggtccccttgcctcactgccttgagtctgttttctcagctcaccctgatcatcacgacggtgagtcatttcacatgacacaaacctcacaggggtttactgcccacagctgacttggcttggcgctgcagacaccctgagccatggtgacaagtgggagaccctaagagaagaccctaagaagacttctggccctttgtccctggtgcagtctcagccacaccccatttggtttatggggaaagtgactcaattgcagattagctgggggcgggtcacaaccaagtgatgaggcaagtcacctgtcttccactgtcaccttctcttggcctctgtgtctccagtggtagctctttggatctggagctttgatcccagccca

SEQ ID NO: 27364 - DNA, 1163 bp, Mus musculus
attgaagacagtagtccagtatatcccactgtagtatttaagacagtagtctagtatatcccaccacagaatttaagacaatagtccagtatatcccaccatagtatataagacaggagtccagtatatcccaccatagtatataagacaggagtccagtatatcccaccatagtatttaaggcagtagtactgtgtagcaggcaccttcatttttctcatcagtaaatactctggaccataaatcctgtaaaccaagctcttagccctgcctccattgttttattctagtatagaaataattgaagagccattcagataggaatcagcagggctgagatttgaacccaggcctctgttcccaaagttccctctccctttctttctctgtctttctgtctgtctctgtctctctttgtctctatctccctctttgtctctgtgtctgtctgtgtctgtctgtctgtctctctctctttgagacagggtttctctgtgtagctccgactatcctggaattcactctgtcaaccaggctggccttgaacttggatatctggttgtctcttcctcctgaatgttgggattaaatacgtaaccactgtccggcatttacccattctttatagctactatacagaattattaggcttgctgggtaattaaactcttgaccatgtaaacttaaacttgatcccataagccatagggatgacatgataaactggaagcccctgtagctaaggaggtgaagtggcttaattttcagactatgtgatgtgtgtctctctttttgtcttttgatttttaagacagggtctcactgtgtagccctgtctggtcagaaacttgctgtatagacaaggataaccttgaactcacagagctccatctgcctgttggtatttaaggcatgtgccactatgcctggatgtatctcagcattactatggtgtcacactcattctatctttggtttttagtcttttcttcttgttcatatttctctatgtaacactacgttttttctttaaattgaggcaaaatacacatatcctaaaatttaccgtgtgtgtgtgtgtgtgtgtgtgtgtgtgtgtgtgtgtgtgtgtgtacatctgtgggctggttgtatgtttgtttgtttgttttgttttctcaaga

SEQ ID NO: 27365 - DNA, 1151 bp, Mus musculus
tttaaatgtcaggctgaggtattcgggctggacgtgagcctggagatgctggggacctttgaaaggatttggcctgcggaggagtgtggtgggctggtgtttgggaaaggtctctggcaggtgtgtggcccacagagaaggccgggactgtgaccttgcacagaggcctcctctcggagagttaagccggggagggaggaaggttgaagctccattaagatatccctctgtgggatgtggtgtggcttgccaggttgagggaggaacggtgtgggggtggggagagccatggggaattcagtttgaggcttggtgagatagagaagggctggtcccctgtcaatcattctgtgggttgggcagcatcttatttgagcatctggcttttttcttttgaatgaattcctttggataaatccccatctataatagcagcaaattggaactaaatgtccaacaataggaagatgattgggaacgttttggaacatacactggataaaataatttgcagtcgtgaacggccgctgctcttttcagagcatggatctgggtgctgcacagttctttgcccacttctgtgtgtcatgctcatgactgcccagtgccagtgatgccctggctcccttccttcctgtggatgagaaggtggaggcttgtccctgtcccgtctgagggcgggattcctgtcttatttcttgctttgtcattaccatgtgcttgctcctgatcagaaaaacgaaggggagggggagaaggggaggaagggcacttgttcaaggtcatgtactttttaaactttatctttaatttttttaaatacttacttttattttatgtgtctgggtgttttgcctgcatgtatgtctgtgtaccacgtgcatggctggtgcctgcagaagccagaagagggcatcaaacgctttgggactggaggtataggtggctgtgagccgccacatggggactgggaattaagctctggtcctctggaggagcagtcagtgctgttaaccactggggcagctttgaagttctcatttatttgtttgtttgaagtgtgtgtgtgtgtgtgtgtgatatttctgtgagagaagacacacagatgtcacaggacagcttacaggagatgattctcaactcccaccttg

SEQ ID NO: 27366 - DNA, 1149 bp, Mus musculus
acgtgctggtgcacaggcaaggagagttaagggagcccacaggcagtggttgaggcacccatgctgtcaaggacagaaacgggtttcagtccccagaccatgagccaaaggagggagcagggtcacctgagctccacagtagcttgagcagggcagagagctgaagagttattaccacttcccatagagaggaaactgggaaggcagctgaccacggtgtctctcctgccttccagccaaaccctccctccagaatttgcaggcgtgggagcttgaggggacagttcagagggctaacctcctgcttcatgcatacatactatggatctggaagtacagatgggcctaccaacccagtaggcattgttgccagggggtgggagagatatgtccccttgatctcccaaaaagaaagaagtctttcttctttgtttgtttgaaaacatctgcctggaatctcttggtacttaagttgtctccggcccctctgaccccctttcttaaacccttccctctctcccaattcccttcctgtctccttcacatccctcctctcccttcctccgccctccttcctactgctgctctactcctgaatctgagtcccctggaacacctgggcaaacatctttggtgtcatcaatgcctaggatttagaagagacaacctcaccatctagtgcgtgactgctcatgcgcatttctcctctaacggcagagtcctggcagtgtctgttattctcgtggtattactccagtgtgggaggcacatgaggaaacagagaagtgacctgcctggatgctcctcaggtaggaagtggtagcgttgagaggaaaaccagtggtccagattctaaatgcgtctcctcctagtggatttgtgtctcagtgttgagcggtccagcctttgccagcttcacccctgcacagtttagcctccattgcactcccccggcctgaggatgttgaaatgctgtatagtaggagcgcctttgagatcatagcaatctggcccagcgtcacgtccttgtgaaagtcagtttcttggcagctgtgggctctcatcgatttggtaaggaggatagtagcaggagattggtttaaaaatccagtgatttgggcctgataaatcagaagagaggctgcctgg

SEQ ID NO: 27367 - DNA, 1164 bp, Mus musculus
gctcatgtcttcaagtcccagggcaggttctagtcccatccctgtgcagtacctgccacccaatgtccctcgtcgcttggcctggtgatctatgcttgcctcccaccccacttgcatcctccaccagttctctgagtccatttagctcctccctctactcccacccttccttagcatcacctctgccccacacccccatcttctctgtgttctttgtatcccctgacaaccagatgtgagggtggggctcgggtgcggaaggaggagcacctgctcgctcagactccagccctaccgccctcctgagtgggctgctggtgcctccctggaaacctcctctccttctctcttctcaccttcctgttctctgcttctatcaacttcgccttccacccccacctcttgttcccttttgcagcacccagatctctctggacccttcagtacaagagagacaatttatcctagctgagagcaggccatagtcagagcctgtcatgataccctgccatccgggcttcagcccggctcaactaccaactttgggtcttagaaagacttggtgggccctgatcgtcagctacacaatagggcaggcatattacctgtgactccagcagtacctgccttattcttgtgccaggccttgactctcagcctttaagctctaggaatcccaggacccaacagttgtactattgggagcacaacccacccccaaggccagcaggcccattgggatcatctgctattcattgccactcaccattgaggcccgtactcaagccctgggcaaagtccactgagtttgacctctccgacggacactgtctgtggccagcttagcccgagagagagggagggagggagggtgggagggagggagggagggagggagggagggagagagggccgaggtccaagcaggtgcctggggggggggtggcagaagcctcggttggattggctttcttcctgagaaggtttgaaagcaactatagagattcttagatgccagagctgagtccaagggaagattccagccttacccaagagcaagattatctcccaggtggctcctctcaaatagccttacagatagcccctaggctccccgcccacttctctctgtcccagatgatgtcccaagcagatggccagcat

SEQ ID NO: 27368 - DNA, 1348 bp, Mus musculus
gtgcacacgacgctggagttaggtgcgtttgagtcattcccaagtaagttgtatagccttggatagatcactctctttctctctgagccacaatgcaggtaaaaggtagctaaaactgctgctgtgtgtttaaaggcgaatgggtaaagtaactaatttcccaccctctggcatccaggaatcctgacctctgtgaagagatgctggcgtgtctggtccaacccaagccagagagccattaagaaggggccttcactctggattctccgacaataccaacatcccagctgcgacgtactgtcactgaagagagactgggaagggaaagcatatatatatagatatatagagatatagatatatatacaggaaacaccgcgtccttgcaccgctgctggggctggcggagcagtcagctgatggccacgaccaacatctgcaacaaccttcatttcctttgcagacaaatcgaattggtgggaattttttttcaggaaaatgtataacaatcataatctctcactccccaaaccccttctcctgcaaactaaaaaagcagaccgccatgattgtagacattcccttgaaccccagctgcacagactccaggatggacgagcaccccgtttgttctccagcctctgttgctccctctaatgcaaaggaagaaagaaattagatcacggagccaaggaagagaagtcacagcagcaagacacgcacggttggctatttgccaagaaagaatggaagtctcccccatggagaggaggaggaggaggaggaggaggaggaggaggaggaggaggaggaggaggaggaggaacgctcagttgttcctttctgggtcttgacactgggctgcaaaatcccttctctgttcttctgcctccccgcttcacccttgacctctactcatcctgtcttcatattctgtctcagctcccctctgcctctctcccaaccctcctgttctgtgtcctggtcctgctgagggccactgcaggtaactctcattggaagaaaaagaaactacaagagcaaacagaagccatgggaagggaagtagacactgtgtgcttccggtttctcatgacggaggtgcagcttgtaggagattatatgactgtgattttaagttatgtatattacatgtaacaggaaacaaatattaaaataaactgtgctggtaagtatgcagctgacatttccaagttataattacctgactgtgattgatgtatcctaaggttcctagatcttgccaaactggcccagctgagaacactggactctgggtgtggccagctcccagtagggctgacagattcagtgtagtgaaactgtg

SEQ ID NO: 27369 - DNA, 1850 bp, Mus musculus
tgaaatgcccagccagcctttcccctctgcctctgtctgtcttgtgaatcatcctcttcttcctgagctaaagtagccacgataaagaggccatgagcacagggaaggccacaataggcccatgctgcatttccaaaagcctcagccatccctaaactagagcaggcttgaggaagtgttgccatccggctccatctgcatcagaccctggcttgcaggacctccatcagtcagtatctaagctcagaaatggccttgaggtgacaggagcccttggagaaaacgctgccacaggctgctatttcggcctggcacatacaggcttcctctggcttgctctcaatgtctctccctttctgagtgaaagtatcccacggcagtcccatctcacttcctgtcctgctaaggcacttcatacatttagtcaacagatgtttaccagtttcctgcttgtgtcaggctctgttttcaaggcagaaggagagggagggacctgggaagccactggacaagcctgtctgtccctatccatagctggctcttttcagtacccttcttcacgccctccacctgatgagacagtcccgtgaaatgtctccgggagagccccggctggatgtgttctcttggcttgcttcttggttactcttgtgatgtacaccttccctactcacaggtgctggcctgacacagggcaagaagctaggagagcttctgtctctgtggcagctgagacgagccaagctcttagataacagagccagccatatgcccccggtgcaggctggtaggcctgccctgctccagtggggcagcacattgtctctgctccaggatctttggccattcttgatggagaagccacagaacctccctcctgctcctcacggcatgcaagctcccactgcttctctgagcccggagcaggaacggctctatcaccttggaatcaggctcgggcctcacctacttttgcaggaactccccggcctgaacacacaagacatacatacctcagagggagcctcattgtacctgctctgaatgtgggctacagggcaaggacgaaatgacccagcttagctcgtgggacattagggtttggggagatacttactccatggatgttctgaccggttcttactatttttttttctcccagagaggcagtcagtaccccgcccagggaggaggagacctgcacagctaaaatctagggcaccgtctcctccccctcctccacttcatagagaataaggacgttgtgttgtctgacttcagcctactttttccttttgctttttttgtgtgtctgtctcatcatctctgtggcacctcgctctccagggggccaggtaacagtgagaaaagccacctagagcagtcagggttccaggtgagcatctcaatgcagctcctaactcaccgtgtgacactgggctgtcccatttcacataactcaaaggacagggcaagcattacaccctgagcctctttcccattctgtgtctcatgcgcctttgttttccccacgtttgctttctgtgaatcttttccacacgagggcagaggaagtgccaggagctgtttcagtttctgaatcctgcaagcacataccaagactggcctgaaattgcatgagcaacatcactctagatatctatttttttttcaaaagcaccttagcagccacctgcaatgctgtcctgttccttttctcccagtcccctctctcctctctcgtccccacgcttccccacctcagtgctccgtgctgtatgcgtgtgctctctgttcttgtataatcaataaaagtgaaataaatgtgtttgatgctgaaccatggactc

SEQ ID NO: 27370 - DNA, 1321 bp, Mus musculus
accctgaggaagaaagctgagaagttccaagcccacctgactaagaagttccgctgggacttcacttcagagccagaggactgtgccccagtggtggtggagctccccgagggcatcgagacggcctaactgcaaatcctcaagctgtgggagacctcttccctcatcactacaacccagcgtctcccccattcattgtcctggaaccctgcagcacagtgatccagtcaggtcccgcaaggatggagctggagcctgtgctcaccataatacgttcctttgctacaaacgtggccatttatgtatggcttcctatagactggcccagccgctgaatttcaggaaaaaaagaggtcgagatgaaacctgccccagcaacagtctaattccttctgacaatgagaaatgaacattagatccaaaagaactagctgcttattccattgctgcttaaaagaggaaagaaaccagatccatcctagggtctgtggcattaagtcagtgagtttttaagttaagtgtgggttggtagctgaatgtggtttgtatagagtttctgcctgctcctggttggatggaaggaaacctgctggaactcaggccactgacctctcaggagcctagctgggaacaggtgacaaggaagatgatgggttgagtctagcaggtggccagcttcatctgccacacctccttctgccaaaagccacagtggttaatacctgagtcggccgctgactgtggggtctcctgctactgtcaccgtcatcctgaggcctcactctgcagcaggatgtagaaacctcccacgggttcccatttctcacaaaggctcccatgatgcttctgatgacatggaaatcaacagcaaaaggaggggtcttgctctgagcctgcttcttaagccctggtaaagcctgggcctttcttcagaaccatagagatagctgggtagcttaactctccccagcactgctgtgggattctcatgagtgctgtcatgtttctggtgttagggagtcttgaaggcacacccattgtgcggtgtgggcagagttctgcctcaagaagggctcccaggccctccattctgacctcaggctctctgctgtactctggagtccttctgaggcttgagctcacagcaggccagtgagtgagagtcctgctgtttaagacttttggttcctcttgtttccttggagatgtttttccaagagcacaatgtacattaaagtctttgagttgggactaatccccctgtgtgagtctcttacagctaatctgcccagtttccaaagtagccaagctgtgtgcatag

SEQ ID NO: 27371 - DNA, 1145 bp, Mus musculus
agctcacttaatacggtgtgttcattctaaacctatgcccgcaccaatgctgaagggcaccgtggaggcagggttgttagctccgagtgtctgagatactaaaaaaaaaagggggggggggaggaggagagggctggggaagcccagttggtaaagcgcctgctgtctgagcatcaggacatcagctcgggtctccagaatccatgtaaaaagtgggagaggggagcaaggatgggggatcccagaagcttgttggctggccagcctagccaagttgatgagctttaggtccagggagagaccttgtctcaagaaaggaacatggagactgactaaggaaagacctctggccagacacacattcataggcatatgcactagcacccacatgtgcatgagcactccacacacaaaccacatatctcctgtctctctctttccctccctcctgccctcctcccccctcaatacaacatcaacaacaatgacaacaggaccccggggagaacgctcagatgaagagcttgccacatgaattgaggactggagttctgatgcccagaactcatgcaaaccaggtgaggtgctgtgagtctgtaatcctggcactccacagccagatgggaggtgaagacagggggcttaggcaccagctagtccttcgatcgcagacggtgacgagagagcctgtctcaagcaagcagacgctgagggcaaatacgtcgagtttataattaaaacacttaaaatggaaattcatttatataataaatgactaagtttaaatctgatatttatttgtgtatgtgtgcatgcgtgcgtgtgtatccaagaagctagaagaggatgttacgtgccctggagctaaagtcacaggttctaagtacccagcatggatgctaggaactgaactctagtcttctggaagagtcacaagcgcttgcaaccatcactctagactcagaatgtattatcaagagagacagagcgggagctggagagatggcttgggttcaagtctcagcctcaacatggcagctcacaaccatctctgtaaccccagttcctgaggatctgatgccctctcctgatgtccatgggcaccaggcactcacgtggtgcacagacacaaatgttaacaaaac

SEQ ID NO: 27372 - DNA, 1099 bp, Mus musculus
tcactatgggctcctgttccatcccctggagtgtcatgagaggagatggggcacaaggagtgccgggtaagtgtagctgcagagaaaccacagtgatcacaggagtggggagtttggctggaacgaacccagcttgaaaggaaatggacttgggtaaggccaggcactcaagctgtgacaaagaggcctctagaactcaggtaatcttcctggcccagggcttgctgatgctgggtgatcaaggacaaaaagccagcagagaaggctcaaagtgaaaatggaggggtctgcgagactctattctctgagtgactggctggaaacctggctggctgctaggtcccatctgaatccctgtcttcggatattccaggtgcccggcggagggggagagtggagcaccacgctgctatcccctcgagacatggatagcaccgctgaggggcccatcccgtgccggcgcatgcgcagtggcagctatatcaaggccatgggcgatgaagacagtgatgagtctgggggtggtagccccaaaccttcacccaagactgcagcgcggcgtcagagctacctgagggctacgcagcagtccctgggagagcagagcaaccctcgacggtgagttccagtctagaatgacagccccgctagagccccaccccttcgtgtacgtcacgccccttgagttgaaccctgtaaaagccaccactttaacttaatgggagcctgtcctgacagtatttccacccgaggaaggtctcagaacttgcagtcctaaccttagatcagctgtgtcccttaggtgagcctcacactgcatgccctgtgtctcgggagcctcgccttccttcactttggccaccctagcagaaccctggcctgctgatggaccctgtttctcggctctcatgcaagtcctagtgactatccccctataagagttttctcatgcttaggttagccctgcctgctaacaacttgtctcccaaacagcccacttacagttaagccctgctcatagtggtaatttggggaactggtttagctaaattctgccgcaggagccatgtgcataggtgagttgccccagggtccgtta

SEQ ID NO: 27373 - DNA, 1132 bp, Mus musculus
gacagaggtgggacaagcacttgagaacactccactatgggaacagcccttttgggcaccatgtgactgacgagcatctcatgtcatgccttggctcctccctaatctacagtgggtatcaccttgggagtgttggcatgaaaggtgttgccagtccagtgttgctggcttgagatactcaagggaggtggtgctgccacacagccactgtctcaggatagtggctctgagaggccactctgtcactgaacttagctttgctgcatacagttcttccctggcttccccactgctgaggtggagataggaagggaagagaaacccaggattgagtggtggcatcggtcatagtacagagaggagtgtccctgcctagcttgggtttggcagcttcttgttgagtggaagagggaatgagatcttcaggcctagcagcaccatgaagggggataagggaagtttgtctgaggccaggcctgtctattcaggtggaacctgaagctggacggtccctcctacatttctgtgaggtttccttcctgtctgtgactcttggcatccagtccttgatatgtctgggccctttcccctatccccaccaagccccaagagtcagcagccagaggacagcaatggccttgggatcacctagcccagcttccaagcaaaggcacttgtaggagctagcttctaggggccaccgtggcctccagagccttaggaggtagagtcccggccaccactgagtatctgattctctgtttagctaatgtggacgcttggatttttaaaaagaatagtgtagagacattcatctgatctgatagtagagaaaaatcttttaatgttgtggttttttgagagtctcattgtaaccccagctgattttgaacttcctatgtagttcctcttgcctctacttcccatatggtaagtcataggcaggcaccaccaagctgtacctacatcgatactgtgttgcgaataggcttttgccttggcatgaggggcctgcatggctaagtggtgggtgggtgggcaagcatgtgtttggtgtacggatgagtcattatgctgtggtttagcagactcttctctcaaggtctttggaattgtgtacaggcttagcggg

SEQ ID NO: 27374 - DNA, 1138 bp, Mus musculus
cgccctcacctctcctgctctccctaacccacttctccttgctggatttctaataaccaagccgggtgtgggtgtgggtggtggctcaggtgtgggggctgggcggggcaggtgggtggacacatgagcgcttgctctgagaccagtcaccccaaggggaacgaggctgggctgggctgggctgtggcccctgctccctgatactggtggtcttcctggccccactgcagtaaacagacaaccttatgaccttgtccttgtgtgtgtgtgtgtgtgcgcgcgtgtgggcatgggcagggtgggcaagggctgagcagagaatgagcgggggctgtgggacccgcttcaggcgcatggtgagcagatgatgcatccgtttctctgtctccccgtgtgtccgggtcaggtggctgctggtttctggccctcttagtgactcattccttcctgtccccatcctcccccaacagaagcagtgccccctctcacagcatgtcctcccgtcgggacactgactctgatacccaggatgccaacgactccagttgtaagtcatctgagaggagtctcccagactgtacctcacaccccaattccatcagcattgatgctggcccccgacaggcccccaagattgcccagatcaagcgcaacctctcctatggagacaacagcgaccctgccctggaggcgtcttcgctgcccccacccgacccttggctggagacttcctccagctccccagcagagcccgctcagccaggggcctgccgcagggatggctactggttcctgaagctccttcaggcagaaacggagagactggaaggctggtgctgccagatggacaaggagaccaaagagaacaacctctctgaagaaggtgggtgtcacaagggtgatcccctgggtgtgtctggagcctctcggggaggatcataggccctgttcttacactcactttgtgagcttgcctctcagtgttcattctttccgtctgcctagccagacctcttcccagatgagcattatgatagtagctccctgttgtcaggctgtgggcttgctcacacacgatcccagctcagtcacctgcttttgatcttcatctctgcccgcataagaaccttgtgaggac

SEQ ID NO: 27375 - DNA, 1762 bp, Mus musculus
gttattatctctagagaccctgagccaactttccaattgacacacacaagggctcacaatgtggcttttctgggtccctccgagctttaggttatgaagacttgactcaaaaaaaaaaaaattaaaaaaaattaaaaaccacactctagaaccttttccccttgggctgccatggcggaccagatgacgacttgggcagccgcggcccagcctccagattgcggtctttttacttgctctgtctgccgagaactagcttgtttacaagacgacgacaacagtccaaggcaaccttgggcccctgccatgtccctccctcccctacagcccacagcttttctgttttcctgcagaactcacaggggtcaccattgtggctttctggttcacaccctttggggctgaggacccagaggacagagagaagggcagcacccacccaccccaacctccccactaagtgctcacacacagctggtccgccctccctccgctgccacacgccagcctaggcagtgtcgggctggactggcctggcctctgagcagataggaaagtactggtccttggggcacgtggggaaaccacggctaccatgctccagcctcctcttcagcaaaagaaaatgtaggactcccaagtggcttccagggggttggctgtccttggccgcacctttatccagtcccccaggggcaggtggcggcttctgtacgtttgtgtacatatgcacatagaccttagagtgtatatttaattaacgcccatctgctcacccaaagcccaccagcgccgccggctctcggggtccctgcaggaggcgggtgtgtgaatagcatatatttttacatgtactatatctaggtgtgtgtacaagtgtgtgtaaaaatataccttgtgtgtaagcagtcccgtttttggttgtccccctagcccgtcagcccagcctcttgagtttttcattctgttgtgatttttcatcccaatcctctcctgtcccccactcccatccccaaggtgttctgagccctgagctgcaaaggcctgggcccgcagagcaggacgggagggcagggctgggtcaggccgcctggagggggccggacccagcagtttggcgtatcgggctgttctatactgtgcatatgatttgagggcattggggacattctcttgtctggcgcatgctgcagggttttcccccaggtgaagcaaaggcctgctctgggggcctgttccagcttggccgccccctctgtgaccttgggcaagtcacttgacctctgtgtgcctcaacttcctcctctgtaaaatggggacagtccctgcccctccctacctcacaggcatgttgtgagaataaatgaggtaacgtgtaacgaggcctcatggtgttattgcactgtggtgggctggactgggtaaggaggatggcagcagacgatcccaggaaacccagctagaccccacctcccggaaggctccctggtctgtgagcctgggcagtaaatcgaggaagcatctatgtggcattcagtccaccaggcatcagaacagcatacttcatagggaccatctcagaagaaagagagcagatcgttcattcaaaggcctggcctctgtacatggcaggcagggccccatgacccccagcaactgccccctcaccagcctagggatccagtgccttagggaatatgacctgctgtgagagagctgcatgggggaagccagtgtggtgtggattagtctcagtgacagg

SEQ ID NO: 27376 - DNA, 1166 bp, Mus musculus
catgccccaggccagggtgttgattggccagttaagttctgttaatggtggtgttcctctggcttcagggttccatgtgacatcaggaggcacctcgtgtgtttgtgtaagacggcgagggtggacctgagtgaaggaactgagctaggttccttttgtctttttcttgcttcttgtttcaggacaggggatcagagaggtgagtgctctctctggtgctgagttgtactctgtgctgggtgatgtcctctcagaactccctacgtgcctgtcctttcttgtgcacttactgtgtgcaaggctgtccctaggggatttagacaggaccaagttggttttagttctctctctttttcttcaaggtctgattatttatttgttcatttttgactggattcagacttagaagtagaaactctcagctcagacaacctatatctcttggtcacctgttcctggcacttttcttaaaaaattttcattaggtttattcactttcttttatgtaaatgttttggctgcgtgtaccaagtgtgtgtctgtctggtgcctatggaggtcagaagagggcactggatctctgaactggtattacagataaatggtcttgacccactatgtgggtgctgggtattaaacctgggtcctcggcaggagcagctgccgttcctcagtgttgggcatgtccccactgccctggcattcttctttgacatccttgattttcttggccaaatttagcatcctcaacagcttcctcatttttttagtgtggcgtttcttcagagcaatgcattcacatttgtgtcacaggatgcatggaataacaagacagtgaatcttgtgtgcttcagtcctgcttctgatcttccttaaaggctctatgacaacattggcagacattatctcttttagagagatagagacgtttgctgattcctttagctcttttactcgccagccacggaggacgggagcatgccagcccaggactgtcccactcccctttcttcacaataactaagttgagaatgctcagactggcacccacagtgcacctatgaataggcttgcacctcctctctccaatttctctggtccataacaagaatgcccctaacccaacagcaggcatcctgtaccgtgggtcaagatgccttgctcat

SEQ ID NO: 27377 - DNA, 1201 bp, Mus musculus
aagaagagagagcctatctccctcaccctcacaattgtcatgggtttgagactaacagctagaattggtaaggggaccgctaccttggtaactggagcccaacaactgaaacaaggtctagaaggactgcaggcagcaatgacagtagacattaaggctttagaaaagtcagttagtcagttagaagagtctttgacctcaactctctgaagtagtcttacagaagaggcttagatctattattcctcaaagaaggaggactatgtgcagccctaaaggaagaatgctgcttctatattaaccattcaggagcaattagagactctatggccaaactcaaagaaaggttagaaaaacgaaaacgagagtgagaagctaatgaagcatggtttgaaggttggttcacaaaatcccatggatgactactttactatctgtcctcatgggccccatattagttttgcttcttttatttactacaggcccctgcctaattaacaagataatggctttcgtcagacagtgggtcagtgctgtacaggttcttatgctgcgccaacaatatcaaaaagtagaacaggctgatacatgctgtactgagtcagaggttttatttttctagttctaggattagaactatttactagaaggagtggggaatgtaagaccccaactcaatgtgtttcttagatccctagaaacgaagcccagcatggaattctttgttctttcaccttcagcctgagagaaagatgaccactgggtgacccacccaggctcctgacccatagtgtaagggaccaagaatgtttgccgaagatagcctgtaacctttctgtgagagatgagctataattcaccatccccatttttacgatgtttactcagcttccccattttctgtgttcttatcctcccctcactttacggtttattctttaaaaaccctcaactgcaactgctgggggtcaatctcctctgcccctgtgcgggttacgagcttggcctcagcatgctgattcctgaataaacttcatgcgatattgcatcaagaatggtttctctcgagttattgaggcatcggctcatccagggacttgagtgagggtctccccaaaacggggggtctttcaattatcttggagtctcagctttgcctttggtgatgactatcattctgtaacctccaagttgtttgtta

SEQ ID NO: 27378 - DNA, 1900 bp, Mus musculus
aatgtttagatttttgctaaattgttttattttccttttgctgtggtttgtgttaatgcagtaggtagcccagaagcacaggtgtggggagagagcaccttacacggtgggtggagctcggtaagtgggtaatctacttcccacaggatggttgtatagggaccagcagattctctgcagtggtgctgagttcagactagagtggttgtttaattcttggtttggtcttccctattataaaagacagaaggaaaatatccacaggtggtgggttatttgcaccagacggtcatttagacacagcagagacagatgacaaaaccagaggcacacgtgtttctattgtcgtggttaagctagagtgaaacagctctgtttttctctctgttctgagtaactcccctcaccccaccccagcgacccccaccctgcaccacctttgtagcttgtttcggatttattctggagcttggcaagaatgtcgtgtgccagcatctacttgggaggagtgagccatctgctggtcattaggcccttcggaaagctgcttgttcacagaggcagctggaaccttcctggaggagaggctgctgaggctaccgactggcccacctcccttcagggtgggattgcaagggcctgcctaaatttcccggggaaacagaccacacttggtcttaatctctccccttttcccgtttactttgcttagttttcagcaacagtataccccatctttatatcctaagaaacactaatcctagatttgtattaaccaaaatacttgtgttctgaataaccagaagatgtgaggagccctgactgtggtctgaggttcacccgggtgtgagcacagacggggctcttggatgttgactggcttggagtgcctgttccgaggaaggcagagaccactctggcctttccagggagcccctgaggcttagcaggcttccatacctctcctgagtgacttcacccatcccttgctgtgcaagtgggcgcgagaatggctatttgtaaggggctgcttccctgggctctgcctcatgcctccctctggcttcctgtcctgtaggagacccagcaggctcaactctctgtcaccctgaggcactgctgggaagggaacatggcttcattgactttgtggtttgcccactgctaccccacctgtctgtgagaccccatgatggctgtaggatgctaaggcgggggtgatactaggatgagggatttcttttccccccacagtgcactgagcaagggaggagggagggagccatgctgctgacatattctggcattccccctcctgggataaaacagggcatcagaaaggtagagcggtctctgcttaggttgcctgtaagataaatgtggagaagcacggttgtcccattgaacaatatttgagcaaaaaactactgtaaataactggtttttgtcttttgtcaaataaaattgttttggttttgtttatgttttaaagtcaaactgaattttttgttgtttctttttcaagacagggtttctctgtgtagccctggctgtcctggaactcactttgtagaccaggctggcctcgaactcagaaatctgcctgtctctgcctcccaagtgctgggattaaaggcgtgtgccaccactgcccggccaaactgaattcttgattggacctaatgtgctttggaaataagtgttttggttttggtttggctctttttttttttttttttttttttttgagagacatggtttctttgtaggcctggctgtagaccagactggcctcaaattctgagatcctcctggctctgcccacaggtgctgggatcaaaggcgtgcacccgtcactgagttctaaccctaccttacctctgctgctctccctctagcc

SEQ ID NO: 27379 - DNA, 1397 bp, Mus musculus
taaagtgtctgctatgcatacagtgaaatgatgattgtctgctcctgagcataggtgagccttgaaaacattatgccaagtggaagactctacggctacatggtccccttagtaaaatacagaatacacagggccagagacagaaagtaggttagtggttgccagtacctgaagctccggagagaggtggcaagtgaccgtgggaacagactttttctttgatgttttgagattaatgataattatcctttatgaacatcctaaagacctcagatttatacattgctgccttcatgtgggggaggagcctgtgttgatccaggtgacgatatgaatattgcttgtgtctcccgtaggtcatttggatcatcttttacactgccatccactatgactgatggcatttgctcccgtgtcttctgtccagtccgaaggacccttttactacagcacaggtacatgccaattggggcactcctgccgcgtggaaccgggaagacccacgtctcctgaacttagaatcaacgtgttggacatcagtattttccgcaagggttgtgaaacttttcaaagaaccatccgcctttggggaagcatttctgaatttgtccattgtcaactgtttttccttggataccatcatgtaacagctgtttgccgagtggagctgctgttgaatttgatgcgcctctggatccggatgaaacattgtcttccttggttctccgtcaggtgtacagtttttaaaccatcactgcatctcaagtcttctgaaaacaccatgtgtgtggtccatggtacaatacaagcagccatctaataagtctccattgtaggatgttttcagaaacttgaataaacaaatctttaactgaaagtgtgttggcatgcctggtaaactaaagccttgcttacctactgaccttaccctctgaacctaggagtagggtttagcagagcccctgctctcttccctcctccctctcctcccacagcagcagtagcagccagactctttctcttttggctggagttggtattggcatttcagagagggtccaccacctgatgtcctgactcagtactgagataggtgactgggctagatgtgagatttaaacggtgtcattttgtgtttgaccaccaggtggcaaaacgggggtatggggaggacctggctgtttgaacactgaagttggctgaaaggacttgatgggagatcatgggaagatctggattgtcagtcttcctcgtgcgtgggagttaggtggggtctactgcggtaaagccatccagtgttcctcttgtcaatgctttctgagccatcctaccatctgagatgtgtttgcattctggaaaagacttgtgagcgttcccaatattttttctctccatgg

SEQ ID NO: 27380 - DNA, 1368 bp, Mus musculus
ccttgtagagtatctgagctccaccaggctcctcctcctgacctcttggttctttgttacagtaccatctgccagcatgacccggctcgcccgatcacgaacccactccacctcaagtagcattggctctggagaaagtccctttagcaggtctgtgaccagcaatcagtcagatggaactcaagaatcctgtgagtcccctgatgtcctggacagacaccagaccatggaagtgtcttgctaagcagatctcctcccctggaccatgcaagtccctctccttgaaatgaccactccgtaatagaacatttcattccgtcagctggcccccacttcctttcactcacgcatggccacagcatctctctctagtagccgagagtgtcattctctccaccctttctgtgtgtaccagagccacacccatgccattactgtaacattccaacatctccatctgacctgacctccatatcttctcttgccagcctttccctatgctccctcaaatatgtatctgatgagattctttaattcccaactccatgtgtgtgcgagcacgcgtgtctgtgtctgtgtgtgcatacttctgtgactttagacatgctttcttgtagtgcttctgcaaagggactttttttgaatcctcagtggcatttttttaagggaaatatgcagagtggatatctgggtgggttgggccacaagattggattttggttccacttggacaacaaacagtatttgcagagtgatttcaggagagagcaggtctgaggaatatgcaaaactgtagttactgtgtgggccattgactgccttgaccagtagaagggataactattacacagataggcaggcagggtggcagtcacctcccctgtccacgtggatccatccctgccattgtgtgagtcagagggatagatctgaagcctgtgaatgatgtctggtacaccacagtgttttctccagagaactggcctaagctctagattagccaagaaagctggaaaacagagcgccaggcttcactctgcagagagaaagtgctctgtccctgtagcgtctgattccacttaccagacacccacgcatctgcaggatgtctgatgcagagcggttctccatccctcagttccagaaaaaatggagtgatatttaaaaatgccatcgatggtggggatcttactggggaagaggaaggaccattagcacaccatcatgatgtcagatgacaaaatggaagccaagacaccttgaaggtgactttctaggaaggtcttaagcatgtaatgtccctttatcagagggaaggggacaaactcagggcagccctgtccaggtagaaatatttttgcccccctg

SEQ ID NO: 27381 - DNA, 1164 bp, Mus musculus
gcttcttggggaaaacccaggggctcaggattagaggctgcagtggcttctgtgagaccttgaggatcatggaggtaaagttgaagacaaggaacggatccccatcaccaagcagggccgcctggttaagaacttgaagatcaagtccttggagatctgcctgttctccctgcccattaaggaatccaagattattgactctttcctgggcgcatccctaaaggatgaagttctgaagatcctgccagtgcagacgcagactctgctggccaacggaccagactcaaggtttttgtcactattggagactacagtggtcacgtgacattggtgttggctttaggtgatccaaggaggtagccactgccatctgagggaccatcgttttggccaagctctccatcacccctgtgcagagaggctattggggcaacagtgtttgcaagctgtatactgttccatgctaggtgacaggctgctgtggctctgtgctggtgcgtctcatccctgccctcagaggcaatagcagtgtctctgcactgtgctgaagaagcccctgatggtggccaatatagatgactgctgcacttcagccaggggctgcgctgccagcttgggcaactctgtcaaggccatctttgatgccccctccatgacctacagctacttgacccctgacctctggaaagaaactgttcaacaagtctccttatcaggaattcactgatcaccttgtgaaaacccacaccagatctgttcagaggacccaggctccagctgtggctacacataagtctttctatacaaaaagataaagtggattaagttggttaaataaataattatgcctccatgtcattatttggaaattggggtggtcatagaaaagcccagacagttaacacctagttatcaaagatagaatgatactgtccagagtagaacgaagaaggaaaccagacagcttccaagaaagcctgtatttgagaatcaaagatgttattactgactgttgtttcaagagcagatagactttggaacatgtcttcatctcactttgctcagtcatcctcaaaggtgactgtgccttcctccattttcttacatccgatcacatttgtttataagtgttcaaacttgaagatggaaaatgtgtttgatgtc

SEQ ID NO: 27382 - DNA, 1182 bp, Mus musculus
atagctttcctggctatgggacagtggttcctccagccactgtcttatttgtcacaccgtgctagctttcctgctagactgccatctccttgaggacaaagacttcatgtgtcatttactacccttcactgtctggcacactgtccaatacattttgtatgaatttaatgaaatgtatcttttggcctcttgcctctgcagagaagagaagtatggaccaattagactcttcacctgctcggaaactgctcaagctccccctccagagctcaccttccacgcagtgatgaggatcctgtcagggaccctacctcacagcagtcagctggaatgtcccagctctacagcacttcactgttgccgagtgacagcatgtatgtatccagaagagtgtgttaaggacactttttgtcgggatgtgcacgatgctcaaaatggccttcagaaccagtcgtccgttgctcctaacatcctcatggtcagcgcttttcatcccataaaataatccagagacatctaaaaccaacctcaaggaaatgttttagaggccaaggtgggttgttgccataaaagactgacgctaaagtttgtgagtgtgggactgaaggtggattataggatgttgtcacataacgggtatgtgtggacactttacagcatgcccattttctgaagtgtcctaatctctgtagagtgctttagtttttaatattgaattgacttcctggaatctaaattcatgacaagaaaaggctgtgccaatttaattttttcctttgggaattacccctgcctccctaagaattgaccccagagctttgtgggtgctagggaagcaccctcaagaagctgcacctttagtccccatattttggggtttttaatattttttttaagttctgttagtgaatggcgtgttatttaaaaaccgtgtgttgtcatttcctggggctgagatagagttatttaacctcttatctcgaacattagatggatgttagaatctatgtcgtaaggacactgtgaggatttgtttaaagagtaaaagcctagaacaatgttatagtttgttgttgaagacttaataaaatgagtatactgtagttaatgaggtgggaaagctactatctcatatggaataccacatggagaactcaagcagatacataaagtctggattag

SEQ ID NO: 27383 - DNA, 1251 bp, Mus musculus
ttgaacacagaaatccgcctgcctctgcctctcaagtgctgggattaaaggtgtgtgccaccaccgcccggccagaagtgaaacacttttatcagcaaatcatgattactcctagagacaaactgatgtggaactggagatctctttacagaccctggatctgactggtgtaataccaggttagcctaagataagacatgttttccagaagactagttacaaaatattaaactgcccccactttgaatgaccttggcccaatcacgtggctagtctatgtctcagttcccccagctataaagtggtggctgtggagaagaccacatatatcatgcctgtttgtctgaaaaaaaagctggcattctatataaatccgaatgaatctgaccatgctctttatagcattgagcccctcagttgccctggctccaagcacctccttccctcattggcctttaatagaagggggccagaggagaatctcaccaacctgctcacgttttaaaatgctactgtagtccttctgtgtgtgtatgtgcatgcgtttgcacatgcgagggatgagactcagagcctagtccatgtgaggcaagcatcttaccactgagttacaccctcagcacctaagaggctttttaaaaactatttactttgagacagggtctcttgtatcatcaggtggcctccaactcactgtgtaaccgcggatggacttgaatctcctactacctttctgcctctatcgcctttggcatttgccatcgctgctggccttagatgtccttgaagtacattctcaatgctttgttaaccaccactgctgctatctccagaacttcttattggtcccaaactgaaataccacacccccataataattactaactaacccctacacagtaactcccatcctgccccaggccgatgacctctggtggtctgctttctcccttcttcactggcctgatttaggtactcatggagatagaacccggtatttatcattttgcctcacccctttatgatatacatgtggagaaggatgcggcttgcccgaggcctctgagcatgacaaaggcgtagctaccagcacaacccagagctcctaactcttcaaagattctatacagagtgaatgaagcatgctcaggggtgtggctgaatccccatctaggttggagttcatttcccacctcacacaccttccgtcctcctttatcattatctatagtttccttcctgtcattacac

SEQ ID NO: 27384 - DNA, 1176 bp, Mus musculus
taattagtcaatctgtcaagcctgtgaatgtgacatgagaaatggtttttatcaaccaggaacttgtcctagatcttgaaggggctcagatcattgagagaaggaacacggtaggtcgaaggaacaggacagagttgtgaggctgggctgcagagagcgtggagtggtgtggttttcatcctgagagaatggcgggagattgctgtgtgtggccctgcactgcatgggaccgggcgggtagtggcttcagctgtgctgctgtggcttcagatcgcttcttgaaaggggaggcccgtgttgagtctccctcttcctgaagtaagagtgagcagggaccacacgggtcaccgacagggtgatagaattgtttcagagggctttgcgtaagagccattcacaaaattaatgtttccacttgccccactgctcgttatgcaataagcaaatgagttgtggcctcgcaccctgggaaggccaattcacccaggctccctctcatgtggacaaagcccattatatggcagaggcctggtggggacctttgttgcactccttgggcctctccctatggatctcttctgcttttagccacctgacttcagagacctgcttgagtgggagcccaggatccgagaggccttccgtaccggggacttggagtccaagcctgaccctagtcggaacttcaggccctaccgagctgaagataacgattcttatgcctctgaggtgggtctaggcctaagcaggctgttgggtggaagccgattgcctcctgaaagcaggcagggtggcccttggaggaggatggtataggttttaagcatttaaacttctgacagccaaggcaaaaaaagaaagaaagaaagaaagagagagagagagagagagagagagagagagagagagagagagagagagaaagagaaaagggaatttgaatcaatcccgtggtttagttagaggaagcttagctggatatgggacatgatatcaaactgtaatcccagtgtcaggacgctgaggcagcctgaatgctgagctggaggccatcttgaaatgactaacttatgtagcagagaagcaatggcctctccatttaggctgtttgagttcatgctgtgactttctgggtgctggctgtgagatctcgggtacgtcatttcactctcgaaa

SEQ ID NO: 27385 - DNA, 1101 bp, Mus musculus
ggcggttaaataagaagaatgtacagtcccagtagttaggaaccaactgggctctgtgatgtgaggccagcctgggctacaacgtaagactttctcaaaacacaaagaataaaataaaaatggattggcactgtagctcagatggtagagcgcttgcctaggatgagtgagctcctggactcaatatgcagttcccaataaaatgggcgtggctccacacatctctaccccagcacccaggagatagagacatgacctacagtagaagcttggggtcatcctttgtgtggaaatcctgggctacatgaggcagtgccccaagagaaagtccttaaacaggacatgatgagaacgtctacagtcccgttacagggaagcctgagggagaagatggctgatgtctaggtatctaaaagctgctgggatagcatagcaagaccctgtcttacaacaaacaaacaaacaaccccatgatttacttaggaattacttgtgagattaaaattttacaacatttgaaaactttatttcatgtctgtgtgtgtgtgtgtgtgtgtgtctgttcgtctgtctgtctgtctctgtctgcatatgtgctccactgtaggcatgtggcaatcagaggacaacttgaagcacttggttctcttcttctacactctggatcctagggatccaactcaggtcatcagggttggtagcaggcgccttttgcccactgacttctcaccatgcctctttgtggacctttaaatgtagattttagggttttaatgtaaagatcccacaatggaccctgacaccgagtaggcgctgaagatattggttctcactcctgggaagcctgatggagcctcccagtgtttagtgctggctccagagcctgtttatttgctgtttgccctctcctcctccctctccttcctgacatggttgctatggagacaagggtccctcagcacttctgccagagctacagtcttatccttgggatctgccttttccatcctgacagatgatgaggtgatgctgtcacccgactgggaatgggagctgatgctgttgccgtggagacagctcctggcgagacagaagggaggt

SEQ ID NO: 27386 - DNA, 1147 bp, Mus musculus
ggggagcaggctggtgggcggggccagagcagctgggatgggggtggggctcagccctccaggaggaggggaagggccccttctgttaggatttgaacgagccaatctgcatgcccgcgctgctcctgcccacccccgcagctgcaacgctgagctcatgttctggctctgtcttagcgggccgcacagttttgccatcacccttcctcccagtgtgctggggatgttagaggcaattatggaggtcctcagaatgctgacttccctgtcttcccctaggcacctctcaaccaggtggagagggactgggggcggggacggaggtggggggtatgcctagggattcctctcctgctcagcaggctccttggccctgtgccctgcagggcttttgagctccggtggttttattgagctggtatgttattagtgagattccccagccgccaccccagaacaaccctcccaggctccttttgctggtccacacagttaacaagatctccgaccctcaacagggagacccgctagcatgaggatggtctggccactttatggccgtgtgggcttgggtaagctgcttcaatctctgatcctgtttccactgtggaacatggagataagtttagtatcctatagagactttaaaaaaaaaacacacaaacaaacctttatttactatgtctgtagctttctgcttacatatatgcctcaacaccagaagaggcaccagatttcagtacagatggttgtgagccaccatgtggttgctgggaattgaactcaggacctctggtagagcagccagtgctcttaaccgctgagccatctctccagccccctatagagactttcatgactataaaatgaaattacaaaatagagtcctgtgtggtaggcatggcaccaatcataggagcacgtgatgggaggagcctcggctgggggactctgggatccactgcttttcctgtagagagccccagaacatgtcagtaacatgtaccccatccttctataaggatgctctggccttggctctgtgtcctgggtgacctgcatcacttcctccttggagcctcagtttccctctgtcaaatggcgtgacaacacccatcatgtgatttttgagtttggtcacacatgc

SEQ ID NO: 27387 - DNA, 1203 bp, Mus musculus
gcagggtaagaatagagcttgccacaaagtatcaccaatgagaaagagagaatagcttctcacctctgctggtgtctggcacatgccatacccttggaagtgcccagctgttgttacttctgttgtcccatttatgagcctcaaaatgagcctaagtcctgactcctgacgcctctgctttcaggcttcttgcctactggggagggagggactaactgtgtgctgttggcatgagcctgccgtggtcagtctgtctgctctctctggtgttggagaggcagggcccagagaagtgggacctcatagatctctagggtcagatatccccagtgccaatggaacaggagcattgagatcctgtaactcggtgatgcatggctggatgtgacttcctctgtgacacttaaccctgattcccccaaacctctgcccacagaggctaagctgggttgagcttgaacaggaggcaggaacccagagtccttcttggcctcactgcgcgttctgtaaaggacaaggagtctttgagttccccttctcctggagtgtttgcattcaaactgggagggaagtgaagctctttgcagccttctcctggggtctgactgtgatgatctcatctggagccctgtcagagtcccggggaggaggagggacagcagatggcttttctggccttttgggtggggctggcctgctgtccctgtggccactgctggtcagctcttccatagctggggtaggttgccagggccagagtgggtgacaagtggtctggagccagggtggcagatgggtaggcagcctgggccttggcccaggggaggaccatggtagccaagtggtgtgggaggaggagggcaaagcggagcccctggtcctttgtagagtggttgattagagtgaagtccctggccccatatagagcatagcttttcctgtccatccctaagtctgcttttgagctgggcaggaaatgatccatttgggtaagatttggaatatgtcacggctgcggtcgggtgtcatggtgctgggagttgaagcctccgtggagattggcctcggagtctaaacagttgctgcagctgctcagtgggatggtggtcctcccttcagcctggctgttctgttccctcatggctatttcttgagcccctctatatgtgcccgttctctggtgactgaagtgggtcttccaca

SEQ ID NO: 27388 - DNA, 2096 bp, Mus musculus
aaaaatggtaacattaacaaatttttcctatctagcctgtggtggtttgactaagaatggtcccataaggtcatataattcaatgcctggtcaccagggagtggaactgtttgaaaggattacaaggatcgagacagtgtggccttgctataggaagtgtgtcacagaagatgtgcatgctcttgtactctctctctctctctctctctctctctctctctctccctccctccctccctccctccctccctccctccctcctgtccatcagctaccacacagcgcctgttcctcgccatgatggtggattaaccctctgaagctgtaagcacacccccagttaaccgctttcctttataagagttgccttggccgtggtgtctcttgactgagacagatgctgtaagaagcattatctggtgtatttttagcactgactgaaacctttctcctttagcaacctatttcccaggataactctcccatctatcctgaactcttgggacaaaggattgccttttgtttttaaatcaggaattgagacaagggtacaaactagaatggaaattgtgatgcgccgtgtagttaaaaaaaaaaccaaaatcccagcccactgaagaggtgcccggcaccctgctccccccacaacaccccaccacttccatccctgttaagtgccaggcatggggggcatcgggagcagttctttcctcagaggagctgaggtgtgtcaggcgggtactctaccgatgacctcagctccatctctgtcttcctggtacaactccccctgtcccctgctttaggagaggctaggttcagaggacacctcataccaggctactcctgagtctgtcgtgactccagacaaaatcagagttttaaagcacctgcaacccctccagccccaggggactcactgctgccagcctggggacaggtcttcgcccatctcttctgagctgaactggtcagctgaccaccgaccccaccctctggctgctctctccggcaccactgttgctgcagtgtgtttacgggttttagaacattctggactgcctttgtgagcttagcagactgcgcagtgagtctcaggttctctttgtagcttgctgttcctaccagtgccgagccgctgtggttctccctgctgcccccctcacccccactttgcacagctttaccaggaattgagtccaattggagccaacagtggtcaacagaaatgctagagatgcaggcagtggggacagaggcaggagctggaggcgacatcttagtgatgatgctctcccgggcgagcagccttgtgctgcctctctcctccgggtagccacgttctgtcttgtccactcatgggtgaagagtatttggtgtgtctgccactatggggtcataaatgcacacgggaggtgctagctcccccactagccacggtgcctctgtagatccacgagacagctaggggtccccctcccctttgtgtgcccagactcaaggttaagaagtggaaagttttctgcgaatatttttgtatttttgccagtctatattttttaaatcattatggtttattgtggagttttgtagtcctaattttgtaccatggtatgtgggaaacaaatctgacccattttctgcctttgatgctgttttccttgtgagtacctgtgtcgtttacgagactgcattaaaaatggagattttaacagcttagtctctcgagttactgaatactgtcagcttgctgtaaatagaaccacaggtttagtgacggtgacatcagttgggtaggggacagctgccataaagctttcatgagcgtttctatcctgaaactagaggcaagctccttaatcgcagactctcataccctgcatgcccggtttggattcctgtacgaaggaatatattctgtagggcccacatagatgcttcttggtgtcacagcattgtgtggggtctgcaggacagtagtacggacaaggtcccaggtacttggttttcctcaccaaaataaaagcaggctatagccggctcctttccagcagaaggcagaccatgcacgggaagggtatgggggcgtaagctca

SEQ ID NO: 27389 - DNA, 1181 bp, Mus musculus
tcacttagatttggagtcccaggtagttgtgagccaccatgtgggtgctgggaactgaactccagtcctctggaagagcagtaagtgttcttctcctctgagccattccttcagcgccccctggaaaagcttcctaaagccgcttaggctgaaacctgaaaggacaggtgatgcagagttggaatgggggaaagtgtcagtgtgggggtgggagaggacggcgtgaggctgaggagacaagatgaggattcagggttggttctgtcctggggagttttcaatgggaatggtgtagtcttgctcttcagattcctggggcttgcatgaaagactgtcctggtggttgaaggtgggggttatctctcccctctagaggctaagcctgtgttctccacccttccctacgtggttgggctccaaaccctgaggcgtcattgttgggatggtgactaggcgtggtgtggtgtgtacttaatacttgtttccctcaggttcaagcgctgtcttcctgttggccctgacaatcactgccagcgtccaggctctgacccccacccactacctcaccaagcaggatgtggaaaggctgaaggcctcactggaccgccccttcacagatttggagtctgccttctactccatcgtgggactcagcagccttggggtacaggtgccagatgtcaaggtgagagtaaagcgcctttcccctgttcagtgtttcaggagacccgcagtctccgggctgtgttaggcttggacactttaaagcaaactcttgctggtgtcaaggcagttgggttaatgtaacatatttctgtcagtttgatggatgattttatgtgtaagagtattttgcctgcatgtatgtgtaccacttgtgctttgtgcccaagagcccaggagagagcaacaggttccctgaaacgagttacagatgattgtgaggctgtttggggccttggaactgaaccctggctctctgcaagagcagccatcttaaccactgagccatctccccagctccacaacatgtgctcgaaaagtgcgaggttcgtggctaaccacctatagggagctcaaggtagagggctcacacgcattaatcagcaacagtaatggtgctaatgggcaatttggacatattttgcttttagtaagcataattcattgcagttgaaatg

SEQ ID NO: 27390 - DNA, 1219 bp, Mus musculus
tggcttacacttccacgtcacagttcatcatcgagagtagtcagtgcgggaactctaggccggaactggggaagaggcagtagaggatagctgttcacctgcttgttcctcgtggcctgctcagcctgctcactcatatgccccaggaccggctgcccagaggaggcaccacccacaagggctgggccctcccacatcaatttctaatcaagaaaatggtctatggacttgactatagatataggccagtcgtagtgaggcatttcctcagttggggttctgtcttctcaggtaactctatagcttgtgtcaagttgacaaaacccactcagagcagaggtggtgttgacattatgaacacttgactctgggtgctgcgtggacgtagccttggcagctgtgttcttaccacggtcggtatgcctttcacaaactgctggaacctcttctaactctgtgtccgccattcctttcctagatatctgtttcaaatgagaccaaagagctcctgctggcagcagtgagtgaagactcccccattgcccagatctaccatgcagttgcagcactcagcgggtttgggcttcccttggcatccaatgaagccctcggtgcccttaccgctcgcctcggcaaggaagagactgtgctagcgtaagttgtcgctttgaagactttttgaggtttgtttgtgttggttactgacctgagaatgctttttcatttctgcagtgcacatttctagacatctgctgtgagccaggtgctctgctagatgtgcagacactgttgtgattgtggggtagggggtcaaggggctggggctgtatttgcaagtggaggccagaggttaacagcaggtatcttcctcagtcactttccaccttgggttttgttttgtttttctaattttaggtagggtttcactatttatacctggctatcctagaactccctgtgcagtcccggctgaccttgaactcacagagatctacctgtctctgcctcccaagtgctggaattacaggcatgtgcattctaccttgttttttgagacaagctagctaatgagctccaggggtctttctgctagtgctggggttacagacacactgccttctccatcttttccatgggtgctaggagtctgaactcaccacgcctgcatggcagacacggaccaactgagtcgtctccccagtcccagggactggcactt

SEQ ID NO: 27391 - DNA, 1155 bp, Mus musculus
actattgctcagtcctgtacccaggatatggccaccctcaagagctggatagccagtggtggcaggcagttctaccagtgtcattgctgtgtgcttctcaggcacggtagctgcttcactctgttcctctgggagagccatggactggggagcagcactatgtaggtgcatggctatggctccgtgtgcatgccaggctttctggcaggtttgcagctgggatcactgttctgctcaaaccagtggctgcttcagtgccctggcccttagggtttgtcaggagtgccggggggctgggggaggcatgctgccaaaacggccagagactgccagtctgcccgaatgcttttcatttatttatggttgtagaaaatactaagtggccttggtggtctttaggctcattgagaccgttaagaaaggccagctgtctggggtcacggttctttttgtatctcatttctgtgacctctgtgtcccaacatgcctctggttttgtttttgtttttgtttttttgtgtgtgtgtgtgacaggaccttgttgctcggctggatgaactagggggtgtgtatctgcagtttgaggaaggactggagctcacggcgctgtttgttgctgccacctacaagctcatggaccacgtggggaccgaaccgtccatgaaggaggtgtgtgtctgaagatggtcgagcatggagctcataggcgctgctgagtttatttgccaggagcagctctttgcagagaggggttgcggtcacacctcagggtgtgggtatgcaggatttagttaggtttaaagactgagaagtggaaggggattgattgatgcctatcctaagaagctgctagtcagggtgacagcatgtaaataaactgtcacgcctgtgtatatgagccatttgcatatcattagtagggacagtcaagtgcatcacccaggtttgctctcctctctcctcctgacagcccagcccagcccttcctgctgtctcttgtatacttttccatttcctttcggcatgaagtgccctggactcagaattgcctcttcttcctttttcccttcatcctcattagcagctaattcagataatcttatctggtagatggagtttttcatgatatttccatgagaagcttgtgtgtcttcc

SEQ ID NO: 27392 - DNA, 1193 bp, Mus musculus
tatacattctcatagagcgcttccccagaccctgaggtatacattctcatagagcgtttccccacaccctgaggtatacgttctcatagagcgcttccccagaccctgaggtatacgttctcatagagcgtttccccagaccctgggtcaggttttctctgtgattttcctcagtcctggcctgcagctgagactgtaagcttagtggtccggtcaacctttctggtccaccttggctggcatgcatgagaccctgagttctagctccagcaccaaataaacaaaacaaaacaaagacagaaaagaaaatgcctcttcagtacagctgtattgatccgctcggcctctaggccacagatagttttgtatgttagttggtccaccttggaagtggtgaaatgggacagggctggtgggactgttattatctctgttttcagacagggagatgctgggagaagactatctgatatgtatataaaataatctctttcagggtgacctacccagccaaagccaagggtacattcatcgcagacagccatcagaactttgccctgtttttccagctggtagatgtgaacaccggtgcggagctcacccctcaccaggtcaggaagtggcccccgttgttctcctgtccagaaattgaatgtccaccagagcagtaatgctctgacacagatgcaaatatcacattcccgtttgtagagcctggctgcaccctgactgtctggtcagcttgtccatgtcccatgactccctcggtagtgatggggacccattaactgaatacacacatttttagaaaaaggaaaaagatgaactcagctcagcggctcagatgctagtcctagaagcttggggtagctgagacaggaagataagctcaggttttctctggagaaataacacttttctctcacattctgtgtagctctgctgtatccatcggcactgtggttctcctcctacactgttcactagcaccacccaaggctttgttaaaaaccacgtgcttttaatgtaagattttcatagtgcttagactgtatagaaggggtaaatgttcttgctatgcaagcctgacaatgtgagttccctcctggaacccatgtaaatccagaggataaacaactacacagacttggcctccagacacacgctactgtctatttctgtgcttaggtcat

SEQ ID NO: 27393 - DNA, 1197 bp, Mus musculus
cccaggctctgcgattcatgcttcacacacagacatctttaacatatttctgtgttaaagatggagaagtcaaggtacaggagattaagtgacttactcagctactaagtgatggggctggtcgctgtgttcagagccaggctctttgtgacaccaggctgctctgtccacttagaactctgcttgctatcagcagcagagcctccactgctacatcttgagctggaaacactaggaaattgaaatcgagcctcatgccgttccacctcgtttccctctcttggcgctctggtgaagaagttaattgggcagcagagtggccaaaagctggcaggagggcaattgctcacactgggttttcagcctccgagtcgctgagcattgctggacagctaagccaagattctctcctttgtcaagcagaaagttgtccctggggtaggaactagagtaagatggctactctctcccctctgaagagcctgagccagagctcttgctatgacagaagagtaggactctattcctggctgactccatgttgggccctctgatcagatggaattcttgttctctccagacgtttgttcgacttcataaccagaagactggccaggaagtggtgtttgttgctgagccagataacaagaatgtatataagtttgaactggacacctctgaaaggaagattgaatttgactctgcctctggcacctacacactctacttaatcatcggggatgccacattgaagaacccaatcctctggaacgtggtatgtgcctgttaggcgcctaggtgaggactgcagcgccacacctcacactgacagcctggctgtgagacatagggtcacacgcctcggccttagcacatagtagatacctaataagtattgatcagacaaatgaatgaaatacacacatgccatgaatttctataactattttactgggaaggttttctggttatgtaaggcattggggcatacatagatggacaaatagtctaggtcttgggacctgttagagcctggggaagaagagggcagggaatgacctgtaggtgtgcagaacgctagttaacagtgtccagcagttacgtgattatgctctaggtttcatggttcttcctgaccggccttacttttgatagttccgatgacagaaacatgaaatacagctttagagcaaggga

SEQ ID NO: 27394 - DNA, 1437 bp, Mus musculus
ggaagatcataagtttggggccagcctgagctacataacaaaaccctatctcaaaaaaaaaggactcaaacctaccaaccagtcagccaactagcctacaaaccaaaaaaggaaggaagagcaaacgaacaaaactgtggttttatgagctaagggcccttttccatacttgctctgtgttagattagttgctgagtctgtactggcaagaatgcaggcagccagcaggattaaactcttgattctttctgactgaagtcttccctgttggcctgtactgtgaggggtgtgcctggaattacctcatccctgtattttcacatgctccctcctcagtcctcagcttacttcatggttttcaggtcatcatgggcctcagctatttttttgaaatgagacggggcatttacaagtggaaccagtagatacaggctgtccccttgtcaatcacatcttctagtgggagaatgacttagtctccctgttgtcccacgtaagaactgtaactgtgctttaaaccatcagtgattgtatgtctgtctgcgtttccttccagaacagcacattagttccagaagaagtctgaagaccctgaaggctgaaatgaacatttaacaaggagtggggacagttcatggtgtgaaaggaagaactggggacacaacaggagggaggagatgcctgttcgttaaaaagagaaaagctgagctgtgcttacatgtttacttgtttctcactttttgcttcacagagcagacatgtttgggcccagattgtctgtccctttgtcttgatgcctggcaagatgctgtgaatatcccaggctacccagatgttgtatttgaaaagttgaaatctgtaattcatcatcagctttggaataaagagaatggtggactcccagtgttgatggagccttgcatgtgtgatatgaagactcagcagtcttcagttgggccatctcacccctttcttaaaagtactaaaagtggctagaaaaagcctgtgtcctttcggctccagtagcaaacactttgtaggagccctgcttgtctttgaagattcttctcttcaaaagacctgctctaggcttttgccttgaacatttgggcttggtgtgtagagaagggttaaaattttgtcaataaaaagctgactgcctcggtccatttcttctgtgataaaatgcaccaaagcagcaggtgacttagagacagtaaaatagagcacttacaggcagtaagatgatttataagcaataaaatagatggatggatggataatttataaataaaaaggtagattggtgtgtggatattgatagaaaggtagatagatagatagacagacagacagacagacagacagacagacagataggcaacccaatagtcctaagaactagaaggcgctggcagagctggtaagtagtaagag

SEQ ID NO: 27395 - DNA, 1483 bp, Mus musculus
acagcatcccgttggtcaagctggagtcctctaaacagtactctgtttttttaatcaccccacaggaggcagaacaggctgagcccagaagtgcagaggggccaaagaagcccaaggttgccatcgcttccaccaacaagaggccgaagaaggagacgaagaagaagcgatagaatcctagaatccgaggccgaggagcccaaggctgcagcctcggggacagccctcctgggaaccagcatcctgtttgctctcacagactgtctctgtcctcggctcagagtctgagaggattgaaactccctctgactacagagctctgaacagtccttaggctccagctgtgcagaccaccacttcctcttctttctctctgtggtgcacgggagattctcaagagcaaacactgccccgagggttccgagtcaggtcaggctcacagggcaacgtattcacattagtcctggagtccagtgggctcgagacctgagcctcactaacagcatggaattgttgcctaaggctgcaggcataccctctccctgtgcttgggccacatttgtcttttgtgagcacagaacttcacacgtgttcaggtcaggatgcatggccgtgcagtgtgagccagccaggtcctgaagatgttgggggttggggggtgaggggggcggacagtagaaggcctgggcccagtggtgcctgcaggggaaggtacagctgaatgaggccagatttcctgggcacagactttgtaagcctttgaagcaggcttgtccctttcacaccaacctccttttaacccagttaacattcaaagtgcctttgacttcaaccagtcctccccacatctcgtattccctgaccagtgaaggaaaatgatgtggagaagtcaaagtaaataaagtgtcctgcatgctgagcctgcctgtgttgctactgaggagggaaaggggcagcctgggtctctcctgagggtggggggaacactgtccccaagaagtgggacagtgtggagagaaagggcagctctgggtaaagcggccctccaggccaggccactctggaacaggttttcaaaaagggtccaatcagtgactccatgctgtccttagtcactggggacccttgcgagttagtttgcacaaggtccaaaccccctctccccataggtccctccagccagaggacaacactgctgtccatagagattcgagaaatacacaacagtacaatacaaagcttcaaggctccaggcagctctgattatagggactgaatcagctgcccaggacaggccctgaaccagctgcccctaacaccacaaagtcacagacaacaggctcccaaacctgccagacccaagtgtcatgaggcttgctgaggcgctcaggtatagacagctttcgtttcaggtgctagtcaggccactgaagcaccacagtggaagtgcaacccaagcccagtgaccaggctatttagtggt

SEQ ID NO: 27396 - DNA, 1148 bp, Mus musculus
tagcaccccaagctctcagagtgaaacaagccaagcaaaagatgactcactcacggcatcctttgccagttcccgggaaaacacagatcatgaaacccatctggggacttctaaggacagaaagggatttccaaacggcgcctctccttggtgggcagaagctgggggaactgaatgtgtgtgtatttccttccccagagacatctcggtcctctcaaagcgagggatagtgtcctccaagagcactaactgagcagcaacgctgctccatacacaggaagctaagcaggacctcagccactgtgacagcggacctactgtgtgcagttaaaaacagtttagaaagctggtgcacacctttaatgccagcactcaggaggcagaggcaggctgatctctgtgaattccaggctagcctggtctacagagtaagttccaggacagccaagactacacaaagaaactctgtctcaaaaacccaaaacaatcaaaacagtttagaaacccttccaggcggtgcatatctggaatcccagcatttgagtacttaggcaagaagaggaagatgtcaggataacctgggctacaaggtgaggttttgtctaaataaagaacaagcaaaatgaaacaaaacaaaacaagagtgactacttagctgttctgggtgttcattagttgattctggtgactccagtcaggactccctgatcactcgtgttgctctaacacggaaaagaaatgtttttcactgtggagtccaacataatttgttccacattgccatggagggaggtgatatgtgtgaagagggttctcaaaggtgaaacaggtaacttgggatagccaggagttagatgggccaactccaagattcacagacaaccagcctagcattacaaagacagataaagagtggtatggtggcacatactgttaatcccagaaggtagatccctgagttcaaggtcagtgtggtctacaaagtgagtcccaggctagccagggctaatatagtaagactatctcaaacaaaccaagacagacagaaagagtgctctcattttgaattacaggacaatggtgctctagtatatcagctgtgcatgcctaccgctttaaaagagagaggggataaaagagagcaggac

SEQ ID NO: 27397 - DNA, 1164 bp, Mus musculus
aagctgggctggggagtgtgcacaggagatggtctggctttctggatataaaccataagacctagagagagaaggttacttgcctagggtttcctaggtgacagccagggatgggctatagggctctgaattccacatttataatctggtgctcttggagtcttaaagccctgcagaggccccactgtgaactacagctgcagtttgaagtcctcctgcccctctgtggcccatcagacttcacagcatctcaggcctcctgtgcattttccatctctctaaggaaaacctttctggctctctggggaagggccccatcgcctttgaggggcctcagtttcttcatctataaaggacagcagtgactcatggctccctggatgtcccaagaggatggacacggggtacttcacacatcaggacttaataaatgtgggcagggcagagccagacctaggctgaggtctggcctcctctagcgcaggtggttcatgccctgtgacacacgggtgaaactgtaaaatggacttggagctaacagggccaaggagaagctggaatcccatccttttagggagacctgttgtccaaggcctcattccactgggaagcctagagtcaagtcacagcctctttcctatgctaatcctaatgcttactctattgacactcattgtacaattcatgtttcctcttctctggctcagacaagaagtcctgactccagtttcataggctgaagtgctgtgtcgagccgcgttctgaggtccagtgttgacttcatgggaaacagtgctgtgatagattcataatgtctgctccggacagaagcttagcaagcattatctgtgtgctatgagtttgtcattcctgatctgtccagactttctttcttccctgtgtgtgtatgtgggtgccatgggaggtgggaatgaaggagaaagacccagggcaagttggccaagctaggactgtccccaccagtcagcctgcctgtgagcatggcgcttgtggctagcctgactaagggactaggcagttagggagaatcccagagcaggaagccagaagccctgtgtttccattccttgctatgggactttgggccagtgacttccccctaggactactgagagttctagaaagaagaagctggaagcgaga

SEQ ID NO: 27398 - DNA, 1136 bp, Mus musculus
ctcagtgcgcccccttcaggatgcctgctttcattacaccagactctcacctggcaggcgcctggggtggtacgccacatctgggaatcagaggcacatacacataattaagaataaaaataaaatattaaaagtttaaaatttattacttccatttgctagatgaggaaaccgagggacagagaggggtcttgggacaacaggcaggacctggcacgcatctgtgtctatgggtcatctggggcctcttttgtatatactcgcctgcccgcctggctgtgtcttattgtgacctcccattgccctttgctgtcccctctccccctgagctttggtctaccttttcaagccagtgctgtttattataagctgaatgaagttccttgcttgaaaagacacgaggtgggcagggtgtttgggcatccttctatccttctatcaggaataaccagcccgagacaccggcttacagcactgggacgggtgtgggttagcccctgagccaggctctctgtctccacagatcgcttcaggcatggcctatgtggagcggatgaactatgtgcaccgggaccttcgagccgccaatatcctagtaggggagaacctggtgtgcaaagtggccgactttgggttggcccggctcatagaagacaacgaatacacagcccggcaaggtgggggtgcctgggggttatccgatggtatccgtctgtcaggtggaagtgagagtcatgctcctgcggcagactggtagtgagtgataccctgtgctttcttgcttgtaggtgccaaattccccatcaagtggaccgcccctgaagctgctctgtacggcaggttcaccatcaagtcggatgtgtggtcctttgggattctgctgaccgagctcaccactaagggaagagtgccctatcctggtgaggaggctatacctgtgtccctgaccttggccctgggggcaagtctcaccctcccccaaccaacacgccgcccctgggcttcctctttccaagctgatctctgatcacaggctgccttttgtcaggactcagcctcagaagcggggttctgtacaccatagggtcaaggctgtctaggctgtgtcagtctctctggagccatctcttcattgc

SEQ ID NO: 27399 - DNA, 2000 bp, Mus musculus
agagagcctttccaaagaggaatgaggcccaggccttggctatacgtacttcctgcccctggccatccttgttggaggcttctgggtggaacactgggtctagaaccttcttccgtggctctcaggcagcccaaggcccaacaccagttgggataagtgtcagagtgagcaccccctcagcccgtcctccacaagggacccttgagatcactgacacatcacccccatttctctgctggaaaaaaccagaatccaggaggggttgtgacctgcccaagaccaagggcagtttagggttgaggtgggcttggcacctggtgctccttctgttcctcaggaactaacgagaactgtcctccaaggcagggggcagggtggggcctgagagtggcttcaagtcggcagggttctgctgcccctgatgctcatgggtctgtcccggggaaagaggcaagcaggaggctgagccaggagcgaggggtagaaagtggtggtgtggaacaggcttctgtttgtcacagtgtgggtgggctggggtggagggagctctcaggctgcagagacagtcaagtagaagaggaagagctaaggggtgtggagtcctgctcctccatttgtcctgatcatttcaacacctggcccttgctctcctgcccgtgccaggactccctaactcagggagggaggggaggtccttagctgggggaaaggaggcgagggtccttactgctgtgtaccaacactgaccccgccctctctgagctgtactctctgcccgtgactatggcctctgtcattgctccgttccaaccaccccccccccccccccccgtattgatagatccacagctgggcgtccaagggggtcctggaacagcagacatctgactgtctggtccctggctcctctgaccagcccttaggctatgtggtggcttctctctgcctcagtgtccgggtctgtaaggtgggcagttgatgatttgtggcatctcaaccaagggcccctgtgtgtgtgtgtttgtgtgtgtgtacacatatctgtgcctgtgtgtcttcccttgtgtccatatttaatgtgtaagaacatccctactctatcccagacacgaccatttcacccattgccccatcacagcaataatgtccccgctactggggacccgagccagccaggccatgtttgcagggaaggatgccaagcagggcctgccctgacagttccactttactcccatattctccccgtgctcctggcgagcctgagcttgccacccggttctccctgcccgactccagctgcccaaggacctttgtgtaaggtggcctcaactgtctggttttctttttttctttctttttaacagtgttttgtagatttcagatgactatgcagaggccttggggacccctccccagctctgggcagggcctggggatcccacattccatgcccaggcttgggggagggggacccagacttgttgtacatattttgcatactgtctgattaaacacaaacagacctcagtttggtcagcagtttattggacatcgactgtgtgtgggaataagaagagtcgtggatgtgagggaagccggcagtcagggtccttgacccctgcagctagtggcttctgggcctggaactgatcagatggggcagatgcggcatgtccgcacttacttgaggatctggaggaggcaccgagtccagggcaaggatgtttgtgagattcaggaccctggcaggatggagcagaactgcctagcatgcatggaatgtgttcctgggtaatctccaaggctgtggtgtgtgtatgtgtgtgtgtgtgtgtgtgtgtgtgtgtgtgtgtgtgtgcgtgtgtaggcggggtggggtggtccaggtgagctgtgtgtgctttgtggagagttcctatctacccccatgcagtgttctctctaactttcccttcccactctcagtctctcctccagagttctcacacatctccagc

SEQ ID NO: 27400 - DNA, 1223 bp, Mus musculus
aaaaaaaaaaacaaacaacaacaaaaaagaaatgcaacatgcaaaaggtgggtggatccctgtgcattccagaggtacacggagataccctgtcaaaagaagaaaaaaaaaatgaaggaggggaggggagggaagaagggaagggaagggaagggaagggaagggaagggaagggaagggaagggaagggaagggaagggaagggaagggaagggaagggaagggaagggaagggaagggaagggaagaagggaagggaggacagagggagggagggaaaatacaaagacagcacgctaataatgcagttactgagagacaacttaacattgtggacatcggatacccaaggagatgaagcagaagcaggagaaggaggggaaaattaaccggccttccaacctttgtctgcctcattctaaaatttacacagtagaccatttgtcatccatgctgtcccacagatagtttttttgtttacgatttatgacaggtttatgttacttctatttgaatttctatatttcccatgtggtttttatgttttaatattaggggagtagagccagttaactttagggagttactcgttttcatcttgaggtggccaatatgggatgtggaatttttacatgagttacacatgtttggcatagtacttttttggtacattgtggcttcagaagggccagtgttaaaactgcttccatgtctaagcaaagaaaactgcctacatattggtgtgtgctggcggggaataatcaggataatgggttccagtcatgagtgtagtctttgtgggtactgtaaggcctggagcacttgtgaggctgtgacacaaacaccctgtggatgcacgctaggatcgtgtgtgtctgcgtgcacactcttgaccacagctccagaagttgtctctagacaaagtcgtgacccaatttactctgataatatgaatactttcatcccagatgaaaggcatagcccagattaaaggtgtgttccttaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaatccaccccttgtcaacttgacacaaataatatctcatgttcaca

SEQ ID NO: 27401 - DNA, 1217 bp, Mus musculus
ggcgcaatgccgcagccccggtggccgtgccttaagtaccctcttgccacctaagtgcgcatgcgcgcttgggggatgttgagaaggaggggtgatggggggcgctcctcattcgccaagagagaaaaaaaaatcccgtctgttctttccacaccgacccccacctcctgagcccgctctaacaccgttccagaagattctgctctgcccgcttttgaaattcggtgtaaaatggagggaagtcgtggctctacagtgtagaatgagggtaggggtgcaagcctcttggttcgacacacccaagcctacaaattctacatgccgcgtaaccagtgccgcgccaaaatataccttccatacggatggaaagccgaagttacagaagtctctctgaaagcaaaatgtataccttttttctgcattcctactagtccgtgaattttaaacccatgccagctgttttgtgagaatctttgatcttttctgactgttggttcccgctctgtccggcaggcggtagtggctgcgatcccgagctggaccggcactcttgctcttcgtagctaaagcaattgtatctactctgggagggatgtaggaaggattggcgtgctttgtgtgtgccaaaggagcgagctttatggagaagtagaccaaattttctgcgggacagatacggacctctgttttttgtgctcccttctcttaatccttagtaggtctgcctgagccagggtggttctttgtatgagttcgctatgcagctggaacacaaaataggattttgctacatccacgtagggttgtggctactgtcttctagtttcaaagtaaagcttgtgtcctctgttagcgttgtcttatagatctttagtgaattgcgataatggtagcaagaccaaattgccatctgcaagtagaaggttcccacggtcccagtggctggagaaagtacctctccagcaagcctccttggcacagaggccaaatagtatttgcccctatttggataggacattaattttgattaaatactttcatagacccatttctgttcaatgtcagtaaaagatggaggtttaatggtccaactgagtttgggtattgtggttttggttttctttttttaaaaatttatttttcaaagaagttggctggtttggggtaaatgatgctgaactatttgcaaaaggcaaacaatggttcaggctgctttc

SEQ ID NO: 27402 - DNA, 1175 bp, Mus musculus
cctggtttggcttttgtgtactcagctggcatctaatttgggctgacgttagaacatggaacaatagagtgacatcaggccccccactccagatctccaaggggagagtcaaccttcctttggaacctgtgttgtatatgtactcaaggttcaatgagtttagtatggcaaaccacagaagtttctaaccataaaggaggtagccactgactgcagatgagtaactacggggcaggcacaggacctgacctgacttcaggccttagcagcagctgtatctaccctgctaaggaagaccgcgccttggaatgggtttcacatccaagtcctgtggaatcccgcctctctgatgtgtatggggctcatctggaccttagtagggaactaaaagcaacctggctgggtggaaaagccaaggccacaccaaaatctgtgctactttcccccgtaattccctagtgctgaatgagactataaagtccctgcagaagagggaggtgccagtgattgatttgaaaatcagggtttcttgggggatctgcaggtcagggttcaagaactttgaggtgctttgtgcacctgagtgtgtaatgtgatgaccaggactaggaagtttgaggaaatagcaagagagactggtgaccttctaactcattggcataggagcaggtgtgcagagacagggacgggtaaagccagaaatgaggcttaacaggtggcaggaccatttggtgaggcagtcagctgacacttgtgaacagctctggctaaccaagaaagggaactaaggggccagcccaccctccctgctgcaatgggaggggaaaaggcaagctatcgatctgataaggcccttagggatgaactgagaaaactaagagagggagtgtccagctggagggttggaaaatcaagacaggatggccagccttagggtgatcctggggtctggagcattaagcttggtggaggaggggccaagccacacctcatgctcattgtcccagccaccaccccctcttcttgcccagcattcatttcctggggctcctgggtagagagatctgtggtatagctttatattcttaaattaacccgtatgacccttagtattccatttagagggccagtcccagttattttctctccatctttcccagatagaaaacctgcca

SEQ ID NO: 27403 - DNA, 1145 bp, Mus musculus
caggcggtaggccgtagctctacgaagctacatgaggtgtgagaaaagaaagggtttattaaaaggaataggcggattgccccagttaataaaaaatgcatcataagggaggaaaatgtcccaaaaagcagagagaaatatctctctgggccttatagcaggagtactctgttcccttttgtgtcttgtctaatgtccggtgcaccaatctgttctcgtgttcaattcatgtatgttcgtgtccagtctgtatgaatgaatgttctatgttttgtgttggataataaagatggtataaaaaactttatctgcaaagccgagagctgccacgtgtttcagccaggaatcagacacgtggcgagagggcccctgctggaaaaactgttcgttttagaaaataagggcgagtgcacagcctctaagtttcagagtaaaaaagctaataaatggttcatgattaatgtgtttgacaatggtaaagtgttttttatttttatggttgtagctacaaaaattattattctctgattggtctaaatgtaactgtttcatttggttcttttttattggtaatgtgctctgagtgttttcacaatcagctcataagttgttggttaagattaataattgttacattgctacagatggttagtgttaaatttgataactcaagtttagagtccttccgacacatggcataaagcaggccaagaggctgggtctctaaagatatttctagtttaggtaataattaatgtggttcgtatcctaaatagtaaaatttaagataagatttaaagcaatgcctctttattaaagcattaaagctgctttaataggtattcataggtattaattgacatccaaacttcgtaatatgatagtaatgcttctaatattgattttaaagataataaattgttttaaacttgggttttgctttcccaaggttacaggtattatcctaaccttgcacaaaaaacttaaaaattatggttaaaactgctattgttccattgactgcagcttgcagtttgatttcaaatttaagatctttaattcacctgtatactgtaattaagataattacaagagtaatcatcttatgagagcgctcatacagctcacttcatacaaaactgtga

SEQ ID NO: 27404 - DNA, 1140 bp, Mus musculus
ccgagtttgggcgccatcaccctacgtatttcattccagggcagttgccagggaaagtcacaaggcaatttgagaagtgacagacatttcttatttatcgttcactcatgtcctgatggtatttgtattctgttcacgggtcattcctgtaaatgggggattagtttgaggttctgttgtggacaatacaagtcaattaattcccggcaagatagaaattctcacctccctttggtctccttgctctctctgtccttgaggatgtcatccttctgactgtatctgcggggctcgccaagatcagttcggttttctgatgacaccgttgatgctcttgtcttattaatcaatagtctcagtcagctatgcctcctttctcctcctctgatagagcagacgggcctgaagaggtagtaattactgctctgatctcagcgtgttctcttctctccttcccaccccagagcatgtctgttcgatcctggcttccctcctgcgcaacctgagagggcagcagcggacccggcttctgaataaatttacggagaacgacagtgagaaggtgggtgaccgtggccatgcagatggggccaggagcagagtggtgtggagacagccccttacctgagggtgctggggccaagtgcttctgctttaacgtaccttcaccagcatgtgggtctgttgcattgtctcttgaaggttcttacaagtctccatgcctgtgttcagtgtccttcccttggagtgcagtacctcctgagtggcagcaatgacactaggctaggggatagaggagactttcagagggttcaggtgagggtctggtgggtgtacagcacagcctggtgattgagaacactagctttggattcagaggtctgcagttgagctgattttgttactttcaagatacgtggcctgcagacatggctgagtgaatgaaagcacttgccatgcaagcagatagactagactttagatacccagaatccatgaaagagctgtagccactacctgtaatcccagaagccaaagatgagagatccctgggcgagcaggctgactgggaaccaggctagctggggtcagtgagctttggctcagtaagaggcttcacctcaataagcaaagaggaga

SEQ ID NO: 27405 - DNA, 1216 bp, Mus musculus
aaagggctgatgtacatgagagattatgcagtcgaacacacagaacacagtgatggctccagccacaaacaccagccttggcttgccagggagggactgtagtctggccaccatcctcctgatgccttcacatggcagctgctgagcctcgagtgtgtttgctcagccagcaagagttaaaagccccggtcttctcagggggtcttagggagattctagagatgatctcgatctacacgaacgaacggctttaggttctcggtcttcctccctgcccctccctccctccctccaaaaaggagaggaaatcaaggtattaatcatattattcatccaaccaaagctccctcagaattactctctatgtaatttgtatttatggatagaagcatctatgccttggaagcagagacctctgaattcataactgtcagaatcacaaaccatgggcaaggaattaatggcagtaattctttttttttttttttctaagtagagacctagatagaattgaattaccaagcatgttccagccctcttgctgctttagcagtgtgcagtcaccaggttgggaactgtttctgcaggttttacagacacttggaagcagatgtggcgattttctccggagtcggttctgtaaagatgtcctgccaaaactgaccagctccttaatcacccaggcccccatcagtgccagggctggaccagtttattctcatacactggccttcaagctacagctggctgtcttgcagggcctgggccccctctgtgaaaatctggacttgggtaggtaccacgtggtctcccagccccagaacttgcacgtgactcgatgccccttctttgcatcctctgactggagcttgtgtccctcacctcccttcttggacacctacctccctcattctgccctagccccctacctggccttttactttatagagtattcctggtttgctggaaagtataaagaattttaagggccttgcatggctaatcttaggtccctagacagtgattggttattgcttgtcccaaatgcagtctgagagcctgaggcttgttttgtttttctaccctgcaggtgagggtgacctgaataaagtggctgatgcctgcgtgatttacctcagtaccaaacagcccgtgaaattacaagaggctgccaggaggtaagtctgcttcatcacctgcatctctttacgtctgt

SEQ ID NO: 27406 - DNA, 1128 bp, Mus musculus
ttcttaggtgctagaaacattgtaggtccgcacatgcatgaaaacttacactgacttaccaagacagcgtgttttactctgtatatgccttttcagcagcacaggaattggaacctaaactcggcctggcccaggtcattgatcaggcatgctattgtgaaactcaattctggcttgccctgttcactaagaacctaaatttagatctatcctcatccctagagactttggcgtatgcttatatccctcactaacctggggatactccaagaataggagctcgttctttgcagtctcctgttcccctttgcacttggggccccgtgaatgtcggctggatggatgtcacttggctttgccttgagcttgaccctgtttactcagaagcttctctcctctagcctgcaggatgtttcctcggtgagaggaaggcggttgtacaatggcggtgtttgacactcctgaggaggcttttggcgtcttacgtccggtctgtgttcagctcacaaagacccagacagtggagaatgtggagcatctgcagacacagttacaagccataagtgacactgctcttcaggaactacagcagtacatcctcttccctttgcgatttgccctgaagaccccagggcccaaaagagagcgcctggtgcagagtgtggtggaatgtctcacctttgtcctctcttccacatgtgtgagagagcaggagcttctgcaggaactcttctcggagctttctgcctgtctgtactctcccagctcccagaaacccgcagctttgtcagaggagttgaaattggctgtcatccagggacttagcaccttaatgcactcagcttacagggacatcattctgactttttatgagccctccattctgcctcgtttaggatttgctgtgtctttactgttaggattggcagagcaggagaagtcaaaacagattaaaattgctgccttacagtgtctgcaggttctcctccttcagtgtgattgtcaggaccatccaaggcccttggatgaactggagcagcagcagctgggggatttgttggcatctttcttacctgggatctcaactgcgctgaccagaatcatcacaggagactttaaacaaggtca

SEQ ID NO: 27407 - DNA, 1196 bp, Mus musculus
tatgtataggattgtatttaaattgatgccccccccccacacacacacacacacacacagggtttctctgtgtagccctggctgtcccggaactcactttgtagaccaggctggcctcaaactcagaaatccgcctgcctctgcctcccaagtgctagtattaaaggcatgcgccatcaccaccacccagcaaattgatgtcttctaaaaagctaaattgtcaaaatcaatatggtcagttttgttttgttttctgtctgttaaaaccagtcatacaggctttccccctatttcttccaccttgcaaaggggaaaaagattccctgggtcgttggatgcctcttcctggttcaacatgggaggaatgtagtttctcaagactgagcatccaagtaatacagagtgtaccacagttttgttttaagtgtgtaaatcattttggcagttgttgttgttgttttaaagtaaatctgtcctaattaaaaacaaaaaatgtaagcttatatatatatcttttcatttttttctggacagagaggcagatgaaggctgtaaaaaacctttagaaagattgctgaacatctggcaagaacgaagtgtgtacggcggcgagttcatacagcagctgaagctgtctatggaggactccaagagccctccccccaaaggtagaacatcaccacatgtttacagctcttggtctttgctcctcccagccccacgtgaaaagctgcagtgggggctacagtggctgctgtgatccaccagccgctttatgactgcagagggatgctcctgagtgatggtgagaacttacacagtggtgcaagcggccaggcctggttctttgctcacgatgccatgctcgcacttcctcactttctgtgtgttcttcatggcccttgttgctctttcagggactgtccttgtgcagggaagggaacaaccaagttctttaggattgtggctgactaacgagtagctcatcctggccctgtcgtggacctcagcggggcctgggataggtctcttgccctttcagaactcagctttattagtaataagtctgggtttatatagtttaatgactatcagattactgtctatattaattattgattttcgtctttactgagcccagggtatctttgtgaagtatatatgtgaattctaaaattcttaagagtccgtgttat

SEQ ID NO: 27408 - DNA, 1661 bp, Mus musculus
tgactaggacaggtatcatgccccaggttcccatgtgtgccagagaaaagaagcaagtcactgctggagacagtcccctgccccagctccatctcttcagccagcatctgcctcagtaatgaagcggggaactctgacttcttactctcctccggctcccctctgagcatggttcagagccatgcagatggactcagttttgattcatatttgctaagaacacagactctccctcccactcatgtctcttgccactgctgcttttccatctttcgctctcttacacccataagccatgaaaatcatgtgtacttctggaagctttcaagagaagcttgcctcagtgacagcacatgccatggaagtctgagctggccttgaccaggttcagaacaggctcccaatgaggactcaggctgcagggattgggctttcctggccaccattgctcacaaggtcggcagcatagctttgccacaaagagtttgccaaattgccgacatttcctgatctaaacacttctgttagagaagtgttgtcatggttaggtgtgtttatttttcgagcattctagagaatccaacagtaagattcgaagctgatctgagacataaaagttatagcgcaggtacagagtggcagggctcacaagtcgtttgccaggcttctcaccacagccttccctgccacattgctccagggtccccagtttcagagcaccttcctaaagcaggaccctctgtcccctggggctgggaagggagctgttgggatagcatgcccaggctgataactgctccacagctggagtctgggctctcgtgcatgttgctctcaccctgaagcttacaataacgccaccatgtggacgcatccacagcatggtgactggacttgaacatctctacagataggacactgagcgtgccaggcagttcctgccactatatgcatccttgctcccatgcagagagaggagtactcaaacaactcacctccagcagaggaagggagtggagggagactaatttggggttgaattccattatcatgccagctgacattatgactgaatgatgtagttgcgatttttacgtctagtaaagagtgggcctggccctggaaatgactgtaatctggcaggcttatatttgacattggaaagggcagaaaccattttgtcctactagtgtgataggaattgtcgcccagagctgaagtccaaaagccataaaaaggaattcagtgaaggggcctgagaagcttcgttgctttaagttgctgttttcaggatcaccaaaaaaaaaaaagcacacatcgtttttacacgttaaagcaaatctgtgtgtcaccaaataggcaggctttggttgaagaagccgccccacctgctatgagatgggactcagttccactctgtccagcctggtcttcgtggaagctgttattcacagagtgcaggctgctgtttgcttgttcactctgccttttctgtcagcatccttttctccagaggttacaggacagcactgactcaggtgaaacccctgtctctgctgcggaacacctccctacacaccacgccactttactgtcacatgcacacaccactctgaacaccctccagacactgctttcccacaaaacagaccaaaagactg

SEQ ID NO: 27409 - DNA, 1173 bp, Mus musculus
cagtcagtgcgtaactcttacagcaggatcaagacgtgaccagtagcgattatgtaaatgaatgtgttggcctcattacaccacttccagcagatttcctgtgaggaagttagtttcgttttaatgaaatgcttcagtttttaatcttccttgttgtgtgcctccaccatgcccccagtctcccaactgtgtgcgaacttcccttgtttaacttaagtgaaacttttgtccctgagagttgatctggcgggtggggtgggtgacttctggttttgtgtttctttagggcatccgtaggcctcaaggatctttcctttagggtcatattcctcagaaagtcttcagtctttctttgtttttgttttgtttttcttaaaggatatttttaaagcttaaatttgtatattaatttaggactttatttagaagtataggctgtcattggtggcagcagtatattctgaaatgtctcatagatatatatttttgaataaagatggtgttgttgaacaacattctgtgatgtttcttctccctgcctcgtgcagtgattagtgatcatcaatggagggcgctctgtctgcacagaatcttcccctgggggctggtagtggtacatacgcaagacaactggttgaacttactctccaagtctctcttggagtttgattggccagttagcagtctatactgtagcagagagcgccaactgggtttcatccttgtataggctgaagactggttggggggtggggaggacttgtgatgtccccccacacacagaggatgtcttgagaggcctttggttgcagtcttttcagtcacaccagcaggccttgtgggaattgtttgatttgcagtatggtgaagctgctcttggaaaaacggaaaataaccaaacatcatcttttttaagtgttttcatggacttctcttctgctgaggttgacatccaatggaagaccctgatgactgagtactctggagacagggtgctctgaagcagctgctgtggtccggaatggttgagatctcccactaagttatggtggggttacctgtttctcatgatgcaaaggacttcctttttagtaatggtggtccatcaagaccacctgcagctgaagtccaagttcactatcaggaaagtgtgtgagttttgcctgcttgtat

SEQ ID NO: 27410 - DNA, 1160 bp, Mus musculus
gaaaaatggaagagcttaaataagttccaaaggtctaagaaagtgaggacgggaacgctggtgtcttaaggtatgaaaatgcaagttgtaaagattataagaaagtaatctaagatatgaaaaatgtttcagatttctctccctctctcttttgaaggtgcagagttttcagtggggtcctgataagctgatagagcactcactgctgttatctatcgaaagctctagattttaaatttcccgtggctgtcttctaagcatagacttaaaggcacttctcatggtactgaaaacacctctgccctgtctctatgcctctccctctagacagaagaaaaatgttcatgctttttatttatttatttatttatttatttatttatttatttttttggtttttggtttttggtttttcaagacagggtttctctgtgtagctgtggctgtcctggaactcactctgtagaccaaactggcctcgaactcagaaatccacctgcctctgcctcccaagtgatgggattaaaggcatgcaccaccatgcctggcatgttcatgctttttttttttttttaaagatttatttattgttatatgtaacacactgtagctgtcttcagacacaccagaagagggcatcagatctgattgccacatcagctggcccagtgaaccagatggatgccccattgcatgagtcctctcctgggctttgactagcattccagcctttctggaccctgacaaccagtttcaacaagaagtggttacagaagagagcatgttgccccttctaataggctggaaactccctggcataggggacaaaatggctactcaagtgcctgttggcataccaggaatggtaccagttaaaaccaaattgacccaaatctattaacagatagattctacagaaatagttctacaatatgatagggtgctctaccagctttattcaggacagggagagtattgtgtggccctaagggaaagaagttcttgttctacacaaaccacttgataaccattagagaaagccagctaggattagatccactgacagtgggggaagggtggcccctgcctcttccccaaggagaaatgctgcttccaggctaaccagtcaggtacagtgaaagacaagatctgacaactcc

SEQ ID NO: 27411 - DNA, 1198 bp, Mus musculus
attctttcttctgatgcaactcacaaccactgccctgccccatctctaccaccaccaagaggccggatagcattcctgatggcgaagcttgtgatggtttgtatacgcttggcccagggagaggcactatttggaggtgtggccttgttggaataggtgtgtcactgtgggtgtgggcttaagaccctcatcctagctgcctggaaatgagtcttccactagcagccttcagatgaagatgtagaactctcagctcctcctgcaccatgcctgcctggatgctgccatgctcccgctttgatgataatggactgaacctctgaacctgtaagccagcaccattaaatgttgtcttttataagacttgccttggtcatggtgtctgtacacagcagtaaaaccctaactaagacagcacttaagcaattttctggtaaactttaacaggattaggacctctctttagggaaatcaaccacccaagtacccaatagtgattatcagacaccttatgtcttatattcagtttaataatagttattcagccgttctcttttcccaagaaccttccttgggaagatgtggattgggttctggggcaagctagaaatgtaacttggacacatgttcgtaactaatttaactggaaaaaaaaaagtaaaactgacattttgagagggcacaagagtagtagctaagatttcagttactgttcgccagacaatgtattgactgctcgctagttctgtataacgaactgagttataatagtggttttgtttctgaggtgctcagagaggtggagtaattcacccaagatcacacagccagtagcagaaaacccaggtttggaatctaagcatctgggtccagagctggagcctaccgtggagtcacacttctgcctttgctaaaagaattgcagcaggagacagaaagtggggcagtccctggggggagtggggggagctggtgtagtggagagagagggtctcccctctgtggtgggcttggagaagacaggctgtcccagaagaggaggtgggggaaggccacatggggacagtgagcagagcatgtcacgtgagcttattgtgaggagactgcagatccagccgacagccatggccaaggtctgtctatggctctgtctatggttttattctctggatttgaagagccggttccaatcccatcc

SEQ ID NO: 27412 - DNA, 1197 bp, Mus musculus
gggagtggtgtgtggatcctcccacctaggtcgtgcatgggtaagtgtgaggcctttccagtgttagtgaattgtaagggcaagggagtggacgtaggcattgaagacacttgtatatgccacggtctccctctttttgtcattgtgttgggtagcagtgacttgttagcagtggagggaaaagtcatagttgaacgatggagagttagggtggtccggagcacctatctgctctggctctttgaggcccctcccttcccgttcattcttctgccagtggcagaagtgcacccacgtgtgtgccttgcttctgccctggaaagctgggcctcagcctagacatcaggtgactagctgttacctagctagtccccagattccaccttaattaagcagccttacctgttttgatcttccatttcctgacttggaaaactaaagctaagacaaaggtttttcaggactgactcccccttcttcttggcagattgtggggctctgtgcagttgatgttagttaaccactggatccacgtgttcaccgtggcttgcgcccctgcatccgaaagtgatcttggctgccgtgtcctggtcattggtagtgcagggaaaggatgcggaaagacgggctccgagctcggggcgtctggcctggagctttcctacacttgtgtcttgctctgcagccttacggaagtgtgggtggcgctttctggaagctgcacaagtcagtgctgggtcttcgcaacttggtgttctgtttccagaaacttggggtgtttgcatgtgctaggtcagcacagatttccaaaggatctctaggtgggttccctaacttttcacagaggagcagaaggtagatgacaggaggagaggtggggctggactgaggggagctgtgtgtgccagggtggggtggggcggggcgtgtaacagcccttaagcgtgtgttgagagaaggagctccctggtacagagtgtgcagctcccttcccagcctgtggtccccgtggcccaatgagtttttgtatcacttgtgagccactggtcttaaaatgcatggtttgcagaccaaaatgcagtccaacattatttgtttcatgtgtctatgtgaatgcacatatgtatgtatgtcatttgtgcctggtgcctgtgaagagtttattgggggctaggaatttcagagggtgactcttca

SEQ ID NO: 27413 - DNA, 1141 bp, Mus musculus
acgcaggttgtctcttcaaagggagagacatatatcctgttttcctcccagaaggctgggagcggaggtgtttaatatcctggcgaactttgtgctatctgtatgaccaagaccatgtcagagcctcccctagagccttaaggtatcatctataatgggtcagctaggtgggggggggggggcgcatgcctttacttccggtattcttctcctaaacccttaagatgtcatatgtaatcagtcacctgggtggtggtggtgcatgcctttatttccaggacttgggtggcaaaggtgggtggatctctgagttcgaggccagcctggtctacagagtgagtccaggtcagccaggactacacagagaaatcttctgtctcaaataaacaaaacaaaacaaaaaataaataatttaaaaaaaagatgtcacgtgtagtcaattatctttatggaaaatgtcatgacttaagctttattatgttaaactacctggtatcagactcttgaagtttgaaccaacacttagccgggcgatggtggcgcacgcctttaatcccagcacttgggaggcagagacaggtgaatctttgagttagaggctagcctggtctaccgagtgagtccgggacagccaggattacacagagaaaccctgtctcaaacatagaattaagtaaactaaagtaataaagacatttgaatcaacactggctactgagtcatgttgaaccagatggccttttttaccttacttgggttaccaccctggctgtttgagatacctgcaaggaccccccacaatggcgaccaacatgagagtctccagtcttggagtaggtaagagaatttttctctagtcacccaggagcagtgcgtgctctcacccaggaggtaacaggtaagtgggaagatagaatatgcctggattcttcccagtcctgaaacaaagcttttttttttttttttttttttttacaattactgagctgttggttaagatccagaggagggaaatagttagagcaacagagctgcagctctgcacaagtgtcagtcagattcagtcccttggcttcctgaacaagaaatgattgatgttgaaaattggaaatgcagccaggtggtggtgacggtctataga

SEQ ID NO: 27414 - DNA, 1100 bp, Mus musculus
ttgagggctttgctttattttagtagttttttttttaatgtagcaagataacataatatcaccattttagccatttacctaagcaagcctcaaacttgccatgctggtcttgaactcataatcttcctgcccccagcctaagcgctgggctatagggacatgccatcattggcgctgttttgtttgtacatttgctttttcttaaaaaagatttatttatttatttattatctgtaagtacactgtagctgtcttcagacaccccagaaatggacatcaggtcccattatagatggttgtgagccaccatgtggttgctgggatttgaactccggaccttcagaagagcagtcagtgctcttaatctctgagccatctctccagcccccaggagagtcttcttgaactcaaaattcaaattgccctaaaatgtaaagatcccaaatcttacataaatagccttaggtttaaatctttcaaagttaatgtgaattaagtaggatttgcttgtggtttagttttgtgcctgcccttggtctgacgtaaaggagcagacaagggaagaagttaggggaggctcaagagccctgccttctgttcaaggctcatgttacacagtattccaagtttctagtgcatattagtagtgagaggttctcgcatcagtgtgacatctacaactgtgtctggggccttgtcttctgtctgtagagacctgtgctcgtgtacactgcaggcatgtattatgcctctccctaattagacagcaggagaatacagccccaagcatggcatagggtcctgggggctccaggaaaacaccattctgtcatatcttcaacttgactttgtcagatagctctttacacatttctttctaggactcccattacgactaaaaactgataaatggacttgctgatactggcaaatgattaaaaaatttttgaagtttatggaatattaatcatgctactgaactcccttacagttgacagtatcaaactattgtaaaacagcacaattcaatactcaaattacaaatttgaattcccacatcttacttttagctaggctaactctaaattttttcactttag

SEQ ID NO: 27415 - DNA, 1177 bp, Mus musculus
ccgagcaatggtggcacacgcctttagtcccagcacttgggaggcagagacaggcagatttctgagttcgaggccagcctacaactgagtgagttccaggacagccagggctacactgagaaacctgtcttgaaaaaaattaattaattaattaattaaaattttttttcactttaaaagagagtgctttttctacttccaaaaaaattttgcccaagggagacactacctagagtatatatttaaaacaaaaacaaaaccaaaaacccacaaaaagcaaaaaacctaacaactaatcaatgggaaatgcccggtgtcctgccatcgaggcgaggttatgcttatgtcttccagaaaatgaagtcccagatggctcctgctgtgacatttcagacaaggactgcatcccagagaccaccagacaagcaaggggttgaagctagacgacaaacccatcaagaggagacgtcccaagaggacaaggaagccaataacgtggagagacttaactggtcaagccaagactttggggaagcaagaaggacctgatactgctgaccccaaaatgatgctgttatgtttactgactgtatttcatgttgattctcagcctgtcggtgcagaatccaaatgccttttgtcaaaaggagggataaagggtgcacctgtaataggacacagtataacattgtattgctgtgctaatcattgtttttattctttgggaccagctgtccaggcaaaaagaagagtatccaaacatttagacacatgaatgggtggcagcttggttagactaactgagtcgttcaaatgtaataatacagattttagcttaatgcagaactctttagaaagctcagatggaagaaattatagttgtatggaaatgagaaagggaataagtgatgtatggcttgctacgattcaaccaacaccagttactaagtagggttgagtggggctgccttcttgtctccaggcgaatcattacattagtctgctggccttggtggaggaagtatgccactgagggaggggagagccttgagagtttaaaagcctcgccttgcttccagtgtagtctctgctctaagcttgaccttcaaggtgtgattgctcagtttcatgcccctgccaccatgcctgctgtgtgctctcatgccttaccgctgta

SEQ ID NO: 27416 - DNA, 1111 bp, Mus musculus
tcttaattactttgtccatttgggttaattgtatagattttaattgctacttttcttcatggttaagcatcattctatagaaggaggaaaaaacagaaaataaataatagaaaaggcaaattctgtatatatctgtatgcagatgtatgcaattatagtcttctgaccagaaattcaatgaaaaaaaatcatttgtagaatctgttgatgatgttattgtaaattaactgctgtctatttcaaagaagatatcagagagccctttaaaaaaataaattatgacatagttgctaaccaaagcattattggattctattgaagtagttatgtaatgacaccaacatttgatctttgtgtccagggtcccatgagcctatttggcgttttgataaaattaatgaaatgctccttttttctccccagccattgcaacccaagctagcatggagtttcgacggaaagggtcccaaatgtcaacagacaccatggtttccaaccctgtgtttgatgccagtgaatttcctgataactatgaagcaggaagagctgaggcttgtgggacattatgtaggattttttgtagcaagaagactggagaagagattctgccagcttatttatccaggttttagaatttttttgtttatttttgcatttatattatttgatggtaaaatactattgtggcatggctaaatcaataagccactgttggtctgaaatgcttgccagtgtctttatgtaattgaaaactgcttgaattctattttacctgcctcatcagatctggtaaagactttaaggttttattctagagctattattatttatcctatcatttgtaaattctggagagatttggatgtaccacagtagtttgttaatagatttttttgggacaatgttaggttctgtgtacagtccagaaataactcagctgtgaatttttactccaaagcgtttaatgactgtggtgaatagattcaagcaaaattacagtgattcaataggaagcagaagttggcaggagagagacatcatggttttgaatgtttggaggaaacagcagctcatacttagcctagaagggtcaggagagagatctggcata

SEQ ID NO: 27417 - DNA, 3096 bp, Mus musculus
ggtaataaacatttgtagaagaaagagactggagagtgattcctacagtccaccacatgtccgtcggaaacagaaaatcactgacattgtcaacaaatatcggaataagcagttggagccagagttttatactgcccttttccaggaggttggactcaagaactgcagttcttagaatgcattttgtccaggtcagtgaactccagagtgggctctaacatcaaagcaagacagtcctgtaaaaatcaaagctaatcactcctaagagctcactgctgaatcagaagaagaaatacgatgtgaagccactggcttgaagacccagctttccagtgaagggaccctgcacagtcacactcctgctgaaaacaacaacaagcattttagccataaactttcttttaaaagtgacaattttagtaaaatatcagccttttgaggaaaaggctttatgcatcagttaaatacatgcattgatagtgtcaacaagtttgcaagttagaaactgaagatagttttatacctcgctttttaggagggtgtattcaaaattaaaatctgtctcagaatcttccagaactttttaggctcaagttgacactgtggagaaggaaaggctgcagcgttgtcctcgtgtggattcacttgtcaccccatcacactgacagagggtgaaacaaatgagttttgttcagataagaagtccaacattaaaatatttcctatttttctctccatatttaacaagttgtccctctgatcgctgtggagctctgtcaaatggctcagcttcttagcagacgtgggcagtggaggccctgctgtatctctgaatagtatactgccatgtttatggttaaaggctgtgagagaacgatggcacctcccttctccgttgctgttcagtttaatggaagggtgacaggttagacgtgactcctccattaaacaccaagaaatgtgagttcatagcaggggcttcatccatattgattgcaggaccaagttgcaagctgcagtagttgaggaaaggttctaatttgtggctcaggaagtagtgtcccactcacttagctccttagagggcacccagcccacaatccacagaactcagtgccacctccttaggtggctgctgctgtttggtttctagccttagccagctgaaggcagaagtctctgccatctcactgctgcttttctgccagggacaaagctttggaagtggccagaaccaaattgttttagaaggactcctgttacagcactcagtatatacctgtttttatgttctccttcaataagatctttttgtcttagaaaacaagtgacatttatagtccaaagagaaataatcacacttgaatggtggtgttcccactggccctctgttgtcattaaagtgtagaccaggactccagtgattggtttgaggtttcttttctttggatgtcaggggcaatgttgggccagctctcctgtgcagatgcctccattctagacatgtgctctgccatctggaagcacaaagcatggctgtagcagtctttggtctgaagtttgccaccaccccttttattttttttccctcagctcaggtacagacagccatccccactcccacccccatcttccttgtcctcttcttcccctatgagtttccattcgaggcaaagagctttctgtctttgattccctctgaagtcaggcaataatctaatgttcccaggtgattccctgagatggggaatggtgaaaattagtgaatttttccctaaaaatattcttgtaactcagcaagaataggtgaaattgaacaacagctaagatacttccagatttgacccttcatgggcaaagtgggttcttgttctatccaaggtgaacaaagaatttatacacatacatgcaacttctaacattccagagggtacaaatatctgataaaggtggactttctttgtgtgattcttctcaaaaccttgtttggatgttttttaaatgatactggaaaaataacgtatgggttatatgtgtaggagtgggcttactggccttcccccttcatttggctctaatttctggtaactctttataattctgattattttggtaagcgaaccaccatggcagatgcagtttgaaatctggggcatgcagtggttccccaagggaagagggctgccccctgccccctgaaggagagaagcatcggtgtgcacagccagcagagcttgggatgcaccgccactgcttgcttctgctccacacaccatctccccagcaaaaggctggcaagaagagcttgggccttcgcagaggcgtttggaatcctgctcactgagctcaccctcctgcctgcactgaggtcactttgaacagaatcatggcagaggaacatccttagagcctaacagtaatctcagtagttcacttgataaatttgccaccacaggttcagaaactttggggggaaactgggaccagtctggactgtggcttaagctattcagttgctgtagctgaatacccaggcaccttcaaacaggaaaacatttcccaagggtatttaggctggtggcccattctgttcacttttgaagctgggggtgagggtgggggtggggcttctactttggccggaacatggaaaacggggctcttaacaccaccttccccttttgtctagggtttcttccttaggccttcctggcctttggccccttgaaaagaataattacatggtagggcagccctctccagccatactgatgcatgtgccatgtgtacacaagcatctcccccttccagcacctcgattttagggtagctccatctctggactcacatacaaaaatacgcacagtttggcgggccctctcagtgtctaacccatgggtagtagggcaatctggaaggcccgcttccacatttatgagctagggaagaaccaggtttggctggctgccattacagacagtgatgaggtttccagggtgtttattcctattaaaaagtggaacttccctcacatactcagccttgggtacagctggataaagctggtagggactgccttggatattatgtggcact

SEQ ID NO: 27418 - DNA, 1368 bp, Mus musculus
ttgccaggaggtctcaaagctcccagcctgctgcttctggagtggtcatgcccaaagctgcaaactgaggtgcccgcggccaccatcctgtgctgcattcaggagagcatggcgtggctggagttggctatcatcccagctgtacagctttgctgcccctgtcttcttgatgctgggaaaggaagcccacaccacatcaccaccatgctatcccacaaaaccgttgaaattgtgccccgtaccttgagtgcgacacactggctctgccaaaaccttctggtgtaactggcaagctacgagttggttccttgctccgtgctctttttatttgtcctcaaactacctccttagagccccaagagggtccccacgtcattcggatgtatgggacagatacttctttacagccccctatgccatacccttagtaggtaggcttgccacttgttggtctctgtctccactgtggcctcagggcctcagtagactagagatgaatcaggacctgactagatctgcaagatgctttattagaaccaggagtgtgggccagagagcaccctgaaggctgctggatgcagaaggaggtgcacaacactaggtcatctccaccccaactccaggacagatggaatccggcatggtgcaataacataagagactaaagacagtttctgggatccctgggggctcagctaggctctgtagcccatagctgaaagaggagatggtcaaaacacacacctgtggctttaaacatttagctctgacagacactgaaatgcctctggagatgattttagccacaaggtgggcagttgcccaggcagccagctacatactcttaggagtcagctgcccagggtttctgagctctgtgctcaggggccagagaatgaaggcatttattgccatctctgagccattcaggccatctcttcacacccagcacttcttcctgcctcctggaccgttcttctctacctgaggggtgggaaactcggctgcctcctgcatgggagctagtcccagacggtgtggactcatgggcttttgttcatgttttccactagggataaacaaatgttccctgttcaggctccaagtccccagggcactttgtgactctttggaatattgagagtcacaatgaggaacagtctccagcgcatgagccagggccacccacccattcactcatgtgatcgatctattgaggtgctgagacacacccgatgcgctgttagtttcagcagataatggactaacctggcagtgaagactttgatctcttgaggaccgtgggcatccccggactcatctattattctaatcagagtgcctccatgccagaccagtgtcccccgt

SEQ ID NO: 27419 - DNA, 1210 bp, Mus musculus
ctccgccagtgttgagcatcctcgcacagctgctcctgagcatggcagacatctgtgccatgcccggggaccacatttctttgaataactgttagcacaccaattgctatcttggtgctactacttgttagttatggattttagtctaccttttcatatttctgaatgtgaatacatgtgagaaaaaaatgtttatttttaataatttcaaattcagcccttaaatttagggttagagttaggcagtgggttagggttacagttaaattttaaattccctttatattttgcacaacatttttactgggtcataatttagcaagctctgacatcttaaactcaggaagaattgtctacatcacattgactcttgacatcatcagttgtaccatccctgtctcatggatgagcctcctttttgccttgagacagggtttctgtctagccctgcctggtctcgaacttgtgaccctcccgccacctgcctgctggaatttacaggccttgtcaccatgcgtggctaggattgcaggattgaacatttttccactgtcaccattatttctcggtgccttctttttcagattcagaaaaagcgaggggatcttcgcttgattgtggcctcagccactctggacgcagaggtaagggcatctctctccttctgcttaaacactggagttgtcagatattcccttgggactgcacctctggccaaagcatgtcttcggcaggacgacctgcctctttgggggccatgtggtgctctagatgtcacctgatgctccttctccacggtgggtagacgttagcctgtgtaccccagggcgttgatgatcaccagcttgccctgtctctgtctctgctgtcctcctcctgacacaggcagcttctttttagttactggtcagtgtgaagctatattaattgaaattatttatgaaaattacatacttattttaattttttggtgtagtggaagtttctcttctaacatagtgatttccatgttaagtgtttttttttaattgtttttactttttgtatgtggggtagggtgtacacatgccatggctggaggtcagaggtcagcttggaggtcagttctatctttcctccatgtgggttcctctgataaaggtcttcaggcttagcagtagacatctttaccagctgagccatctctttcatcccaatgtttttatatggc

SEQ ID NO: 27420 - DNA, 1206 bp, Mus musculus
tattttcccagtgtgagcaattttcttgagttctctcaccttttgtcacatggtatctaatcccaactgtgacatcccattgtgccacctaatgcatccctttttccatccaagtagatggcactgttttcaagagggctccttggaccatcaaggccatccagtataatgggagtccccagggccatgacaccgccaggctccacagttgtgctccctaagtacacaaaggcatctttggtggtagcagagctcaagtgcagcagctgtacctgctgctttttattgtggtaaaaaatagttatactgaatattgtgtcatgtcggagcatgagagactggctgtaagaactccatctgtgtctgggcacctagctttcactggcatggaactgctcatagttcatgctcagaatttggctagtgtagcctaccaggctggctcatggcagctggtaactggtacagcagatgcccaggaacagctacaatgttgcaagacaccaacatgaaaggtagtgctgcctccctccccaaccctaccttctgtaaatggaattctgagggcttttctttgccctttttgctcccaattaacagcagggcatttgtatgcccaccattgtagtccgttttagcttctgagtataacacagagaactaataaagttattaaactgtaggcactatgctggccatatagtcatctattctaaccctcaatggctgcctacttcccagccacgtggttctttacctgcaatctgagtcttcttaccctggctcgtgcttttccatgtgtgtcctcttggcaactccctgctgatctgcttgccaccagccagtcgtcctgtccttctccaggtctctcttcttcctcttctctcatctctctccctctctttttgggaacccctgactctgatcagaagccccaccttattcacttctgctcagctataggctgaattagattttattaaccaatctgaggtgatagaaaagagtttttacacatctttgagacaggagatgctccaaataccatgacaatgccaacctccagactgctggcaggtccatcagcatctgaatacactgtacaaaactgtacaaaaccccctcccccaacaaccttcggttttgttgaatttaaaatactcacatgtgactgattgctttcttagacagtacaactttgaatgt

SEQ ID NO: 27421 - DNA, 1148 bp, Mus musculus
ggaagtcatttttctgctgtgtagattcctggggattgcacataattgtcatgtttggcatcagggacttttccagcctgagctggaaaagccatagagatttcaattaagaactttgtcttctttgttttctgctttgttttgtttttaatttaaaatctctcacagcatctgtagcacagtttgaggatatactagatatgtaatgactttgagttcatattattggcctagatgttttgtccatggaattatttaccagcaaccctaattttctctgagatagttaatttttacatttttagatagcatttgttttcaaaggcttgggacccggttttaaattccattttgaaaatttatgcatttcaggaagataataatgtgaaatctaataggaactactctgaatttgtattttaaagtttagtgctttttagtgacttttgcatgtttgtatttgacaaaaataaatttgtttgtttatttagacagggtctctctgtaaccctggttgtcctggaactctctgtgtagaccaggctggccttgaactcaatctgtctgcctttgtctcctgagtgctgggattaaaggcgtgtactaccaggtctggcttcaaattttaaagtttgctaatctctaactttattataaaagtcgttcattatggaaaataagatgaagcacacttaagaactcaagttcacaaatttctaaattttaaaattactacattctttttaaaatgtatgtcttccagtcttttttgtatgtggtcatggatttattgaattacatacagtggtgctcattttctctccttttcagataatttccttgtcatgcctttgaaccaaagcagtagatcttaacgttcaatattctgaagcccatttactgatttctaactataaacaaaacaacacatgctttatttcaggttgtagtcctggtgcatgcatgcattgtcatttttatgccatgaggtaaaagtcaccagttttatcctgattgactcagcatgttaagactttagactggagacttagaagtcagagggtcctgtacactgcatgggagatttgagttcagtcttctaacactatatgctttacttactattctcatctctgtgggatggaaag

SEQ ID NO: 27422 - DNA, 1149 bp, Mus musculus
aatattttacagatcagatatttaaaaatacactttgaaataaaaggactgtttttctaggtctcaaggcattactgggcttgtagtgtgaccaggtagctctcttaatcattcttaatcagattttctttaatttgtaatattgaaaagcactataaaacaaaaggtcaagttctgccactcacaaactgtatcctaatctaagcatcttaccttttttgcctccttttcatttttgattgatttcctgctaagtaatttagataatgatggtgatgatgacaattataacaaaacctaataaaagatcatgtagataaattgcaactgtcagtttttgtagtggaatctaactcagtagttaattattgataaatctgatttggaactaggactttttagttatttctagctttatagttgagtactatcattgcttttaagatttcatggtggaggcaacctttttgtttgtttttgcagatgttggttatcaaacttgttgattctggctctttttttttaaaaaaaaaatctttttattcatttaatgtatatgagtacactgttgcaatcttcagacacaccagaagagagcatcagatactattacagatggttgtgagccatcatgtgattgctgggatttgaactcaggacctctgaaagagcagtcagtgctcttaactactgagccatctctccagcccccaacctttttgtttttttaagaccgggtttctctgtgtagctctggctgttctaaaactagttctataggccaggctgaccagcaactcagataccctcctgtttctgcctctcaagtgctgggattgaagacatatatcaccacacccagctcatggagacaacatatgaagctagccactgaaaatagttacgatcacagaaggatgaaaggataatggctaaaaaaagaggtatctggtgggtacagtggtacttgacttgggaggttatggcagaagggtgaccaagttccaagccaaactgagctataactgtctcaaatataattaaaggagcctttcagatgataagaaaagcatgaagaggttaaggaatgtagctccgtgttagtgtgtaccccgtagaatatacaagccctatgttttattcccaata

SEQ ID NO: 27423 - DNA, 1146 bp, Mus musculus
acagtgcagtttttgattctaggtataggactgaggcccaaaacttggtatttataacaaacttgcttgtgatggttttggtctgtgaactacttgagtagcaaggttctagaggaaggtcttatttacgctttttatgtgggaaatctgggcttgcctgctatgaatatatattcttattcatattccacccacgtaactttgaagaagaaagatgcctatttcttttccccacaattcctttcttccactccctgcccctatcctttcctccccttcttgaacagaggctgcttagcttagcagtggcaggagtccttctgaggatttgatttttaaaaaccattgaagaggtgtaaaggaccctgcttgctgaaaggaaaaggaagagtggctgggccttccccaggtcatccctgtcctgagcaggcacctgggaacaattaactggcatagtctccaaaaaaagacccaggtaaatatctactaaagagaaggagaaatttttaagtagatctctgacagtatgttactctgttgttgttatcactgtgtgtcagcagacctttgtacaccttggaaaggtgagccatcagtcatgacctctccagtgttcagtgcacatagaatatgaatagtgtgcctcactgtttggaaccattttcttccttcaggtaaagttatgaagctgagtcctaaagcagaagaagtagctacattctttgcaaaaatgcttgaccacgaatatactactaaggaaatattcaggaaaaatttctttaaagattggagaaaggtattgtggcccatgtgttcatatcttaatcatttataaaagtgctgacttagaggtatagctcatttgttaatgtcttgtttgtttaaaaaatgcaaagtatagtttaatgtatatcttttttcccttactattttaatgtggtttttgttcaacaagaatatatcccttctcagctttcatgtgactgcaggaaggagcttatcagattaggttaaacagaaaacctcaaatccagttgagcaaaggaagcattgtttctgcagggactgtcctctgatgcctttacacagggtcagtctgaccatctattctgtattgatataaaaaagtaccattgttttcaattt

SEQ ID NO: 27424 - DNA, 1180 bp, Mus musculus
cccagaaacattttttttctcagtcaaatcagagaccattttaaatgcagaagtgagaaaatggtgaataattacgcctattcatggaagcttttgtcttccttggtaattacatgttgttgtcttgggttctgtttctttgataggtccctgaaaccgctatggctgtcttgaatttaatggaattcagtgctagcagagaactggagcatgcattccacagcaaggctgtggtgcttctgaagcaatggagatgcttacatcctttatgttgacagaagtcagtttgggggcatgcttggtggatctcacaagagtgggaaccattttttagataggaaagctttcttagcaattatacaggacggagtcagtagaatagcaagtattcttgtcatgttacatgccccagactttctcttcagttctatgcttttccagctttggttaaaatcaggttcctgttttggggttcagagctctaaatattcaatgtgttgctccactgcagggtgagaaagactggcagaagtatgagactgcgcggcgtctgaagaagtgtgtggacaagatccgaaatcagtatcgggaagactggaagtccaaagagatgaaagttcgtcagagagctgtagcactgtacttcattgataaggtggggacatgttcctttatccacattggacagttctgtttacaggtatagggaatgtctacagtatagggatcaggaatgtatatctgctgtgtgacttataatccaaatttacttaagtaggaagagtagatgtggatacaaagaaagaggcatgtacagtatgttggctattgagcagtctctataacaagaggatctgcataaactgaacattattagttagtttgtttgtttgcttgtttttggtttttcgagacaaggtttctctgtgtagccctggctgtcctggaactcactttgtagacgaggctgggctcaaactcagaaatcttcctgcctctgcctcccaagtgctgggattaaaggcgtgtgccaccactgcccggctgtttgtttttttaataactgtgatgctcaagatttttgaccataatctgcaaaagtacttactttatgtcaaaatccaacataacagttttatttatgtgaaattaaatcgaaagttgcacaaaccactggtta

SEQ ID NO: 27425 - DNA, 1445 bp, Mus musculus
gaggagaacaaacaaattgccttggggacctccaaactcaattatctggaccctaggatcacagtggcttggtaagtcttaggcctgtgtagatttcctgcttttggttaaggaaaggcagaaagtctcttggatattgccagctccttcatgccgtgtctaagtttacatttcttccaggagagcctacagctctggttgctgaggtacatggaatatcctaggtgccccatgggcacattagtatagtagcccatgcctgctttcgagatctctgagataaagaatgagctgataaaataaagtcctttgaatatttttgtgcaccagaaagctctggacccctgctatgggttatcattgagctagactaatctcctttgttgtctccatatttattcgtttcttttttctttctttctttctttctttttttttttttacaggtgcaaaaagtggggggtcccaattgagaagatttacaacaaaacccagagggagaagtttgcttgggccattgatatgactgatgaggactacgagttttgaccagtctcggcaggggttctgtgaaaaggaacagtgtggtttggggaagatggataaactgagcctcacttgccctcacacccgagggagaggccacaagtcttaacaaaccaacatctttgcaaaaagatagacctggagatactataagggagagctgagccagttgtcctatggacaacttatttaaaaatatttcagatatcaaaattctagctgtatgatttgttttgaattttgtttttactttcaagagagcaagtggatgggaatttgtcagcatcctgccaggcaaattcagttttgctgcaatgtttggattctctcagctactgtatgtgaagtctgattatattggtgcgtttttacagttagggttttgcaataacttctatattttaatagaaacaaattcctaaactccctcctctcccctatttcaggaatttaaaattaagtagaacaaaacaaaaacccagcgcacctattacagctgtcattctatcgtcatgggaatcagttttcattaaacttgaagcagttgtgacattggcagtgttttggttcagacacctattcacagaaaagcatgatgggaaaatatttcctgacttgagtgttcctttttaaatgtgaatttttatttcgttttaattattttaaaatatttaagccttcttcttgatcttaaagatcgtgtagcttggggttggggagggatgaagggcgagtgagtctaaggataatgtaataatcagtgactgaaaccattttcccatcatcctttgttctgaccattctttgtaccctttaagagatccatctttttctttggaaaccccagtctttcatttgaaagatgttattgtataaaaacttccacaggtcaataaatt

SEQ ID NO: 27426 - DNA, 1129 bp, Mus musculus
atgtatgcacatgtgctgtactaggttaaaggatggggactgccctctgctttactccacacaatccaatcccactgtctcacctctgcagtgtgcagtaaaagccctcttcgactacaaggcccagagagaggatgagctgaccttcaccaagagtgccatcatccagaatgtggaaaagcaagatggtggctggtgagataaaccatccaggctagaaagcctgtggtgtggtgggacaggaggccggggcctctgtggagctgtcactgaaagcacttgtgacagtatgctttgagagcatctgtctcatgctcactagcagtgtctgccttggcctgacttatgtgtgggaaccccccaggaagagcttgtgagtttggggcagttgctggagtcagtaccctgtggcttccacaggtggcgaggggactatggtgggaagaagcagctgtggttcccctcaaactatgtggaagagatgatcaatccagcagtcctagagcctgagagggaggtatgtctggaaccactctgtgtcacgggtttgtttccctgtccccaggttttcttttgatgtgtctatcacacccaggccttcctgtcatctgtgagccacacatcctgtgtggctacactctagtctctcttgtacctatgtcatgcttggctggtcatgagtagacctaaaagatcgtcaaaaagttccctcagctgagcctgcggcagcgatgctgaccatcctggggttttgcttcctacagcacctggatgagaacagcccactgggggacttgctgcgaggggtcttagatgtgccagcttgtcagatcggtgagatctaattcctagctcatgattcctcttagtgtcagggtgtccttgtcactcctcctgcttctggagaggaatccagtggccgagttcccagaggctactcttatactatggaagtcccagactcttttgtcatccccaaattttaccctctgccaagtacagtggagtcaaaagttggcagagatgttgacagactgacatccagtcctaatggtttagaccacagcattgtgacagaagcttggagatgggttagggtgggggctacagtgcatggctccaaggaaga

SEQ ID NO: 27427 - DNA, 1157 bp, Mus musculus
aagccccttggaaagagaagttgcctcagttggtggcataggaggtctcaaggagctgctgacacattcctgaaagaggagaaggagaaggaggaggagccttggtgggccagggaaacaaagtttacattgtcctgtagctttaaaaccacagggtgaaagagtaaatgccctgcagtttggccctggagccaggacagaggaatgcagggcctataatgagaaggctctgctctgcccatggaggaagacacagcacaagggcacattgcccatggctgggtacactacccagcctgaaagatacaggggatcatgataaaaatagcagtattaatttttttttcttctcagtggtattgtaactaagttattctgtcctgctcctcaccttggaagggaagacccagcacagagcctttgggaacagcagctctatggggtgttgtactgggagagggcactgtcaagaagggtggaggggcaggaagagagaagagcaatgtctaccctggtgagcttttttgtttttatgacaaagacgactcgatatgcttccccttaggaatggagatataggtaagtggagtcaggcagtaggtaccaaattaagctgctgcttggtgcagtttctatgcagttggtaaaaagatgcaaaggagatgggaaggttgggaaggtaagccccacctctgagaacagaggctggggtccaggcctgtgggtgcaaaggtgcctcagcatagccagcatcagcacacgcaaacccactgcccaaatttgggctcagggttggccatttgctagttctgctgccctcttaagatctgactgccaaataaatcatcctcatgtcctttttcttttaacttgtttgtttcttgggggctcaggagaacatggtgattgagaatagaagcaagtgtggtataatatccctggagacctgggaagtcacacagctcttccctgtggctctaaaatgtgaggcccctctgccaccccatcttctaatggtattgttgaagcctgcccaccccatcaaggggcaagctcagtctccattgcacagaaacctacttcaaaaaagtagcatttggttatgtgctgccaggtgcgtctgtttgcctcttcatctgccagttagaacctctgtg

SEQ ID NO: 27428 - DNA, 2953 bp, Mus musculus
tgatgtaaacacagacgctctggtagacgacaagcctggccctagtccgttttctgatcagtcagaacccacaataactactagtagtcctgtggctttcaacccatttctcatcccaggagtgtctcctggactcatctacccttccatgtttctttcccctggcatgggcatggctctgccagccatgcagcaggccagacactcagagatggtcggtcttgagacccagaagaggaaaaagaagaaaactaagggggacagccccacccaagagcctgcgtctgtgtgtgaaaaggagccaggcagtgatcagaactgcaccgagtccagtgccactgtgtccccagagagagaacacgtggcacaggccagggaggaggggctcaaagactccaatgaggataccaattagaactttttcatttaagaaatgattgtggcttgtaagtttcttatcccataaaggtttgtcacttccctcacttcaccttcataagaacctgtgttttcatcagtaatattacctacctaatttcctgtctgagaactctggtgacatgttaatagttgcagggtcttgccactttgttaggtaagtgtcacctgcctagtctaggcggcacagaatccttccttttatccagttcattccagcaatcacagttgatacagtgcttggtgacataccaccttccccttctctttcaagtcccactcatctgaggaagaaaatggcagaagaaagctgtgtagggattcactgtggggccaaagagcaaagatgaacgtaagtgcaagctcgttcttttgtgagcaactgaataaaaagatcatattgaggaaaccaaaaggcacatgataggaagtgccggtgcgtacttttgtagttcaggtgtcctgttgtcttggttactgagtagcgtagtctacagcatataaactaatggttcaaaatgcatatactgatggcttctaaaaacaggaaccttccagatagtaatacagtttccccctcaaggttttcctcctcttcagcaagaagaaatactggccagctaggcagtttccctatcgtccctgctgagtctgagacacttcagcaccttgagttactgcagcaactgcgagggcgctgctcagggtccacagatgctgctggcatttatcccaggacaactgctgccacccgtttccacttttaagaaacttgctggatttttgtgttctttcacccagagcaaggctttttggagcctagtaaggtaatcgctcagcacttgctagattctgtcattagcgtagcgtgtcaaaacacgcacaccaccttttacattgcaactgtgaagttttgtccctcccattttctcactactcaaacggtatcttagtattgggcccaaattccaaattgtcagtcaggcaaggttctgttaagtcagcagcatacactctccagctccgtgttgaagaattgagcagggaggagcccactcggtggcgcttcagttcccgttttctttcccctcacccttacatcatgttcctcctgagggtctcctccaaggacagcccctgctgagacttgaaccagccaaacctagttctctggagcacaggctcaggggctagacaggtggcgggtgtcccgagtaccaggttcacttcggtgttacaattaactgtgttttttttactgtttctgttacagttttgctaacttatcagaaggtcggaaagtttggctgtttcagtttgcattatttatttatgatgatttttgtcattgtcttttatacgtttgggttataaattatgtaaatgttaaaatgagcatctcaaagaagtctgttaaattgtgaccggaaaaaaaaaaacaatcaggtgtattttcaaaacagagagtcccagttttatgaatcatagatataaactagaaattctataacgatctataagaaagaagaatccaagaactgaataaatgctatttaataacctccttgtagtgtagaaggtctgtgatgctggtaacagatttcttagaaatgctgctcactgttgaactaacatcctgttcagttctgctccggcggaagcagaaaggtttctcggctgttaaatcctaaagatcaatataatttatttatgtaagagaaacatgcaatcaatatatttttgaaccttttaagtactaattttctttttatcaagtagaaaaaaatgtatttgccctaaatccttaaaaatacaaatgctataaaacctcctgtattttgcaagccttactgcaatgagcattgtagacacccagcagggtctgctcttcctgtcgtctcccgtgttgtctcatgtggagagctcctctcccagcttccacctaaacttccaagtaggtcacagggtccgctgcggacccaacttaaccaccagcatgcgcaatcccttgttatatcttaaccgaacctgtatgttaactctcgggtgttcaggcttctgttgactgctgttgtgatactgtttgcaaaatgaaattgacactgtggattatttgctctgtaaggcataagtgcttcttatgattattttaacgttccgagagcaaaagccaaatttaaactctcttcagcaaacttgagcctcttcatctaattccatgtcactcatagccataacttctcttggtcatcttcacccatgtttcacataataaattgtctgtggtcttgatcctggatttaaaaaggaagttcaaaattcagatttatattaaggatttcattagtgcttagatgtctggctacctgggcattttatgaatgtattgtgtataccagggatctacagtccttctgggtacctgattcctgctgggcaacactcttgggagctgacctgacccatctccactctcagaacacagattaaactgtgccatgggaaggacttagca

SEQ ID NO: 27429 - DNA, 1109 bp, Mus musculus
gtgtgcatgccatggtgagtgtgcagaggttgcagggcaattggttttcaccttttataaagtcttttcacctttacaagtattctggggattgaacatggatcctaaattgaacaggaacatctttgcctgtaataagccatcttaccggctcatgggctaacttgtgacatattatcagcaccatgatcctgcggcataaggccacagatggctgtgtcctgcttgctactgtatcccaaggcctagtgtactggaactaacacttagtagcaactcagatactcacttcttactgactaaatctatgtcttcaaacctaatcgcacactttgtgtggagcagtgagagagtaatgtgcttgctttctctttcacagttgtccaagttaagagctttgaatcactccccaatgtcggatgcctctgttaactttgactacaaatctccgtcaccattcgattgcagtcctgatcagggagagaacattgaagaagctgccaatcattgtctgccccataagaacctctatactactgaagaggaagctgacacccttttttctaggaaattgacatcccataatgggatggaggatagtggaggcagaggtactggagtaaagaagaaacggaagaaaaaggagccaggggagcaagaggggacaaagggaagcaaggacagagagcctaagccaaagaggaagcgagaacctaaagagccaaaagaacccagaagggccaaggagccgaagagagccaaggagcccaaggagacaaagcagaaagacggtgtcaagaagccccggaagcaccgggaggcctccggtaccaaggaaggtaaagagaagagaagctgcactgattatggatccaggacaaagtccaagaaggccaggtgtgtgctttcctccttgcccttgccttcatggggctgtttgcctttgccattaacccaacccctaggcctgacttgactatacctgtgctggcccaagctgtataccttatttacataacttctggcattgatggcaggtggtattatctaatttctaattattttctaattctgatttccaaaatcacacttcaaaaacactttgcttt

SEQ ID NO: 27430 - DNA, 1163 bp, Mus musculus
ctgaactattctatacacatgccaccgatcttgctttggtctcagagcttgtttgctttgagcatgaaacttctgtagggacgctgcatgatgcagcatgcttcaggcttcctcacagatctacactctcttgaagggctcctactaaacacaatataaaccacaggaatgtggacacgatagtggtcattatatgcttgatgaataaattatggaagctggaatatgttaaatgaaggccccctgaaaaggaaaatagtaacttatatgaagtattatcagataagatgatccaatgggtgtcacttaagagagtgtaagtggatggtggtaaagattgcatgcaatagaaactaataccttaaagggtattgtgttggttctataaaccccgtggtggtttgtatatccttggaccagggagtggcaccagctgaaggtgtggtctggttggaatgggtgtgtcactgtgggtgtgggtataagatcctcaccctagttgcctggaagtcagtcttctactcgcagcctttggatgaagacatagaactctcagctcctcctgcgccatgcctgcctggatgctgccatgctcccaccttgatgataatggactgaacctctgaacctgaaagccagccccaattaaatgttgttttttataagacttgccttggtcatggtgtctgttcatggcagtaaaaccctaagacaaacccctaaaaagaataattgaagaccactgggaagaagctaccaccaaagatatattaaataattacattgcaaagtgtccttagagcatcaatccccatattgctaccccttgcatcagcaaagtaagttctctgtcattaaaggcattcaaaaataaacactgaaaaactttgacttaatgtggtaatagtaaccaaagaatgttgtattagggtgggtgagcatgaatgggaaggtgatggatggcctttgtgaatttttccagccttgtcaatgtgtgatgttgatggatacaactactaaaccaaggaaatagcggagtatttgacataaacagtttctttgtttttttctaagattaaaaaaataagtttttgaatgtgattctgggctgtgataaggggaacaattcatacagtgaactaaaatatcttccttgtatccgg

SEQ ID NO: 27431 - DNA, 1136 bp, Mus musculus
tttcccaggatgccaaacaaatggcccttgtgggggattcctggcatgcggacttcccggctcgttggtatgctgaggacttcttgcttacacataagtgcttgtttctgagctgaggctgtgttgctgggtcggctggcaggttgcaccaggcaggcttgcttcctgcaggggattggggatgggctttttgggctttttttttcctttttttttctttttccatgcaggagagagaaggcagggggatagctcctccctgaatctgtgactagtgggtgtgcaatatgcacagcagtgctgtttggaatcaggttagcaatgaagccatcttgacctgggtgcggtaagccacagcgatggagttaaactcacctcggggccacgaattgtctctttcagtctcaaaacacctccacctctccatcccgaaaggaatatttgagggtcattatcagtgtcttacatggaaggggtgttctgcagcctgagaacagtgccataaaccggaatgtactctgtgaaaggaccatggagctgtcatcatctccctttatgtcagaaggctggagttggggagggggatgagagagagaaaggcaatggtaattcttcatggccggcatcctacctgaggctctgacaaacatttttctgcagaatccacaaggcaagtggctctgagaggcagcgtttcctgccattttataggtagaaagcttgatgttcacagaggagggatatactgccccagtattgggggacaaagcaacattaatgatagtgttgtagaagatacagggtgctcacctatatccttgaggaggacattccctctgcagtgtgaccagaggattggcaagctgacttccaactgggtctcttttaaaatcagaaagattcctcatcatcccccagcccaaagcatctctcaacaagtgacaatgatacagggctggaaggactggtacccaactctctcatggcacaggtgtgaatctgacatcttcctcacttggctttcagtttctttatctgtgaggtgaatgttgctaggtctcagtacgtatagacctaaggtaagcagaggttcccagacatgctctttccctgcacagaggcctgagaagcactgc

SEQ ID NO: 27432 - DNA, 1148 bp, Mus musculus
attgaatttagatcctactccgacatgaagcgtgctttggataaactggatggtacagaaataaatggcagaaatattaggcttattgaagataagccaagaacaagccataggcgctcctactctggcagtagatccaggtaacgagggctggggggaggcttgtcatttccagttgttgcctagttgtatttacggtgtttcttggttgtagtaagcagatattctagccacagatgggtagttaaaacatattccttttttttttttaagatttatttatatatttatttattatatgtgagtgcactgtagctgtcttcagacactccagaagagggcatcagattttgtaacagatggttgtgagccaccatgtggttgctgggatttgaactcaggaccttcagaagagcagtcggtgctcttaacctctgagccatctcaccagccccctaaaacatattcttgaaaagattaaaacatcactgtctcttgtgtgtagatcacggtctagaagaaggtctcggagtaggagtcgcagaagcagccgcagtagatctcgaagtatctcaaaaagtcgctcccggtaaataatgtggtattgggtctcttaattttttaccacttgatggagtataggtgttttctgacaagatactgaaagaaatctggcttttcttgtacagatctaggtctcggagcaaaggtcgatcccgatcccgctcaaaaggcaggaaatccagatcaaagagcaaatcgaagcccaagtctgaccggggctcccattcccactcaagaagcaggtctaaggataagtatgggaagtcacgtagtaggtcacggtctcggtcccccaaagagaacggcaaaggagacataaagtcaaagtccagatcccggagccagtctcggtcccactcgcctctacctgctccaccctcaaaggctcggtccatgtcccctccgccaaaaagagcttcaaggtcccgttctagatctcgttcaaggtccagatcaagttccagagattaaccctgacctcgacgttctttgcacactataacagaacactttcctacttgcttaggcagttactcttccgagtttatactcgcctcttctttaagaggatttcctgaaaaggg

SEQ ID NO: 27433 - DNA, 2711 bp, Mus musculus
ccttctttgtagaattaagataattttgattttgtagcctttgagctaaaataacttttgtaaagattaagctcatttagattttttttaaagtattgcagcaggatctgctgcagggttctgttgttttgttttgcttatttttaaattaactgttcaggctttggatactgcaggctttagagggagaacccaaattttcaattatgttggctttttataaagcttgagttatgtaagatttaaataaaagtttgctaccaagatgattgccttattgaataggtcactactaaggcccttaagtgttgatacctgccatgtgtggagacagtgtaaattctacatgagtgtgaaacaaggcaagtctcagaccagcaataaattattcagtttggctaaccttattttgtgctgttaatctaccaaagtgttttgtctacccctttaataagttgagttaaaagtaaaaggaactttatagttagtgccacaagataaataaaagaaactaaaggattacaatttgaacttttcaagaagtaggtcctagtacttgggatcttgttagatctgtgctctggaggtggtctgcgtgattagtgttagtgtatggtttggtggtctttaatgttttgaaaaacggaagtgattagaagttaagttactgttcaaagttgaaaagcatatatgctacattttctgctgaaaggtgattatatttgacaggtgcttagacatttggctaagatattttccaatcagtcccctttgtattagtggggcatttgtggttagtttgaaaaacagacatggataaactaaaatgcttcatactttataagtaaagcgctatgaatgctgtggagaccaaggtgaaataaatagtgcaaatgtgtaggaataattagattgcagtttccatacatccgcaagcccagttagttgaaactgcaatcaatatttaccttacaacctttccattattcagacatttgtaaagtcatttcatcccaaatacttaacctcattctttagtaatggtgtaggtggattggctcaggtttaatacatctgttattatataatctagcaaaagttggattatagattataacgtagagttggtttgtagggccaaataatcagaggacatgcaataaggcaaggctgagtggaaaatagaggttcaagggcctaggtaggtgtctgtagctgggaatacttgggaacaggggaaggggaatgttttcaagacatttatcctgttagaaaatcttacagactagctttaggaacatagtgtcaaacaaagctgctgctttagtcttcttttctttgatgctttgtttagatgtttataagaaataggtttatttttccagtgtaaatttcagaatttaaagaaaactggttgtagtttactattttacctacctaaaaacagatgtgatggctctttaagaattgggtttgaccaaagttctctttgttttcagggaaaactatataaaagctttctgagccacagccttttaaaaggggaaaggctaatagtaaaatttgactttctgactgcatgcaactgctgggcttgccttctgttagtgtggtagtacatgacagaggcattagactattttttagctgccctcataaatatataacgaataggtaaatgccaatacccatacagtttttctagtggggacaaaggccgttttattagaaatttaggctttcatgcctgtagaccctagttattaaatgcactaaacaaacaactgcatttaaagcattggccttagcagaagtgactgacttaaagtgttttagtttcttactgatgagtgaattcagttccctaccaactaatgcgcagaattgaagaatcccatcctgcacacattggttggtgccctgggtggaatagcaacgacaccaactgataaaagcacaagagaagtggggaacatcttgagtcctgttggacgtgatagtgtttcttgatctgtatgccacagtgcctttatggccagtttgagtcctacctacttcagtttttatgttcccactcctcctgtgttaataacattgctttcatcttggatattttttttctactttgttaacctactttatgctttatctcaataaaatgcttaccaagggaaagacttgttcttcatttattgtgttgtcccttggcaccaaataattgccaggtagttcttttgaagtggagttaaccattagctaccattgatgtgttctcttgttttagctctaaaaagcagggtttggggacttcaaataagtagatggtttgttttattttcatgtgtttactcgtgtccatttttatctgtagttgtttttaaaacagtcaacttaggaagttttaaatacctgaaatgcttaacctagtgtctgtccttaaccctggacctagggcacacttgagctttgcaagtttacccgtcaataccatcgtattccctttgcttaaccttgttctcagaagctttgcctgtggttgacctgattgcggatacgtgatgtggaaccaagtgtggagtttcactttgtgtttatagaaataatccagggcttcgtgtgtggctcaggttgagcatgtgatcttagcaggtacacaatcctcgttggtgtgctgctctccctcacatacagactcataggggcaaattata

SEQ ID NO: 27434 - DNA, 1234 bp, Mus musculus
ctagagatatcattggctggggagaagaagggccatgtgatgtgcaaggggagagagcagacagggcccagatgctggaggtgtgtatgttgtaggaagagtttatgggctttttcttatcacttccagtttctcactgtaataaataataaaaaagttgttcattaaaattaccttaaggagaattgtttttgacaaagttgaagtgattaaaaaggatattgatggataaaggtggagatgtgagtaaatttgagggcgaaagttgattgccaagaattcaggaaagaccatgatagtaaaagggaactcgtcaagtcagcctggttccagctgtgctcagtggtgcaattgtgtaattggagagttggactctgccagtccagtgagctttgtgcctttttctgcataaagtgttcagttgtcagtgatggaaagtggcgggtctcttggcaaggaaatagaagttctgtagattgagacccaagatggttgatgcttgacagattaaactcccatttacttgtgctgaaaggaactctctcttggcttttagatttccgactacacgatggtaccagacacagccaccctctcagagcagctccgagtgtgtctgcaggagggcgatgagaacccccgtgactttaccaccctctttgacctgtccatttaccagctggacaccacctgcctgcccaaggtcatcaagttagtactcaggctgcctgggctacacgctgcactccactctgcttggcttgagaaccggagcctggggataggagttaggtcacacagctgtaaagggatgacgttctcagatctgtggaagtcagtagggaaattggtgtagggggtgtggatgatgtaggggaactgctattaattacaatcccctgtgttccaggatctatgggacattagagtaaccaagccttttccacttcgccaacagcttttctgggttaacatagagtcctgggttctaggcatatagtacacagatttgtgtacttcccttagaagcacttaaacatattagagagagcactgaggctcttggggcttgtccatcacagcctatagacacacgctggcagactctttcctcacagagatcctttaaagctcaggtacccttcctaactccacctgccagcactcctcgtctagtcagtcagtgacagacgggtattgtgtgtgcagcttggtgcaaaggctcctgcctaac

SEQ ID NO: 27435 - DNA, 1400 bp, Mus musculus
agttaagggttaaccagactgttctgtgtttaggtactgatgaagacctggaattctatgtcaggaagtgtggcgacattcttggagtaacaagcaaacttccaaaggatcaacaggatgccaaacatatccttgaacacatcttcttccaagtggtggagttcaagaaactgaaccaggaggcccactgaggtggcagcccttcaggtgatgtcactcactctttgcaacattcattagttcttcagtgcttactaagtgtctgtctcccagatgaacaacagatgatgatccttcgagaatggaacttctgttctagctggagggtccccacaaacagtagcgtaatctgtaagcaaacacttagacgccagaggatggtaagtgctgtggtgtagaaacagtagagctaggctggagggatctagtgtgccagcgttcagcagagtgagcagagctggtcagtacacactgatgccagcgtctgctgtgctgtttgtgtcagaacctataacagcacttgagtgacacatggttgctgtggcagtgtgcacaatctgtcctggagttgtaagaacttcatcctgggcttagaatcagcctttaggccagctaatccccacttatcccagctaatggtgattttgaatgtcgaattaatgttcaaaataccaaagagttcctgtttcaggctctgaatttaaataaaataaaattctgtgtttcctggctcatctggaacatgatattgatgtgactgaaatggcattccagaacttctgacgactgtaaagtaccttctgcccgcccgcccgctgagctctgtggttttgaattcttctcaggaaagtatctgtacttgtttttctctaacgctgtggaaggtttgcccatcctttgtagtgcccagatggaagagatgattcattggcataaattaaatctgtgattgagcttttgtaatttataaaatggtctgtcattgatatccttttttctcattcctgctcaagatttgaatctcttttttttttttaaaagatttatttatttattatatgtaagtacactgtagctgtcttcagacactccagaaatgccagatctcattacggatggttgtgagccatcatgtggttgctgggatttgaactcaggaccttcagaagagcagtcagtgctcttaaccgctgagccatctctccagccccaagatttgaatctcttattaaagatgtacctagtgcccggcatggtggcgcacgcctttagtcccagcacttgggaggcagaggcaggcagatttctgagttcgaggccagcctagtctacagagtgagtgccaggacagccaaggctacacagagaaatcctgtctcgaaaaaccaaaaaaaaaaaaa

SEQ ID NO: 27436 - DNA, 1196 bp, Mus musculus
ctaggactcccactgcagagaggggaatcagcttgagtttcggccgctagaggccgccagctctgccgatgcacgctgtcaagctgcggagactgccgatgaactcgcgctgggaaagagccaaggtgctgactgacaggtcttcaggctccatgcttcttccagtgagtctggagagacccctagagtgatgcaaaaggagaaaacttgctgtgtccccctgcgagcttctcttcttctcttcagccattgtcactttttaaagtgggattgcagttccaagagttttatacagatggcagccatcatcctgttctcaggcttcttttagcaaagcatttcaaaatcaatttctctctgtaatttgtttacccaggcagttgttgagggtttgggatgtcttcagtttggggctgttgttaatatacatgtgaaaatctgtgtgggcatatacatttatttttttgaaggtttgaccatacaatgggtgtatagatgaaaggtttcccttcctgttttgggggagcagttttgagtgggtttggttggttgatttggggtgttggtttttgagagtttcactgtagaacccagggtaatctggaatttaccatgtaggacaaacagggctcaaactttcagtgatgttcctgcttccgcctctggttgcaggtctgggccacccggcctggtttatgtgggtaatagagatcacacccaggccttcatgcctagtcagtgaacacactaccaagattctttctaccccatcccccactccccaactcttgctttataggccagccattggatctttagcaaccttgcctctacctcccaagtgccatgtgtacagttttagttacagctgtgtgcttgtcttagttagggtttcattgttatgaagagacaccatgaccaaggcaactcttaactggggcaacatttaattagggctggcttatagtttcagaggttcagtccatcatcatcatcatagtgggaagcatggcagtgtgcaggcagacatgatgctggaagagctgagaattctacatcttgatcccaaggcaaccaggaagagactacttcttccctgcactgggcgggacttaagcatagaacctcaaagcccacctccccagtgactcacttcctccaacaaagccatacttactccaacaaggccacacctc

SEQ ID NO: 27437 - DNA, 1532 bp, Mus musculus
gctggaggcccattactgggtagggagaatgtctccccttgtcgcagcgagtggaaggcagaagcctgggagacacttgtcgatcaagagtggctcgaatttgctggcgttcctttcttgttagcattccgggaagcacaaagcccctgggccctccgcgggatgcgagacggggaattcgttgtctcatggggtttcggcggccggttcggtttggtttcagaagccttcttcctgtcccacgctagttttgggcagttggggatgagtaaagactattggtgtgcaacgagactgctctgctagcagcctctgagccaaaggcaggaactgggtttccctcttagttccctagaggttaggtggctgggtcaagtctggacttttgggacacctgtgtatctggggcctaatcgcggggctttccagcctttctaaggcgtgggataattgggttctgctgtgttccttctgggtctttccaattcagaacgcctttccaccgtcttcagatggccgaacctggcctaggatgaagataaggcacagagatgcctgcttgcttacttgcagagttcttcgtggctgggttgggtattggtttggtctgtgggtgctgatcagggtggcttcccatgccccggtgtctaggacagttcagtgcccaggaagggcatctggaagtactaatcccagagccccgggcttatctgagggtctcttttgtgaagtgtggactctgtgcccctgcatcctcacgagcctttctctgccacatggtgtgactccctgtaccccagtggcccacttccctcttggcctctgactcacctttccctggagcatagcccagaacgtacaagggcaagagaaagggtatgtgtatatacaaaagtgtgacttttctttaaacagcacactggcctctgcttttcatgctacggttcctagggaggttagggtgtaaaaatgtggagcttggtgtgacataatcgttgtcggcctcacttttcccgtctgttaaatggagcccttgagaatgcgcaagaaggtgtgtgactgatggatactcccatctgtttaatagtgtgaccatgccgggtagcagcaacacatgtctttaatcacagcactcaggcaggtgaatctcttcagtatacaggacagcatggtttgcagagtgagttccagggcagccaaggcaacatagagatacctatctcaaaggacccccgccctccaaatactgtcactattacacagcactgaggcttcaggctctcttacacagagccttttccctaggacaccggctgagcttctaatagaatctgggcctcgtgctgggttttggagaagcaaactcaactgataatgtttagtagattttgcctcctgctttacaatggtaggtggggcgtgcattgggtcagcactgacaatacaaatctgctttctggattctgtgacgcgtattgctaggcttaggaacttcttttcgttttcgtcgggatttttttttagaattgttt

SEQ ID NO: 27438 - DNA, 2037 bp, Mus musculus
atatatggagagcccttgtttggctgttgttttctgaaactttcccactctgtggctgctcttggatactttataacaagcacattgaaccttgaacatctgctgcctctaagtacctaagtcagtcctactggcctatctatcaccatcatcctctccagccatagcctcttccctcccttctccccagtttagctatctcttattttaaaactgccctgcctgaagaagaggcggtcactgtagctcccagtttatcctccagcacagaccggctccacttctgtttgcctgaggctttgattggcatctgcctcccttcaagcagttttgtggcttcctgctaccgcaactaacacacttggcacttagtaggccctcagttcctgagaaatgtatgaatatgactgctatcatagcgtctgtaagactctccatacatgtgagctaaaccaagccttgtgtctttcttgcattggcaggacgagcagttgagggccctggtgaggcagtttggacagcaagactggaagttcttggccagtcactttcctgtgagtattgcctcccccagagcaagggttctgggtggccccttgtgagtgctgtctagaaagcttagcataggtgagctgaggctgggaggccaggcttcctgcacaggccttggggaggtggaggctggtggatctcttgagttccaggctagcctagtctacagagtgagttgctagacagccaggaatacacagagaaatcttgtagtcaaaccaatttatgcttattcctgactagtttacgtacgaataaactagacttggactatggtaattttatttggctttgacaattactgggggggggtcacctctaatctactctcctgactgctggtctggctacctccccagccctgtgccccagatacttcctgtttctcctggccacgtgcttatggcacctctcctctcttagaggcttcttctcccctcctcctccctctctcttcctttccttctcccccccccttcccctcccttcctccccctcccctccccctctccctggtctttcctcctccaaccaggtgactccaaacccacccacctctagtccctccagtaattggctccagccaattttatttaaccaataattgtaaatcaaggaacaaggtttgcacaacaaaagctggtaaactggagaagttagcattataatagcagtagacctaacctcgaccaacccctgtcagtctgaaaaaccaaaaagaaaagacaccaatcaaataaaacaaaataagaaagcacccaggaaccggatctcacatggctgcctaaggtgcttgtaccctgccccctgagctcggggctcaaccagagttcaatcttgtcccagcattctttctgttctagaaccgcacagaccagcaatgccagtaccggtggctgagggttttgaatcccgaccttgttaagggaccatggaccaaagaggaagatcaaaaggtaagtgctggctggcaaaggggcagcacacacagtgggcttgcagtgagtctgagcatccctgtaccatccaacaacttcagggacttgtgcgtggatgtgtgttgtgtgagaggccagctttgtagttctgctggtcccatagtcatgctatagcataagctgacctagggtactcctcaaaccccagccttctgagtgccaggctgagcggctacctcgccccatggattatccagacagctgtttgttgttggggtttgtttttcgagatagggtttctccatgtggccttggctggcctgaaactcacagaaatccacctgcctctcatattctccctcggcctcccaagtgccaggaaccaccactatccagtgaaactacccagcttttaactggtaaccatgcctgccactagggcaaggataggtaatgaatgggtggtccacataagaggcttgcttagccagtggcagcggccattgaggctatgataatgtgatagtcacagtgataaaggttatac

SEQ ID NO: 27439 - DNA, 1187 bp, Mus musculus
gtggccaatgcaggaggcaggcagatctctgtgagttccaggacagccaggggggctaaacctggagaaaccctgtcaggaaaagcctaaactgacaagaattgaggcgtgaggcggggcccagcactggtggctctgactgttactgtttatgtcctgagcaagagaaccttactaagaggtgatggaagactgaaatctaggtctagttagtcatgacttgaggctgtacagtctcctggtttgatgtccacagaagtgctggagggacaggcattatcatgtcctatagtatggttggggctgacctcataggcttttgtagctctataaactctgcaaagcgaggcccactggatatctagatgcttgagtgaaggcgatgcaggggctggtccctcactgatgttccctttaaggtcattgagttggtcaagaagtatggcaccaaacagtggacgctgatagccaagcacctgaagggccggctggggaagcagtgccgtgagcgctggcacaaccacctcaaccccgaggtgaagaagtcatgctggaccgaggaggaagacaggataatctgtgaggcccataaagtcctgggtaaccgctgggctgagatcgccaagatgctaccagggaggtgagctatctcctggtaggtgggtataagtaagcagggtgctgttccaggaggtgggctatcacctggtaggtgggtgtaagcaaggtgctgttccaggaggtgggctatctcctggtaggtgggtataagtaagcagggtgctgttccaggaggtgggctatcacctggtaggtgggtgcaagcagggtgctgttccaggaggtgcggcccatatttgtaataaaggagtgtctcagagtactgtgagcagccctctatgttctttaacattcagccagccaggtcttatagagacatgcattaaaaggaagtaggcccccccaggaatggcctgtctaaagagacagcaccaggaagtctggttgtaccctattagaaggaatataatagaaacaccacttcctgtccccagacccgtgttgaacccaagctgacttagaactcaggaccttggcttcacaagtgatatggatgtgggtgtgtaccaccatgcctgaccagtctctgtattaagtatattctacttaaaagtggtgttttttgt

SEQ ID NO: 27440 - DNA, 1238 bp, Mus musculus
gatgcagatttccatggaaccccagtttctgatctgtgttgtggccaaggttgctgggattttctttcattcttttttaaaaaagatttatgtatttacttatctcatgtacgtgggtacaatgtcactgtcttcagacacaccagaagagggcatcggatcccattacagatgattgtgagccaccatgtggttgctgggaattgaactcagaaactctgggagagcagtcggtgctcttaaccgctgagcaccgtccagcatcccgcccctgtcatttctcaatggtttctccagatgtgcgctctgggtcagtccagcttgttctccatcctgccttgagttccacatttgctcatttcatagagctaatgaggaaattcactaaaccttcgagggctggaaacagtgaggcttcactgtacagctggaggatgcctgtgtccagcccttcacgttcaggtgtggggagaagctgcggcagccgagagctgcgtgtcagaggccccgggttttccccacaggacggacaatgctgtgaagaatcactggaactccactatcaaaaggaaagtcgacacgggaggtttcccagccgagtccagggactgcaagcctgtctacttgctcctggagctggaggacaaggaacagcaccagggtgtccagccggtggacggccaggtgagtgctgggcggtcttgcgctctggctccgggctccacaagctggctctgggctgccgcttgtgggttggtttgctttgtttcctggtcatctgaccctatctccccaagaacttccccagagccacccacccatttctgctctagggtctgagagtgagtgagtgagtgtggccagcacgtttctagaacttaacttgtgacaaatcaaccctagttctctttcaggcgaagtgagcagcatgatgggtaactgagaacgggctggggaggggttctcagcctctgtcctcagcaactgtcttcttgtcaacctgcccatgtggaggtcagaggacaattcatggtgactcatattttctttcctttttttggtgatgtgtgtggcggggtgtcttgagacaggctctttctatgtagctctgtctgtcctggaatgtgctatgcaggccaggttggcctaagactgccacccaggtcctgggattaaaggaagacatggaccgccatgtttgttctgccttcagagaccaatgtgtaggagttggctct

SEQ ID NO: 27441 - DNA, 1196 bp, Mus musculus
cactgctgtggggtttaccacgcaacttctggggcagcagacaagtgctgctgtggccagcattgattccagggcctctgtctcgtctatagtctgtgttccatttagttaatgacagtgtcatttatgcatcagcctcattggcctctgtcatgatactaatatgttttgaagtgctcagtacagttgaaatgtctctcaatttctgtccctgtgagttcctttgatgcttgatttgggttatgtgtttttagctacaagctgcagcacggtcaatatttcaacaaaaatctacagtgtgcccttgtattctacagggaagtctcgtgagcagctggccgctggtgccctctattgtgaaggaggagagcagcgaggaggagattgccatagctgctacttctgctaaagaactcggacatgagcctgtccctgctgatctgggagaagtgcgcaccccagagcccccagaatctctcaagcgtgaataccaggagttctcctccccggaaacgagcctgccctacaagtgggtggtagaggcggcaaacctcctcatcccggctgtggggtccagcctctctgaagctctggacttgattgagtcggtatgttgatcccagcaggtacacagcaggtaacacttctcttgtgaactgccccttccccaacctaccatttattgaatgatgggggctgcccagctctgagcaggctggggacaccagctaggtcattacaatatttaccctccagcatggagtgggtgagaaggcttcccagagatgggccgaattggtattacagggttagatctcactggagaggcgccgccaagggccaggagtcatggttgctctggagcaacaagagggtttggctgctcagccaaggccatgcttgctgccgtgggccgtgctccctgtgcggcttttcctgaggagacaaatacacacctgtttaccccagacctgtactgaggacagatgaaggaagcaattgcgcacaggtctaacatggcagactaatgaaatccttggagataccagcaggattgtgggtgacaggaagattcctgcatgaccagaagaagagtgacagactcctaaaggcagtctccctggagcttacagcccaacatacatgaaacctgggggcagaatctctttttcaccagcagttatttattgctttat

SEQ ID NO: 27442 - DNA, 1140 bp, Mus musculus
ggatctacttagggcagcgtctccaggatcaaaatggaagcttctgtttctagaaagctttgggtaaagacagaggacatgtggttcctgtttgttcttaggggcttagttagcgtgggttccttgatgtgaaagtgagcaaaggagctagtgagacggctcaggggatagagagaggtgcctatcaccaagcctggccatctaaatccaatcctcaggacccacgagctaggagagacctaactccttacactagcacataaacgtatgtaatgaaccataaaccagcaaagccatgttttcccagccggttgctatggggactgtaaagctgctgatgggcaagcatcccattcaagtttccgtatatgtagaacactgaagaaatggatgtagacagtagttaacagtagtgactaagtggataagggaccgaacttgacactggtcacttaagttctgctgtgttaggaggacctttaacctccctctctggcaggaccctgatgcttggtgcgacctgagtaaatttgaccttcctgaagaaccctctacggagggcagtgtcgtcagcagcccagtgcagccccagacgtcgcagcagcagcaggaggaggcactgcagtcatcccagcaggctgccacgccggggcccagtgtgactgagtaccgccttgatggccacactatttcagacctgagccggagcagtcggggggagctgatccccatttctcctagcactgagtttgggggctcaggcattggcacacctccctcagtgctcaagcgacagaagaaacggcgtgtggccctgtcgcctgtcacagagaacagtgccagcctgtccttcctggactcttgtaacagcctcaccccgaagagcacgcctgtcaaaaccctccccttctctccttcccaggtgtgtgggcacctctgcctacctccgcttccatacataaatatctcgtgcccagcgagggcccggcacaggtacacactggataatcagtgttcaccgattatctccctgtgcccggtgctcaggtgcccgcagtgagcaaacccagagctggccctgcccccttggagctaacactctaggctgcgggtccagacgagtggtcacatggagaagga

SEQ ID NO: 27443 - DNA, 3035 bp, Mus musculus
ccagccctggccccagtacagggaatagtggggtcgggggagcatgaatgaaggatatgaattgctaaacatatcttgcaagtagggttgtgtcctgtgtccttctagaaaagcgtttgaccagggaagcctgtaagactggggacttgctcacttcagtcagacctttggctacttagagtcctttttttttttttaagcagtactaggggttgagcccagggcctcacccacccactgtgggcatgagctctgctgtggacagatggtcgtgggaagtagttagcctgtgtccccagcctcagttaggaccttaggaaaggcagtactgagcagagccgggagcgctcgggcgtttctagagcaggaagctggatcctcatgtgataggagctggcattgctgggcactgaggtgggcagctcggctgctcctttaattctttaagcaaaaagattaagggggctcctctagacttccggatcataaagggacctgggccttggagaggtacgtcctgctccgaatcggatcgccgcagccagggggggtgccaggttgtgttggttttgttatgtttttttgtttgttttgttttgttcctccttgcaaagatcgtgtggcaaagtggtgacttaactcggttttgatttcagccaaccagtgtcacacccagctcctgtggcttcacctcgccaggtagcaaagagggtaacagcctgctcaaccagggtttcctacaggccaaacccgagaaggtggtggccgcccagaagactcggagccacattccaacccctgcccctgtgagtgcagtaaacaggtcccactgcccgccctttcacccccagggcctgacttgtgagttcctgtggctgcttgcctcattgacttaacttttacagtcttagcccaaacgctacttcctacaggaagccattcctgacctcactggagagatgccccagcctcatttccttcctgaggtctggacttaactgtcactaggatattgtctgttctaacagagctggcctgggtcttgcttcccagtgccttcatatgcttgactggctccttgggatctgcccctactttcctgtcccagcctcctgctttactgttaaagcccaaggatggggcctgttttccctggatccaccaggaaaatggagcacaggctggcaagagggaggggtcctagaagcgtccccgctctttagtcaggaccactagggtttatacagagctaaccctctcacctcctctcagatgacccatgcctggaagacggtggcctgtgggggcaccaaagaccagctcttcatgcaggagaaagcccggcagctcctgagccgcctgaagtccagccacacatctcggaccctcattctgtcctgagggacttgaatggcaagagccggctctcatgtttacaggggtagggtgtggggtaaggttaaagtcacattaagtgaccagcttcaggatgtcttctgccagcccctcaaactacttaggtggcagaagtcacgtggtaataccccttccctgagtctagctttgggaagttcctggtgctaatagaacaaggtcccactcctgggcctgcctgtcctctacccaatgctagaaggaaccctatcagggtctcccaggctctcatccagtctggcctcatctcagactcctgcttaggatgggggtgtggctaggggtgcgcctttcctcgtctcctgttggtacactgtccccacaataaaatgccattctccctctgccgccccgactctgccctctgagtcctgaagtgcctcgatggccttttcctgacatgtagacctttgtcactgggtacagctttgccctgtgagtatctctgcaaagctcccaagaactatgtatgagtggatgaagatgggttctgagaacttgttggagcgctgcattcaccttggccttaatgcatcagagtcataacgcacttggcttgggccatcttccaaggagcggctgccttaagttgagccagcccttaggtaagaccattaatagagggctggcagacctttcaactctagccaatgtgcagaaggctgcccagcccctggattctgtatcatgagttggtggcagcagttgcctcggctgttacctccctaggaatcagtgggtagagtgtggcccatagctggtgatcagtctcaaacttgaaaagggagatgctgagcctaaagtctagatcaggaagtgttttcagtagccttgcctgggtgtccttgggttggggatcatatgggagccctatacttagtcctgtttgtaagggagatgaggcaaaccctctccaacagggcaagagacaacatctgaagacatgaccaagttagcacaccagagtctagacactttcctgctcttatgcaaaggatgcaggaggtggactctactatcccactctgcctcatcctacagcctcctgagccccatgctcactgagctgcatctgcctcacccctacttgttttctcagtatgactaaggcaacttagagtagctacactcattggtgtgtggtctgtgctaggaaaggcgtgggtagggtggggtgaggctgtcaagcagaggatagaggctgctggtgcccacctggctttcctgccgtctaggatctctccatgggtgctgccacctgcattattagggtggctcttttaaacctggaatttcctcgcagacacacccaaatgtgtcttctggtcagccaagttgacaataaagagtaacacattgtagtgtctgactcctcctttttctgctttcttggggaagaggcctgaactgccttctttccaaaggttcccaccaagactctggagtgtcatggctgcctgctgttgcccagaaatacaggtctaaaggctttcaagaggagccctgtcccctggaactttggctgtgctgatgaactagcctaggagagacacttgtgctgcggatgagctggaagggacctcagctgtgctaaatctttg

SEQ ID NO: 27444 - DNA, 3018 bp, Mus musculus
tttttctgtgcttttagagatgccatattaaagtaataatgtcctaaggaggaaccacttcagggactgcatttccactttgccaataattagagtaattcagatagtactgaataacattgctgaaagaatagttaggtcttagcaagaaggaaaatgcttgagagtcacagtcctttggccataataactgaaagtagcttctcagctccgtactagaacagtactagggttaatggtgccagctaagcctcactgtggggtcttttggtgttggtcaggatgggtggaatgggagggatgcagatttgcaatactaatctctttctccctccctactctctgttttcttagccctgatgccaaattccagaaggtatccagcaagtggctagctgtgtggttcaaaatgggctccagctggttgtgcctcctcctttacctctggactcttgtggctcccctggtcctcacaggtcgggacttcagctgagctcagtgtgtcaaggacactgataaagctgaccagagtctccttttctgaaaatgcatatccattttgcgtttcatcaacgagactattaagtgaacgctttgcagatttggctgtattcaggtttatatcaaaaggcaagattgagtaatgcttgatgcagaatctgagctttcatatatatatatatatatatatatatatacacacacacacacacacatatatatgtttatttgtaaggctatagcacaaagggaacatttttgtgttttaacatgaactacagctgtgctgtgaagagaattctttataaagacctgtagattcctacaactttggtttaagttttaagttagaagattgttggatatttaaggctatttttaatttctattacagtctccttaaaaaccaaaaaggaatgcattaatccacatttcccttcttcagaggtgtagtgtcctggctcttggcaaggaattatgtatttaggtcagtccccagaaatgcagctgctcatacagctgagagaaggctattattgagttcctttacttactttttatactacactgatgctgcttgatagaagtctgtggctttgtcagatatgtcacccaagtaaatgctttgtagatctgattaaaatgaaaagctcacttgagaaacactgcagagttatgtaatgatcttgttgtgagtgtgtgaaagtcaaaggcatgtcagtttattacatttgcaacataaaagtacttaattaaaatagatatttagtttcttgtttgtttgtgtatttgtttagaaagggtcttttccacataacccagacttgcttggaatgcagatcatcctatctccacttccaagtactgaggaggaggtttctatcaccatagctagtcttttcttaaagatccttctgcagtggggttgataggttttcttttattgttgttttcttgtttagagagtcccaaatcaatctgacatttcaggcaaaatgctcctcttctaacacttaagatttgactagtcaagtttttaagttcatttagaaactaccctaaatattttctctggggaagatcaaagtaggtaagaaacagtttaggcactgtcaaaaaagatattcctgaaaagcagtgtgcaaaggaggtatgataaaacaggcttttcaagagaaactagtatcggttctgcactaggccctgttggggtgaagacaagacagacattcttccatctaaggaaaatgagcggaccagcctggtaaattagtgctgaaaactcataaacagaaatcagtggatagaggctagcacagtgacttcctcgagagagtgctgttaggatttgtaacgtaggttcacaccaggtatcagggcagttcatctgagatttgaactaaagatgtaagggggtttggggaaaaattgacagcttagagaatttccacattggtgtttaaggggataggaaaaacttatttccagtttaatctgtgtacataggttctgcttgggatcctggttgggatggaggtggtcccttcatatgatgaataggtttgggagtcagacctctggggtctgcctgacctctgctattttctaggttgagtggctgtctaatgctcactgagtacatgctgtgcttgtgaccttgagcactctgcctgggcctcatgcagaacttagtaccagagattatttgaagataaagttgtctcagaatggatatgttgtaaggatgtttgacagtaagtgccaatgtcactatggattaaagcaagactaaatgtacttaaaaggtcagaagtgttcagaatctgatagaggctgggttgaatgtagttttagagaattaaacatagttgtaatatagacagctaggtagagctggaggctagggaagctgggtttgatgggttgttggaactactgtcctttaggatcatgtgtcaaagcaaactacaaaggatttgtgaagcagataattgtggcccttaagcttaactgtgtgagacaaatacctgtttttaacagtaggggaaccataaatttcaaagcggatcctattctttgtcttatatgattaaaaataaatggagttctaaactaccaaataatgtaatagagttcaataaagggttttttttttttttcaccatgataccttagattaatttgaaataagttctcttaaaaacagagcaattctactgttgcttggctgcactctaagttaagtctggctgttaacatgaaacagttgttcatttcagtctcgtgcagaactgtacacaggcgtgaaataccggcgttttgagtaagcctgtgggtatacttcagaactggacatagttttgagttatctcatgccagatgagtccacttgatatttcatcacagactcatctgtagactgagggccctgattcagatgagtggcatggtctaggaattcattgaaggcaacagcagaggctggctacagctggggaaactagttgacccagcttg

SEQ ID NO: 27445 - DNA, 2066 bp, Mus musculus
cattttagtctttaaataaaccatcctgtaccaagggcagaagccactgcccagcctcatcaccttggctcaaggagagatggcgttccaggaggagggatgcagagctgtaagtgtaagaatttagaggctccaatgagacctgggcagctgccttcctgtggccctccctggggcctgcgggagcccttttgcatgcgagggaggacacagtcaggcccctatagaagcacatttctatcacccctcctgggaggcgcccagcagcccgccagtcctcctcactagtccctgctgtgtagggtgtagtccaggttagctgggtagttagtgttcacgcctgaggcctgttagctcagatgtagtcttttttttttttcttcaagccccgggctgtgaggagagggagaccccagtacattccagaagattacagactctctctagcctgggctgggctgggctgggctgggctgcctggctccctggaggccagcccttccgccttctccctgccttcctctctcctcccttctagggttgtagccctaactgttcatcacactcagcacgctggtgtcacaccttcagcattcccgagggttgttgggccttgcagaggggcctggactccattagagggtgtcattttccaccaaggatgccaggactctattgagtcccacctggttcctggttcatctaccaagaaattccttctacttggaaattctcccattcccaggctggctaagcccggagtgccctttagggttctgtccagttctgtcatctccacatgcagctgttgacactacacagggaaggggctgtggacaggcccctcttctcccattggtcttcagagtgtcattgggactgtggatgggcaggcctcctgaacaagggagcagggctctcgatgggctcctttttgaggcccacagttagccatcaccccattttttcaacagtgtgatatcctcactgttaggttattactcgctgtttggaatattttgagccaggagggcaccttccctctccagctgtcactgctgtggttgttcagggtgggacagagcctggctgtcacgaccaggggggagagactcagctctaatttgagagagagagagagagagagagagagagagagagagagagagagagagagcatgatagcaccaaggagcactgactccaaagcaataacaccctgaggtggtcagtgagacccctcagtgactttcttgtttgttctgtgaaatctcgctcacctcctggaggggtagagtgaggggctggagccccatttcttgtaccattgtaagcgtgtgccccacttccaaggggctgtgaccactgggtgtgggagccatttctgtcctcaccaaaggactcggggcagagtgattttcatccatagcttcggggaccaacaagcccagcctgttcccactgctgtctgaccctctgtcaactcaaactctgccatcaggaaaggagcagagggggtggagttgggggccctttctggtgctgtgtctctaagggtgtttctttttttttcccctctggacaaaagtcatgtataggactgccatgtaaaggggccatctccattttcctcacccagaatgcctctgcgttctgaagggaagggcctgtagatttttagcccatttgcatttttaaaaagaatactaaggccctgcgtgaggagagccaacgtggggtccttggtatgtccggtggcatttccgcctaggggtccccttcatgtctcatgctgagccagagtcagggaaggatgaaggggacagccatttctcatcctttctgctgcttttctttggagcctcctggtggctcccagttatgtcaggacaaagctgtagctcatctgagaggttaggaaactcgggccacagcaggcctctcagcaacatgcactgggggacaaagctgggagaccactgctcaagggcaggttggccaccatcattatttccagccgttaggcacaggtggccctgccctgcttggctctcttctgggagaag

SEQ ID NO: 27446 - DNA, 1099 bp, Mus musculus
gggtgttaggtaggcgaagaaagagggactgtttcatttttccttgtctgtgccttcctccaaactagtagatgttgtgtaacccatttcctgttgaaattggcccggctgctccaaatccatgctatgtaagtcttgagttatgtaagtaagcatcagggcctttagttagtgttttcttgtgtgtgtgtgtgtgtgtgtgtgtgtgtgtgtgtgtgtgtctgcgcacaattgaaagttttagaaaatacccgttttctttttaaagacatacatttatgtctgcagtaacatgatggtttttaatcttcaagaactctgacagtgtcaaagaatcttaaaatagttattttggatttgtttatttattttgatttttttgagacagggtttctctgtgtagctctggctgacctggagcttactctagaccaggctggccttggaactcacagagatccacctgcctctgcctcccaagtgctgggatggatttatttctttttatgtatataggggtgtgtgtgtgtgtgtgtgtgtgtgtgtgtatgtatgcatgcatgtgtatgattatgtgtatgcatgcgtgtgagtgagtgtgtgtgtacgtgtgtgtacgcgcgaacgtgtatgcttgttgctcacagaagccaaaagagggcattgcatcattgaagctagaattctgggtggttgtaagctgctacaagcatgaagggatttgaacccaagtcctcttgaaagagcagctcttccctgctgagtcaactctccagcccctggcacttctctttgatgctgcatgtctagtgtggcatagtccctcaggaacttgttctgtagaaagtcaccattggtgggctgcgcataagaatgcatggacttgtaggtgacagctctaagagaaaggcctagggttttcactggtttttgcctgggagaactgtcatttctgctgacatttcttctagccagaatgcttgctgtttgactcttagctgctgtgggatgctgtgaagtagacagtgagaagggtcttctgtattggcagggtgtagagctaaggttactttaaaaaagaaaaagcatcatgtatgta

SEQ ID NO: 27447 - DNA, 2402 bp, Mus musculus
tctcttatggcttcctaggacataggcatgcaaaaggcacacagacagacatgcacaacacccatacatggaaaacattttagtttttttcacaatggtaattaagtgaggtaagctatactggacctcctcttgaagaaaacttggaatgaccttaactttattacagctttttgtttctttttcttttgcagctgtggacgtcagaaaaccagggggatgaaggagatgctggagagggagagaactaatgtctgttgtgctctgtgatctgtttgtgtcactttgtatcctccacattatgtccctttgtgcgataaacaaaaacaaaaaatcgaatgtggactttcgatttttcacagcctaagccttgcaaagatggtccctgggatgaacagctggtatttgtatctaaagctcagactggtcccttaataccatggtattgtgaagtcttgattttgatcaacattgacaaggattactgtgtgtttaatttttacaaactgaacactgtgatcatggggttttataacttagcagaactctttctggtaggaaaaatagacctgaattatgtgtaacttcttggaaagtttaatctgatatcaaaatggtcactgaaatacaattctgttgtaaagctgtacagaaagttctagagattctgtggtgatgctgggacttggtgagatgctgaccaccggcatcctgagtttggtaactcacagtaattctgcctgtggttgagggcttaccaacccttgatcattcagggctgttgccactcaaaagttcatgaccacaaatatctgcagtgtcttctgaggaaactcaaaacctgaaagtgaacttctttggccgataattgggctgtgtcaccacaataaaaaaaggtcccgtgctcataccacctgtgtgactaaaccctttactatagcagtgtgttcctgattagcagcgtgtgaaaacagggctgttaccccctagctaaaggagagggggaaggaagagagaaagcagtgtatcttacaaatggccagaccagttttctggatgattctttaagaataatgtgttgaggcggcctctcgcctgaggagcactcatagtcttggggttcttctagcttggagggtggaagctttgaaatttaacgttctttccgccctgtccttctgactgttgacttttttccctctttaaatttacagctttctgcttccttgggtggttttctttggaagcctgtattagtcaggactgtatggacagggcggggtgttgagcacagggtgagcaagctttgctttaaggtgttgagaaagaagaccttccagtgccaccaccctgccttcctccagttctcagcacagttgttcttcatagtgtgactcatccaaaacaaacaaacaaacaaacaaaagtattttgaagtctccatgatttccccctattgcactcagccctgacaatcttgttagtgcctgtcaccagaccctccagtgtactcatctagcttcgtgctcagacacgtctcaacaagaccttagaacacagggaagttgcatggacactacagtcgagacaaccaagaacagccaggccttcagtctcacagtctcacccctctaccttgacattccatgtagccgtagacatagtccatctgtttgtccatctgctgaaatatgaaaagaattcatgcactgatttaaaccaaaaaaaaaaaaaaaaaaaacccacaaaaaaaatctcttctttctagctgaacaaaaaaaaatgtgcagttaatacttggcgcttgacaacgcagtagtgagtgtggaaccaagcctgtctgtatatctggtagctctttgctctggttttttgtttgtttgtttgttttgttttttcccttaccagtattctgcctaatgtttgcttctgtggtggttctatttgcctagcaagcacacccgtgattgtgaaaatagtgtagcaaaaaagaaaagaaaccccagttactgatgtgctagatccgtgtatgtctaaacattctagtttcaccttacacagagtaatcaggaaaatgtaaaaacttaaagtgaaataaaacattttatcagttagttgcctgtggattgatgtgtcaccgccacccctctcgttctcaggaccattcccatcccgtttaattttggcttcttctttaaagagtaaatagtttttacttcaccccttagaaccagcagtagagatgtcttaggtggctgtctctgataagttggatgtgatcactgccggcttgaaccagagcagccatgatcgcctgtgcaagaccctccctcgcctttcttttcgagggggtggggcgtgttccgtaaggtcacatgagcacttgggctggacaggcacag

SEQ ID NO: 27448 - DNA, 1412 bp, Mus musculus
ccatgatcttgcatcagcagctgtcatctgtctgtccatccattccccacccccgtttttgtgtcctctaggtcccctccccaactctctttctcttttataggactataagtcaagcctttcggatatcagcagcctcctacaaattgaacccaggaatggccctgcacagaagttacggcaggaagttaaccagaacatgaactaaaccgtagagggcaacagggaccctgaacttgaccttcccagagaagccagggcctcccttgcatctgccccaatgcccagcatgccgccaagggagtgcaaaatcaaccccactttgactccttggagaggtagcagcctttcacctgacacattttacttgttcagattaagtccattacagacaagcacaggactctttttttttttcttcttttttttttccagaaaggtccccactagaggtttttgttttgttttatttttaatttaaaaaagcgtgacgccaacagccctggcctcattcgcttgcttctgcctggcccttgtcaacacagtccttggcaactgtccctgacccagatatgcacagactgggtgcctgtgacttcctctgccgccatagctctgcagttcacctgagtgctgacaggctagaagtgcttgctcgtccgcagccacagcggcctgttgagctggttctccaaggctgcctgccatctcctcgaggagacagctgctgtctgcaccctgtccttgacacagtgtcctgtgttgagccccagtgcctttagtccaggccctttgtgggaaggcagagcctaacccttggaggctctgtgttgttgccttctgtctgagctacctacgatgttcaaagagcccagattcctcctgcaatggggagagaggcctccttgagattagtgtccctccagtctgagcaggaacttaaccttttcccccatagcagcagcccctcgggctcctttgttttgttttgttttgttaatatgttggagttaattgaactgattttattgaagtgtgtgttgctgttgcattaaaaggttttcttctatacagctggctctgacgcatttgtttatgccttctcgggtttgctcctgcaacttggtcatggtaacaactgactataacacacaagacaggaagcaaaggcaagctaaatcttatacatactttcttgtactactgattttcaaccctgtaaaagaagtgttaaaattttaaatatttcctgaataagatttgggatgatcaaaaaaaaaaaaaaaaaaaaaaaaagccgggcatggtggtgcacacctttaatcccagcacttgggaggcagaggcaggcggatttctgagttcgaggccagcctggtctacaaagtgagttctaggacagccagggctat

SEQ ID NO: 27449 - DNA, 1219 bp, Mus musculus
ttcttcaaaccacaggggaaccttgggaccattttttatatctcagctttaagacgatttttctaattgcacatataaaccaagggagtgttaccgagtgtaagaaggaaaacatctgagtagctctgccctctagctgtgaccgttcctaacagtgcttatcactccaggctgctcttgtgcggccctggcgtttctgttgactgggtgttgcattctcttgactgttgttttgttttcacagaaataaagctgtattcttcaatattttgtaaactatttcttttggtgttgcaatagcttacacgttttccatacctgttttcatttgaaatagaggtttgctatttagttctgtctatcctcaaaattaagagccttttgctgtgtctctcgtgtgtgggctgtaggtgaatgttcactctgcctgcctcttgagagaatttttaacatggtatttcagtatatacgtatgtattgtaatatttatttttctttttgagcagggtcttactaggtattcctggctggcctggaacttgctatgtagatcagaatggcctagaaagcatgcacaaagatctgtttgcctctgccgccttggatgctgagattaaaggctggtcttacttatttatgattttgagactaggtttcattctaggttccctgccattctggaactcactgtgcagtccaggctggccttgaattctctgagatcttcttacctcagctccctgaggactcagattacaagtgttaggcacctgtgtggtgatttcttaaaaaattatttttattattgttatgtaactcaggttaggtgcttaattattgagacagagtaccgcagcattgtcttgatcttgagctatgttgttcaggtggcctttggagtagctgaggtagaggtgtccctggcttggtagtcacttgaacattctacttttgtgtgtatggtttagggtactcacatgtaaggtaaatgtctagaaagatacttggttagagagatatagatattttaaaaaagtttactaaatattgccagttggtgaggttgtactttctcatactccagtgatcagatgtttcatgtatgttttttattagtactagtttaaatttaaaaaattttaataactgtattttaataattgaaaatctttatggttcttggccatttgactttctttttttttttttttttttttta

SEQ ID NO: 27450 - DNA, 1181 bp, Mus musculus
tgagcgtgactttttcaattccccaccttatctggccacttcactcttttctactcataatctaacctatctcacacttagagatacttgctattagggcttttgttccaaatccaaatccaaatattggatttatatatgaccgagccaacctgacctgatataaatttccctgtttttaccttcaggatgccaggataatttgttaaagaaacatgcaatacagtgtgcatgtggaggaagaaatacatgcacaccgcagtatacacgtgggggtcaggacagtgcatgggtttgagtctctccttccactgtgtaggtccccgagacccagtacaagagcataggcttggtgacagctgcctttacccactgagccatcttgccagcctgagaattctatctctttctttctttctttctatctatctatctatctatctatttatttatttatttcggtttttcgagacagggtttctctggctgtcctggaacttactctgtaggccaggctggcctcgaactcagaaatccgcctgcctctgcctcccaagtgctgggattactggcatgtgccaccactgcccagcctagaattctatttttagaaaagatattttttatgtgtggatcggtgtgagtatgtgcacatgaatacagtgcctacagagaccagaacatgagatgtcctggaattggaattacaggcagttgtgagctgtctgatatgggtgctgagagatgaactcaggttgtctgtaagagcttacatactcttaactatcaagctgtttctccagtccctacagaactcattctttaaaattctcttttaagggcatttcatagttgagtaatgaaagaaggtgggattaagatgtacatgaagtaattctaaagatcaagggcaaactgtctctaaggcctccatattgaggccttatcacagtcctgaagcatggatttggaggtagtctaaaagatggctcacagtgcaccagcagttgaccaggagatactgaactagaatctgaggacagcaccaggtggtgcctcagcctgccccttggtgacactaagccatgaagtctgacctaaaagatgtcagagtgtagtatagcatacgagtttctgtttttcttactagttaccataatggcagaggcccactgcattgt

SEQ ID NO: 27451 - DNA, 4112 bp, Mus musculus
cagccaatcctggatgccattgaagccaagaagaggaggcaacagaacttctgacaacaccagcccagccttggtggcttctgggttgctagactcatgtctgttagccagcacttctgctctgtcatctctccacagcacctttgtgaactcaggaatgtgcgccagtgggaagggctgcttggcagtcacagtgccatttggtgtgtgcatttacactggcaaggtgtatcttgaagggtttgtattggtgcttttaactcagaattctagaccccaggagcagagactcctagttcagtgatagctgggaaattttttacattgtttctttttgttttccttctagtaatagcttttggttgctcgccctggaagactttttaaaaatctataaatatgcatatattatatatatatataaattataaatagattccccactctgtggtggtgtctctgtacaggtacagtttcaaacactttgcctctttcctgtgagattatggtactgtgcagcaagcgggcagaagacactgggaggctcgtaggtggtcactgaatcccagacgtcagcttcacccattgcagggttgcatggagaaattagtcttgggatggttgtgccaccacagtgacgagcctcccatggtccccactggcctcggaagctgtcggtgacgccaggaaaaaatgtggagaacttgagagtttgctcttttcccaggagacgcctgcaccctctttgcagagtagcctttgctgtctcaacgcctttcatccatcgccaccctcccagctgcctaaagtcgcatccaagatactgcccagtgccttaagaggagacacatctgtgaaaggacaggctttcaagaactttccagcaaaccaggccctatccagtccagaaaatctcagtgttcctgggtaaaatcacacacggcatttgttcttcatttcgtagatacagggtaaagggcattgcttccatagtccacatccaaatacgtgattgtttattttttcattcactgtggaggctctggcaagggtaaattaatgcccaactgaggctcactcccagaaggcttagttggattcagaatggtagggaagggactgtcatagtcatagtaggtctgattgtattgtccaggtggaaaaatgagactcagaggagaggtgacattaccaacaccacaaatcagggtagactagaagtagggattggaattcagagcatttgtcctgtaccactggaccaagagcctcttcactgagagaatgaagctaccactgtacatcaggttggcccaggaacccctgctctttccttgcctctttggtacctgagctgctatggaaaggctccccagaggagccgtgtcattcagtcccagctactagtgggttccttactgtgtcccagagacagacagtctctcatggagggcctgcagcagggtagaggactttgcagaagacagttacggagtcatccccgcatctttggctcaaaactgcagtcagaaggaactgggaagccagtcgccctattatttcttctcatttcatccctccgatgggagccctgatggggctgcacctgagcattctgaaattcgactccataattgcttttgctccctaacctgagagtcgataaagtggcaggggatgttctcttctgtgaccagattctgttctttgcaattaaagcaagctttaaaaaatgcaagaggcagctggtctgcaggacttagccaataaggtaactgtgtgacagagagaattaggacaattcggggatcttgctgagatgataaatggctgctaggacttcctgggaagcacgtgtcaggcactggcctaggtgtactacaggtttcatcgggattccctgggcttattaagttatttctcacatgatgaaatttcgtttgaaaggttccttcccatgacactgtggattgggatgcatgacatcatcctgtggggctggtagtcacagggacagcaaagtcctaaatgcttagaatgaagtgaccgtggcttctcacgaagacttaagtctaagtggtatgttcttttaaagcttagaaaccaggtgaattaatagtctagtccccaagtcaagaaagcttttaaaacccagtacacagggcctgcataacatttgctgtgctacttaatagcccagcttcgagctctttcctcttgaaggaaaatgctttgggctttgccagacaaggaaaacgcccacagctcccttctgaagcaagatgggtgtacaggaaaatagcctttcctgtgactcttctgcagccatgaacctagatctggagtctatttggttgcaggcaggcatgcatgtctgcactgcgcccacagcttggtccacagtcaggtgcctggcaggtcagctcaccagccgtttgccggaagccggctgttttggattcctggcgaggcgtatgtgctgttcggtggcagaagggagcaaactgtcctttccttgaggaccgaatccaaggaaccccgtctcacttctctagagcttgaacatttgtggctcaggcttgcagtggactctctgcttccaagatgtggaggccacacataaatcttcttactagcaaacaaacaaaacctcatactctctgaacatattgtagtgttgctcccattcagaagcttgaagcacatttccatctttatttcctttatatacatttttattttatataagattttacattccccagtagattggacgagaatttgactggctggacgtgagagaggttgctgggtgtgtgaataaacagagtagtaatcggaagcctcaggagttgggtcttgagttccttacactgtagactagcacctgacaatgccagattcttattttaccatttaaaactcagtacccctgtctaatgtcaggaatgagagagatgacatcactgcagatcctgcagacactcagagactagtagtaataatattatgaacagcttcttgctaatacattccccagcttaagtgaaatggacagatacccagaaaattacaaaggaactaagcttactcagagatgaaatggccaatcgcaacagcccccagccccttttctaccggaacttggtagctctgagagacatgggactgacgctccggtaacaactgtccctcagtgtcatgccagcagacaagtcccattcttatgccactggccttcccagcctaagtttcaggctctaaagattgctgtcctttattctgggggaagtttttccagctcaaactacaccctcaccctcaccaccctttttaaagcactgtttttgtatttttattagaattacatgcattgtctttggaatccgtgttctttgtgtctcttccaccagcctgcactcagaccaacttggagagaaaaaaaaaatcttaaatgctgttgctgatgtaaatttaaaaaaaaaatgtgaagtttgtagctttaatcttttgtaacaaaaactaattaacactggctgtaagtgctgactcgaaatgctattttgtaaggtttggatgtaaataatagaggtcagctgtttgtatatgtgtgagacatagcttcttccactgccatttggtcttaacttgaggtacttcctgtgtgcttttatgttagagttgtcccctcatttctcccccaacacctgtcacccttgtgttaaataaactgtcctttagaccacagtctgtcccctttcttcacatgaggttttcatacatgtcagtgctgtgcagtgtgttgtgattcttgatgctactgggtggatattctggggtccagagccaggagagaggtcagcttgttgacacacgatgacagaaccagttggcaataccattccaatgaactggaatggacatagttgtgtgtgtatgtacgtgcgtgtgcgagatcttttaaaatgttttatatatatttactatataatatatattatctccccatacacatatacacacacacacatacacacacacacaaacatctccccatccttgcctctttcattcttcccatccccctcttctgagatgtcccctgagctttg

SEQ ID NO: 27452 - DNA, 2747 bp, Mus musculus
agtgagaggtggaagagagaacaagacaagataagtgggggggatgagtcagagccaagtacatgaaatgtcacataaggaaatgtcacaaggaaatccattcttttgtactgtgctgaagaagaagaaacatggataaaaataccagattgtcaagtctgagataggagagctatgtggtctccgagagtctgtctaatccttttccatttccctcatgcaggcttcagagattagactttgagaatatgcatctgacatggaccattgtgccttgtgacctcagtgctttccatatgccaagaacgaggtcttactgagcttaataataaaaagatatggtaatgtcgatcttatttatgggtcaaagaagaaaatccatgtccaattctccgtatcaaggacacggatatcaaaaaggagattaagattgggggtgggcctagagagggagctgggagaagcagctcgagtcagttgatcggcataggcggcaggcagagctagtgaagctgtctccatgctcatgccagccgtagagggaagtgtggtgaagggaaagctaccattgggagtacccatcttagtggatcttagtgggatggctttgttcttggatttcttaaagacttgtgggtaaaactgaacaagttttactatctaatgttttgtttctagatctcaaacctcagattctttagagcaagtggaccctcatgccacataccctcactttctgctactgggattgtggcctctttttgtccctggcctgatcagatctctccatagactctcctaggaattgatagaggctgtaggcaggtcctccctccccgcacccctttccaggaaaggttctagtagttcttactggactcagaaaatgttaactaatctagaagctgacactagctcatgcgtggccacaagctgttcacatgtggcctattgtgtgggaaaatttttgttgaccacgacgtggcttagatgtgaagagaacctttgtgtgatacagaggagatactgacatcatagttatgagattaggaaccctttcccacctctcccctccacttcctgtaagggtgtgtagaggagccacacttttgtgggtctgggaagtgattgcttaggaaagtccctaatgcgtttaatgctgaccctggatcattccctgggttggtatgctaaggaagctcacgttccctgttcaccaaagggaatatgcaaagtaaggaggggtaggaccttatgctgcaaggaagaaggaggtaaggtgttgaccgtggtgaggaacatgcatgcagtctgagaggattagtacagactgctctgagcttcccttggtagcattgtgggcacctgcacttggctttccttgtttcgcaggggtttttggaagcagtgtgatgatgagttcaagcacgggtgggattgttttggacactgggtcactgttccccagatgtagtgtgttctgaaaaatgaagagccctgagtgttttggctcctcaacaggagctgcctgtaggagggagaactgtgcgtacttcttaggtcgaccgtgacgtctgttcaccatcagcctccagtgccctcagaaggggcagctctgtcttgccaacgtttgtttgactttgttgaagggaggaaagtaactaataccctgacaaaacgcaagacagttcttacaagttacttaaaggtcatttttcatgttgatattttaaaaaaattctttatgctgattgcaacagctcaaagcaaagaaaatcttttaaaaatctcttgtgtatattttcagttctaataaaacaccaggcactttcaattattttgaaagtttttactaggttcaaaacacattttgacacactctgctagcctgtatacagtgcaaatcaaaaaggagcaaaaaacatgtcctgacatgagcttgagacattgtggttagcattattacactcgttgctgtcgtgaagaaaatgattttcctgggagaggttgcagttggaggtttgaattcatgaacacataacagtctgaggctacacttttatggttgaagtgattgttgtcagcaaagcttttgttgttgggttttttagttgttgttgtttgttttcctgttagattatcatggcacaacttgaggacatgggcatgtggctgaggtgctgagtgtaggtgcacacttaaagaatgacacagcattctatggaagataattcattgaagaggaaattgaaatatattgtaaagtggggtttgaacagtaagtaggtttgcttaagttcacatatgcttacttagcaaatttgttcctgttgcttcaaggaaggttctagaattactataaagactgtacttgccatacttgtggtggtttcacccatgtcctatcattgagagccttgggtttgtaggagttggcctgataggaagaaaaggaggaaactgtggtgggtctcacctggttccatatgcagatggataggaaacctctgtaaaccaaacctaccacttacctccgcttcacctccagccccaaggacatggcccagactggcccagaccagctcagcccagaccaggagtagctcagtcagggcagagagtagagaaggaaaggctgtggggggaagtagatgcccagagctaccccaaccttggtttttcaatatggattagaagaaatgtcaggtgacatttgactgcaaagatatttctaaacagccttctta

SEQ ID NO: 27453 - DNA, 2335 bp, Mus musculus
tgggatgaaatagtggtgttggtccactctagctgtgatcttagtctttcctctctgacggaagtcatgaaggtcgatgctaatgaggtgtcctcttgcttggtctagggggtgtggttatggtgagattgactggcggtgggcggggctgaggagcacatggacctggagccagctcaccccttgctctctcctactgcagctctgatcgtgggcggcgtggtaggcatcctctttgccgttttcctgatcctgctgctggtgtaccgcatgaagaagaaggacgaaggcagttacgacttgggcaagaaacccatctacaaaaaagcccccaccaatgagttctacgcatgaagcttcctcccgcgagcgctgcttggacttattggggagaggagtggagggttgtgggtggcgggcgttggcagagagcagcaggcaccttaatgctgacttgtcagtatctccatctctagtcacctttctggtgtcagaagagatgtgatcttctactgtgctgcctgagagagagagagagagagagagggagagagagagagagagagagaggctgtgtctgtgtgtctgtgtctcagttgctctggcagaaaaatggggttaaacttgccctttctgaaggcaagcctagaattgggtcttttgttgtcattgttccaaatttccagaatagaatataggaccagtttagatcctgtagtaaacatgtcccatctatgactgccttgattatagaggcaaggggttactgtgtgaatcccggctcccttccacatgctgtacaccctatccatctgtcaggagctggggcaaggagccagaaccctctgcgccttgagatgagtctgccatgagaacttgctcacgctgcagagtctctgtggcgtacctgggggcattctaagtccagtgacttttgaaattcaacctttttttaaaaaaaaaaaatctagggagggcggggtgaagtgctgaaagctcacactgaagtgtgtttgtaggagattcataaaactaagtttttaaatggttcattcctttatgggagcgtctgcgcctgggctgagtgtgggggatacacagatgttctatctagaacatttccattgcaacagctaagtttgtgtttcgtggtttttttatgttttgtttgttttttgaaaatgagagaagagttggagatatgatttttatgatttttttttgttttttactatttatagcttcagacagggctgcttttcatctttctattgtcccccatgttttttttttttttttttttttaatgctccgtgtccttgtttttgaccttggcccttcctgaagttgctttatcttacgaagtagctacagggttctagcagtttccagaatataatgtagggggatagcgggatatttttgtttgtgttcttgtaatatattatccttccttggttctagaagaatagataaatatatttttttaggctatagaatgatattacaggtcccatgttggctggatggttgcgtgagttttcgtgtggctgaagaggctgctgccctcttaccttgccctgttcccggtgccttcttgcgaatgagctagagtagtttagggtccctgactcgaaccctcactgtgccttctgccggggaggaggggctcctgggcctgcttcctccaggcgctctagatgcacaatccaatacagtggcctcgtgtggctgtataactcggttcacttcagactacgtgattggaagtcattcctcggttgcactagccacacaaaatgctcagtcaccatcccccgggcaccgagggttaagctggtttagcaggtcattgctcagctttgcttgtctccctgggcaagggaaggggaccaggagaaaggtgatgaggccccagggactcctgtcatctggtactctccctcttacagaggagagagctagtggcttaaaaggcctggggtggtggggagatcacaccactctcaaccatactctgttcctgtgaggcccccatcaccacctccgtgcagggtcctagctggctgggtcctcttctagccttggtgcctgctccttttctgcaccattcacactgttgtctgttactgatcttttttttttttttttttgataaaaagataataaaacctggtactttctagattgtcagcctgtcagttttatttttggtttctcaaaacagggtttctctgtgtagccctggctgtcctgaaaagcattctgtagatcaggtgaacctagaactcaagaggctgacctgcctctacctcgattaaagaggtgtgccatc

SEQ ID NO: 27454 - DNA, 1496 bp, Mus musculus
tctgtaggcatctgattaggatgacccttgcttctcacttaccgtgcttgcttctgatcatcatgatgtcatcctaactgtccccacttccccagaaacctgatgtaaggccaggacaacccagtgacaactcgctgctatcctctccccacagtgccctgggcttgctgtacttcatccggcgagggaagcagtgcctggatttcactgtcactgtgcatttctttcacctcctgggctgctggctctacagctcccgtttcccctcggcgctgacctggtggctggtccaggctgtgtgcattgcactcatggccgtcatcggggagtacctgtgcatgcggacggagctcaaggagatccccctcagctcagcccctaagtccaatgtctagagttgggccctttggacactctgctggcacttgggccccatcaccttgggctgctcagacctccagatggggtctggcccaagtctgagcagaaccctggaaatgtgaagtctgttggtggagagataatgaggtcccatcataaaggcaggtagcagccatgatcacagatgtaagaatggcctctgtctgccaaagccttgatatctggaggccagtaagggacctcatggagggtagtggcagatttggaaccatgtcacatgagccatcatactgtcaccagcctgttattttaaaaagaaaaaaaaaaaatcaaggatatctgattggaataaaccactcttctcgttgtctgtcttatgcccatgacagccagtacctttgctgtgttgccaaaccacagggattctctgtggagaaatacctgatttctgggtccatagccacagaaaaagatgtaggtacagagtgctaggctgctgacaggacgtcgaggggaggaggcatcaagcacaagaaaaatgcatggccgtgccgttagacacacacacacacttttgtgtgtgtccaggacccatgactgtctccctccagttccctgtatggactctgccttgctgttgtcactcagcacagccagagacaggacccagagaaaaccccagcatccctcccagccttcccttcataataaaagccattgtctgctctctggaagtgagcaggcagccagcttctactggacctcaactgtggcaggagtttctgtttgctgtcttttgagttctgtgatagggagggtgtactaaaggtgctggaggctcaccctgctaagctttcttccaagtggtttcctcaggaagggctggcagctgtccttcctaggtacataaatacactattttccaatcctttggcttgtacttaagtcattgttgggaccaagagagatcaactgtgcacaagagctataaataattagtattccttcattcctgagccccagagttatttctccaggtaaaatactaaatgccagagtaagtgtggtagcactaccttgccctaagacttgggagactgaggtatggggatcat

SEQ ID NO: 27455 - DNA, 1102 bp, Mus musculus
ctctgtctagtgtggatctgtaaccacaggccagtgagtaggtttgtctctgtctagtgtggatctgtaaccacaggccagtgagtaggtttgtctctgtctagtgtggataagtcctggagggagctcagcaatgtcctctcggggatcttctgtgcatccctcaacttcatcgacgccaccaataccgtcactcccaccgcctccttcaaacctctgggactggccaatggtgagatagccccgggcctttcctccttgtaccctccatgttcgcatccttccccttgggctcctcttccacagcggggctagatgctaaatgtggtgggtgtacaggtcccaggtagcttcctaagactgctgtctctgcattgcttcctccctggagtcccacctggaggggggaccacttggcggtagtactagagtggtccagcagtgggtggatgaggtcacctacatctcggagggacaggacccagctctgtctccctcagacactgacgactacttcctgcgctacgctgtgctgcctcgggaggttgtctgcactgagaacctcacgccatggaagaagctcttgccctgcagttccaaggtgagtgaggacgggtggggggattggagagggcagatgtgtccctcacagcctggcagccagggtatagttaagggaatctgtgccctcatgtcaagtggggtactgaccagccccgtgtctcttcctgtctcctccaggccggtctctcagtgctattgaaagcagaccgcttgttccacaccagttaccactcccaggcagtgcacatccggcctatctgcagagtaagtcatggggagtaaggatgggtgttatccttggctcagagaggcagcaagttaatgtgcctgactccggggctgagtagcgagtggctggagtgctactctggatgcgggtattggctctgcaccagggtaattgagcggctgtctggggagcattcaataaatcttcctcatggagcacaaaatcaggagcagcagcctgtgaatgcagcgctggctcggtcactcgccagctggcatgaccttgaggaagtcatttcatttccttgaa

SEQ ID NO: 27456 - DNA, 1216 bp, Mus musculus
ggtgtgccccctctctagtccggcgtgcccgtggtgtaccccctctctagtcctgtgagcccgtggtgtaccccctctctagtccggcgcgcccgtggtgtgccccctctctagtccggcgcgcccgtggtgtgccccctctctagtccggcgagcccgtggtgtgccccctctctagtccggcgagcccgtggtgtgccccctctctagtccggcgtgcccgtggtgtaccccctctctagtcctgtgagcccgtggtgtaccccctctctagtccggcgcgcccgtggtgtgccccctctctagtccggcgctcccatggtgtgccccctctctagtccggcgctcccgtggtgtgccccctctctagtccggcgagcccgtggtgtgccccctctctagtcctccctttccccagcaactgcagctgcactcgtccgacccgagggagcagggcagggctttttctgccacccgctgtgtctccagagttagcttttgaggctaactccctctggagctggtctgggccaaggcgtggtttccagtgtggtagacttgagccaaatcccttcccatcctctcctgtggcagccgtgcttctgcctacaaggggctcgtgctgcagtataccggacagcctagcgatgcttccgtctttactggacattctgatggcccaggcaatgggcgcagtagagctgtggtgctgtttgggggtggggtggggtggggtggggtgggggtgagtgtctgtgaacttactgatgtaataaagtggcagccttcctaggtcgttgcttccttcctaaggcctgggaagagttcccagctaaagcctgtgatgcctatgggcccaccccagacagaaatgccttctcgtctgtgtatctcccacccctctcgtaatgactccccaactctggttttggctgggagattttctgtaaatataacctatgatcatgaaaatcctcctagcaaaggcagagcagagtggctaactacagtgtgtcagaatggcggactctctgcggtgcctggaaatgtttggtattaaggaccacttcttagccaggtgctgcacacctttaatcccagcgctttggggggcagaggcaggtggatttctgtgagtttcaggacagcctggtctacagagcaagttctaggacagccagggctacacagagaaaccctgtctcagaagctaaag

SEQ ID NO: 27457 - DNA, 1246 bp, Mus musculus
gcctgatatgcttttcagtgggtaggagagagctatagttttcctgaactctgctatgaggctaatggtctcttatctccttcaatgccaaactgcacagtgggcattgcaagtaggatgaccacaatgcagactccagctctgacccttacctagcctctttatctccttgcccacagttatgtgctttcggtatggggataaagagcatctatttggtcaatttaactcagctcaatctaaggaatgaaggcatggtggggctttttggtgatagaagaaagattcttagggaaataaatatttatgggtctccagagaggccacaacggtcattaggaccattgtatatccaagtaggtcctggaacaggtttgatttgaagcataagaggcaagcctggaacttgctgggagatgcagacagaggccacaagaaggtagtgctttgctgtgtgtgcaagtgtgacaggcttggtgggagctgggtgacccttgggtctagtatgacatgttattgatgacagcgccatggtctctccctccagcttcagcctccagcagcctgaggaatggagagaggttgtttctgccggactgtgcatctggagtcgttcctgtggcctcctttctctctggtctttgcatttcttcctggtccgatgaaagcatctcctttttctaaccaataaagtgatcgctttcagcaatggagaagctataacacctgcttgcctcactttcttctgtttctcttgacttgggttagatgggtgggacagtgcgggacaactgggccatcaaggtacaaaatccagggagggattggttctgaagttgtgaacagtaattcaggtgtgcccctgcggtgttaggatttctccagtgggtccttacaccaggcctgtggggctggttatttattctccaagggtcatggagacaacgtggcctcagagaggtgtgggaatgcttctgaaatcactcagacccactgctccatgtgttgcacgtctatgtgccagccacagtgctgagagacacactccgagccctcagggtaattcatagcaatccagggggctggcgagaatgctcgctgtcagctaagtgcccgctgtccaagcaagaggacctgagttcaatccccagcacacgtgtataaaacaactaagtgcaacagaatacccgggggtggagctggagacaggctaactcccagatcttcttggtcagccaggctagcc

SEQ ID NO: 27458 - DNA, 1238 bp, Mus musculus
aaaaacaaaaataaatagtattggggattaaacctggggccttccacaagtcagataagctactctgctcctgagccatatatatccccagcagcctgccttaccttcgcctttaattgattttttttgagatggggtttgtgtagcccaggctagctttaaacttgccagataatacaggctgtcgttaaacgcctgctcttgcctcaacctctcaagtgctgggattacagatgtacaacattcctggccttttggaaagcctattttaaaaatttgagacaagcactaagcctggcctcgaacttgttctgtagcctagtaggctttgattaaaaatcctcctggtcaggctggtggcacctttaatcccagcacttgacatattgggactatatctcaaaagaaagcaaacaacaaagaaaaacaaacacaaaaatcccctgcctcaacttcctgagtcgatgggataacaggctcatgtcaccaggcctggccacctccagctttaaaaagacttgttgctgcccctctttctcccctccttcttctggggcagggtctcactgtgaagctatggctggcttggaacttacaatgctctggcttcctctgccttccaagtgctgggatgacagacgtgtacagcacacccagctctgctcatgtttctacttcaagctatgctgcatcctatgttgtaagtgggacaatttggaactatttataagagggtggcaagtcacaacataaaagcaagctctcactgccaaaaagcagatggcatgcacaggaattcaaggccctgagagtcttatgagcagttccaacagtgctcacgtagagaacactgcctgtggagaaagccatcacagtcgtctcaggacacacagctatcctgactgctgctggatttgagctgagttggcttggagtagacatgaatgtggaaagtgctgctaggtttctttttccttttttttttttgttattttttgagacagggtctttctgttatgtagtcctggctgtggctgccttgtactcacagagatccacctacctctccttccaaagtgctgggattaacggtgtctgccactatgcctggctgttagcatctttaacttgtgcccctactgtgttgagaaggcattctatagctgtatctgtgatttcttgtatccctactatgctgtctggaaaatgctgtggtcaatggacaaaaaatcttatgt

SEQ ID NO: 27459 - DNA, 1271 bp, Mus musculus
gtccacagaacccaacatcgatagccctttgaacacacacgctgcggaactctggaaaaaccccacaggtaggaccttgtccagctcagggtgatccttgccagcattcagagagaccctgagggccgggttggcttctcccacatccgtcctgctagtgcttccattctcacatagatagatgaaggggtctatgaatagaatatatctcctgatccttccctggactctggaaaccaccagacggcaacatgggtatctgctggacagggagaatgggccctgccgccccttcccccacgccccaatccatcactcactcgagccccatttgttctcttccagcatttaagaaatacctgcaagaaacctattcaaagcaggtctccagccaagatccctgatgcaagctggccgccctgcccctcttttgtgttgtcttttttcttagactatctgtcctttctccttgatttctaaactatgttatttttgttttgtttcgtttttaaattaagtctgcttgactagccgggcgtggtggcgctcgcctttaatcccagcactcgggaggcagaggcaggcggatttctgagttcaaggccaacctggtctacaaagtaagctccaggacagccagggctatacagagaaaccctgtctcgaaaaacaaaaaataaataaattaagtctgcttgaacccttaacaatgtatattaaataaatacacattgattgttttgtataaattgttttctcaagttaccctcagccagaggatgcagggggggggtagcttaaatctgtgttctggcccattgtctacagtgttggttggaagcagctgattgacagtgggagtcacatactgtgtatttgcctagaggtatagctccctggcagagagcctgtttgatccgagtgaggtaccagattcaatcccagcaccaaaactggtgtccacttgtaaggagttagagcatgcgctaggaacacacagtgaccatcggggacagttccagttgggatacagatgcgactaaaccagaccctaagctcaagaatctatagaagtgccagacactcactttcatgttaaagatctggggggtggggggcctgactccggttgccctgtagcaggcccaagctctggaggatagaaaggttggctctggacccgggtgggtgatttcatctcctactccatctccacgaggtcttatgggccctgcccaagttgtcagctcattgagcagttgtgcagccct

SEQ ID NO: 27460 - DNA, 1604 bp, Mus musculus
cacggggccagccgcccagctttgcctaggcgagcttgcggtcgtccagaaatccatgcacctcattggctccggctccgagaagatgagcatccagattctggaggacacgcacaccgtccagccccagccccccgccagctgcagctgctactttaaccaagccttccacctgccctgccgccacatcctagccatgctcagtgcccgccagcaggtactccagcccgacatgctgcccgctcagtggacctcgggctgtgcctccagtctagacagtatcctaggcagcaagtggagtgccagcctggataagcacctggctgtgactctgctcactgaagaggtgggtcggctcttacagcactgcagcgaggaggagttcgagcgtcgctacagcaccctccgggaactggccgacaactggatcggcccttatgagcaggtacagctctaatcacgtgtacacgcccagtactaggaactgaacccagaggagtcgacgggttaggcaggctctactactgcctctttttatgtcttattctgagatagcctctcactaggttgcccaggctactcttgaactcactctgtagacaggctggctttgaacttgtgagtctcctagctaacctgcagagtaagtgggattatagcctgagtcagtaggctcaacttctgattgtatttgtgctctgagttcacacacatacgagcattcacgtccttccctctgtgcttgcttccaaaggcttctgctctgccccagcctcttgtctagaacgtgtcagggagtcagaaaatcctttctgctaagggctcagtagtaaatatgtaggctttgatggccaaatacagtctgctgtgcattctggcttcatttttgacaactgaaaaggaaaaatgatttgtagctccagaaatttctggaaacaggtgattccttaagagaaatagtgggtggtgaggctgaaggttctgtgttggtaactcctgctcacccgtgatgtgattcacctgacactggccctggagcctccccacaaaggcagagactatggtgaggccgtcaagcttcccagttctcctgtcccacctgggatcaataaagtgaatgtcctgtccccactcgtgtcttgtctggtttatgcgtggtccttttgtgtcacgcaccctgagagtgctgactctgttctcaatttacctgctgtagttttcaggcctggttcttccttcactaccagtgagactccaagaaaacgctctctaagcttcagctcatctgtaaagggggcgtcctcacagggttggctggagtaaagaatgggtttctgtttgctcgttcaagtgttcatttcccatcacttgccttcagtcccatctcccttcagcaagctgggacacaaggcaagaggaaaatccatactgtctaggacttcagacaagaaaatttcctctgctcccccaatagggcttcctccttaggtatcttgacttaatctgctcaggtctgtggtggtatgaagaacttcctgcggtgcagttggtcagggtggctcagttacccacaccctcttcccatccctgcgagagccatcccc

SEQ ID NO: 27461 - DNA, 1736 bp, Mus musculus
ttaaaaaagtgaacaatgagcaaactgtcacgtgatgcagatgctcacgtgaccagagctacacatgacttccagtccaaaggcgcctcctggagagcaaggacgcaaggaagcagaggtacggagatgcccaaactggtgggcagcgaaggtggctctgtggcccggagttggatccgagcgggggcttctcccggagatgtgcgccatcgtctccccaggaactgctgcaccgaagcgcaagggatctggggggactggtaaacaaacatcctccaccgatgcttcctcctgcagatgcccggaaccgcgctgtctccactgctcttgttgctgctcctgtcctgggcgtcccggaacgaagcagctccggaccaggatgaaatcgattgtctccccggcctggccaagcagccctctttccggcaatactccggctacctcagagcatcggactccaagcacttccactactggtgcttggcttggccctaaagttcctaggagggcatgataactggacgagcgaattctaacgaccccaggcaggacctggactcacaccaatcctttcctatccttcccaggtttgtggagtcgcagaacgacccaaagaacagccccgtggtgctttggcttaacgggggtcccggctgcagctcgctcgatgggctgcttacagagcacggcccctttctggtgagttgaccactatccccctcccccatgagagagggcaggagactagttagagacagctcaaggaaaaggcaggaaggggaaggggagaaggaacctgtggcctaagtttgctttccttaacaattctgttttatgtggtggcccttgccctaactttccgtacctctcatggagtgtgagaatacggaaacgcactgtggctctttctctccacccagctgctaaccggcaccctcacaggcctctctgtctttcctccccagatccagccagatggtgtcaccctggagtacaacccctatgcttggaacctggtactcctggagctgtgggtctcttagggatgtctgggtacttgaagggttggggaccccctcttctgctcattccctcctccccctagattgccaacgtgctgtatatcgagtccccagctggggtgggcttctcctactcggatgacaagatgtacgtgaccaatgacacagaggtgagtctgttgcctgaccacctgccccattccccgtttccccagagatggcttgattaggaggagagcatggcctcagagtccactttgagccctgtcatgtgctctggtaaactcaaccagtccacttcctcttatacaaaataaaatgggttgaactcattatctctgaagcgctttctaacttaaacgtcctcgggtctcctgactcttccatcttggcatcctcaggtggcggagaacaattatgaagcccttaaagacttcttccgcctctttccggaatacaaggacaacaaacttttcctgacaggagagagctatgctggcatctacatccccaccttggctgtactggtcatgcaggatcctagcatgaatcttcaggtgcagggcagctacctgagggaagggaggccccacagtgctgtgacctaggattagggaggtcagcctggccgctccctcacagcctactggctggccactggctactccgatagcttgctttgcctcccaccacaggaagctcacctgtctgtct

SEQ ID NO: 27462 - DNA, 1350 bp, Mus musculus
ggattcgctcaaccagaaggtaaagttgccagggagctgggctggctagggtgccaggagagggcaaaactggagagcagctttgagcaaggatgggggttgccactggctatcgtctttcccgatgggacagatggaggtgcagcgccggccctggctagtggactacggggagagcggagaacaggtagctggtttcgtgaaggagtgttcacacatcaccttcctcaccatcaaggtaggactttgtgcctagtgagggacagccggggccagagcgggggagtggtgtgacttccccgtctctctctgatgattctgggtcacccttgatgcattgggcgagcttgcagggtgaggaggtgaagaaggaagcggctggaagtgaggggtgatgcatgttggggatccagatctctcataaagctttgctccccagggtgccggacacatggtccccacggacaagcctcgagctgcttttaccatgttctcgaggttcctgaacaaagagccttactgatagcttccgctgcaacccatggaaatcctcagtacctgatcagcccctctcggcctctctcagcagagaggagtcctccgctaatgctcccgtggggcaagtcctgtactaaaactgcccagacttctcacagcctggtgcatcccagcctgggcctcagggcgtcacagacagcctaggaccaagtgagcactttgttccggccatcgtggggtggcctgacctccccgactgcataaaaactgaccaccccaggaccccaacagagctagagaaacccaaggaggggggtggatggattctaattgatggttgactaattctggaattaaatcgggtatagcttccaactgggctcttctctgtggcaccgggaccactaacactgtagatgggaaggggttggcagggggtgcagagaagacttcagttaggttcctgaatgccagccacccaggtggggtgatgggctcaggcagctgcagcagagggtggggggacatgggaggccgcaacgtctgcaggacggttcttgtcaatcacttctcgaagccctttggcaaagtggaggtcagccccaacagtgacgaagccctgcgggaggggacagggagcctggctggttcagttgtttggaaacagcctccaaacaaacacaagactcttgagcaaatcccctcaggggccccagctgctttgcggcgtggcgtatgttctctggagcatggccctgcttctaagttaaatctttactacttaaataatatatatgtgaaggagcaactagtgtaaaggggtttcgggaaaacagacaagcactggggtgt

SEQ ID NO: 27463 - DNA, 1201 bp, Mus musculus
gacacagatggactgatggacacccaggctgagcttgcctctctcatccacagagcgtacctggcgtggggtgcagatcccccttcctgagggtatcaacttcgtgcgtgaggtggtgaccaaccacgcggtaagtacattgtggaaaggaggccgtagaccagggcattcctgtccctacaacaccccagtgcttgtctgttttcccgaaacccctttacactagttgctccttcacatatatattatttaagtagtaaagatttaacttagaagcagggccatgctccagagaacatacgccacgccgcaaagcagctggggcccctgaggggatttgctcaagagtcttgtgtttgtttggaggctgtttccaaacaactgaaccagccaggctccctgtcccctcccgcagggcttcgtcactgttggggctgacctccactttgccaaagggcttcgagaagtgattgacaagaaccgtcctgcagacgttgcggcctcccatgtccccccaccctctgctgcagctgcctgagcccatcaccccacctgggtggctggcattcaggaacctaactgaagtcttctctgcaccccctgccaaccccttcccatctacagtgttagtggtcccggtgccacagagaagagcccagttggaagctatacccgatttaattccagaattagtcaaccatcaattagaatccatccacccccctccttgggtttctctagctctgttggggtcctggggtggtcagtttttatgcagtcggggaggtcaggccaccccacgatggccggaacaaagtgctcacttggtcctaggctgtctgtgacgccctgaggcccaggctgggatgcaccaggctgtgagaagtctgggcagttttagtacaggacttgccccacgggagcattagcggaggactcctctctgctgagagaggccgagaggggctgatcaggtactgaggatttccatgggttgcagcggaagctatcagtaaggctctttgttcaggaacctcgagaacatggtaaaagcagctcgaggcttgtccgtggggaccatgtgtccggcaccctggggagcaaagctttatgagagatctggatccccaacatgcatcacccctcacttccagccgcttccttcttcacctcctcaccctgcaagctcgcccaatgcatc

SEQ ID NO: 27464 - DNA, 1192 bp, Mus musculus
aaggaaaagagaaagtgttggtgggggatggggggctgttcatcctcctgagatccaaacttgtcacgaggcagttgcacgggggaaccgagccccaaatcctttggaagcagggcgcaagtcttatcgtgcttcggaacctcggttttgcatcaggcaaagacaagatgattggttccgagtgccccaaacactttacgggcagtaacggtccgggccagcactccgttctagttgcatgaccaaagagtggttttgagcctctcagatgacacctgcgactcgaccccaccctgcccccaggcttggtcgccatggtcctgctctgggccctcttcctagcgctcctggcaggtgcccacgccgagctcccgggctgcaagatccgcgtcacctccgcggctctggatctgggtaaggcgcgcggcgggagccgtggaccgggtggggtgctctggccccgggcgcgggacctgagtgtctccatgctatctcagtgaagcaggaaggcctgcgctttctggaacaagagctggagaccatcaccatcccagacgtgtacggcgcaaagggccacttttactacaatatctcggagtaagtaaggctcggggggccggggtctcaaaggtggtgggatgacctgggacaccgccccagactgggcgggtctgggcgtggccaattaaatgaggtgggatccataataacgagtaaggctactaggtaaaaagactggaggtaggcgggtccaagaaaggggaatacgaaccagcagaattgtagcttggaccaaagaacaccgcgatgatacactggaagaatttacctgtgggtgagagtggagtctatccagagggtggcgccaaaaagagggaagcccaggataggagagatagaggtgaggcgatgtggggtgagttaaagtgatggaggcaaagtcaaaggaccaggtggaaagctcagtctggcgcacgcctgccaaaaacaaaacaacaacaaaacagaaaccaaaaagacgaaaacagatctagcaatcacaatgtggacagaacacggaggtgtaagcaagaccatagtttttacttatttatttttaagattttatttaattttaatgtatgtgcattggtgttttgtctgcatgtacgtctttgtgagagtgtcgggtccccttggaactatagttaca

SEQ ID NO: 27465 - DNA, 1155 bp, Mus musculus
ccggcagcggtggctgatgctgccatggcccaagcccagggcctgtttggcactgaggaggcagtgccggagcagatccaccagctgcagcatcagggcatcgagtacgacgtcattaccctctcggatgactgagcctcaaaggcccaacgctgactgatcgtggatatcaggggccggctctcctggagactagggagtttcctgtcctacttagggcctccagatactggacagttagtgtcccttgactccaaaggagccagacctgtgctcttggggggcagccaagggctccagccaggacatgctgggtgcctcagcctgctggcaggctttgggagagaaatttatttttgttttgatggacccactggctcctgtctcaataaagggaccagagtccagcccttgcaactctctttgtatatgtgctaataacctgaaccaggtaagggccaggaaaccaggcagaggtcccaacaagtagaggctacctggctccacagccagctggctctaccttgtatgaacagcggttgcagtacaggccaagccagcttcatctcaggagagagctgagctagtgagaaccctgcttcctccatgggctccctgtctccagggtctcagagggcaggtagtatataccctgaagcctgcagtgcctcgaaggcaacacttcctcctgagcagatggaaaacatcagccagcctggaagtctggtgtaggcgggctggaggtatctgggcaggctcagctgtaggactctggactcctccatcctactgcgctcaggtagacgcctctaaggattcagtactaaaaggacctgtggatggatttgaaggcctgggtaccttgataaggggcacctagggagtggtcaccgaggcaaccgccccaagaccctcacacactcttggggagtttctgtatttccttttacaaatgaaacaaggcagcaacagggtctggggctggggaggcacgggcctatttacaagggacttggtgaatcggaaagggtgagagcagggagggggatccctggcagagccgtaatattcctatgtccctggcagctcaagtcctgctgccaccccaggggagagccctgaggctgagtcctagcagtctgtgacagcacccct

SEQ ID NO: 27466 - DNA, 2477 bp, Mus musculus
ggcagcaggacttgagctgccagggacataggaatattacggctctgccagggatccccctccctgctctcaccctttccgattcaccaagtcccttgtaaataggcccgtgcctccccagccccagaccctgttgctgccttgtttcatttgtaaaaggaaatacagaaactccccaagagtgtgtgagggtcttggggcggttgcctcggtgaccactccctaggtgccccttatcaaggtacccaggccttcaaatccatccacaggtccttttagtactgaatccttagaggcgtctacctgagcgcagtaggatggaggagtccagagtcctacagctgagcctgcccagatacctccagcccgcctacaccagacttccaggctggctgatgttttccatctgctcaggaggaagtgttgccttcgaggcactgcaggcttcagggtatatactacctgccctctgagaccctggagacagggagcccatggaggaagcagggttctcactagctcagctctctcctgagatgaagctggcttggcctgtactgcaaccgctgttcatacaaggtagagccagctggctgtggagccaggtagcctctacttgttgggacctctgcctggtttcctggcccttacctggttcaggttattagcacatatacaaagagagttgcaagggctggactctggtccctttattgagacaggagccagtgggtccatcaaaacaaaaataaatttctctcccaaagcctgccagcaggctgaggcacccagcatgtcctggctggagcccttggctgccccccaagagcacaggtctggctcctttggagtcaagggacactaactgtccagtatctggaggccctaagtaggacaggaaactccctagtctccaggagagccggcccctgatatccacgatcagtcagcgttgggcctttgaggctcagtcatccgagagggtaatgacgtcgtactcgatgccctgatgctgcagctggtggatctgctccggcactgcctcctcagtgccaaacaggccctgggcttgggccatggcagcatcagccaccgctgccggggagggaaaagcacagtaagcctgaggctccaagagcaaggcctcacctcaggctcctggctggcagtatccggtccatacctgtgacagcggagtgtgcggcagcttccagctgagcctgggtgacaagctgctggctgggggagacaggtacatactggatctagagaaagaagccagtaagacgagccatcacggaagcttcactaccccagctctgcctgggctcccagggaccctacctgggactcctgcaggaatggagtaccttgctcatactggatgtgtgtgatctggccttcctggacctagagataggaagctgtccagtgatcctgtaaggttgcagccttcctccaaaccccaccctgccccaggcctggcctacctggatatgatggccatcagggaccacaacgtactcctgaggcagtaagtgctggacaccatcctgagagatgatatactgaacctaaggaaggggaggaggcagctgctggggctccactcagtgggagctgggtaagggcagagtagaagacacagctatggacaatggcctcagggacaggaggttacctggttgtctgaggtcaccagatgctgtactgtctggccatctgctgtgatttcctggatgtaggtagcttcctcctgtcaagggaggagtagcctcagttctttaccgagctcatatgcttatattcagtgtttttggagttctgtgtgccccaacctggcatggaggccggggctcagcagggtgccaagcattgctcgccatcactttttgcttgttctccacccttcttggagcatgacacgcggacacctagcttgttatgtgcttgtgcaagcacttctaaccctctgagccatctctctagttcttctagcctgtctgtctgtcccaccctttcttcagggtccgcagacctcagtcttacctgattggtcactgtctgttcctgggccacaatgatgtgttcttggctcagtgcctgctgtagccgctctgtacccagaaccccgtgactggactggaaggcagctgggcagagagaagggaactcattggggggttagggaaaacttgactgacgcatccctggggttcctttgttgctagtctttggacccaaatggtccactgcatggcccaggagtagcttactgtgtagtgtggccagtgtctcctcttcactattgaggatgatggtctgggctggggctcgggctgtagaagtcccagtctttctcccatcaatgctatgtagccgctggatgtggaatttgaggtgcccgttcctgttgaaactgtggagagggaagagtgggcatcagatagctctaccaggtgtgtgcatgcaagtcc

SEQ ID NO: 27467 - DNA, 1437 bp, Mus musculus
tagccccacccttccctggcccctcctacttcatcctaagtagagttgtttggaagtgttcgaaacactttccaggtcaacatcaaatatcctaagtttctctcaccactccttcctgcggctgttgcttatcacttatcagaatcagaacttagactgcattcggggctggatcttttgtttgggtagaagataagtgttctgggatctgggctcagcttctgtctgggatcgctctggcacctgcctggcagatttggaggaacaggaagaagccaagcgcagctgccctatgggaacaccatttctggaggcagtggtcatagccttagttttcacctccacagcagccagagctgcgtcctgcctggctcccagtgaagccaggtggtcttggcagacagtgtcatcattgttccatcagagaatagaactccaaggactcaagagtgatttctctggactgtgaagtgccatgtggcagccagagaagagaggactcttgtgactgcatcagagtggtcccttgaagttggtttggtttcgtattttttattttcctggagggtctgcagacaagtgagcagctctcttggcactttgacatgaactgtgactctggggcccactgctctccacagcgttagctgcacctttctctccggctgcacctcatgcagtcagcactgggggcagctccaggctctggagctggacaccttggtggtccgtgatttcttttgagccccaggcttttgttttcattcagactcttgttctgttttctgatgagcaggagacggggaccacttgatggtagactgtggtagttgggtatgttctcatacagaagagcattcgtgtaacttctgagacagggtgatgtttagagaagggctctggctgctgccctgaatggagccagaggaagaagcgccttttcctttgggaaaggctgctcattaaatgaagtgaggatcaggtcaggggagggtcaggcctggctgggcggcaagagtgctaactccagtccagtccctgccagaggctgagcaaaccagtttcaaaagctaagtccccaaatggcagcagtttatgttctgatctgtttgtgttatacggtgggtccccctccccctttggaactcttgtgttgttgataaaatgaaataattactttttaattaaaatgaaaaagtcagacctgtgctaatctttcttgggtgtgtctgcagcagcacctctgctgagcactttccccaagagcagagtctctgtgcccagcctaaactcgctgtgctgcccgccagtgagaagtgttgataggaatgcctacagcagactcacgctctgtgcctgctgctagagtcggtgtattgcaggtgtccaagataggttacggggaaggaagccactgtgaggaagagcctctctggg

SEQ ID NO: 27468 - DNA, 1222 bp, Mus musculus
gagtcagggctactgagtaagacctgaaggacacgggtagggacatggcagaagctgcacaggaaccccaggtgacaggattcacgacacgtaggttgggaagtccaggaagccaggaggaaaagcaggctgttgtggggttaaggacaggttggagacccacgtaagacacccaaagtgattagccaaggtagccagggagagagagaaacagtcagaaggtgagaagatgagggaggctggggcgccaggtcagagggatttgctgagctagcattgggaggataaggggatggctaaaggacaggcaggggctgacatggggtgacaggaaaggaaaggatggggagggcgtgtgagggtgcctaggaaagccagtggccttccttataggtggctccatgtcacttagggtggcctagcctcgagcctgtctagcagtggcccttttccacgtgctcgctggtgctttggctttagtcctgtgaggggcaagcctggctgggtttagctctgctggcctgctctctccctgaccccctctctctctgggccccctcccgcccccacctctggtgtccgaggttgaaccgtcattctctgttccacttcccctgcccaagagtggagaggaaggcctgtgtgaacctactctggccgagtctagcccccttccactcaagaacatgcaggcaccatgactggaaggaaaagatccctgtccagtgtacttaacacacacacacacacacacacacacacacacacacacacacacacacacacacacacggcactttaggaaagacagtgcactgagtctgtgcctccttctgcctttctttctctagcatgtgatcagagggaatcgtccaatcaaaacagagatggcccatcagctgtatgtccttcaggtcttgacctttaaccttctggaagaaagaatgatgaccaagatggatcccaatgaccaggcaggtgctgggggccatcctggtataagctgtgctgtttcttcatggctgtggtctttccgcctacagtgtgtgctgagaatgctgtgtgaagtggtctcctcaaaactggtgtgggccacatctcccgaggacttgggacaaaggcctcttctgtccttccatcctcccgctggtccatccctggagactggcttgggagcacgtgccctgctctctctcttccctgcttctcttgggagctgatc

SEQ ID NO: 27469 - DNA, 1218 bp, Mus musculus
cacacacacacacacacatcacttgtttcccatctgagctttctggaaacaaggactcagccatttttgaccctctctccctcctgacggttggttgatcacttactaagccaacagtgtggtggcaacaataagaagtgtaggcttcgtgagtttgtgttgccggctcggatccaggctctggtgtgccagggtttggccttaaacttcctgctccagctgttggtctcactttcctcatctctagagatgtaagtcttctccaccttctctacccattcggctcaaaggagagttaaatactagtacagtggccggcccagattatcacccaactcaaaagctgggttttagtgtgtgtgtgtgtgtgtgtgtgtgtgtgtgtgtgtgtgtgtgtgtgtgtgttttgcaagcttaccttatcaggatatattttttagcctgtaataaagccaggtgccacacaggtacctctgggagcctgtccgtgatggtgggggcgggacttctgcatagaagggtggtcacacagttgattggctaacactgactcttacaccttcctgcctgctggactcaactggaatggcccagttcccctatggggccctgaggatgcagagctccaagacagtctcccagatgcaaggcggacgtggcttcccccaggagcagctcaggagtggcagcgccctcaatgagctgggcccctaagtcctcaatgtcaatgattaattaagaaaatgcaccactggcttgcttacagcctgatcttgggaaggcggttttccaagtgaagctccctcctctcagatgagtgtagcttgtgtcaagtagacataagactggacagcacaactgactacgtgtcaccttaaaagacaaacacatcatcaccatgaagccacctttcccttcttgttcatcccaagatcacacattaataaaggcaccacaatcgaaaacactttacaaacttaaaagctccacagccttacaaaattcaaacactttaaagttgcccctttaaaaatatccagtctctttaaaagtccaaagtctgtgtaatgctctcaaatcttttaggtttaaagcctctcaactgtgcactcctgtaaaaatgaatgcttccctatgtcaagagggaagaaccagggcagtcacagactgaactgtaaataacccggtgcccagtgtctggggttccatcctctgagg

SEQ ID NO: 27470 - DNA, 1137 bp, Mus musculus
ggacgccattctgtttggttcgcggggcttgtttagcgctcgggtccctccgtttctcatttctctgtttctgcttaccgtccttccctctccatttggtggtcttaagcagtaggtgtcctgacaggcgggtggcaggagccgggctctgtggattcacattctccctgcattgtctccctcgtagccattcagcgagtcgtctagcccagttaccttgtatgtcaccggaatctcagggatattgtggtcattaaagaaggcatatgcatcacatgttcttatgctgacatagttcagtaaatgtttgatttcattaaattgttattcttttctttaaaaaacatccacacccccacaaaacaacaacaacaacaacaacattactccagagaaaatgagactcaaagaggggaagtgcctgaggttccacagctaccaggcagcctgtctgtggcccagaaccaccgagcctttgctatttttctctttaatggtttttaggtgcccactgccaggacattgataggtgccaggagccaggggaaatgcagaagtgaacaggcctgtgcttttctgccctagaggggcaatggagttataaagaagtgttcatatattctcctttaccttttgtaagttttatcagacatgggtgggggctaccttggtaccccagtttctaggaaactgttctgaacttggttgacattcaggagagactcctggtgttaactggaggttttgttaccactttacagttgtggagactgaggcatagagtagctaagggaaccttgaggtttcacgcctaataagggatctgaacctgcctgttccagagcacagatgagcctgtaaggtgacaccctgcttagccacttgcctggtgactgtcaggtagaaactgcccagactgcaggatgctttccttctggcttcttgttttgtttgtttttagggagcagcaatgaattccagtcctcaggtggcttgagaaaggaggagcaagccttgatacttccagacttaccctggcctggtctcaggccgtagtcctgcagggctttaacagggcaagctctggataaattgtatcattttccacagtagtctaaaccctgttccaaagctgtc

SEQ ID NO: 27471 - DNA, 1124 bp, Mus musculus
ggacaccatcactcgctaacctcactctctgctagtgtgacaccttttgacctttcagttagctatagcccaaagccagctgccctcactctgtgttctacagccacagccctgggatctcaggggcagctgtgggcgtggtccggttggagtgggcgtggtctggctggagggagggaaggtaacttccagctgggagatgagttgaggaaggtggggaggggagttgaacacactgcctttccttcacagaccattcccggagcagcaaggcaggtttgtggagcagcagcgaggagaagcgagcgtcatcccgctctgagcacagtggagggaccagcacgaagaacctcatgcccaaagagtcccgggagtctcggctagatgccttctgggactaggggtgcattgtgagccagaacacctccctataggcgggagaaacagcccaaaccacaggaagcaacagaaactggagaaccgccacctttagaatttccaacactcaggctctgcccgtcggcttggctgcaggacagagacttgactccatcccagctctggtcttggctgggatggcactaccctgtgagccaaacactttaggtgtaagtaggtacacttgtgacgtcactgacctagcgtacctttccttttcatatctacactgaccttaacttataaaaaaaacagaaaagaaaagcaagttttatatatatacatatatatataaagatctacaattaaaagaatgttttgataatccaggggctggttagtgagcccgctggcctcactggggtgtcagggctgggcccagggattgctattttcacgtaggcccttgtccttggatacccaggggagggagccactgtcgccgcagcacaccaggattggggctctcaggctgtgctgccctagacccgccacaccaagccatccgcccctcacagaccctacaagacgatgttaggaaacacatgcttgctggccttgaaggacacagagagaagtatgtgtgtgtggtgtgtttccagctctggctcccgaaggggcaaagcagcctcctgtttacagaaggtccacgcgagctatccccgtggcgttacgaatgcagccag

SEQ ID NO: 27472 - DNA, 1187 bp, Mus musculus
tgagctacaaggcaagctcaatccagatgaaagaattcacattttataaaatgagaaatggttacagagatgcctcctcagttaaaccgcactggctgtaactttggaggctcaggactgagtcccagcactgccatggtgacttagagccatctgcaactccggttctgcagaacctcatgccttctggcctccacaggcaagagacaggcatgtggcacacagacactcatacaggcagcacacccatattcataagagaattgaaactgtatcagaacacccagcccaaaacagtaagacttgtaaaacttgcttcagtcacatggatctgcacagggtgggactagcttccaagaattacttgtaaagactggcccaggatactgtggtaaaacacctttgcaagccaaggctctgcccaaggaagcccctcctcaccctgttccccgatttccccttgcctccctctacccaccaacgcctttacattttctgcagagagaaaggagaagttcaaggacaaagggtcattgctgccagacacacacactcacatacacacacttcttgaaacgccactgacccaagttcaggttcaggatgctcccggtggtggaggtggaagtcttgtcgggttttgtcatgatgggtgtcggcgcttgcggagagaaaggctttgggctgccagacaagctcccggcttgccccgtcttggtggaggctggagaagctagaaaagtatgtcagggttagaaagctggctttacagatcagtaaaccaataaagctcccagggtcggtcggtcggtcggggctgaggacaggagagaaggggtgtggcgtgcttcactgcacaagtgctgttcagggtcctgggtgggactgggaagatgggcagccatgaactgccaacaaagggctgtcaccaaacacaggctctgagccaaatggctaggctgccactgaaattgcattggcccgtttatgggtttaagccataagcaaaacccccctcatatgctgtatgcacgggtcaggagcatgtaggcatgacagccattggtaagagtctggggacagctcagagccttccccacctgtctctgaccagccctggggagggctacaggaaagcaagctgggcatcgggtgaaggggtagagatgttggcaaattatctcatt

SEQ ID NO: 27473 - DNA, 1201 bp, Mus musculus
tatttattattatatgtaagtacactgtagctgtcttcagacacaccagaagagggagtcagatcttgttacggatggttgtgagccaccatgtggttgctgggatttgaactctggaccttcggaagagcagtcgggtgctcttacccactgagccatctcaccagcccccgaaagcttagtttttgatacctttgtgttagggttgacttagacgtgaggagactgaggtgaaaattgatcccccttgcctccttcagggctggcttttccagctatgtgtcgtagtttggagacaacaactggtctctaattgcaggactccccatcagttgatgtggctttggggacatatttaatgtctttatgccttagccttcccacctctaccatggcgaccgtaactggctacgccgagcctcccctatgtgtaagctctgttgagagcacaaggagtcaggacccacagtaggacaggagcactggggcagtgttgaccatggaattctttttcctggtgatctctaaagtgctggctgcgaggatctgagaagagatgcaatggaggggtgacttaaggaatgttcttggcaggaagatcctcccatctccctcttccacgggctgggcttacaggtgtaccccaccacagctgccccattaaaacctgcttgaagttagcacatcgtaaaataaagtgtgttcgtgtgcaaactcccctttgctctcttgttccgcatttcaaaaaaaaaaaatagagctttataggaatctaagaatggttgtgtttaatttagtgtttgtcttcccttgggtgggatccgtggcatcgagctttgcggcaaaattccttactcactggcagagtttttcttctttttaaagatgagaacttagacttcaaagaccctattctaaaactacacaacctactcagcccaccttgcttgacacttgctaattccgtcataaggtggccatagaagacgctactgtgacagcacatgccagtgtggtcaccccagcatttgggaggtaggggcagggggattaggagttcgaggccttgactacatgagatcctgtctcaaaaatactaaaataacaaccaaaaaacccaaaccctcaacaaagaaagagggtgacactcagattgttatactctcaacaaattgcgtcccttgctgagtgggcccacagt

SEQ ID NO: 27474 - DNA, 1317 bp, Mus musculus
cgggtgagttgtaaagacagccgagaagacgaaatggagtctgatagtgtgctctgcactcttgtcagatttttgagtgactctttgtggtccttctcttgacaaccaaccacagtgggagcttgttggaaggccccggagatgtgacagatggaaactgattccaaattaatggagaaaatgttgcatctctccttcatagcccgaccggaagagtcctctacaccttaggatttgctatttttttcgtttgttgccacataaacctcagagtccccgagatctggtacggtgggtgtgggggtgctttcaaagcagtctggctacagttgattatctgggtcttccctttgataaggatgtctcttatgaaatgaagattttgagcctggtgtgatggcacacattggtaaactcactgtggaggctgagtcaggggcattgggagtttgaggccagcctgggctacaatagagtctgtctccaaagagaagagaggaaggaagggaaaggtgaagaaaaaaggtaagggatggaaaagggaagaaaagggcaactggatatggaggcgcacacctttagccttgacactagggaggcagaggaagtggttctccgagagttccaggccagcctgggccagcctagtgacaggttttataacaaggaaaggaaaagggagaggtttcctcttgcagagcgtccttgggcgtggaccagtggagttgtgttcttgttggctgatcccctcctctaattcttcccagccctctgtgccagccacatttttgagaatggctgtgccggactcctcagccatagcccagggcccaggaagttgtggatggttgtcgagctcacaggcccactccatccactggtttgctggttcagtttttgttgttttctgagacagggtttctctttgcctgagtcagggtttctccctgactgtcttggaactcacctggtagaccaggctagcctcgaactcacagagatcctcctgcctctgcctcccaaattctgggatcaaaggtgtgcgccacctccgcctgactcacactcagttcttaagacccaagggttgtggtcctgcacggtcccaggtcccagctccaaccacgatgccttcatcggcctgtgtcacctcccggcacagtgtatgtgtggattgatgactgaagtctttgcccacagatctcatacgcgttggtcttgtggtttggagtcctttcttcccgtgtaggtgggaatgactcttacctgtgagtgcagagatagaaggagactaactggcggtaatgtgtctttccc

SEQ ID NO: 27475 - DNA, 1124 bp, Mus musculus
ttccaatgctatcccaaaagtcccccataccctctcccccaccccctacccacccactcccactttttggccctggcattcccctgtactggggcatataaagtttgcaaatccaatgggcctctctttccagtgatggccaactaggccatcttttgatacatatgcagctagagacatgagctccggggtactggttagttcataatgttgttccatctatagggttgcggatccctttagctccttgggtattttctctagctcctccattgggggccctgtgatccatccaatagctgactgtgagcatctacttatgtgtttgctaggccctggcgtagtctcacaagagacagctatatcagggtcctttcagcaaaatcttgcttgtgtatgcaatggtgtcagcgtttggaggctgattatgggatgtatccttggatatggcagtctctagatggtccatccttttgtctcagctccaaactttgtctctgtaattccttccatgggtgttttgttcccaattctaagaaggggcaaagtgtccacactttggtatttgtagggttaaaattcttaatgttaggagatcagttatcaatagaatttcacacacacacacacacacacacacacacacacacacacacacaagaggtaagtagggagggagggagggagggaagggtacacacacgtaggcttccacatgctgggcattatattttgagacagtctagctgcagtggaacttgtcatgtagaccaagctggccttgaactcaatgcctatgcatgcctcaggctcctgagagctggttttccaggtgtgtattgccatgtcaaccccatgggtatgcttctgtgtttgtcctttctcagtatgtgtcctcatcccagccccacacagtttagatattgtcttgaaattagatctaaatcttccacctttattctttctttcatttttttttttttaagattctttaggatttcatgtaatttttaggatagagttggggatgtatgtacttgaattgataaaagtgcccagcattcccaaagccctgagttccagccctagtactaaacaaactgatatattggcactttaatccc

SEQ ID NO: 27476 - DNA, 1212 bp, Mus musculus
tttttttttttttttttttttaaagattttgtttattcattttatatatgtgaatatactgtagctgtcttcagacacaccagaagagggcgtcagatctcattacggatggttgcaagccaccatgtggttgctgggaattgaactcaggacctctggaagagcagtctgtgctcttaactactgagccatctcttcagccccctggaagagcagtcttaaccactgaaccatctttgtagcctgttttgtttggtttctgtttctgtttctgtttctgtttctgtttctgtttttttccttccttccttccttccttccttccttcctttttttttttttttttgggagacaggttttctctgtaacagccttggctgtcgaagaactcactgtgtagaccaggctggccctgcctctaactcccaagtactgagatcaaatgtatgtgccaggctcccttctctctttgtccctgttctttcattagggtttttgtttttgttttcattactttttgctgcattttctaatataactaaagtttcctttccaggaaataagcatatagttggcacagtggtttaaataccagtaatctgagctctggaggtggcataggaacaggagcacacacaagacactgacttacttcatcagtacaaattaagaagacttatatagggccagagacatggctcagcagttaaaaacacatgtgcctttgcagtttctgttcccagtgccctcatggtacttctggggaatttgatgcctcttctgaccttcattggctcctaaatacatgtggtgtacatacatatacccagtcaggtgcacagcagatgtttatacaaatctttttaaaagggggctaatatgatctagttctttgcatctttgtataaaacagtatatgaccataacccttccttgagaggttagggtctatttggggacattagaaacaaacaggaaagctagataactagaaaagaattatttcaaggagtaatgagataaatttagcaaggcaaatgcaagattaattttcaaataaattgtgctaataattgcttctagatgaggaaggaggttgaagttggtttgtctaggttaggatttaaatatatttctgtaacatgttttgcttgtgtgtgtgtgtgtgtgtgtgtgtgtgagaaagagagagagagaacctgcaagagttga

SEQ ID NO: 27477 - DNA, 1438 bp, Mus musculus
tgggtatataacttagaacaaactactgcagtgttttgaaaacatttggcggtgcattcaggagtgtacagacagtggccgattttctgctgcgctgaccctgtgttcttctgttaacagaaatactgctgacatctccctagtgggactgactgtacagatgacactgcacaggatcatcaggacgtggcggcgagtcattgtctaagcatccagcttggaagcaaggccagcgtgaccagcagcggggtctgtgctgtcatttgagcagagctgggtctcgctgaagcgcactgtctacctgatgccctgcctctgtgtggcaaggtgttctgcctcatgaggatgtgattctggagatggggtgttcgtaagcaccgctctcttacgtcactcccttctgcctcgccagccaaagtcttcacgtagatctagatggctagggtttctgtcttgcagcactggacgagggggcacagtctgccttctcgcgtgtcgtcagcaagtagttcgtgtcgctctcctgtccagtgcaatcagtgtttctgcgctcttgtcctttacaggtgtagtccccagagtctgtcgtcctaggtctctcctggtgaggtccccgtaccctgtaattctcaaggatttgtcattgatgttaaatggctttgaagaagggaagatgagatggcaatattgaattttcccgccccaatgtgcagccaagcgcactttactgaggaagtcacggagaaatgcaatattcctgagggcgtgaggaatggtgaaccacattcctgctttctgtctgcactaatctgttaggacaagaacacgattgtcgtttgtttgtttgttgtttctttcaagtactggcgtcaccctttgcctatatggtggagcaataatgctttgaaataaacttgtgaaacccaaggccaggtcctgcactctgagtcagaagcgagcagtgcttctgtggacacacttccttccctttgtaaataggatctttaagatattgtattatgtgaaaatatgtacataccttttttgtaggccacagcagctcatttttacagagtttgtgaagctaaatatttaacattgttgatttctgtaagctccacgcagtgaggttacaggcagcggagacatctggaaggcccagcctggggcagggcagcctgcagctcccctcgtgttacaggcctcactctttaaaaaggctttttaaagggatcatttgtttagatgtaggcatttaaattttttaaaaattttctttaccagagaactacgcactttgttaatttgtggggaaagaatagatatggggaaatgagctttaaacgaaaacagaaaaccgccaagagtctaaaaacaaaaccgaagcaaattgattttaaaaagaatcttgtgttttttaagcagtccataaattaaa

SEQ ID NO: 27478 - DNA, 1559 bp, Mus musculus
ccccagctccaggccaactggttggtaccccctttttatatggggagacaaatgaagtttattatgtttttatattttctacttactgatttttattggtgccagttcaaaattcggatttccttttaatagcctctcagataatttgttgtttttacctgaattgtccttaaatcttttttgggtcattctctttgtactcttcttgcctacctcgcctccactcctccctggcccctctttaaacctaggtgtccttggggcaaatggtataaaagtattcttttcatctgcttttatgatgtggggacatttccagtacctaccttttttttttttttttttttttttttgctgaatccaaagatatataaataaaaatgtattttatgaagatccaaatgatattaaggcaacatgtttcttcaaaaataaatgaagctgtactgttgctgttggtatcagaacgctttctctctaaactgtgcccctgtcattaacaggcctacccggttcatcagcattagatgctgaggtgggtcggggccagaggcagtgggtactagggcacataattggcttgattcaggggtaggtgcagctggactgtgcagagagtttccagtttacaacacgccagtccagtccctttctatctgcagtagagtgttaccaggagcagacctctaggtgagctcgaatctggccctgccatgaagcaacaggtgtgtttacctccagtgcaggcgattaaaaacagggcggtgttttgtttttctcttgcctcctccctttttctcttcttttgaaaataaggagttctgaagaagacggaaatgtcactccaagagcagtaaattctcaggaactgaccgacaccactgagaacacatttggggttaatcacatttatataagtgtcacttaagatggtgtcattctttacaccgcaaggaatggaaaccattcggtgactcagttgggtgagctttggatgccttgccgactgtctggatgctcttgtaaataaaggtttctatttaagcctccgcctccgcatgcttttcctctctccacacccagggcaggggtgaaagcgggataaggagtgaggaggacactgtgtctgcgaggtcggaacagttcgttctcctgggagcctggaaaactgtgggatagtttagaccagtggttctccagcatccctattgctgcaaccctttaattatgttcctcatactgtggggctccccagccaccggtctgctactgttgctacttcttagctgtgacttcgttactgttgtgaactgtaacatttaaatgtgctctctgatggccttagggacccctgtgaaagggtcgttggagccccagcttgaaaactgctggtttagagaaatgtgagccccctctgctgagtcgggttgggctgacatttccacccccacctccgaagctctgacagctgctttctggcagccatattgaccaggttaccctacctggatgaacaaagggttggtgcagttggatgctttgcttcacagatcgatgcc

SEQ ID NO: 27479 - DNA, 1766 bp, Mus musculus
gttctctctgtaagtctgggggcttgagctattatgtagcgctgagaagtactacaggtgacagacaccttgaaggatgtggctgcagaagcgctgacagggtgtgtccctctcagcagaatggctgtcaagggccatgtgcagactgcagcaacctgcacttgacctcatgtctaagggggttagggggtggggtggggagaagagccaatcgttccccaaggggtccaaattctttgccagattctctcaaaagagcagttcttttccttacggcctaagtactcctttgcatcagccacatccttgaggcaacgcttgcagtgtggggctgacttaaatccagataacactgtaatcacaggctgatgtgcactttgttctgcaggggacagctatgggaaggttgggaaggctaagcggccatagagagaggaacctccaaaaccaggggcctcgtgtggctgcccaggccatgcaaaaaacacccgattcccagaagatgaatgttggaactgggagacctgacagaaggcagggcctgctcttgggacaggaaatcctggaggacagcgcctggactttccgatgctcagtttctttgccctgctttgctctggatcaaacctcactggctgctctgggatgcgtgctcacacctggagtctctgctcaccctttcagaggctcacaaagacaaaggaactaatttccatggacacttcctccagagatggaaattgctgggattcgcccactcctcccctgcacccctcccccagtcatctagggaagcaagcttgttttaaccttcttactctttggagaaagcacggacatcccaggtgctgtcaacctcacagtcttgacaaagtctatagcacaaaacagtaccattcaccaggctggttgacctggctggctcagaagctgccttcaccacatacatgaccgctcacacgtaaccaacacagggaattgtaggggaatctcactaatatgaaatcccgcttttcaagagtcgcggtgtcaataaacgctgtggctaggatcaaggataatcccttgagctttcagacatttattcctgcccgggattcgttcctttgttatccatcccagaactgatgtttttctaaggtaccgaaaccccaagttgatgtgtgtcctgtgttttaatgacattgtatttgtaaagttttgtagtataagtaccatcttacagtgttcctgcccccagccaatgtctagctattggtatgaaaaaaaaaatctttgaatttttgtaaaaggctatcttgggacttttttgctctttattattatcatttttttcttgaagcactcaagatgttgtcgaccttcagctgagggttggagaagcagagggtaatacattaatagtaaacctctccgattcaagggacctcataggtaagtctcaccagctttggggcatcgatctgtgaagcaaagcatccaactgcaccaaccctttgttcatccaggtagggtaacctggtcaatatggctgccagaaagcagctgtcagagcttcggaggtgggggtggaaatgtcagcccaacccgactcagcagagggggctcacatttctctaaaccagcagttttcaagctggggctccaacgaccctttcacaggggtccctaaggccatcagagagcacatttaaatgttacagttcacaacagtaacgaagtcacagctaagaagtagcaacagtagcagaccggtggctggggag

SEQ ID NO: 27480 - DNA, 1199 bp, Mus musculus
tctaatctggagcaggcggaaatgataaggtcaacgggttctcaaacctccctcaaatgaccactctaatggtgagagcagcagacagacagctgagggactgacaagaagccaagtggcatgtttgggccttaatgtccaaagaggtctagttatgacttgaaggaaaagccatcagagcatactgaccacgtgcttccacagtccacactggcagatccccctgctcccaaaacgcatctgtggcccacacgtgtggaggtcgggtcatcttgcaggagttagctctctccttctaccacacgggccacggggatcaaactcaggtgtggaagcatctttacctgcaaaaccacctcactggctctcctgacgttcaagttgtttagcctgcccagtgtaacgacctcccgatgacccacttccggggatagctctcccaagcccgcacagcatgcaacactgagactggaacttggggttttacccctgtcttgattgaaggcccatggctggggctccctggacagcctgtcccagcctctctgacttatcatccctcctggcacccacagagtataagaccagctatgcccggaaccgctccatccgttccgtggccatcgaggtggacggtgagatataccacgtaggcttggatactgtgcctcagccccgcaaccttagcaagccgcactggccaggggcccctgaagaccaagatgacaaggatggtggcagtttcagtggtactggtggccttccagattattctgcccccaatcccatcaaagtgacccatcggtgagagtctggctggaggttgggggtagagggacaggctgggcctctcttctcccctcggggccggccactcatgaccctttctctggagcaggtgctacatccttgagaatgacacagtccagtgcgacttggacctgtacaagtccctgcaggcttggaaagaccacaagctgcacatcgaccatgaggtgtggccactggggcagcacaggctggcggccagcatccacaggaagggcggggggcctggtgaggggagaaagcaagattggtcccccagaatccatgaccccatcccagaataggaatctgagtcatggggtctggaagccagccaaaggtccagctcagagatggctggctggctggggacagcgcagcatactttattt

SEQ ID NO: 27481 - DNA, 1186 bp, Mus musculus
ggcagcagaaaccaacctgtctgcttccaccatgctcacggccacaaaccagagtccagggctttatcatccataggaatcactgacttgtttgtttgtttgtttgtttgttaagacaagctgtagccctggctgtcctagaactcactctgtaaaccaggctgaccttgaactcagacattcccctgcctctgtttcccaagtgctggtattaatggcatatgtcaccaccacctagcttgatctcttattttttaaaggacatattatctattgtaaattattttagtatttctatagccgtatttcaagtcccttgtttcttccctgtgaccctactatagactttgaactcgtacacatgtacttctgtgaggaggggccctgggctcccccttcctgccaaagggcagaggggtgtgttggtctctggctgtgaacactcaagtcagtcagcatcactgagggttgccaaggccagggctggctgctctcttgctcacctctgatcgccgatctcttccagctttcttcggaaaatacctcaatgagtacaacggctcatacgtgccgcccggctggaaggagtgggtcggcctacttaagaactcccgcttttataactacacactctgccggaatggggtgaaggagaaacatggctcagactactccacggtaagctgtgcacccccaggccccaccaccgcctcccgagccaggggaaccctactcgtagctcaccctgtggccttggagaggatgctcgtgcctaattagatgtgtggccttgagcatcgtccagtgctgcttctcaggttccccatcgctccactgctagagttaactcagatgccacctcccgaaagaggccccctcactgttccagctaaatgacgtccccaagcccagtttctggagtctgaactccaacattcaacagtgacccagaacaccttgatttctctgtaccttcgtctctaaggagggattgttaccatgtccattctcagaggaccataaacactcaattgtggtatcgttattcttttgctgcccctcccgccatgttcccgactctctcctgctctcttttccttcgccaaacctcgagtgttgtttcttttgtttctgtgataccctgacaaaagcaatgcctacatgccggggctgttccgttcccctg

SEQ ID NO: 27482 - DNA, 1148 bp, Mus musculus
tgtttgtttgtttttgaaattttgaaacagggtttctctgtcctggttgtcctggaactcacgctgttagaccaggctggcctagaactcagaaatccgcctgcccttgcctcccaagtgctgggattaaaggcatgtgccaccactgcccagcttaattttctttctaattgtaatatattttaaatttttatttatatatataaatatttatttatatatatatatatgtaaatgtgaggatatgctgagtgtaattgcccaccatggccataagagggtgccagatctcctggagaggcattgtgtgcaattgtgagccacccagcttgggtgctgggaaccaaacctgagtcctctggaagagcatcatgctctcactagctagcatctctccacaccccctctagttatcctagggggaggagtgatggtgttctatttactttcttccttgttgaagtctgagccagcacagaaagaatggtgacaaggttgggagccagcctggatctgggaaagccacagcggaagggcctggcttcttcctgatggcatttgggcttcctggacgtacacacacacagagagagagagagagagagagagacagagagagagagagagagagagagagagggagggagggagggagggagagagagagagagagagagagagagagagagagagagagagctctgttctcaaaggtcccacgtggaagggcccagcactgtcctctgggcccagagcagcccagccccctcctgccttcccctgcaagcaattccttccctatctctctctcttattttgagagttgcaccagcacccactggttactccacagtcacggggcacagctccgatcagtatgctctcaagttatcctaccctcctaccacagtcaaggtcctgggctggccttgctcatagtggagtgacttgggacctcggtgtccctgtctggaaatagaggactggggtataacctatgcgcagaatagtttgtcccttaccccggggagaagctctgggtctcccctcctgattaatatggattgctgtggttttattaatggcggcatcattgttgaccaatacagacacagaaatccaccgtggccagatggccccaccaccaa

SEQ ID NO: 27483 - DNA, 1152 bp, Mus musculus
gggcagacagccaaagggtcagagagaactgcggtttcagagtcccccgctctggcagcctgtaagtgacttggacgggatattcaaggagcgtttccatccacagctggagttgatgatgagagtctctgctgtgtgcagcggtggaccgagactcgtgtagacatgcatctagacacggttaagtgctactgagcacaacgcctgcagaacagcaggagcgaatcaacacggagtcactgctttatattgtgattgccggttgaaaaatgagattctcggggctttgcaaatttctgttatgtcctggcaggcttcctctcacaatcctaatggcatgtgcagctctggctaagccccgccccctccagtccctctccgttttctctgtgtgcaggtgtgtgtataggtgtgcgtgcacatgaaggtcaaaggtcaactttaggtgctgttcctcaggctcaccaaccttgagacagaatctctcacctgcttgaagcttgaaaattaggctaggccagtgggccttgggatcttcctacggatggctaattttccaacggtctgcctctgaaccaagcttttccctggttctggggatccaactcatccccccacagcaagcttctctccctttctagatgagctatgctgaccacccagcaaccttttcctcccctaccatgaccacaggcgacttggaaagagtgtgttcagtttacagattgtcgtccatccctaagggaagtcaggacagggactcaaagctggaacctggaggcaggaactcaagcaggggccacggaggcatgctgcttactgactggctcagcttctttgcaaacagcgcccctgtccaccaatccaagtgtagtaccgcccacagtgggcggaaccctcttccaccaatcatctacggaggaaaaaaaaaaggttcaaggacttgtctacagaataatcttacggaggcattttctcagttaaggttccctcttcccagatgacccaagtttatatcaagctgacaaataaataaataaatcagctcaagcatttttttttggtttttcgagacagggtttctctctctctctctctctctctctctctctctctctctcgatcaaagaaagttctcagctctaactgtgc

SEQ ID NO: 27484 - DNA, 1194 bp, Mus musculus
ttacatttccttttttttgttgttgtttttgttttgttattttgagacaaagtctcttgtagctgaggctggccttgaactccagagtgctgggactacagatacgagcttccatgcctggttagtctaaggcaatgattctggagcctttaaatacagctcctcgttttatggtgaccccaggcatacagctaataaatatctgatatgtaggctatctgatgtgtgacccccggtgaaagggcagttcggtgcatatagaagtcacaacccacaggttgatcacacccatgtaagcctttatcctctgggctatatcacatccccagcctgtgagaagtgcttacagctgggtccagcagggggcagcactgggcatccatggggtcgctggtgggacttccaaggggcaaagactgctgggtagcttccccctctctctcactgtggagtcagagatgaggtgaagcctgctctttgatgagccctgtggcggtgccctgccagcctgtgtcctcaccttcaaggcctttccctcgctctggcaggctgctgtcaaccatcacagagcccacatcagctgcccctgcgccctgtgacccatccttggtggaggagacctcatcttccccaccggtcagtgaggagagtgaagtggaccggactgaccacagcggcatcaagaaagtgtgcttcaaggtgtcggaggacgagcaggaagactcgggccacgacaccatgagctaccgcgactcctacaggtgcgtgcggcccacaggaggtcaccggacaactgaggcttctgacctgtgggaaagtcaagactgtggcatttcccaagatgaagggcatcagtctctggggctaacgatgtgtgtttggtggggcggagatgcagggccgggggcttctgatcctctcagaggatgttccacagaacttgcctgcttgggtcccttgccttgagctgaggcctccgagcctggcagatggacaccattcattctgtgttactctgtatgctcgcaggctggacgagagtctgggttctgtggtgtgtggggcttctgtagatccaaggagtcagatgttttcttgttttcctgcctccgaggatgggagtggtatttctgcaattgttaaatttattttgaaaataccagtagggtgttaattagttaaccaggcaaaacc

SEQ ID NO: 27485 - DNA, 1174 bp, Mus musculus
caagcactgtagatttcatttctaacatcaggggacatggtctacagacgtacagagccagagaattttgggctttgtgtctctcgtgagagcagcacatggttggtggcccagaacaaccagggccgcctcatgaggtctttgaggatccccctctctgtttttctattctgccaccattacagtgttttaccctgaggtcacattgtgattgcagaagcaccaggcatcacatcttagttccaggcagggagtcaggaagaagaggacagcctgtgagcacaggaggtttgccacaacacccttattcctagagggttttgttgcgtctcattgtccaccttaactgccagggtggtcgtgaaatggggggagtttcagggatcaagaaagggctgttgctaggagtttatcaggaatggttcctaacatttctggggaccttggtccttagtatgacaaatctctgccctcatgcaacttgtgtttcccgatagtagcccatcttaaacgattcagtgctggctcccctcagagcagcctcttctgttccatttcagggggactgccagacacgggaggaggccgtggcgcttggtgtgggcctgtgcaacaacggttttatgcaccatggtaagtgcggggcctccagctttgcttagggccctgagagccaagagccagctttgcatacccggtgtctcagcattgaaggtgaatgctttggtctcccctgctcccaggtggcctggtgtcctcctatgccccactcccattacctttcttggttcctctctcagagaaactgagttctccctttgagtctctgactcctccctgtgggtggccactgtgcacccaccatggtgccatattgtagtacagagtggtaaacgcagcggggggcttggggctcgggatctggcatatgtgcatgtgtggatcctccttgtatatcagacagacacaacccatcttgtgtatgctgataagctggtactgtggtccaaatgctgaggcttggatacaggtacagactgcagaagtgtgagctttgttctaacttagatttagtgaacttgctctgcaaagggccaagcagctgccacaacactggaacaaaatgggtgtggctaggtgccaataaaactttatttaggaaaactggccgggg

SEQ ID NO: 27486 - DNA, 1120 bp, Mus musculus
caggagatacaggtattttaagttcaggctggaaaacacaagacttcaaatggtaccactaatccaggcctggtggtatgggccgattatccctgctatttgagaggatgaggcaggagaattataagttctaagcctgtgtggcctacacatggtaagttcaagggtagcctaggcaacctgatgaaaccttgctgtatcagttacccaactgttgctatggcaacataccttgataacagcaaccttaaggaagggaaatactctggctcacaattccagggtacagtcagtcatggcggagagggcatggcggcagaggcatgaggcagccactcacgttgtgtctgttgtcaggccacttggagaggaactctgccctcagcatgctttctcctttttatgcagtctgagacccccagcctgtgggatggtgcctgccccccacattcaggatgggtcttcccacctcaccctaacctaacataatccctcactgggtgtgcttagcgacttgtctcctgaggtgactctagatcttgtcaggttgacaatgatagtatatatctatggccataccaccctgaacatgctctatctcgtctgatctcagaagctaagcagggtcgggcttggttagtatttggatgggagacagtgatagtatagtagtcttgtattgccacaagacaagaactgaactgagagcctgggatgtagctcattggtagagcacttacttgtctggtgtgctgaggtcctgggctcagtctcttaacactgcaaataagcccaagcccacacaagtacaaacaggatggggtacgtgtggccatgctggtggtgtggtcacgctgggtgtctggctccttagtggtggctggcaggtgtccgaagctttcttaggaagcacggtgcccggagcctgtggatacccagctcccattcccagagacccctgtaatctgcagatgggattatgatggggctagatgctcacctacagtctcaagtattttatgtgcctgcatcactcctgtgtatcacatgtgttacgtgatggcctctgacgtgctccctgcaggcagagctctcactctttctttgattcatagaggag

SEQ ID NO: 27487 - DNA, 1204 bp, Mus musculus
gccacatggttctgggtcaggcttgttcctgttctaacgggggccctcactgagcggggaggggttagaggttattttggggtccctcatcacctttttgggccctaaaatcatgaatgctccctgaatggcttacagcagccatatgatcctgggctaccgactgcgtggtgcctcagtgtccccgtctgttgttggtgccccactggagttgcctgacatgcagacttggttattagcatgcacgtgtgcacatgttctcccatcaggcagaacgggtgccagggtggctatcctcccacgtgcaccaccgtcattgtcgttgtcatcatgtttctgcagaagtggggttccctcgtgcacgtgacgctgcacagttggagttgtttgctgtatgtgagcgtgtggtttattcacacccactccccccccccacttgctttcccacatttccagaaataaatgcaagctggggtccttgggccgccgaggctgcagcatcagggatgttccagcggatggtggagggacagggcgggtggtgtgaggagccctgagctgggctagttgtgaccccacagtgtgggtgtgaatctctggtgggacccctgcctgcagagtggctgtaggaaagtgctgggctctgcatcactgtcttgacctgggctccctttggatggaagataatcagtttctcccggtcctgcccaacaggcctgcggagcttttctctgctacccacacctcctgtttcttctccccagcatatggctcacacacatttggtcctaagctccgtggagattgatataaaccaaagcgggcagagtcagcgcagcagagacctggccagcttcttgtcttcctgctcacctccccagttcctttcctccaccctccaacccatcctccatcttacattaccttggccctcgccctctttccctgagcacctgtggccacagaggcctttgctcccacagccccaccccactccatttttggttgcagggcacggtgggggtggggggttgaatccattgcctcgccacaccccagtctcccttttactttttattttgagataggatctcactaagttgcccagaactggcccagaactcacttaccctggagtcttagcttagtgtcctcctgcctcagtatttggtgtagctggggtttacagacccaagtcagtggg

SEQ ID NO: 27488 - DNA, 1150 bp, Mus musculus
catgggctgagtcttttgtttccaggtgagaagctgcggtccttgtgagggacactggccctgcaattagacagagtcctgtccccagagccttggggactgtcaccctataatccagtgtcccagaagtgagtcctggaggagccagctgcttgtcaggatatgctgggcttgcagttctacagagtggggctactctgtgcattgtggaacaatttcagtgtcatctgtcaccagctagatgccaggatcagcctctgcccagtgggactgactatcaggaaagtctcagaagtcaccagatgtcccgtgaggggcggtgtgagcagagccttctgataagaaccactgggctgggctctctctggcttccagctttgggttccaacctttgggtgctcatgtgcactggtagcaatgtggggacccactgtgtgtgtgtgtgtgtgtgtttcggggaggacctggtgtgttgtgcttctcacccagcagtgtggcccctgtgttctctctcctcttacaggtaagagcaccaactctggctgcgctcatattttggctctgttcctgggaccttggacctgatcctttgcctctgtttgcccgcctgtgaagtgtggctgcctggagccatccaggatcccttcctgcagtgcatgcagtggtctgatctgggagaggggctcagtgctctgggttttctctggtggctgcaggttcacggtgtccctggaagttggggaggagggaccttcatcctccctgtgccggagcacgggaagtttcatctgtttcttcactttctcgggcagcagggctcttcctttgtcttgtggtcaggcgctcaatctgtgtttgtcagtggtctggttcctttccccagtgtggagctgacagtgctcccttgactctgggcggaggaggccagggtgtcatagactggtgttggtaggtggctggcagcctctggggcctgggtgtcttctgcctggaggacagagcagagtgccttcaccgagagcttttattcatgaattcacttcccatttggtcgggggacacaagtatgtactaggttctgagtgtcttgttgtgtctcacagagtcctcagataccacagaaagagtccttgaaaatgatgaattgttg

SEQ ID NO: 27489 - DNA, 1102 bp, Mus musculus
gctgctgtgtgggtgctgggaattgaacctgggtcctccggaagaacagccaggcctcttaaatgctgaactatctccaaccccaagaagaaaaatgtgtttaaagatactatatagattgtcattaattttggtgagaactctaagtgaccaccgaaagctagagtgcttgactgatagagttcttactggaacctgtttctgtgacaggttatagccagttatagcatgtcaggggagtggggagggcttcagggcttcatctcaggtcttgagaagtcagccttctgggattcaagacttcctggattcaaatcccctcccttcccttgctgtatttatagttaatcttacacgcttgtcagtgttgctgttaaaatgaagttacttggcatgtgcaaactcttggggtagagcaggtgctctgcagatgcttgctgcctcgattattagcacagcatctattagtctttcaggagtcacttagtgatctgcttggtttgtagatataataaataagagtaattacgggactggagagttggcttggcaaataggagctttagtgctgatcccttccagaagactttggtttactctgagcacctatatagtaagtggttcgcagcagtctgtaactccagtgccagggcatctaacaccctcttttggcttctgtgagcaccagacacacacatgatatgcgctgtacatacgtgtagacaaactcacgaaaataaataaatctgttctaaaaaaaaaaaaaagaaagaaagaagaagatcctgtgacagaaggctgtgctccttacagtgctgatctgttaaatgcagtgaggacaggagttgtcttttgtaacagcagcgatgagcagggtagaacaggattggagtgactcagtgagtcatctctctgagtatcagttgcataggtagatgactgtccaaatcagggctggtgtcctaggcaggggaaaccaagggcctgggagagtatttctccccaaggacactgttgctcttgtccctttaatgaagcccggacatgccttaatcatctcctgactttcggctccagccctctgtttgggagtttaattcca

SEQ ID NO: 27490 - DNA, 1149 bp, Mus musculus
ggccgtaaaccagcttccagctgaagaaagcacctgtgttttgaattgttagtgaagctttgtggttttgagtatatatgttgttttgtttgtagtttacagattaattctctgtgcatgctttgagaactagggacacctgagcttatgaacatgggctttctagactgatttcttggattcatcccagctctacctggaacgttctctggctctcatttcctagtctgtaaggtttacagagtctggccttggattctggcctgcttctcttgttgctgctcttcagttgagccactgagcttgtgcagagcctgcatttcgtcctcagctgatgacgtactctttaagcacctttcccacctgtaggtgtttgtttgcagccagtgaagtattgcttctgagtccttcccattccttgaaagagaaactatgagccagtagcttcgtggccagggcggccaggagatcagtcttatctgggcatagttattatggaaaggctgaatttgctttgagttgcaatctgaactttcttgtaaagtctgggcttgcccactgggataatcagagcaaccaacatcctgggttagagtctctagagctgccagtgccagccactgaaggctactgctctgctgtccctaagatgttttcttcccgatgcctctcctgacatttcgtgattggtgtgcataggctttcaagtgtgtagccctgagtttagtcttgttggttttggtgccttgcatcgacagtgagcggctgtactggtgagatttgtgtatcactggcttagcaccattggtatccagaacagatggttggagattcagagaccaccagcctctagcatgggcttggccgtatctgatgcatctgactgagccctaagagtgctgctcctgaccagaagaaaaccttacacttgagttggcagcagggtgcatccggtgtgtcacaggaacttgcaaagccattgcgttatgtcagatgatggaagctacatcctgtaggccagtcttgtagccttctgttggaggtggatgagttatgtcctttaaggacagggtccatgttggctgttcctttcacaagctcgggtgtcacaggcctcgtgggcagttacctgctgctttgttaggcagg

SEQ ID NO: 27491 - DNA, 1786 bp, Mus musculus
acttgtatgtatatgtaccatgtgtgttgctaatgacctcggagatcagaagagtgtcagatctggccagacagtggtggtgcacgcctctaacttcagcactacaggtcaatctctgtgagtttaaggccaaccaaggctacacagagaaaccctgtcttgggaactggagttacagatggttgtgagccactatatagatgctgggaatggggcctgagtttttaagcaacgagagctcttaaccactgagccatcattccaacagatctttttccttttgtttgttttttgatagagtctcactttgtagccctgactggcctggaatttgctctatagaccaggctggcctgttaactcacagagatccaactgactctcctactcaagtgctaggattaaagatatgtaaccactgtacctggtggatttttggctttttatatctgacttgatggtggtaaggagattctttgagactgatagataaagatccctggattgggtaattgctatgacaaaattcttgaatttaaagtttattttctttggtttattttggctcccaatttgaggactcagttgttcattgtggtagaagggcctggcagaaagagctttgggtggctagacacttagatccgcagttagcaagtagagtgtgacggaacctggagcttgcctccatcctcacttctttgcaggctgggactctcgcccatggcatggcaccacagatattaagggtcagtctgtcccttaatgaacttaatctgaactccctcaatcatgcctgaaggctcatctccatgatgactgtagagcctgtgaggggtgagaatgaaccagcacaagcccgtgctcacggcagatgaggagggaagagtatggggctgagtcttgtgcacggacacagcctagggctggctcttcaaactcagctcccacctgggtcctgtcctttatccactctgtgttggggacaggcaaaagggagtaggaattggaccctcttgttctcagggcctgcagggactgagggacccatcctgtgctctctgccttcatcctgttggcacgtaggggctgtttttatttcttaaatcattggcctcggaggtctgcttggctgggcacagtgtgtatttctgtaatatcagtctttgggtggtagaggcaggaaagtcaggagtttaaggtcatttttggtcacatagtagctggtaaaagatcaaaggcttttcaaggaacgtacagttttagtttgtaacgcccaatatttggcaggcagagtcagggtcacgagttccaggtcagctggacacagtgagaccctgaccagaccagaaacaaaaagcagcctcctgcctggcgttctacgtcctgtgcgccaccactgcctctcgttctctctgcaggtcccacgagcttcgttccaaggtggtttccctgcagctgctcctctctgtgctgcagaatgctggcccagtcttcaggagccacgagatgttcgtcactgccattaagcagtacctgtgtgtggccctttccaagaatggcgtgtcctcagtgcctgacgtcttcgaactctcgcttgctatttttcttactcttctttcaaacttcaagatgcacttgaaaatgcagatagaggtaatacttcagctagtgtttttatttggggaccttaatgccagataagaagcctgcttgtgagccactagcctgcaatcccagcacttttgagttagaaacaaggcaatcaggaagtcagggccagcct

SEQ ID NO: 27492 - DNA, 1196 bp, Mus musculus
tcctgcctctaccttctaagtgttgggattacatgtgtgcaccaccacacccagtactaataagtcttggctgaaggaattatttaattaaaagaaagaaaactattctttcccacccttccctgtgacagtcttcctgtatctgacctcagactggtcttaaacttacaattctcttgcttcactctccccatacccatttcttaactcaagcctagagggtaatcacctgcattggctcccagcttcgctagtcagggttgtggtgtaacatttaaatctgggagcagtctgacgtagctaggagtgaagaaagagtcggtaacactgagggtgcttacggtgctgtggactgacagggccgcaccagcagttccagagccattctgtcatttgacagagtgagggcctggtgctctgcccaggccaacacagccagtgtaggcattcagtaggctgctgaaggaatctggctgtcccctggtgtgaagtgcccactcctggcttgacatgcctgtctcttacctctagagtgtgcagtgaagcacttgcctatttcattactgtgaactccgagagccatcgggaagcatggacgagcctcctgctgctacttctaaccaaaaccctcaagataagcgatgaaaaggtacagagtgaactcctcttccctgttcgctctggtcacagggacaggtgtgcttttcctccagctgagatgactgctggagacagttcattgggaaagtgggtgccttcagataacagcttttcccaagaaccccagctgagaaaggatgacatgtggaccgtgtgtgtgtgtgtgtgtgtgtgtgtctgtgtctgtgtgtgtgtgtctctgtgtgtgtgtctgtgtgtgtgtgtgtgtctgtgtgtgtgtgtgtgtgtgtgtgtgtgtgtgtctgtgtctgtgtgtgtgtgtctgtgtgtgtgtgtctgtgtgtgtgtgtgtctgtgtctgtgtgtgtgtgtggctgttgggctgagaagggatggcgtgtgtaccgtgtgtaccgtgtgtgtgtgtgtctgtgtgtgtgtgtgtgtggctgttgggataggactgacctcagtacagaagaggctgtggccgtgcagtgatggcgtagactagaagcccactctgcaggttggaagaagcctgctgaggccagcgaggctgtttgttagaaaag

SEQ ID NO: 27493 - DNA, 3613 bp, Mus musculus
tagaccacactgcccagctagagtaagtttcagtagcgagaaagcgcagcaacggtactccaggtgccgtagcttaggctgaggtggacacatctggaaaacgggtgcagaaaggaaggtgttccatggctaacttggctctctgcttcctcctgcaagttcaaagcacacgcgtcaatgtactacccctacctgtgtgaaattatgcagtttgacctgatccctgagctccgagcagttctgcgaaagttcttcctgcggataggcctggtgtataagatatggattccagaagagccgtcgcaagtgccagcagcactgtcatcgacctggtagcactggctgcatggccactgctgtggttctgtagaacatccgccatgccgtcccagctggcggagggggagctgcccacctagctgggtttggacctggagtgcagtggcgtgaaccctggtcagcacagtccccagcggaggctcatggtgtctcattaaaccatcacataccagtaactcggtgggcagggagtctgttcccccgtccttgcattccgctggctgacctgttagacctgtccttgtgaatgccaccgtttcctctaagactggccattaatgtttcgtcggcggaagtcgctctcctgggaggcaatgagcattgccgtataggttcctgtttattagagagtatgctaataaaagtccttgtaatagctcacagccacctaagtgcgcggtgttttgttgtttgactgtgttagagaagtttgaatgtttgtgtcagttttgggtcagcctagataaagatgggaaagagggagtgttccttatgtcttgttttgtaattgtttgagtggtttctaaaatattttacaaagatatattattaaaaatttgattaaaggcagagtttagtagacttaagagcttgcaaggttttaagaaaatgtagtgcctcgtggctccctggtttagtaacttggagagacagtctgtaggaaaaagataatctaaaaaaaggtgttagccttccttgaagtatttgtgggtggatgttccgttaaattttccagaatgcattgcacatctttttatgaaatctagactatgaaaaggtgataaacatgaagtaactgacccagagttggtttatctttgagtaaacctttttagtttttacctcagcagagtgttagtatggctgctttgcagtccctgctaaagggaccaccagagggagggacagttcgtacggccctctcagcacgcgtcatgagtgggactggagcccctgcgggactagcacagctgggctgtgacagtggcagaggtggcacccagagcttctgttaacttgagccgggagctgggttctttagcaagatgagcttctggggtccttatgttggtaatggtgccatgtccagacccacagcagagtgaagtctgagtgctcctaacaacccacagcagccacgctagaagcttaatggattcggagcccatgagagaaagaacacaggcttcctggtctgccctccccctccgctcaccaggagctaaactgagaggctaaactgtgtcatgaagcgcgttggaaacagacttctgcctacatcgagtcctacgaattggggttgtattgatgtcactctggtgccttagaagtcagtcgtccttgggaaggtgtctgcgagactgggccctttcttctctccagagcaggatgcctggtgctcttgctattctctctctcgtttctgacagccttggcacatgctcggtttggccagtagaatttgtatttatgctttttttttccccaaaagtattttaatttctctaccaaagggggaaaagaaagcaggctgaggttattattgctaacacacctcagccgagcaggctatgtacctcgaagggagggcctgggggacaatgttaccgagaggagaatgtgagcacatttgactgacacggcctggaacccagtgcatcttttcacggcactgccgagacgtactccctggtgttgccgctcacaggccctcagctgtcggtggttcctgcagcttttgttcctcgcatgtaatcagggagcacgcatgcacgttgagtgggtgcatcctgcctaagctgtgtccctgagtggtggctttccctcctgtcacgtgacatcccattcactcatctacactagcccagtgctcccattgtcccctgcctcctctgtaatttttgccccttccagggtacggaatgtgtcagtgcattttctccttgctgagagtctcagctccaatctcttcataattttgttctgtaaaagatgaacctttccgagtgatgcattcaaactgtctagcaatagatcttttaaaacgatgtaaaaccattcagggtaatttttcttgtcagtggccagtggcatccctgacctccagaaagaagccatgcagtataaactccttgtggtgaacaagtctgttcatggcaaacgtggctcgagcccaccagacaccagcgcagagcgggggcagcctgccccgctgtagcacaggagcaatggtgtagcgtcttccaaggccttacttttttttcagaatgctttaagtgttggctgtatgtgctgggttctctaaagaagtttctcttcccgagctgtttttccgagcagttttgttcgtgtctcttaaggaaatcaccagctttggcatctgaccaacaaacagtgagtgggagacgtgatttccgatgcgcatcttcagagtcaaacacaccctccctcgtgtacaaccaaagaacaggcattatgaaattgtatagtaatatctagaaacaccacttccctccaacctgcgacttttgtacaaaattcagagaatctgtaaagaaccccccacccctcaaaaaagcctaagcacttgctgttgttcttttgtgattatggctgtacatttagttgtctttctagttatgaaaagaacgttgacacacgtaggcatggccgccccactcaggtgttcgttgttacagtgctaatggatcctgggtgcagtaggcgctgggtcctcctgacctctgtttcactgtttgtggtaaggtagccacacctggagctcacgtgtaacctggagcgctgtgctaccagtagctttggggttttggaagcagacacaccaaagccgagcatcatagagaatgaatccctctggaaacacttactctcagaaaatgacactcttcccacatgtggggttttctcagtgttctaagtttttaagaagttttatcttgtgtatttgcatcaaacatttctttatgtgctaaatgtttgctctttaaaaatgtctcagagttagttaccagcttccttgatttcatctatacacaatgattaagtgcatttaatattggtaatttaatgaaaagcattccttgcccaatggatgtaaacatttttgaaagaataaagcagaattatataatatgaaatgctatgtaaagttttctatgtaaaaaaatattatgtataatactgttaaataccccatgctttgatcaggtggaaaaaatcaataaagttttaaaaagtaaagctgctcccagtg

SEQ ID NO: 27494 - DNA, 1177 bp, Mus musculus
agaagctcaccaattagctagacaggccggccagtaagccccagcgatcttcctgtgtctgcctccccaggtacggaattgtagtcaggctggcttttatgtgggtgctggggattcgaactcccgtcttcttccttgcgcagctatcacttgcttaaccaagcgtgctatcccctagcttgaaattcttactcattcgtttattctatttgtcctagaacagacgctctgctctgtcccttcgctcaggcgtgaacgagcacgttccatccaacagttagaagccactaggagccactcgcagaacctgctagggtctgaggaaagaaacccaaaacagaagcctgcgtcaaaaggcacggtctcttgtgacgtcaccgcagacccgagcaatggttccgattggccctcgcagccggggtggggccaaagcattcctggctccaccccgcgtcccggtctcactcgcacatgcgcagtggccgccaccttagccgccgcgccattttgccagggtttgaatgtgaggcggagcagcggctggagtggggtagtgtcggctgcagctctcgcttgggattccctcctcggtctcggcgtccccacgaggtgaggcatggagcgagcagggtggccgcggggacgcggctgagggaggggccgatcgctgggaggtggatctgggcctcagcccgaggacgcgcgcctggtcttccccgcacgccgcctctgggtcgggcctgaccgctccgggaagctggggcagcttggggctcggcctcacgcgagcttctcgagctcccgccccttcccttccagcgttgctgggattggtcgcgccgccgcgtaggcgtccgcggattggtcaagcccgcgcgtccgttctcggcgcgccggggcccgcagcgtgagcgctgttccgcgccgaggcctgacctggccgagccggtctgggtccctggttctaaaagaggccggagatcgcccactctgacttcgcggggctttggcctccgccagagtggacttggccctcgggtttcagctggctgtgacgttcgtgtccctaggacctaaggaacctacaggcgaatggtgttcccctgcctggggctcgccggctttccagttagataatctgtccccacgcacactccgtctttccctaggagtgtaa

SEQ ID NO: 27495 - DNA, 1217 bp, Mus musculus
gcataaaataaatcttaaaaagaaaagaaaaaaacaaaacaaaaattaagactcaaaaccagatctaccactagccctcttgagtctttctttgtaggaggactgactgctttgagttgaagttgaagccagcttggacaacagtattaagacccagatggaaatctaccaatgaacccagaagagcctgcgagtcatgctggaatccatcagggttagggttaggaatgctgaccatcagtttccagtggagaagccaagagcagaagacaactatcttgcctccccaggccctccaagagttagccagtcaattgtgcagccacaagaaagcctttccccacactctcagcaggaatactcaccacagcttagtgtactccgtgtccatcattggtggacactctgtgagtaatttggttatgccaactgcacagatttttttctccacgttcccagataccttttgaatctctggaataatgattttttccaaaaccattccaaacattctattaataaaagcagaacaaatgcactcaatactaagcatgcattatactcagacagtaagatagatataattcatacttagtgacgtggtgtgactggagcccagtactgaatagtaagggcactccccatgagtctgtctcagactgactgctatggcttctgctgattacatagtgctgtggggttacaccttctcttaagcagtctttgcagcttttggggggaggttaggagaaaaaatatttgcttaaaatgttactcaaaaattgttaaattttaaatgaaaaccatagttaggatacaagaggcagccaccactggcaaggaccattgtggcaggcctgcaccaggagcttcgtctttgctgaagtgcgtttgattagtcctcagctgagtcaataacctctcacattctaaatgacgagctccttatccctgacgagtgcagaaagcagatcacaggcaagcactctgctcactgtgaagggggtgctgagtctggcagcacatgagcctcagatagcccacaacccctactaccacaagatgactgattttttaaagtcagtttgcaatggctgggagagttgcccacaaaaaatttcccctaaccctatcctctactcatccgttagccttccattgccctaagggtcacacaactaaacatgttctttgcataaagtcacaaccaaattcca

SEQ ID NO: 27496 - DNA, 1784 bp, Mus musculus
actgtgagagagagagagtgtgtgtatgtgtgtgcacgcacgcatgtgcatgcacgtgtgcgagatctttgatccccccccccaggggggggcatctatctacctttattttttgagatgtgtaaaggtcacagagctacttgtcacttttcatcttccaaggagtgggtcctgggaagcaaacttagttaggcttggtgctcagtactcagtactcctatgaccacaccacaagtatctttgctcggctgctgtggtgaatgcctagctgttttgaatgtctgaaataagttagattatttggctctccagtggacagtgactggctgccttttccccacatggtggcagcgtttcatttaggccccagtttgcatttgtacataagagcctcctacaccatgtggtttcactctcctgtaggttccctcgatggtgagcaccagcctcaatgcagaagccttgcagtatctccaaggttacctgcaggcagccagtgtgaccctgttgtgaactccatcttcctgaccatgcagcggctgaggatggtttcttagaaccatgtggacttctgagcacggccctgctgaagcaacacaggtttccaacctcttgaacttgtcacaaactcttacagaggacagaaaatattgctgtaagccaatgaggttgtttgtcttgatcatcaatataactgataacttgtctactttgtccttaatgggacaagtatttacaatcccatgtatggccatggtctctgttgaacatttgcacggtttgggttatttcaaatttttggcaggccttgactgtggagacttaatttctattgttttgaagcttgtatttctcttgtcctttgtggattttgtctgtttctttaaacttttattggacatatgaaaaagtcttgttgacttgcaatgcacatttcgtagttaaagtctgtaatcagcaataaaaacccaaaatgtgtatctaaaagtgtcttcaggacaggatttggtgctttctgaaactttgatgaaatgaagaatttctttaaatctactttccccatctggactccataaaaatactaatttttaaatcatttaaactcagaatggtggtttttattgttttctttttttaagagtctaagcaaaacagtccttcgggcagatctggagcttgccaggcatcccagactgagttaagggcttcctactgacaagtcctgtggaagggttaggattagagcagccgtcattgactgtgctttctgctaaaaggaactgtatttgttgtttttaacctggaccttcatgtggtcacaggccaagcaattttgttatggacagcttaccaaatgatttctcttccacgcaattcttatgcgtgcctatgttggttgtcttcttccacagtgagtcttctgggactgacccgggtctgtcaggtttggatttaagtgccttggcctgctgaaccatctcaccagcccatggagggttttttttttgggggggggggggtttcgagacagggtttctctgtgtagccctagctgtcccggaactcactttgtagaccaggctggcctcaaactcagaaatccacctgcctctgcctcctgagtactggagttaaaggcgtgcgccaccatgcccacagattgtttttttcttaagcatttttttttaattgcttggtaggtatcaaacaggtttttgtttttttaagatttattttatatacacctgcatgttaggacctctggaagtacaaccagtgctctc

SEQ ID NO: 27497 - DNA, 1204 bp, Mus musculus
tgatctctggcttagtgtctaggagtatctgagagcccagtgcaggagtctgccacgacacccagctgagctctgcctgggacttaagtgtgcatagtaatgatagattcttacacagaatccattaaagataaaagtttttagactctgcccagcttcagacagagcttatgttcatgaaagcaagatatagagcaaccagaacaaagtgctctatttattattattatatatatgttctagatttacttatcctatgtatataagtgtggctatatgtatgtctatgcaccatgagcatgcctagtaccagtggaggccaaaacaggacattggagaccttcaattaagagttatggatggctataagtgtgtatgtgagttctggaaatgcatccaggtcttctggaagagcggcctgtggtctttaactccggagccagctctctagcctcatccatattatttcaaaattcgtgtgtgtgtccctgaatgcatgtgaactgtgtgcatgtagaggtcagaggataacttgtgggagtcaatttttttcttccatgtaggtcttagggcttgcactcaggtcctcaggcttggtggttaatgcctcttaggacaagcgtagccatttctctggcctccaagccccaccatatttatttatttgtttgtaaccaggtcttttaaaaaaattatagccgggcggtggtggcacacgccttttaatcccagcacttgggaggcagaggcaggcagatttctgagttcgaggccagcctggtctaaaaagtgagttgtaggacagccagggctacacagagaaaccctgtctcaaaaacaaaacaaaacaacaaaaaacaaaacaaaacccaaaaaatttatttatttactgcatataaatacactgtagttgtcctcagacgctccaggagagggcatcagatcttatttggtggttgtgagccactatgtagttgctgggatttgaattcataacctctagaagagctgccactgctcttaaccactgagccatctctccagcccccttgtagacaggtctttatgtagccctggctgtcctagaacttgctctgtcgaccatatctgcctgtcccactgtatttttgagacagaatcactgttcggaagctcattgctaaggctggcaggctagcaagccctaggaacctgcctgtctctt

SEQ ID NO: 27498 - DNA, 1123 bp, Mus musculus
tgtctgttttcggctcagacttcatttactctgacttccccagtaaactccataagggcagggacttgtgcattctcactgtattctcagctttcggtcttgcacgcagcagcaggttaacaaaagttagcgtagggaaaaaggggtgactgtaggaagggaacagaaagcctagaaaagaaaggaagcgaggcctgtattccctgccgagaccgagctcctgggaaactacaactcccaacatgcctcggacccagcgcagccgtgcccggcccttgtgggccttgcgtgcctagagagcgcatgcgggacgcggcgcccgctgggacttgtggttcctgccgcggtgtgtagggggtggggccggcatggaggcgggcgggggccgggggcgggcgcggcccctcccccgtcacttcctgccaggctgcgggccccgagccgctcttcagcgtttgcgctggctgtcgtcgcgtctgtgtgcgctcccccttcttctgagccccggcctggcggcgcccgccttcgcctccgccactccgcctcttccctcctctggtcggtccctttttcctcgccgtcttcacttgcttcttcacctcctcgccgccgcccaagaccgccggccccgggacgagctctggggaagcagccaggtaaggcggccggtccgggccgggtcggagcgggtcgcggaaggacccacgcaggcacggcgtcagcgggaggtgggcggcgggtgggctaggccttgcgggcgcgcgagccgcggcccaggcccgtctccgcctgcggggccttcccggaggaggcgggccctccgcgccgctcgtgggccctgtgccggagttaacgcggggggcgcgggcgggcaggggcagcgtcggtccggaggccccccgggtttcggtgctatgcacagtgtcgcggccagtgccgagccgcgggatgaggtgccaattcccggctcggcccccttcgtcagtcacttcgtattctttgtgtctctgttatgagggggagaaggagggggaatagtattaatcctgtcccaacccggtccctgcctcttcaggctgtgaagttgtgcagtgaaatggggcgtgtaaagtgcttatcagtg

SEQ ID NO: 27499 - DNA, 1155 bp, Mus musculus
agatagccttagatagggttaacagcccaggctggcttggaactcactgtagtcaaggctggctttgacttggtggctttttgcctcaaccctttcagatgctagattacagctatgagcctccatgcctagcacagacagtcctcttctacactagcacttgagtcctgaccccgtgacgcctgtttggcgtcctttctgagttatgtgtatctttgacctgcaatgattttctctccagcgggcagccactacactagatgagaagattgagaaagtccggaagagaaggaaggcagaggtgaggctgagacccggctgcggcggttgtagttgcactctggcctgtggctttgagaggggcgggaacaggtgctccggtctgggtggtcattactccttactgtctggccttggagttcagcatcgcttctcttaggttctgaatttcctggtgtttgtagtcacacctacttcatttgatttttcctcaggacaaggaagccaagtctgggaaggtggaggagaaagaaggccaggcagactctgacctgaaggggcaggagaatccgggtgaggatgaggcaggctccaaggatgaagactctgagactgactactcctctgaggatgaggaaatcctcaccaaagcaggtaggccgatgcaccttggctctgtaggaggttgtgcagtctttgtgctggagcctgctggtccccacggtgctgggatttgttaggataaattgtctctttactggccaccatatcagggcttcttctttctggggacctgcttctctcctcattctcagctccacggagtgttggcttctctacagctcgcctacttggggcgactcggttgcattgggtttgcctctgtagttgggggttcagtgagcattttggtagaattcactcaggtgtcacagtgttgtgttaagagcctgccatctacactgtactcactaggctagtgtcctgtctgcgtttgcccttacctgtgaaaggagtgggacagcaccctccctggacagcaccaaggacatggggtccagaggcaggtgctgggtaagaagcactctgcacactgctgtgttttttcccacagacacactcaaagtgaaggagaagaagaagaagaagaagggc

SEQ ID NO: 27500 - DNA, 1099 bp, Mus musculus
cctggtggacacaatgagttctagatcagcaaagatgcacagtcagactctgctaaaaagaagacctaaccttgagaaagagaattcagggatggggatgtggctccacggcagaggagctgtattatgtagcttctgccagtctctgggttcagtttctagtaacacacaaaaaacagtattattttggacaggagagatggctctgtggttaagagcactgaatgactgactgtatcccagcacttgggaggcagagacaggtggatttctgagtttgaggtgagcctggtctacagagtgagttccaggacagccagggatatacagagaaaccctgtctccaaaaaacaaaaacaaaacagcactgactgctcttccagaggtcctgagttcaattcccagcaaccacgtggtggctcacaaccatttgtaatgggatctgatgccctcttcccgtgtgtctgaagacagctacagtgtgctcatataaataaaatatcatttattaaaaaaaatccatagtattatttcccataaaatcttttgtgatcctagcacttgcaaggatgaagtagggctcattgacagccagggctacatatgtgagaccctgtctcaaaccaataaagaaagatgacttaaccttgataatgagaattcggggtggggtttggctccccactgatgctcattgagaaatcacgttgccaaggccttcggcttgcttgtttctctgtgtgctctacatttggcctgagccccaggccgggggccccactgatgaatgagtgatcaggccatccgtggggcgttttctgcaggtggcctggatgtgaagtctcaggaagccgctcttcgggcagcaccagacatcctcattgccacacctggccggctcatcgaccacctccataactgcccctccttccacctgagcagcattgaagtgctcatcttggatgaggctgacaggtgtgcctgagatggggcctggggatgctgtgctgttcccctgcgtgctcgctaaggctcttggtgacacgtgtgtagtaacaccattgctgttcacattgggtttttgtccagattgaggtca

SEQ ID NO: 27501 - DNA, 1178 bp, Mus musculus
gagcagatgaaggagattatccgaatgtgttcccaccaccgccagaccatgctcttctcggccaccatgacagatgaggtgggtgtgcctcgttgcgtgcagaggatcccagctgggcaagccctcttttcttgttctccatctcagagctgatcagccatgaccttgtacttggtaggtgaaagatctggcttcggtctccttaaagaatcctgtgcggatatttgtgaacagcaacacagatgtcgctcccttcctgcggcaagagttcatacggatccggcctaatagggaaggggaccgggaggccattgtggcaggtgaagactcagggctggtctgggcagggtgggtgtctgcactcaggctgcctccatccattctccccagctcacacggtggcactgcctgttacctagtccacgccacctctcccaggaggctgctagcccgctgcctcccgtttcctcagtccgtgctgttgactacgcttgggagttggcttctctggctttgccttggcccgggagccccgcagacagttcatggtcggtctgcccggtgctggctcactcttctccctgcagctctgctgatgagaaccttcactgaccacgtgatgctcttcacccagaccaagaagcaggcccatcgcatgcacatcctcctggggctgctggggctgcaggtgggcgagctccacggcaacttgtcacagacccagcgcctggaggccctccggtaacgctcggtgctgccctccttcctggtcagcccaggggaccatgctgggagaaaagagttgtgttagagcagaggcaggggacacaaacaatacagtgccccactttaagcagttgtacaccagtgtctgccaccacccctgtagtcccagcaggtgggagagggaggtgggactcactgacacctcattgggtttaatgtgagcgctgtgaggtgatgcacttagaactcttctgaccttggagcgggttgctcactgtgctcctgtgtgtggctttcccagagcagctccagtgtcaagtgattaggcctcgcccctggccagcagccatttcacgagcatgtgctctgcgtgtgcgtcatggttcctgtgtggtttgtcattcagttctcaagagcagaggagagctacaggacaggggcctgcagaacgc

SEQ ID NO: 27502 - DNA, 1197 bp, Mus musculus
agaagagtgggaggtaaaccagcttccttgcctgaaagagaggacttagtcttcccaggcagacttggagtgggctctgctggaacaggccctggcgatgttcaggcccagtttggccaacgctgttattactgttacatcatcacttcatccacagctggctgacataacctgagggtagaaaagctatggtctacagagtgagttccaggatagccagggctacacagaaaaaccctgttacaaaaaaaaaaaaaaaaaaaaaaaaaagctatggtcggtcagaggggccctggcaggatcgagcaacttagatggtgtcacatcacagtatggtgctttgtcatctcacacaccttgtcagccttggggtctgtgagcagccagtgcagataaccgaggacctcatccttagtcgccctggaatccagctcttatctctgagccacggtggtgtggtgctgtggcttaggtctccgataggcttcccagtgcttgtgaagcacttactctgtgctagcatgtgaacaggagacctgctactccacataccaacccgtaaccctgactgagaatgaaggcctcttaaggacaacatggctgcagtaattttcaccttagcgtctgtctgtgccttactggctcaggttagtagtattgtgtggggcagaggaataagcccagttcttaaaactgtgttgggcttctctctgctgtgtcacttgggattgggccctttagtgtggtgacatcagttcacatgccagtcctcataaaatcttgtagcttcattcagcgacagatccagaagggataagatattgtgtgcaaggaccattgtagctggcctatgacagaccctgtatcaaacgccagctcctaggcagtgacccagagagcaagagcccgcgaggctctactttgaggatacatacctactgtagaaagaggaggaaatggttgtcaaagcgagtccaggcaggagtagcagggaaaggggaagctagagacatggcccaaacacagtcagaaaatgtcacgatgacatctgagacattgtggccagtggtcagccattgctggccaggtgaggtccttcccagggctcttcacactgccaagcctgcagcaagcaccctaggtcacatcacttgagaagagtcaggacagatttggggcccaggcaggtctctggaa

SEQ ID NO: 27503 - DNA, 1231 bp, Mus musculus
tgtcatatcatttgcaagtggacagtgccagtcagagttgtatatgtgagacagttgcatttagggtttggtgctggagtcatgggcgcctcaggtcatacgtgaggcctcctggtacataatgttgaaactttccaaggcgattgtgattatctcagcaagtcccattcctttagctaataattggagacactggtattacagctgtctcctgtaaaggagatgtagtcctaagtagctgtctacctagcccttgggatcaggctcagcagcctcccacagacaggcatgtgtgatgacacaacttttttccccatcagatcgaccatgttgatcacattcttttaagccagtatgtctgacatgcctgcctgacagtacccactgctgctgtgcccttggcgctcaggtagttgacaggttatttctgcattttatctcaggtttgctgacagacaaaaccgggctttgaatggagcgtgaactcctgaggcgagcattggtgagtggtttccacgtgtccctcttccagtgtatactttgtttctgacataaacttggctggtgaactgatgatatcatttctttccccgtcagatcgaccctgttgatctcaaatactaattgccagttttgtctgatgcatcagccccaggaataattcattgttggctttaatctatttcacttgataatggcttcgatttattttctacaggcccgagagagccgaggatgcaggtgttggtctgatcttgatttcaggtgaggttcttttactgttttaacctgtttctagggatgttataacaagtgtggagagtaacgggtgtttgattcttggcttttgctgctctgttcatgctgttaaggttcctggtgggattcaagttcaccatgttgcttgctaagtgggggtgggggatgtgttcagccagaaaagcctatcaacattttacttttctttttaggtacttttggaatacagaataccagatgtgttcctgctgcccagccccacaaggctatgcagaatgcaaagaagagttactttttggctggggagtagtggtatcatgtgcactattgctggaaataataaatattggcctatctgtagaaataaaaatctgactaatgatatttatctgctgtgtcttgagtttctgggttgggtgggcctacagctgcttcctgtgaacatttcccactgccttaagtgggacagctg

SEQ ID NO: 27504 - DNA, 1231 bp, Mus musculus; identical to SEQ ID NO: 27503

SEQ ID NO: 27505 - DNA, 1211 bp, Mus musculus
cctgatcaaaccccgaactgccgcccagtctccatctaaccccaacccttccctcacccacgcccaccagagcccctgatagggagctgtgagttgaggtgttcagcaggtgttactcagagtacctagggatctggcaagaactgggggtcatcgggcaaaaatacctcacaagtcagaaaggccaggaacaaaagagccaatgtcacatggtgccattcatacaattggtaaatgcaccatttagggctggttgggtcagaggaccaagggaagggtaagtctaacagggacagggtttcttttggatgggagcaatgctgttccaaaaggacattctcgtgggtggtttgaataagaatggcccacacaggctcctgtagttgaatgtttggttcccagttggttgaagtgcttaggaaggattaagaggtgtggccttgttggggaaggcgtgtcactgggggtgggctttgaaatttcaaaagcccatgctaggccctgtctctttctctctgtctttctgtctcttcccctttctcctctctgctacctgcagataagatgtaagctctcagtcactgctcccgtgcatgcagccctggtccctgccatgacagccatagactcccccttcgacactgtaaacaagcccccgttacatggtttcttttataagctgccttggtcatagtatctctttacagcaacagacagtggctaaagcaagcctagtgatgcttacagagttggttggcatgcaggatggacctaacagtgctctggtatgcagaaccaaatggcagttgttcatgggtaagcagcgtggtgcgtgcctgagtgggatatcattgagggtgacatggcacagctgactcccaggaacagagacttcttttgctgcctgaagcctctcttggcttttcttttttcttttctttttttatttttttaagatttatttatttatttactgtagctgtcttcagacacatcagaaaagggcatcagatctcattacagatggttgtgagccaccatgtggttgctgggatttgaactcaggaccttcagaagagcagtcagtgctcttgcaagctgagccatctctctagctcctctcttggcttttcagtcatctaggggtgagccttaccagggtttggtggatcctggtcgcctaacagtcactagcttcctgctagacgaag

SEQ ID NO: 27506 - DNA, 1146 bp, Mus musculus
cacacacacacaattttccccacccccgcagagccccagcgacaggagagaccctgagagccacgacaagtctgtggacaccaactaggatggggaccacacctaacagcttcttccttagatggcaggagcagagctgacagccacatactcctagtctcctttagaggctctgtctgcctctgagtgcgtcatcgccatctctcatggcgtcagctgaggcaggtgttggagcaaggggttgctagtgagagagtgggctggccaagcagtagtgggtgtcccccctcttgttagaggggtacagaggacacttgatcctgagggagtctccacttcatcagccacactcctagggcataacgcttaaacaagcagcggctcaaatgattcagtattctgtggtatctggggctttagtctgagaagctgtcaggaggagctgacaatttaaactcaatcctttctgctcacctggcaatccagaaagggttccaacagttggcacgcagccaaggggatataagccagggctgtcacaggaatgcgggtcccaaacagggctagcccggactgaaaagataagcgtcaaatatgcaaacgagatagattattcaaaaagactgtgtgtgactgaaaaacaacattaaaaaaataataaatttcattttctacatgaaaaaaaaaagaaaaaagaaaagaaaaatccttcactgaactgccctgtgaagaattgtgactactttctgctgtggtgtggtagggaacacacctactatgagaggaagttctctctctctttttttttctttctttttttgtttcctgtagtattcaagctaaaaaataataataataataagttaataaaaaaagcactttatgtttttctaatctaggttctaccagggacagtgtcaagatctcgcactttaaaacaagcactatttcccctgggccgtaagctggccctgcacttggggtattacttgtgcccatttctggccacagtgggtctaccgttaccacatcagagtccggggcttttccgtgacccctcaggatcacccctcatccctcatgggacaggagaggtcctcaggtttcggaggcagggatctcttaaagcctgcgtacaagagacac

SEQ ID NO: 27507 - DNA, 1471 bp, Mus musculus
tgttttgttctttttgtagactagtgtggtaactagggaacagatggcactgcagagtgcttcccgctcatatgagagagcaggtgtctgcccttgagagctggtgagccgcgtcatctgtttgcgctgggcaaggagctgcaccgctgcgttgacctgccttgtcttacggtacacacagcaataaagcctgggttccgcccggtctccaccctccctccgcctcccttggttagtttcacagtgctggcaatgaagcccgtggcccaccacgctaggcgagtgctctgccactgagtcacggcccagccctctctccctcattcttctgtttccataccaaaggccaggagtgcttcactgtgctggagccatggtgtcctttggagggacaacggtgcacgcggcatgtatcctggctgaagcgctgcaatcttacactagccacagggtactgttttgagccaaaggctgatacttaattgaagagggaaaatgcagatttggggacaaaggtctttttactgctcaagtagggtcgcttctgtcctgttgcaatcatgtccaagtttgtttttagtgtggacttttgtgggcactgtctgtcattggccacccagtcacgtaccgagtgggcagtgtcacagccaaagctaccactgagccacagcgtaggtcattgcttgaaaaaaatgacagtgacaatggagtgtgaccttggtgtactgtggcagcccagatgactgagtgctacagacgagtgacccttagatgacctcctcaactgcctgccttgtgtgtgcgcgcaaggcccctctctgcacaggggttcttcgggggagggggtatttgcaaaaccttaattttgttaaaatgggggactctgtcaggggactctgtcatcgcttcccttcctcagaggacagcacagagccgcggcgtacacactgacgtacccaccaccaacagattgaggcactgacgcagccagcttagcccagcattactgtctctgttgtgagcttgctctttgttttaaaaggtgccaggggtacatttttgcactgaaacctaaagatgttttaaaaacacttttcacagaaatagtccttgtcattacattgttcactcatgtgtttgtacatttttgtatgttaatttatgaatgattttttcagtaaaaaatacatattcaataaccaaaccttggtagtcgtctctctgtctagctgcctctcagggtggtttcccttcctctgtagaacaccacacactggcgacaccagggaatgaagatctggctccagaacattctcggtgggcagtcctgggttctttctgccagaacattctcggtgggcagtcctgggttctttctgccagatcctgctcgtgttgtaatcacaaactgttaggaattgaaggcttgtcattcccggtgtgtgtgcattttgacttattttcccatctc

SEQ ID NO: 27508 - DNA, 1828 bp, Mus musculus
ctacaagggagtggtagggctctaagcctgacttctttctgcccctcctctgtaatctccggagctccccagttctgacctgggattcgtctctggagcctccgtttccttgggcctcagaggcattagatgagatgctggaagacgggtccaggcatctgccctggacttgtaaagctgggcgtcagctctcctccctctctgtcctcggctccccaggtacgctctgctgaggaagtcaaaggagcggcaaggactggatggcctcaacaacctgaactactctgcgaatgtcacgtacgacgccttgtataaaaacataactgtcaacttgacacccgagctggctcaggtgactgagtactgagatgcgaagagaagccgcactcacctacccaccgctcccttggacgggctgcgacccgccatcctgggggtcaacacaggaggacagaagagagtggagcacaggaccataggggttccagaaaactgtcacagagcacacgcacaaaggccttcgctgtagggcccaacagggacaggagacttgaggacacctgtcatcagcactggtgtctattccacaagacagatgtctgccctgccactcccttccgtccgtccctgtccgtccccccccccccaccgcccccaggtcctgtctcagctgcaacccatagaactgcagggccaggctaggtgccccttggatagatgggtggccaagccccctggcctgaaggcccgtctctgcatctctacagttctctttggttttcatttttcatttggcttagtttaggggtttttgtttgtttgggtttttttgttttgttttgttttgttttgttttggttttggtttgtttgtggggttttggggttgtttttttttttggtggttttttttttttttttttttaaagaaaaattttctgctttgggtggggactgaggacagaggggagggacttggtgtgatagacatataacagtcacttcttgaagaagtgcagttgtaaataagccatgtaaaatgcctttttaaagtttaattttatagctggctccacatcaaagtgagggcctcatatgttagatcaccttgggtggcaaacaccccagttcccacgcagttgagtgtcatcacccaagtccctgtcatctaggaaggaagtggatgcagggtggaacaaagaacctccggtcactgtagcccctcttctctgctctgcccctcctttcctgtcccctcctttagccccttcccccaaggacttcctcctggagactcagcccctaagctggaactgctgttaggggcacagtgctctcccctcttacagacccagcggagccagctgggatgtgcaggggaggggaggcaaaggcccagggcacaggcttatcactccagtatggatggcgggagctagagaccaggagatatgaggccagtgtgagctgtgtcacaagttccaggtcagcctgtgctgtgtagcacagtccagctccctacacctcctcacacacacagtggctgctgggtgaccgttcccttttttctttggaacttggccacagtttctctgggctgtgcctgcatgaccagctggcttcagtgatttctccgtttccctctttagtttctaggaagccactgtgctgtgctaagaagcagttggtcaggagggctcagcccaggagcaggtggccctggggtgcatgtcagccaggggccagtcagcccagcagtctcccctgctccctgacatgagttcctaaagggcactgaaaagggcacctccttcctgtgtctgcctcca

SEQ ID NO: 27509 - DNA, 1197 bp, Mus musculus
ataactgtttcatggaagccacagggttcccttgtgacagcacaacagcagggctttcatgtaagagaaaaataaaaaacaaaaaggaaaaggaaaaacaaaacaactgtagttggggagggtggcacacacctaaaatctcagtgttagggctggggctggagggttgtgagtttaaggccagcctgaactacacagccagtttaaggtcagcctgagtttttagggagaccctgtctcaaaagaaccaaaaagcagggctgtctggggagatgctccctggataaagcaccttgttgcaagagtgaggaccttaattcagcacccgcataaaggctgggtgtggttggtgtggccctgaaatcccagcactcagctggcagagaccggaattgatctcccagagctcactggctggccagccgacacaactgctgagcaccgggttcagttagagtccttgtccttaaaaataaggtggcgagagatgggaggtgaagacatgacgcttcctccacagacgcactacttatcccttacaaatccaaaccaaacagagagctctgagtggtagagccagtaggagccgcggtttatcctacctctcccagttgctgctgagggtgctcggaagtcactgcagtgtggatgaaggtctccttagaaagatcaagagagacaacaaaggcacaataactgtgcaccttgtagcactgtgtctccctccaggtgtgcccttgggctagccaccttagtgttatcagtgagcttgatacaggttctaggtccaaccctgactgctccagttcatgtccctggggggcagatgcatgatcctggctttctgagccctccttgaggaaggctacaccaggggagcacctctgttggaagaacctttgcagctcacgggtggggaggattgtctgcagtgcctaggtactctgcttcttccctaaccatgtgactagggccagagagagacctagttggtaaagtgcttccaaagagcctgagttccgttcatggcgcccatgtgaaagagccaagtgtgtgaagccatccatgtgcttgtaaccccagccccgggcaggggagacctgagcgtctttagtactcacgagtcagccagtcttgcttaattggtgagttgcaggccaaagagaagccctgtttgaaaggaggaagatgccgttc

SEQ ID NO: 27510 - DNA, 1169 bp, Mus musculus
cctatgcccccttctggcatgcaagtgtacatgcagacagagcactcatacatagaatcaacaaatctttaaaaacaactgtgaaatcaaggcaggatttcactcactctgtagcctaaacaggctttgaactttgaattgttctgccagtgccctttgagtctatgggcgagtcctgtgtgttaaaagacaattatatctcaatcaagataatgaatgatttagtatatggagtgctagtagtttgttaatattctaaagaagtactggactgaagattatagagaaagtacacttgctacataaccaaatagatgtttttctgataaatactggactgttcagattcccttacatacgtcacggcaggaaaaccctttgttgtttctgccttaaaaatgccttctgaatgtctccatgtccttactatatgaattttctggaggaaatacagattggggaatctgattgctttgggaaatgaaaaacctcctgctaagacactttctttccccttcagtgttcttttctgtctcaggttcacaaatgttgttctgttgagacatggtctcatgtagcccaggctagcctcaaactctccgtgtggtcaagcatgaactgaacagaattctggtctttcttccttcacctctcaagttctagacatgtctttgaatagtgccctccctcccttcctctgaggaacgtgtatagagggcaggctgacttgcagaaagaaaagtaccgctgctgtcagggctccgactaggttttctgtcctctggagagttcttgctgtcaaggagaggcctgaggtttggggttgagctggtctttggccgtgagaacaggtgctcctcctcccagactttaaggtccatagagctgagatcatgacagccaggaaggagagcccctttgccatgtcttctagagttctttgagagagtgacaacccaaagccacaatcgccaagacactatggactcaccaagacaccaccaactcactaggacactgctgactcgcctggtccctttgcttgggtttttgtgaccgtaacgggagggctgctgtggtctgtcggggaaaatcaggagttccctgaagctgggtagataagggctaatcagaagccagcagggtgggtgtgagcagagaggaggcct

SEQ ID NO: 27511 - DNA, 1163 bp, Mus musculus
ccgcaccatggggcctgcagaactctagggaagctgctgtaatgggtatcacccactctagagtactgcccagtccagccaagtagccttgtgctaagtttctgctgtttgctttttccttccaggtattctcatgggagcagtaataaaagttatagagtttaaaaagctggcaaattggaaggtaggtttgtcataatccctgcttttgctttccattgtgtgtgtgtggctgtgtgtgcacatgtatggacgaggtgaacagtcttgggtgtcagtgttcctcaggtgctgcgaagtaggtctctcactggcccagatgtatgtaggccatgtatggcaggccatggacgctgggattccaactgtgcatcctgcctttatgtttagctcctctggctcctgaaggctgaggttacaggctgtgccatcacactccacttggtctgatttgaaacagtgtctctctttgctcaggcttgcctgagattgtcagtcttcctgcctcagcctccaaagtgaccaggactatatataggtaaatctgtagactctgttgggaagtcctttttgttatttggtgcctaggatggagcttagggcatactatgcatgggcctttccactgagctgtaccccagcttacaattgttgttataattagattagatgcaaatgaagtcaggggcagctcaagaggcacagcggaggagtgctatagtgcaggctgaggtgttatgaatacttggccatttgaaaagacacaaatggtggaggacagctatggtcaagattgcttgcttgggtagggggtgggggtggcacacacctttaattcagcactcaggaggccagcctgagtttctatcttttttttttttaagatttatttatttatttatttattatatgtaagtacactgtagctgtcctcagacactccagaagagagaatcagatctcgttacggatggttgtgagccaccatgtggttgctgggatttgaactcctgaccttcggaagagcagtcgggtgctcttacccactgagccatcttaccagcccccagcctgagtttctacagagtctatagagtgagctccaaaacagccaatcacacaaagaaaccctgcctggaaaaacaaacaaacaaacaaaccaa

SEQ ID NO: 27512 - DNA, 1194 bp, Mus musculus
aagcccttcacagtgctgcccgagtggagtctgcagagtcctagtagcttcagttctccctgagtggaactataggaactgtacctgtgttgtttggactcagatcttttcttgtatttcatggcttgggttcctttgagatagagcctcatgtagtccaggctggctaggaactatatggctgaggatggtctggaacttgtcactcccctgcttgcaccccccagtgctaggattgcaggcatgtgtcccagcacctgtgtgctggacttgaacccaaggcttcatgtacgccaggcaagcggcctaccacttagccctgtaccctggcggagccctttgcttatctgtttgatgatgctaatatggcataaaggactttctgatggaaagaaaaatgaggaataaccgttcttagatatggccaaggaaaaggcttttaatgtagataggaaggagtgaacaggtatcaggaagggtccagactgaacatggctagtagaatagacctagccatgagaggagagagagaggcaagagagggggcaagtggaccgagaggtctaggagtagagccaagagaacctgtgaccaaaatgtcttaatgttatgtaggaaagagaaagtgggggcagggcagaaaagctgggggctaaagaggtttagggtaggtagggactggagtgagaagtactgagacgaaccaggactacctgggattttgaggacttagcagccagtatctgctttgatgtgttaatgggctctcggacatttgtcccaggtttctttgaacctaacactgaccattgtccagtgtttgaacttattagccttttcaaaatgcaccctttaattgagtagaaaactgtgatagtgtagattttagactgggatagtcacggaccatgcttgtttctgtcatacctgggtattgagcatcatccataggacagatgccattgttcctactgagccttgagtcttgtgggaaagacagctgtcagctgtacataagcaagtggggagtgcagctaccactgagggagcacagccagatcctcctaagagctaccttgggacaagaccaaggaaacccctctgcagaagggttagcatgaggcacacaaaggatcagggtgcactctggcggctagggcccaggcagtaaggtagtgtcctgccatgggacag

SEQ ID NO: 27513 - DNA, 1212 bp, Mus musculus
agactgagcagagagtcttcttaaaacctaccctaagggctgccaggtccatgtgcccgtggtaggtctggggccaggcagctgctgctgtcctgatcccccctcccttagctatggatccttgtagtagaggtcagccgctcctggcgcaaacaggatccagtagctgtctgccacccacgaggtttctaagataccatgtggagacagggtcctccccatccttttcagaaatagcagcttgttttctctgctggcatgtgtccagggcaccaggtcccagcagggggaggcagactgttaactgaacgcgcataggaacaggaggcagcgagagcctgtgggaggaagggccttctagtgaccctgcttctccatcctgcctccctcctgtccacccagtttcagagttgggaggggaggagccatggctccctcacccaggcttggtggctgtggccctgttttagagccatggcagcacaggctggtgagtggtagagttgtactgaaggctctcttcacaagcctgggtttctttcttctctgacatggagggttttggaagccctagttttctgttgtgatttaaggagactggccgggagccattgttcaaggtccctgaggcctttgctgctttgggaagggcctggggtctgagcttgggggggggggaagctgtcgctccctcatctggagcttccctcttgcctgtctactcccctcaccctcactgctgaattgggggaagggtgccccaggtcacatgactggatagttagaaataaagtgctatgtagtcagctgacctctgttgtgtcacgtgtttgcatactcctacatgtggttctgggtccccacagttgtgcaggacagcagcaggcacattccaagaagtgcagtgttcaggagtacagctctggccctcggtgaacaacagcacttgaggcagaatgctcatgccaaccatgacttcctcccaggtgccaggaagccattgctctgagcctgtggctgcttgagtgtgttcgttttttgacagcagaaaatggagaactaacttctccatggaatctgaaagctgaggatctagagcctctggtcttcagttcatgaagaaaggccttctgtgaggtcctgagtcagctcatgcacgcacacttcctgaaggagctgctgccagggaaggctacctgagtgtgacatccc

SEQ ID NO: 27514 - DNA, 1207 bp, Mus musculus
cagctagggtggagctgggagcctggcgtaagggactgataaagcccatgttccttcccatggtggtagagagctactgtcttccctacggtaaatattatacacctacctccagtgtgcacacaggggttagcatggtgccggggcaatgacctcagtgacaagatggggacctcagcccccacgtctatagctctgtctggtcttggtgcctgctgagcatgaatcttgtaccctgaaccttgaatctcagaaggaagttcaggcggtgggtgcctccacccccatctagccttcctcactggttcccggggctgtcagcgcggctctcagtctttttgcactagggcgggcagaggtgggatgcgctccttagatgcctctccagtattcagtgtccacacttcctgggataaatcccacctctgggttttcctttttggggagaggggcagggcaggaatttgaagctgtcacttccttgtgaagtgtgaacacagtttagccataggcagttgtgatgtccagtgtttgggatctatgggcaagtagttttcccaaagcaggcattcagttctggagcaggcttgactctggccaaaccctgagccactgtgaatttgctggtggtcttccgacttactggagtgattttttaggttttccaaatcttatatgactctttttttatctctagctgatagaccgcatgtaattaggtgtacatacagcagactctgggcagttttattcctgagactggccttcctgggcagctctttgatgtcagcacctcagacctggcaaggcctggccctttcctgagagctccagctctgcattccagtcactccagcattgcagggactctcttaagatggaggacaggccacctgaggaagtccagtgtgttccaccaggaaatacagtgtacagactggcaaggcctctcccctcctaggtgtgtctcactataggagatcgctgtgatccgggtagttgagtatatgttaatttaaaatgcacatattttgcatttgatttctacggagttgaaatgttgagagatttaaaaaaaaaaaataaagtgtcttccattgttaaatgaagtgttcatggtgttacagccccttctgtggcttccctcatttatttgcagcatgtgctggcctagacaccacagttagctcaagtgacaggactcaga

SEQ ID NO: 27515 - DNA, 1680 bp, Mus musculus
catggcaccagacagggtcacttcttcaagggtgatggggccctagggcagagagagccctgtttcctctgggctcttgccagcattgtcttccccactggtgaccttgtttgtcccatggtctgctttcaccacacctcagctactgcctgctttaagaagagcccagcttcttctcctacaggatcttaatcgcattcatcctgttgcccagtgttcatctctcaggtccttctagccagccaggaccttccctgggctgtgaatagcacaataaagcagggactcctttccttggccctgaggtgccttggttctgcagtttactgggccagggctctgctcctctcctcctgggtgacatcgcagtctgatgggggaagttttggttactgctgtttccctacacctgcacatctgtacacctgagggcttaaatgcctgatggtgcctttttaggataaggtatcaccatagaattgtagtggaaatgttgggtagcaaagatggggtgtgttcatgtgtaagtagggagaaggtgtagggtgtgtggctttttggtttactttgatgctgatgagtgttctcaggtggctgggtcgtgtgcccctcttattgagtatatgctgacattcttgctctgaagagtgttggagggaggcaccgactgctgggtgctgcttggtaacttgatgagcctgagcagtattgctgcctccttgtgcaagtatgttttaaaccctgccttttgttgtggaggcagtggtaaagccagggtcatacctgggaagttaaagttaggcccctgcacagtcgagggaggcggtctgctgaggctttcttgagcagcagctataacagctggaaatgcagtcatgttacagagcacaaggaagagcacctccagtcagttccacaggacagaccctctaccaggcctggggcttgggagtgagtcttctttctggtcatggggctctggtccatctgagactgcatgtaacattgtacttgtggcaccacgcctccacagtggtgcctctgcctgccagggccaagccagcccagatgccagcagagtcggacaggatcattttcccaacgttactgcttcttcactgtaccctctggaaaggtttgctcaggagatgtgtggagggaggttcaacaagacctgccccgagcaactgggaaaggcacaggtgtgccacagtgcagcagggacctcttgtccttcatcacactcgctgtttctaatatgactttccagaaagtgtggttatgttctgtcttatagaaagtgaaatataaataaatttcataatttatccaaccagtaagctgcaatgttttcatttaaacagctttttctgaagtgtgggcccagcagcctctagaaggttgttactccaagggaacactcttgtctgtccctgagtcaacctggcttctggtcaattctgagagcaactgagcctcaagcacctggcttctctgaaaactgagcagaagtctgtccatctgcccatgtccctatgtccccatccccccttaaaataggggaattcacaatagcaggccaggctctcgcagctgcagtgactcgagtgtaactcagacttcaggctgtgcatgtgtgcattgtgtcagttgctgacacctaatgaaccatctgaaggg

SEQ ID NO: 27516 - DNA, 1199 bp, Mus musculus
ggccttgggtttctcctctgccgggagggagcaagtccttccaggcaggcatcaggaaacatctccgaagctgctaggatcccccagggccatgcacctttcccccagccgccagggccccagctgctccgctcggaccaaatggcaggtgcgtgggaatgctgtgcctgtggtcaccaccttctcaggatccccagtttccccgtgtggggagataaagccgacgtccctctctcctcatggcggtcagcttctctgaagccccatttgctctgaggtggaaggggatggtgtgggtggagcagacgcggctctctcaggaggaaatgctgttcagtctcccttacaaaaggaggaactgaggccgcggcgaggcgggttctgaccctggcccggtgctcacagtgaactgggcattgggcggagccctttgaccccagctgctgcgcctggttctctcggcaggcaaggtaggaagcagccgctgggacccaagctttcagtgaggaagtaaaatgcaagctaagaggaaaggcaaggccaaggccaggtcacaggggaaatggggacagccaactgcactccagacccagggacaccaacctgatgctgctggctgtgcaggcaggatgagcaacacacacatacacgcacatgcacacactcacatacacacatacacactcatacactcacaccatacacacacacacaaacacacctatatatacactcacacacaaacacactcactcatacatatacactcactcatacatgcaaacttacacatatacatactcacatatacatacatacatgcatacatacaaactcacatacacatatacatacggtggtagtagagttgggttttgggggttttttgttttgttttgttttgtttttttgttttgaaagatttatttattttatgtatatgagtgtactgttgctgtcttcagacacaccagaagagggcatcagatcctgttacagatggttgtgagccaccatgtggttgctgggaattgaactaaggacctctggaagagcagtcagtgctcttacccacagagccatctctccagcccgttttgttttgttttgttttgttttgttttgttttgttttgttttgagacagggccccatgtagcctaggctaaactaaaattcactatgaagctgactatgatt

SEQ ID NO: 27517 - DNA, 2304 bp, Mus musculus
tctacacagagaaaccctgtctcgaaaaaccaaaaaaaagggggggggggaatcctagtgatttggggagacctgagggagggccccaagccgcacttgaaagaggtctctctctttctgtgtgctccaccttcttctgcctgtctcctgagggctctccaccccagggctggctctcctcactacccccataactgtgtctgctgcaggctggctcaactaccccctagaggttataggcttctggcggcgcctggaggatctcatccaaggcctgacgggtgagaagccgagagcggacgacatgaaatgggcacagaagatcaagtagcatgtctggactcttggtcgccaaccttcccaaacctgaactgaagccatctgccaaatcccggcgtctctgagctaccctccagtgaagagaagtcccctgggctgggcccgggcacccctagcccacccccagtgacacagaatacttgagccacccacttttcatttcctcttctccttttctttccttgggccttcctggccactgagctgctccgaggccaagcctgactgcagacgggagcccagtcctgctggccagccccaccctatgcatctgctctgcacgcctgctccctgggccgatgtagggtcacagacaacaagtggtctgtctcggtgacccagagagcccccagaacacgtaaatgtccctggatcatgattctccctcagccctgtagacagaccccagaggcctaggtgggtgggtcaccccagctgccacccaagggaggcagagctgggcaaaggtcagggggcaagctgtcaaggagaggccatgatgccccgcccactctcggatactctcctttcccctagttctcctgtccatgtgtccagccacttctgaggtctccctgcagagacatcttcatgggcacagctcttgtgaagggcttggtcatctggggaagggacactgtgtcccttctggccagtgtgtcagaggaagaagaataaggcttttttattcggattttttttaaaggtgcttgcttgtcaatgtaaataatagaaagccttaatatctttctgtaacatggagtaatattttaatgtcatgttttggatgtatataatatatttataacagaggaagcatctccttcactctggttgccgtgtggtgtttccggatggctgcatagagggagctagccctggcctgagggatgggggctttatcccccgacacagtgaagtggtctagatttatttattttatgttttgcccacatgtgtgtgtgtgtgtaccatgtgtgtgcctcgtccccacagaggtcacgagagcactggaaccctggatctgaagttacggatgctgaaacactgtgggtactggggaaaaaccgggtcctcttaagtgctcttaaccagggtgccatctctctccagtactgaatttttgtttaaggcggtggtatatcatatactccaagtgacctcacacttcttatagaaaccaaggctgaccttgaattcctggtccccgtaccctcccaagtgccaggatcacaggtgtgtgccaccattcacatgacctttcacctagattgtgctagagcagtgctggctggcctgtcccagaactcctttaagaggtcattggcatctgatgtatgtcatggctctggcctagacccagaccaccagactgactgactgtggtgggagctgatcaaaaaaaaaaaaaaaaaaaaacaataaataaagagaacgtactacaacttctttattatatttttttgtttgttttaatactttgttctttcaagaggcaagggtctccgtatatagttctggttatcctggcacttgctctgtagaccaggctggtcttgaactcccgagattcacctttgatcccagtgttggaatcaaagcttgcgccaccatgcccagctcacagtgcagtttcacaaggtacaaaggccctggggcaggtgcagacttgcagttagatgctggggtgatcagcaagaccagccagcacagaagtgaggagagcagctgtcgcgaagccccgggccacctgatggacaagcatttccaaggcaccaggatttagtagtgaacacacattctggtgtgtatctggtcaggctgtctgtggctccaggcctgttgattcaagcctgtaatcccagcatttggaaggtgaagataggaagattatagagggtcaagttcatctttggctacatagcaagtttgaagccaacctggactatataagaacctgtcttt

SEQ ID NO: 27518 - DNA, 1210 bp, Mus musculus
atgtgctgccccgtccagcagcttcctagcgaatgcacgatctgcagtagccatgcactccgtaggcgcttcgcagcgcgtactccctgcctccagcgcggtacgcgagttcgcggggcgcagcggggacgcgcacatccaccctgccttccgcgtccagctgcgtccagctgcgaccccgccccccggcgccgcggttggctgaggcccgaaggcctgcgattggccgggcgcggcgcgggcgcgggctccgattggctgtgacgcggggccccgccgacgccccgccccggccgccgcgccccgcgccggccggtcattgggcggcgtgatatcgccgcggttccgcggccgccgccgctgcaggcagagcgcagcgggcgggccgggcgacgggccatggcgggcgccgaggacgcgccgggccggcagccggagctggacgaggacgagacggcggagggccggcgctggggcgcacagcacgcgggagcccgtgagctggcggcgctttactcgccaggtaggacggatggagggcctgcgatctgatgggtgctcggcgccgggcccgccccgaccgaaccccaggcggtccgaacacctggaccctaacccatctgagccctctggatccgaaccttagcccattcgaagtccccggattcgaaccctaacccatcctgagtccacggattagaaccccaacctattcgaacctcacttcgacccaacccgtccgaacccccacgaatccaaaccccagcccatccgaaatgccgagatctgaactctacccagatccgaactccagcagcccatttggacgcccttggatccgaaccgcactccatccgaaccctagccccatcctaaccctgcccccaatctaatcccagcttccacccaaagcggaactccagggcttccaactttgcaaagagcacccctagatcttgggaccctaactaaaccccttcctactccgagccgtgaggctttggggttgcagagatttaggaacagccccaatgcacctgcgcatccagagtcctagccccagggcaccttgggcagtttaggaaccccaccctggcctgccttgtcttcctaaatcccagtccaaggcttccggttctcaggcagcgcgaagccttagacatctcagtcgcaggcactgcccttagccacctaaactcacacgcagtcc

SEQ ID NO: 27519 - DNA, 1202 bp, Mus musculus
gttttctgtgatccggtccacttgaggggttctggtggttcattaaaaaaaaaaaaagtattatgaaagtagggttctcccccccaccccccgccatgtatgaaacagtgaattgaaaatgcaaagatgtctttgcaagcagctaagtcctctaaagaaaacaaatcttccgattaaatgtcagtgcgggggttgtgaggattaaccatactcgccaggcatcttaaataagcatgtgcaaaatagatcctgttcctcgggtaaagagagcaggcggtttattctgctttcagcttctaggttcaaaagacagcgggtgagacccatcagctggaaattgaaatctattttgagcttcacttaggaaagtaggcaccctcaggctgttgtttggtgttcttgactgacaaaaccttttttggggggttgccttggtttccagattctttgacagggttctttttacttgggcctcggtgtgctcgtcagcttttttggggggcagatatttgtagctagtgtaatctgtgtcagtcgagcgatcaattgtaacatttgtattgcacgtctagtctatgaattggctggacagattccactaaggagtcaggtctgtgggcagattttctgtatcagattaaatgcaaggggatcccagtgtaacaacagcacgtgaagattgttctgtaagccactctgatgtgtggaggttgttggctaaacagaccgtcccaagtggagaccgttgaatctttagtactgagacagacttatttggtaacaaattggcatcattaataagttatggtagaatgtggttttttacgcttttaggttagagtggcctgccccgacatctaagccttgttaaagctggcgcagagtgggctggctttgaaatctgttttcttcattcttctccaatttctcctccacacttaagccccacacgttagtaaattgctagtaatagtaatagtaagccccacaagttaagtacgatgccagggtccgcacagcctgttcacaagtgcttgtgcccttggttccccagtgtgaaggttttatgttctctctctctctctcttctttttgttttttagagataaggtttctctgtgtagccctggcagtcctggaacttgctctgtagaccatctggctggctttgaactcagagatcaggctgtttttgtttctgg

SEQ ID NO: 27520 - DNA, 1153 bp, Mus musculus
acttccaccctgtgccgggaagcatgctgggatagagtcaaaagctgtatacttacggtattagcatcagcctttcggtcagtcgcaggttatgttgagggcctgccctggcctgggtctgagattagaaatgagggcctctctcttaatggacacctgactgctttcaggaagccatcctgctctgccctgtggcagacagttttaaacaaataatgcattcttccatggagcaagaagaagtcattcactgcatggaactaaagcagatgtgttaaagccagtgctgctgtttgacttagcaaagtattctgtgaaaatctggaggcatttctgtgtggctggactggatgttatccctgtttacttccaaaagaaatagagatctcagtcaaggcaggtcagctgctttgtcatccacgttggtatttctgactaattgcatgtgagagacacttgaatcagcttccctaaatgcaaaaatatcattctgcttatttcttgttcatttgttctgttttgagacaaggtctcattatgtagaccaggctgtcctcaaactcacagcaattcacctgcctctgctcctgactgctgagatgaaagctatgcagcctggtgccagggatcattttgattctttgaggtgggatctagctgtatagctcaggctgacctcagcctctgagtactggcatcacagatgtccatggccaccatgactggcactcggaccgtttgtgtcctctcaccatggctttaatgctagctttgtgatcagttcactttctcagttcaggtttttgtggagtcatgcagctggaggctctgaaggcctgccatgcatacctcgttctcatgcagattctgacgccctccttctcccatctcaattggaatcccctgttggctagcttcaggtcagattctcatgtcttggggagtatgctggaaggcggcttgacgctgctgtctttctcatgtcggcagaaggaagcgtacagtcaggctgtgctgcccttccaccgtgaactgcctctcaggctctggggctacacagtccagagaaggggttgtttctctgcttctcatgggcacttggtgggactttctattgtctcagtacctgtagtttactatattttactttagc

SEQ ID NO: 27521 - DNA, 1223 bp, Mus musculus
acaagcagggtgctctgtgctcggtggggagggttcatttctccaggtttcctccatagagatggtctccttttccatctactcagggtaggtaaccaacctgtctcttcctctctcctcagcatgagtccagacactgaagttaggagacggatggtgggtggaggtcttcaaagtgctcaggcgtctgtccccaccgaggaagagctgtcctccactgaggaggaacacaaggcacattggccaagtcactggaagcccttcctggtcaatgtgtgcatggccacgctcctggccaccggcgcgtacttgtgctaccgggtgtgttttcactgacagactgggaggcactgccactgcccagcttaggatgcggtctgcggcgtctgacctggtgtagagggaacaacaactcgcaagcctgctctggaactggaagggccagccccaggagggtattagtgcactgggctttgaaggagcccctggtcccacgaacagagtctaatctcagggccttaacctgttcaggagaagtagaggaaatgccaaatactcttcttgctctcacctcactcctcccctttctctgattcatttgtttttggaaaaaaaaaaaaaaagaattacaacacattgttgtttttaacatttataaaggcaggtttttgttatttctggagaaaaaaaaaagatgctaggcactggtgagcttctctcgtgccctttggcatgtgatcagattcatgatttctattgatttccagtggaaggatcccgctgggcaggactgtaaagttcctgctggcgtgggcagcccccactgtgcacccggagcttgcaggtgccctggagccccatcctgttgtgaggagggcagccacatgggctgcctctgaacagcaagcccggctctgcttcgctcaggtgtcccccccgcggttccatccttctcggtctcctccctctttgtgagtgccatcttgcaaatggcccagcccttgccaccctatccctgtaaatccctgagggccttgcctcggggtcagaggtggctgccagcctaagtgctggggtttccatttcatttggaaagtcattactactctgtgtggaagccactctactgaggtgcaagcaagactggtgaaggagaaaggagccctggtgtcatggaagcccctcggcaggacctgtacccccctctgaaacactgttccagt

SEQ ID NO: 27522 - DNA, 1140 bp, Mus musculus
gctgcccagcagcagagcctgcatgccagcctctgcgctgcaggccacaatggccatggcggcccaaagagtgagctgcgatggaggcttatcacatggagctgccttttcaggctatgcatctcccttcctgctttaccctctgcttccttcccgagtagcaagcccaccatcatgaggagtgcaagggaggggcaggcattagagcggggtgcggctttcgaggtgaggccacctccgaggctgccctcctcttatttattcactttgcccggaggtggcccccgcgtgagcatgccctgaaactgaccgtgtctgcctgcacccatgaccgtcaggtcagtcctggggttgaggcatgagtgcaggactgacaggagccacagtatggccagtgctggggccaggagcaggagcaggagggtgtgaagagcagccttcaggagcataggacagtggtaatgcgcagagcccctgtggctgctcctgcgacgtgcagggtggaggctgggctttctgcccacgaccttctagatcccattcccggcctctgctttccctgtgagttagaagatacacagttctgtgctggtggcaccttgtgcttgacatgggaaacttagaagcctgctcactgacaggcacctcccgtgctctgaccggaagtggccgtcgctgagtaaccaccgccactcagtgagagcagtgctgtccagtcaggtgccacctgactcctggcaggacacttcaggcttccgtcctgccactccacgccacgccacgccatgccccgctggatctcagacattccacactcacacctcattccctggacacttaggcaagcagggttcttccacctcttggatcagcccctccattccaagttcatgctgtcctggagcaggccaggactggaagcaaggcagcttgtgagaagcaacctcctgggaacagtatggatgacagccttagagtcggcctgctgtcattgctggccccagggccccttacccagaagtgtgcagctctccggcctgggagagacggatgacggtgctcatgactcttctgggaggggaagaaccgagccttcacattgggtggctttttaaaataagcgaaggcagctggaactcc

SEQ ID NO: 27523 - DNA, 1697 bp, Mus musculus
gtatgtgtggtgtatgtgtgtgtgtgtgtgtgtgtttgtgggtaggtgatagcatagttagttgactcccacactcttcagtgtaccagacagtgtggatcatgggataaaaatgcccccaggttaagagacttacacacgatatagatgtgcactttttattcaaaagacggagttttcttcctggggattctagggtgctgcccacatttggggaaacccgtgtcaagtacaccactcgcagggctggtgattatttgagtctatttattctcttctgtgcgtccatttgggatgaggggaccgcagttgtcttcccttacctggctccctcctgttgcatgcacagtcagcgagacccacgtgtgtggctcagacttccctgaggcccaaggctctgagggggacagttatttatttcttaaccttgtggtggccgagtgtgggtgcctcataggtgtgtactgactccgagttgaaggactttttcctcgtagtaagagccggcagaaatgaagtcttgatccaatgaagggcactgactgagcgagttatctgcaggcgcctggcggaggctgggtgcagtgagcctgtgactgttgaattcactgagtttctcctctcacacggcacccaccgcttgctagcagtgctccccctcgctccccctctgacactgcgctccctgcagtggaaggcagccataggcacagaaggctcagttgcatatgtaacttaggggtgcatgggctcagcattgtaagtaaagatatttcacatactacctctctcttctctctttctctctctttttttaacagagttttaacatagaacctttctcttgggggaagaaatacttcagggcttgacttttgtacaaattttaactgaaaaacagatttctcttctgtctgaaaacggagatcagagctgctgacgctgattttaatttcaaggacaatagtgtttgttagtgatgaggtcgtaccaatgaagtcaatgtcagtagaccttctgtgaggccagtgagtcttggctgtggaggtcccgtcccgtcccgtcccgtcccgtcggctcagttcttgagacacctcggaacaggagcgtaagcgtcggcagcttagcgtgcagttctgttgtcccgaacgtcgagcctcactgtgaattctgttctgtcctaagtccgccatgtcaaccagatgctgtgctgttgtgaaccatgaattttctaattaaattttacatgctataacatacatgctataacatgatttttacatgaatgatactttgtttaaactattaaatgtcagtattttactacaattttattataaaatgtacattatcactaaatgaactttgattttaagaatcaagttagctttagttacatattattttttacaaataaaaacggacttgtataaaggctactttcttgtttgaaattacatgaagagaggatgtaaggatgtttgccaagcatccttagttactgcatagggagtgaaactgagtcaccactgattccttgacccttttccagggctatgctgagccccaggcctcggtccccacatcccccacctgtccaggctgaaccccagctcggggcactcggtctctcggagctggaatgacagacgcaggccatgtggccattccctagttgttttgttttggtttttagt

SEQ ID NO: 27524 - DNA, 2067 bp, Mus musculus
cctaaaattcccagtgataatttagaggagcctgtaccgaaggttattccggaaggtgctttggaatctgagaagctagaccaaaaagaggaggaggaggaggaggaggaggaggatggttcaaaatatgaaactatccatttgactgaggaaccagccaaattaatgcatgatgcctctgatagtgaggtagaccaagatgatgtagttgagtggaaagatggtgcttcaccatctgagagtgggcctggttcccaacaaatctcagactttgaggataatacatgtgaaatgaaaccaggaacctggtctgatgagtcttcccagagtgaagatgcaaggagcagtaagccagctgccaaaaaaaaggctacagtgcaagatgacacagagcagttaaaatggaagaatagttcctatggaaaagttgaagggttttggtccaaggaccagtcacagtgggaaaatgcatctgagaatgcagagcgcttaccaaacccacagattgagtggcagaatagcacaattgacagtgaggacggggagcagtttgacagcatgactgacggagttgctgatcccatgcatggcagcttaactggagtgaagctgagcagccagcaagcctgaggccctggcgtgccatagcatatgcatatgggccgtgttgcatcctggacttctgctctccttccagtctgactgcaaagctgtcttctaactggcactaccttgcaaggactggtcagtcagcaggctgtggggatgtgtgaccactgtagtctcagtggttatttccaagtctatgatagatgactggttgatctttgttcagactcttctctggtagactcggtgatgaagtgtgaaaaaccagtaagctggtagctcatgaatgcacacagggagaagtagttccttacctacctgccttctcagcatttcttcccctcagatgtttggttggatgtcctgggaaagccttatcctgattcacatagtagtgcagggcgggcatacacactaccagtcaaatgtgtctagtagacttgggaacatggaccgttttttcatgtatcttctgaatagttgaaatgtatatttgtacagtcttttagacctaaagtgatgcttatgacactgttactgtgtgcccgtcatagattggtttttagtgttgcccttgctgtgtgataaatgctatatctagtttacctagcagaagcttgaccctgcgatagtatggacctttggacagacttagtttttgcacataaccttgtacaatcttgcaaaagaggccagcaacataagatatatatctggactctcctgtattatagaatttttttcttgttctgagtatccttgacattacaattgtcaaaaatggtatttcagatctctttctgagaccttttaagctaaaataacatgcaagaattgattttacagctactaattttgacaccttttagacctgtaagagtgttgtatcagagcaacaagcacagttgagtgctgcgtttgggatatttagtttcctctttagttgagcaccactgggtgtattcatttataccatctaatatatgacacactgttgtagtctgtatgattttgtggtctttatttctctttgtattcattttaagcatctaaataaattgctgtattgtgcttaatgtaaatatttgcttttattacacacgacagtcctgtgtctattacatcttttgctgtttgatgccacagcaccctgagaagagatggaagacacactcacaaagaatactgtgggaaatcacaatctatcatttgcttaaagcatgctttctctccaggcacctgctacaattttgtgtatatgtttcctttttgctgcaaaagtaaacatccttgaggttttcaattccccttttgataaggagcattgcctctgtatgtagacatggtgaaggatggaactatgttggcccctggtggtctttcttccctgtgtactgtttattccctcctatggcaacacttgtaccaaacaggcattaactattttgccctgaagag

SEQ ID NO: 27525 - DNA, 1170 bp, Mus musculus
aggactatcggacaaaacctttttgctgcagtgcttgtccgttttcctcaaaattcttctctgcctacaaaagtcatttccggaatgtccatagtgaagactttgaaaataggattctccttaactgcccttactgtaccttcaatgcagataaaaagactttggaaacacacattaaaatatttcatgctccaaactccagcgcaccaagtagcagcctcagcactttcaaagataaaaacaaaaacgatggccttaaacctaagcaggctgacaatgtagagcaagccgtgtattactgcaagaagtgcacttaccgagaccctctctacgagatcgtcaggaagcacatctacagggaacattttcaacacgtggcagcaccctacatagcaaaagcaggagaaaaatcactcaatggtgcagtctccctgggcacaaatgcccgagaggagtgtaacatccactgcaagcgatgccttttcatgcccaagtcctatgaagctttggtacagcatgtcattgaggaccatgaacggataggctatcaggtcactgccatgatcggacacacaaatgttgtagttccccgagccaagcccttgatgctgatagctcccaaacctcaagacaaaaagggcatgggactcccaccacgaatcagctcccttgcttctggaaatgtccggtcgttgccatcacagcagatggtaaaccgattgtcaataccaaagcccaacttaaattcaacgggagtcaacatgatgtccaatgttcacctgcagcaaaacaactatggagtcaaatctgtgggccagagctatggtgttggccagtcagtgaggctgggactaggtggcaatgctccagtttccatccctcaacagtctcagtccgtgaaacagttacttccaagtgggaatgggaggtcttttgggctaggtgctgagcagaggcccccagcagcagccaggtactccctgcagactgccaacacctctctacccccaggccaagtgaagtctccctctgtgtctcagtcacaggcatctagagtattaggtcagtccagttctaaacctccaccagccgccacaggccctcctccaagcaaccactgtgccactcagaagtggaaaatctgtacaatctgtaacgagcttttccctg

SEQ ID NO: 27526 - DNA, 1126 bp, Mus musculus
aggtgtcactcactgtgcagggcttctgtcattgagagtataggtgcccttagctcagctcatgatcctctcaagcactgggattctaaatgtgttaccacccagccccgcctgacccttaattaagtactttaacaggtagcggcctgaggaaaagcatggaggcctttgagtccttcttcatgtcatgtgtagtaattcagacatggactggtgttttattaaaaccttcttgcttggtttggtgtaaggcccagggagtatgaaggagaaatggtaatggttgctcttctggggagagaaagcactccccagaggtcttaactcataggagtttatctagcgaatgatgaggctgggaagtgctgagttttcagtgaatgttttgatgttgggagacccagccaaacgttggtacttcttaatgggttattctgagacctgtgacttaccggaacatgcccagattgaggcttgcagtcagtgaaggtgttggttacagtgagagtggaggtttgtcaggccccaggtgctggtgctttggagtcgattggtgtttttttgtggctttggtcttagagctatttttattctccagaattttgttggacttacattattataaaaaataaggttacattcaaagccttaaaaatgtcgcctcaatttttactaatcagttttcttaaataagcaaagtgccttgagttttaagaaacttggaaaattgatctacatttctactttgaatgcatttggcacagtcaggtgcctttttgattcccttaggcacaagtgcacgaatgttcacagggtttttgttttttttttttttaaaggatcccagaaagacaggattcactgtatgttctgatgccacaaacatgctttttcccatctatgtgtttattctgtggcctatgtgaggcctttgccctgatgtgtttccacccagggagccagtcccaccaccatttgggactttggtttgaggaggagaccgaaacagtcactgaatgacatgtggcttctgtgagtgtcatggccttgatcaggacatttcagatggcagaatcctcccctcagcactgaaagctgagtgatgctgtgaagctcggagtggctc

SEQ ID NO: 27527 - DNA, 1172 bp, Mus musculus
gctctgacttggctggatagtgactgcttagcaatcctagctcttgtcccttctttctgaactctgtgcggagctttgtggttgtctgctcactttcagaacagtgtgtggtgagaactttgcatatggtgctgcggcagctttacattttaagttgcaggtgtgagttctaagttagaattcttactcctgtgaaaggtgagctggggctgttctgattccagaagtgccccaactcatgaaaaacagcaggcgcaaagcacaaatgaaatgcctctggttgagccagcaagtgaatccctagtgctgtagaatctctgtgtgtggtagtgcctggctttcctgaaatctcagcaccaccgagaagtaggggtaggaggaaaggtaaggtaactgtttttctcagctgtatgggaagttgaaggttaacctgtttgggaaacatgccttttgttaaaccttgaccctgggagagggtgtagaaaaacagcttgataacattgcttaaataaattgttctgttattttaaactggtgtagaaaataatttctcattgctgtggaaagttattctggggtggttttgaaagagtagagtttttacataaacttagttacaatcttagatacaaccctaagattgagatacaaggatactttgttcttgtgattataaagggcacatctgcagtgcttaggcccactgggtattcgaattgcatacaccccagcttaccaggttgtccactctactatactgacaggaagttctctaagccatggagctcttcaaagcgcctttgcaattgtctagatacatgtttctcactcgtccttatctctgttttctttttaaagattacatcaccgagacatcatcttttcaagtaaaatatgagctcttaaattgatgggggttaacacgccagacctggcattgcatcgcagctttctctttgttccttggacatggggttagcaatagagtcttaaaagttacttgcgtaggtgtggtaagtgtacaaaagtcccagtagacaaatatttgaagtaccactgaatataaaaactagaatgtgctaatttgaactgctcagttacatgtacccaaattattgccagaaccactacagtgtgtctgtgtgagtacagatgctcattatgctgtgtac

SEQ ID NO: 27528 - DNA, 1225 bp, Mus musculus
tttctttataaatctgcattgttgcttctggtttatggtcatggagaaaataccagcccccacccaaaaggcactgcagccaagtcggttaaaggcactgagtgtgggagtcagtagggggcgcattccctgcactgggtaaggctgcagaggggggaagggccccagaactagaacaggatgtgctaaacagcgccttctacagaccatgggaaaatgggtccagcaagacttgcactgggtgagctgacagcaacatggcgaaggattaagtgaggctagagagattttatttaagaaagccacttctccgtttggaaagttgtctttttttactttttcaaacctgttcaccctcagactttgattgctgatcagtcaccttggtgcacatccttgggtcataggttccctttctcaagaattccttcaccttaaggtttgatgtgttgacatctctttcctaggctaggtggtaaagggggttgtttaaaacctgaaagtcacgggcttgggagatcaggtcaatccaaatctctccgactcttttgcgagtggaaagtcattcttgagaggttttatgggttggtgattttgacagccatgaaagatgggtgtcaggatttgcaaggctttgttggtaaacatcaggtccctattgagttcttcattgtcaaacttaatagagttcactgcaaaattgtgttgccttccactttcagcagtacactgtctgtagccaactgcctttgcaagtgttgacaccagtcttggttcggtgcgcacccacctttttagggtgtgtggatttctgtagattttactcctgttgttatttccataggtgtgagatgcacagtacgaaacctaggccccagcttttacatcgtgatgcacagggttgcactttttgtactgaactgataggtggcctagtggttattccctgtactgccattttgaggatctggactccgttccctgccttgctctttggactgcattgtcaattcacaccggtgggtatatcattttggagggtggggactgcagcatcaggaaagctagagacttcctcctgatcaccaccagaacatgaactttcaaaatttcagcctcgccacattcctcaaggaactcgttagagctggttgcagtaatgggttttgaacgtttaaaatatgtgtctcttttaagagaaaaatttaaagtcgatgatgttgtt

SEQ ID NO: 27529 - DNA, 1189 bp, Mus musculus
gggatgtctctgtcctcacctcatccagtcacagattaagatcacctcaactgggggctgaagagatgactcagtggttaagagcactgactgctcctccgaaggaggctcacaaccatccataatgagatctgatgccctcttctggtgcatctgaagacagctacagtgtacttagatataataataaataaatctttaaaaaaaaagagagatcacctcaagtatgaaatcttgggatagtcatttaaaacatctcatttttctgtaaaacaaagagattggatgaatagtggttttcagtctctcctaaggagagaacacacagcaactcctgcccttctcatacctgttgcctaccatgtgactgagattctccaaaggctggaggcagactcagctggagctgaaaacaaattattaacctccaaagacattttgaacttggtcattcactcacctatgaattaaaactaggaagtccaaacaggagcacattctaccttttagtcgtggcatttagttgtatttagttttgactggtgatagtagttactgtctgtattttgtaggcctcaggtctcattagtgtagcccacaactagaagtcagactcacagctggtgactcttaacacactttaatcaaaatactctaaagatgtatgtatgtatgcatgcatgtatgtatgtatgtataagagtatgctgtagctatacagatggttgtgagccttcatgtgattgttgggaattgaattttttaggacctctggtccctctggtccctctggtcaaccctgctcattcaggttgcccccgcttgctcagtccctacttgctccagcccaaagatttatttattattataagtaattacactgtagctgacttcagacgcaccagaagagggcgtcagatctcattacagatggttgtaagacaccatgttgttgctggaatttgaactcagaaactttgggaagagcagtcagtgctcttatctgctgagccacctccccagcccattgaaaattctccagttcaaggttaggttgaaccacataagaagtccacaccatccatccaattaaaaatccatcatcaccaggcaatctagtacatgcctattggcccccatattcaagaggataaagcaggggaattacttaaatataggcttttaggac

SEQ ID NO: 27530 - DNA, 1197 bp, Mus musculus
tctactccaggagccttgcagcacaatctttgagcagtggaagacccctggttgtgctgacaaaaaaaaaaaaaaaaaaaaaaaaaaaaaaagaaagaaagaaagaaagaaaatttaagtgggcagtcagttagctaagactattgaacctcccatcccccaacccctcaccccttctgttttttaagggccccgaatttgggggtttaatatgttttgttttctcgtcggatgtgataggatcacatgctagatgctttgaggacacggtaatcacagaagcagcttggtagccccacagtgacttaagtatatgaactaaaggacagagacggagagagctgaactctttaccacatgagcaagaagctgggggacttgggtggggcggtgatgtatcactgcgtaggtagacatttgtattaaaatggctaaatgatcgtcacaaggaaagatgcagaaagtagcatctaattggatgcctggtttgggttgtcatctcacatctttttaaaaattctctctccctcttctagttaatgaaatcatcaggaaggagttttcaggacctccctcccgaaatcagacctagaaacaaacataatctcgcgacgccttctactctggaccgcttctgtctcctcctgccgtctgtgactggaacactgcgcatgcgcacagtgcacgcagatggtgtcagagcctgggagcctgctgccgcgcaaacagcatcttagccgttgtccatggtgactggacacgaaaagcaactgcctgctgaccaaagcctcattctcaactcaccaggatgctgaacctgagacgccaggctgcgctggcaggagaactggagaaactgcgatagcccacagacatggcttcattttttttgaattttctctttccaaagccaaacagccttgccctgacaggaccacctgtcccaacttctcagccttaagttataacacacgtacgtgtctgccagcttctgggcctttgctgtgttttcctctgcttcaaagagccaaccaaggaggccgtgggctgagagccctctcggccagctattccctaacctgctgcctacaccagactggctggtggcatccagtcccggctgcctgttgggaaccctgcttctgaaggttcccctctccaccccctccacccagaggtcgggagaaccttctggat

SEQ ID NO: 27531 - DNA, 1231 bp, Mus musculus
tttttttttttttttttttaattttttttaattaggtagctctgttgttttgtattggggattgaacccatggtcccacgtggggataagctcagagtcctacgtgctgaacagcaggagggagacactcaccactgttaccataacatgtccagaccccttgtctctctgctcctctccatagcaatcccaggatccacctgctcagaagggccccacggtcaccaccaaggttcggaggaccatgagcagccgtgtccacgaggctgtgaaggccattgcactctgccacaacgtgacacccgtgtacgagtccaatggtgtgacggaccaggctgaggctgagaagcagtttgaggactcctgccgagtgtaccaggcatccagcccggatgaggtaaccctggctgggaaggaagggtcttagccacaccacttcctccatcactgctcagtgggaccctgactgtccacgttcgctctgtgcctggccttctcaattccctccctcctgcccacaagacttggcttctgatagcagcaacggtttttggttttgtggacagtgtctcatatagcatgaggttggagtggcttcaaggtaccagggctcggtggcccacacggctaggatatagcaccgtgaaaaccttttcttaagccataggtcaagggaaactgggatatctccctttaagccctgtcgctttgcccctggggaagactcttccttgtactctgtgtggtgctgtggggtagctcagcccaaaaaaccgtgcttgtccgtgaccactgatactcaaaacaagcgttttagggaaatgtgggtgctgggagctggggaccctgtgtaagtggagggggcggtggggctgggctctgctccactgttgtaactgacgtcatcattgcttctccagctccctgggttcagtcctttgcaccttgtctttcaggaacagaattgggaccctccggggtttgggctgtgggaaaggatggtatttttttcttggtagtttgtgactggggatcaggaccatgtgtgagcgtgtgatgacgttggagtttgagatactgatgctctgcacggtgtgcctgctctgccctctgtggaagcgtcgggtccaacctgccagcttcctttatgcagggtcgctgtgtctgttttagggccgtgggagggtgctctgaggcgatctcgtcatctgtcttgtttctccaagtttct

SEQ ID NO: 27532 - DNA, 1201 bp, Mus musculus
aggcctaccttggactggaaagaagaaaggaagaggaatgttccattttcccaagttggttccgagtttggttctgaactctgtggtccagagcacaagacagcggagacgagagggaaagagttggggagagaggcctctcatgtctgggtaagccagcccagcccagtgactctcctggttctgtccaccatctcatagaaggccagccaaggcattcctatctgttcgctccgcacagtcacccaaaagccaactgaaatttatagcatagcacgcagactaaaaatagccccccccccgcccccgtcctccccccatgactcacggattcatgcactccgtaaatatttactgtgtaccgacactgtggctggcaacttcagtgctggggacaccagaggcacactcctggcggtggcagcttgcatgcaccaagacacatcgtgtgtcctgggaaggcttgggtgaacttggagtcttaggtgtcagccagcgctctgccctaggtgtgtaaagcttgtctggggaattgtgtgtgctccgtgcagtctgcagagcttaaagaactccacatgcccctgccctgcggccaccctgccctcccggccccccatcctttctgtttgctttctcctcccccttcctttcctcccactctttctttctctccctccttccatagcccctgtttctaggccttagtgaggtctccagacccttctcagaccctgggtctcagcttgcagactgaacccatgctggcctggtgcttgaaggtcgctcattcctgtcccagcctgtgcatcacagctgtggtatcactgagactttccagcagtcgctaacccacgggctgagccttggggtcatagtcacgagtgtccctcctgagtcagtgggtatgagaatgagagggcctatgggaccaggaagaccttgtacagcccagaactacagcgagaaaccccggctctggggccccagtgggatgattgctttgaggcagggcctcatgtagcccaggctggcctcaccctgtccttacctcagaggacttagataacagctgtaggtcatccgatgagctgcccagtggggtttttaaatcacagcccttccatctgggaattagagtgatagttcctggtgcagcacctagtgattattgtcccaagtcttggtgctgggttgggatgca

SEQ ID NO: 27533 - DNA, 2235 bp, Mus musculus
gagaaaagctcgctgttcccgacggcatggccaaacaccagttccctcacttcctggaggaaaataagattgctgtcagctaaggaggaagaggagaggagtcttctgcagggagattctagaatctgctttattctttagttttttgtttttttttttttttcttaacccacctcctttttttattttcttcctcttcctgatatgcaagtgatgtggcttgtgaccatagccttgggcaatcctacaatcacgagagttgctatgctgctttccaaaaaaaagatgaaaaatggaggaaaagtgaaaaacaacaaaaacaaaccaaaaaaaaaaatgataaaaagccagactttttgtttttgtttttaaaccattttggaaagaagcgggttttgaaaaatagttctgttaatttgggacaaattatattctagaagctttgtgtgacctcatggctgtttccaaagactgtcatcaacctgtttcgaagtgaaacagttgggactcattggaccacagtggaagtgacaactccttaacccagtcctggggtgagggtgtggtgtccttctgtggtgactaatgcgggtaaatgtagggacctggttttatgcctcccgaccctgtcttcatcctctgtttttttttttttgtttttgattttgttttttttaaatgtactttaagagaaaaggagaagagaatgccagaaaactaagatggttcaattaatccacttccttcagccttatgcccttggataggacatcctccatacaccggccatggtccctcggaaagcccacaatttctcctgctgcttccttaaatatttcagagcccttagagtatgcctccaacccctgctaccccatctcccacaaaccaccttcccaggccccagggtggggacaggcaccagagtgggcacctcaggagattttctgaggttgtcttcagtgcccgctacattggaaaactgcctgtttcctagtggcaccaggagggttgcctcgactccacgtgcatgctatcctttctgtttatttcggttattccaagacccaaagaccttcacacccacccaccctccgccgcctgccgtcatgaaggttatagagttgagaccagcaagtcttggatgtgagggctttaatttatctacctcaattatctttatttttgtagccaaaagtcttctctattttgctatttttgcgaccacccaagtattgccaggtcttaaacctaagagttcttatactggtaagaaggccccgaagctcaagaagtcttcgtggttggttctgtgggttttgtttttgtttttaattacatttttgttcgtgtaataattctgaacagctgttgtaacagtgttccaatggtttagtgaggtaggagagatttctccagtctctgggtagaaaattctgcctgccgtgttgaatgcccttgccaaatgaagatggagactctcgcccagtgtttcctctgacttgttgcacctgattttaggatccaaaacttgttttgttgttacttctttctttttctctttctttttttcgccaagtcgtgcctttccttctgggattgtaagtgaaccccgtgatcaagtgttcaccggttcacctgtttacactgtgaagtgggtatcttacggagaacacaccagccttggttttctcacgccccgtgaatgaatgtgtacgccacagttttacctgctgatactgtaaggtctgaaaataaagtgaatgttttccctccatgaggcgggcttgtgtgtatgcttttctggtatggtctgctttcaaagcactcccccgatccaattttagagtctgacacacatatatgtggttaggtccattctggcccctaatgtagggggcatgtgtgagggttgcgtttatattaacacacacacacacacacacacgcttgcagaagactgcttgtggaggacacacacacacacacaggagcttgcagaagactgcttgtggaggccagacacacacggacacacacacacacacacaggagcttgcagaagactacttgtggaggccagacacacacggacacacacacacacacacacaggagcttgcagaatactgcttgtggaggacacacacacaaacacacacggacacacacacacttgcagaagactgcttgtggaggacacacacacacggacacacacgcttgcagaagact

SEQ ID NO: 27534 - DNA, 1194 bp, Mus musculus
ctgttcggtcctataggctatatataggagacttagtgtcccttatacaatcctcctgagtcaggacatgtgctgatggggaattgattactgctggtcacttgacatcccttctcagggcatcctgctcacctttttctctcctttcacaggtgctccagtgaactcccctgggaactgcgatgaagcctcagaggactccataccggtgaagcggccccggcgggaggacactcacatctgcaacaaatgctgtgccgagttctttagtctctctgaattcatggaacacaagaaaagttgcactaaaacccctcctgtcctcatcatgaatgacagcgaggggccagtgccttcagaggacttttccagagctgccctgagccaccagctgggcagcccaagcaataaagacagtctccaggagaacggcagcagctcgggggacttgaagaagctgggcacggactccatcctgtacttgaagacagaggctacccagccatccacaccccaggacataagctatttacccaaaggcaaagtagccaacaccaatgtgactctgcaggcgctccgcggcaccaaggtggccgtgaaccaacggggtgcagaggcacccatggcgcccatgcctgctgcccaaggcatcccttgggtcctggagcagatcctgtgcctgcagcagcagcaactccagcaaatccagcttacggaacagattcgcgtccaggtgaacatgtgggcagcgcacgcgctccactctggagtggcgggggccgacacgctgaaggccttaagcagccatgtgtctcagcaagtgtccgtgtcccagcaggtgtcggctgccgtggccctgctcagccagaaagcctcaaacccagctctgtcgctcgatgccttgaaacaagccaagctacctcatgccagcgtcccctccgcagccagcccgttgtcctcggggttaacgtccttcaccttgaagcctgacgggacacgggttctccccaacttcgtgtctcgccttcccagtgccctgctacctcagactccgggctctgtgctcctgcagagtcccttctccgctgtgacgctcgaccagtccaagaaaggaaaggggaaaccccagaacctctccgcctctgcctcggtgttagatgtcaaggccaaggacgaagtcgtcctcggtaagca

SEQ ID NO: 27535 - DNA, 1168 bp, Mus musculus
aattctcccatctactacacactaatctcttttttttttttttttaagttacttatattgtacatgcagatgcttgagtctgtttccaccatgtgagctggctggcaggaaaccaggcttggtgacgtgtgccctacccctgctgagccatctcaccggctcaacccagcagcagggcaaaggccccgccccggtgttacgctgccggatctgccctaggggagcaccccgggatttggggctccactctcccaggccggcagcgcatcctcctggcatctgcgaaggaatgagcgtctccaggagggcaagatgcaaaggcgcaaggcgaccacagagtccctggcatgcctgggatagggtggagggatcggtgtactcgggtcttagactccacgacctttcccggttcctcgggagagcaccgcctgggagtcgggctgggtgcaaggggccagcgccctctaggcagcggaagtggcgctggttgtacatccgtccccgcctcacagagttgggagaagactggctggtgcgggaaatatgcaggagaaaagtctttgcataatgtagagcgagccgtggggctccgggagcggcgccccaaggtctggggccatgaacgcgagcgtggaaggagacaccttttctggatcgatgcaaagtaagtactgaacagacgcagctggggcctggcccggacagagccagcaggccccgggatcggggtgacggcgcaccttgcatgcctgtccccgccagcccagtcggcgtgtcaggtcgggagccgcctggaactcttgcagtaccccaggggaggcaagaccaggggaggccacgcggcgaggagactgtcaccacctcccctgccccgccgggtggagtttggggcgcagaggagaggagaaagtggggtgatccaggccaactggtagggaaacttctgcttcagtggctcaggttggagcatccctgaggggctcgcggacaggtttgcagagccatcctggcactcagggtaggggatgatatgggtgtgaaagacctggctgggggtgacttgcagtgagtttgaggttctgctattttcctgacatcctataagctattgctatctccatgtgcctttgttccccaaagtacgggccacggactgaaccgtggaccg

SEQ ID NO: 27536 - DNA, 1152 bp, Mus musculus
cgactatattagctcattagtcaatttttctttttgttttttgttttttgatttttttcgagacagggtttctctgtgtagccctggctgtcctggaactcactccgtagaccaggatggcctcgaactcagaaacccgcctgcctttgcctcccgagtgctgggattaaaggcgtgcgccaccacgcccggctattagtcaatttgttaacttgttaagactgtcagatttattatcaaagacgcacagatttcccttgatcgcggcttcctgatgaagggcacacaagttcagatgcacgctctcacagatgtagccttctcttactcccccaaactcagctcccagtgactcaatgctccagatttcctttccttgctatgtcactgtcctaacaccaatcagtatcgttctcataaatgaccctacgctaatacagcattccactaaccgggccaactgtgcagtcacaagttcacattctaagtttcctttggttgtctttttaactttagacttaaagtgtttctcatgctaaatttatatgatcaactatcgtgttcacaaggtcaaggtttggagtttccgctatttgtcttttaaatgtaaacttaaaattgtttctcattatgatacatatatatatatatatttgtctcctagacagaagaaaaaaaggccttcatgttccttctgctccacaaaaagtttttgtctcccctcagctcacctttaagactgttcatgctgctaacaaataagctccagaaaatccacccagatctacctctcgtgcaccaagcagactccatctggataaggacacctgccaatcattagcctgagccccacttgctccctgttccagagggtgggagtcctttcctgtttctgggattgggactcccctcaccccaaccgccaagtcctaagggtttcaaatgtacacctaaggaaaaaagatgtccccaaacgtacttaactttattctctacctctgatatgtgtgcttcagcatcttgtcaagtccaggcatctactcaaagtctacatccaggacagctccagaggagcaacccatagacacagccagatgtgcctggcttactataaaaggggctgttttttcctctctcccttactctctgccc

SEQ ID NO: 27537 - DNA, 1192 bp, Mus musculus
gttgtcccagtggtccttcactgcatcatcagtcacactggggagaacccttgggaatcttgttagtttcaggaacttcctaagacttgcgagctggttactttaggagttttaagagcctcttttctctatcctccagcaaatgtttcaatttagaggaaactgctacattggtaaatccaacctgggtagtgggttaacttggtaactgaggatcattaaatttgtgtgatttctagtcttccaagaaggattctaggaaatgtagggtaaaaggtcagagctcacttctgggtttgaaaaacccatgaaagctcaccaatccttcagcttgaaaacacatcaattcctgagcttgaaatcccaccaacccctaggctttccccaagttcagaacttgacatcccaccaatccccagcctggaattctctaccatggacgactccacccgaagaaaccctaaataaacctgcctcctgcttagtccctgctgcagcatactgacaccctgccctgggggtgttcactgtcttttcccacaaacctgcttgctttgaaaacatctcccagcaaatgacgagacaaatggtgtcctaaggcgagctgtgttgtggagtcttgtgagcgccggactggccagcagtaacgacgctgcaacaggatccttctgcacacgtttattgggagagcttgattgcagaggcgaagagaccctgagcccagaactggtgctgcttatataggcctaggagaggcgtgtctcacacctggattggttatgcactaagcctcatttgcatgttcctcatctgattggctactctctctctgtacctcacagagcctcattatcatacctcatttgcatgtctcacatctgattggttatacttccaaagcctcatcatgcccgggccaggcagtgtctttgcaaaaaactttactgcatatgtacacattggttgtttgtccaaacttatgcgtggtggccagcagtagtcagtgccactctgcaacggcacatgtggcttcccacagtggagaactgtccacccgatgtcacaatgatgctgtgtagaattgtccaccaatgtcacaatgatgctgtggagaaatgtccacccggtgtcacaatgatgcattgcactgccaggcaggcagggactctctgctccaccacttgaagactga

SEQ ID NO: 27538 - DNA, 1148 bp, Mus musculus
gggggattttttttgtctctctctgtgtacacacatatgtatagatttacaagtatatatgttgtgctcattttttttttgagacagaatctctcactaggatgatgctcaccaaatagggcaggctggccagccagagagccccagggatccccctatggctgcccctgagcactgggattacaaacacatctgactcattacagtgtgtgtgtttgggaattaactcaggttcttgtgcttctacagctaggccatctccccacttcctgcaatgaaggcttctgaagttatgagagcatcgaaggagaaagagtcacaattgattggtaatgtctgccctggctatagaagttatgcatgacagcacacaggatatacgttcataatggctgatttaaatgcatgcttgttcagagatggagggagtgagggatagagagagggagtagagagagctagagagacaagagaggaagaagaggagggaaaaagaaagaaaaggagacaggaagcaggaaaggaagagaagcatgattgattagtaatgtctgccatgggtgtaggagtgtggggacagcacacattatatactgatagtttctgatgtaggtgtagagcacagctctgacataatttcctcgaattgtctttggtaggtgaccgagtttctctctttatacttcttgctcatcagcagatgccctttagttgtttagacctaggctgtacttaaaccacattaataaagtaatgtcacaatgggtttctcagacacgaaggtggtagatgggcagtggcacataccattgtgtaggtgtggattctagtggcactctgttgtgtgacaaagcactctaaccaaaaacaattaagggaagaaaggacttacttgcttatacctccaggccacagtccatcaccgaggaagtcaggccaggaactcaaggcaggaacttgaaaacagaactagagagaatgagttgctctcttgctgctagtccatgcagtgttacctctgactgtgtcactaatagctgagaggaggtacagcaggaaacagagaatgtggcttgctggctctcatgcaggctcaagatcaggtagctttcttgtatggcccaggaccatgtgcctagggaatggtt

SEQ ID NO: 27539 - DNA, 1570 bp, Mus musculus
tattgagctctctaacgtgggtgcggggatcaaaacttgggttctctggtagagctggtgtggtagctgcggagcggtctctacagcttatttcttgcaatcctttaatgattgtgtgttttctaatcactttcaatgctttcccattaggtccctggatgcaagtacacacttccacggaatcatacattggttcatcttctgagagcgcacaatagctactgaacaagctgtgactgaactgtacatagacctgagaggagcagagaaggaacactacattctctaacgttctgttaacctttgtaccaaatagcaataaaaacgagtgggagccgttgggcggtgcgccagagggactgaaatctattttgtccctaaatatttttttaaagaattgaccaaataagtttttttttttttttgcatacttgagcgctgctgaaaagaaatcatttggggtagggtggggtggggtgggcaggggatgttgtaaagcttgcacctcaggtaactgtaaataccgacgtggtaaacttgcttgagtactgtgtgtctccctcatggagtgcgaggatttgagcattttctgcttctttatgctttttcatttaaaacatgttttaaagcatattctcactgagtctattgtttgtcttcacattgctgatggaacgaaatgttgacactcagtgatgtgctgtgcatcttgaggtcagcaggcactaacctggcaccttttactccagctggtagagctagagctaatgtgtacaggtgtcctggagccccagcttgctgcctggggtcttcggggggaggggggcttttgagtgggtgttgcctacagagaagctgcctctgtagagtggccgatgtcacagagagccaggctccatggggagccatctaagttcttttcttttggaagattgggtgtctcggagagttgccatatctccttgtgtgaattgcgtgcttggaagcaatttttaaagggagtggaaagcttagggaaatcgtttgtatttggagtcttgctgtgtctggtattggaggtgtggacaccttgagtctgggtgagttgctgctggctgagccctcctggcaggcagggagagaagacgcctgggcctctccattgtttgtttcccagggtgatttcctcagtgcacaggcagctcgagatggagggaggacagccaccaactagctcactcagcattttaaacttgagttcctttgatatctgagtttattcaacagttcttgggtttagcaaacccaaaatattttattaagaaactgtttcaaagataaatttgcactgctcctttttcttgccccacccctcctgatgggacaaaagggtgaagagctcaaagaaccccgactcccccctcccctcccacctcattgtgtaccatgaggggtccttgggaaatgtcttacctcttgtgttgaatggagacctgggttgagatgtgtctgctcttgtaggaagatcttttgtatcaggaacatgtacactaggccctgttcccgtccacaagctgagccatatgtacat

SEQ ID NO: 27540 - DNA, 1173 bp, Mus musculus
acaggtcatgggcaagttgggttggtgtgtgtgtgtgtgtgtgtgtgtgcgcgcgcgcgcgtgtgtgtttttactaagttcaccatcttttttttacctcagaaatgaagaaaattaaaaacaaaaaatcaagttgagaacaatcactgcacttctgtagacactgaaactctagaaggacacccccccccccagccccaagtctgaaaagacgtcactctataacagagtgagatagtgcaggggttcctccaccttgtattcttgacaaggccattttaggtttaactagattttcgtcttgatagagattcccgtggaaaattagccagctctgttctagaaagcagaggtcgggttgccttgggttctagctcctgttaaatcacctgctgaaaacctcagagtgaggttctgcctgccggaggccgcagtggtgcagagacccccgggtgaatccacgtcccatgtctgaccaggaggcaaaaccttcaactgaggacttaggcgataagaaggaaggagaatacattaaactcaaagttattggacaggacagcagtgagatacatttcaaagtgaaaatgacaacacatctcaagaaactcaaagaatcatactgtcaaagacagggagttccaatgaattcactcaggtttctctttgaaggtcagagaattgctgataatcatactccgaaagaactgggaatggagaaagaagatgtgattgaagtttatcaggaacaaacggggggtcactcgacggtttagataattctttttattttttatttttcctttccctcaatccttttttatttttaaaaatagttcttttgtaatgtggtgttcaaaatgaaaattgaatactggcactccatctcttagaacatatgaattctagtgttcaatattcattattggttgtttttgttgtgctgatttttggtgatcagacctcagctcccttaatactgccctttttcctttaagagatttcatgtgtgcacagagaggccaccctttttaggactgtgcattttcaggtttgtgatgataaaaagatcgaccaatgggagctttcctatgacctttcaattggctctgaagttccagcatgtggttgcttcactcctggactgtgattttcagtgggagatgggaatttttc

SEQ ID NO: 27541 - DNA, 1224 bp, Mus musculus
gggtgaacttgaagcagcttcaccaatgagaagcctccgcactgtggataatggcttcccagagatgcatagacatatttcctaactttccgttaactttcagtactcagtatactctgatacctcccaagaccacaagaccatgagcaactaaggaagaattacagaaaactggcccaaaaggtaatggatagaatacctggaatcttaggtgagggtccagtgaccctctctaacccatcctcttaaaggtcgagatctactcttcaaggtctcttgcaagtacagccttcttcttcgggaaaacaccaaatggcagatgaagccgatgtagcaggagggcccagaggacccgggggcccaggattaggaggccgcttccgcggaggattcggcagcggtcttaggtcgtagccgaggccgcggggctcgtggaggtaaagctgaacacaaggagtggatccccgtcaccaaactgggccgcctggttaaggacatgaagagcaagtccttagaggagatctacctgttctccctgcccattaaggagtctgagatcattgacttcttcctgggtgcgtccctaaaggatgaggttctgaaaatcatgccagtgtagaagcagactcgggctggccagcggaccaggttcaaagcattcgttgctgttggggactacaatggtctcattggtcttggtgttaagtgctccaaggaggttgccactgccatccgaggagccatcatcttggccaagctttccattgtccctgtgcagagaggctactgggggaacaagattggcaagccccacactgttccatgcaaggtgacaggccactgtggctctgtgctggtgcttctcatccctgcccccagaggcactggcagtctctgctcctgtgcccaagaagctcctaatgatggccggtatagaagactgctacacttcagccagaggctgcactgccacccagggcaactttgccaaggccacctttgtcatttctaagacttacagctacctgaccccagacctctggaaagagactgtcctcaccaggaattcactgatcatcttgtgaaaagtcacaccagagtcccagaatctctgttcagaggacccaggctccagctatggctaccacataaggggtttgtacaaggaaaagaaaggaagaaagagagagagagagagagagagagagagagagagagagagag

SEQ ID NO: 27542 - DNA, 1262 bp, Mus musculus
ggtggtacaggccagtaaagccagctgctctggaggcggaggcaggaggatctcaaattcaagcctgcttaagctacttatagttcagggtccgcttaacaatttataagactgtgtcttgttcaccagtgagagagggctgaggtcattactcacctggcacagacggcctaaatgcaatccccagcacaaaaagagactgcctacaaattgttcctctagatcatcggggcagaggtgctgtctataaagcccccccgggggctaacctttgctcagattcttaaaaagcagtggttaatttgctggcttttcaaaccctgcccgccctggtttgcctgcggtttaatatgcaatattcagcagacagctgctggcgctacaattagtgaggcgaaaataaccacgatccacattaccatcaagcccttgacattcgcagcacttgctgtggggaaagcaggccaagaacttgtcatgtgccccatccacttcgaggctggatgggatggggctccaagtctgagatttcattgatactaggcaatatggtttgtaaaatacagaaacactgcccaattgtgatgttgtcaatgggctcctgatgcccatattctggggaaccttagatactgccatagaagctaaaagcaccctagctttcttagacaatccacttagctatctgaaacttgaggcattccagacctgacatgtttacaatgcaccactgaacttttttaaattgaattaatcagatgtatatttgtaccactttggggggtggggggaggttgagaggaaaatattgctcgttctaactgtaaagaaaccaagaaataatacaagctggggaaaagagatgtcttaattagggtcctattgctgtgatgaaacaaaatgaccaaactcacggttccatacaacacttcatcaaacacagggagggcaggcacctggaggcaggagctgacagcagaggccagagaggagagccacttactggcttgttcagctgctttcttacagaacatagcctgccagctcatgggtgccagtggttctcaacttgtgagttgcaactcctttgtcaaacctctagctcaactcaaaacagtagcaaaattaattgtgaagtagcaatgaaaataaccttctggttgggggccaccatgaggaactgtactaaagggtggcagcatgaggaaggttgggtaccgctggtgtagagggaggttggaatagaaagtcaagcagagact

SEQ ID NO: 27543 - DNA, 1521 bp, Mus musculus
gagcgctcatcacatcaccacatggtatgtctgtgtgtcaaccccagtctccgtttggtttaggagaaccacaatgtgtggcaccctggactacctgcccccagagatgattgaaggccggatgcatgacgagaaggtggacctctggagcctcggcgttctctgctatgagttcctagtggggatgcctcctttcgaggcacacacgtaccaggagacttacagaaggatatctcgggtgagctgctgctgtcaggcttctgccgagggctggtgttttgtttattcatgttcacctctgacccatgcttgtgttggtttatcatttattctgcaggttgaattcactttccctgactttgtgacagagggagccagggacctcatttcaagactgttaaaacacaacgcaagccaaaggctaacactagcggaagtccttgagcacccttggatcaaagctaattcttccaaacctccaactggccacactagcaaagagccaaccagcaaatcatcttagggaatcctgaaccacggccaccgtgcaactgtgagaaacaccctattgaagccaccctcctggaccctcatggctgccctcagggtgccttgctgagcaactagtccttggccatgcatccaggaaaccccaagaaccatgctgcttttcctgatttagtaatctggagggaaggttccactgcagctgtcccctaccctcaccctgggcctgtgccccaaggtgtccttgtgggggggggggtctcactgtgggaaacttaccagagatcacctgtgtcgtagccttcaagtgccagagtgtgtgtataacttattgggtcaccaggcctagggaaactgttggaatgggtatgtaatcttttaaatgtcaaaataaagatttgcatagactttgacttttaagtgacacccattcagggtcttgtttccagtcgtctgaagcccgtgcgggatttggatcctcagccactgctacggagcctgtgccttgtcttgagacctgactcgggggtttctttttctgcatgttaaaggctattttttatgttggagttctgtcatgtatgcaaacttgttaaatatatatgtataccatctacctggagtacgtgggtaatcatttgagtatctcttcactgttggctagccatgagcgactggtgtttttctggcctgctggatagtggccagtgccatctgtccatcaaccagagggggaacttggaattagagaaacaggctttcatggccaactggaccaccatcaggaacttgagaacatgcctgagtggaagtctatcctcttgggacaagaggcctctagtcatccgtcctgtgctaaggctttgttgaagtagcaatattgctagtactgtccacccaagctgcagttaagtgagatgcaatccagggaggcaaactgagcacgggacactgcctcctctagctccggctagtttgtgactatcctacatgcagaggagtgccacattccca

SEQ ID NO: 27544 - DNA, 1137 bp, Mus musculus
ctcggtctcccgctctcttctagaaaaatggaggagcgaatcgtgcccgatcgatcgctcggagtgcacacccagtgcgcacgtgcaaagggcatgcagccgagcgccgagcatccctgctccctcgcaagtctgcccttctcgccatcttactcactggcacgttcgagacgctcattcaccgtctccgaactaatcacctccgcgactgccttgaatccaaagggctgtgtgtgactggcgaacgcctgatcctggggagcacggcgggcgatagaacggccgcagatcggacgggccgttggtgcaccacttccgggctccgacagctcagtgcgcctgcgcccagctacggcagggaacgagcttcccatagtcgcgtttacggtgagccaatcacagaacggcattgctccggctctagccaatcagctcttggagtagagggtttgactcctattttaaaaggagaacctttgaattgtaacggctgagctaccgggatcgcttggaggcttcggtcgggagcaggttcctgcctgtgagttggaaagggacatggctgttgagggcgagcctggatgctgcaaacggatagggaaggctgtgtggcgtcggggtaatggactgtctcagtgggtttgcattctgtttaagaaaggtccagacgtttaagatttcccggcttggttttaggttcttgtgggaatggggatccagaccatcagctaaccgagtaatttgcaaaccgatggtggatgcgggaactgcggcttattggggactgcttcgggtggagaatcagagtctaagtcgactcgacgagtctgtggatgaacgggagttccctcgtagagtgcccaggactggtgctgctcttcccgcagccttctgagcagtttatgtcgggactacttgagggtctgtttcaaagcgcagacccgctaaagctcagtttgtagaatattccagaagttttaggattgaacactgccttcgtggtggccgccgctgtttattccaacagtaaggtggtggaggcaggatcaagtcaaaggtcatcctcagctacacagtaggtccgaaaaaccagcctaaattacatccacatacgtccctacctcaacacctccatcc

SEQ ID NO: 27545 - DNA, 1278 bp, Mus musculus
gtggtatcttccaaatgtaaggtggcttttcagataagcactccctcaatggcttggccatgataccgatttgaacctcttgctttgtgtgatttgaagggttttctgggtcaaaagactagtaaattgttttctaggtcacctcaaggtgcttacatgaggaagatagctgcttattattattatttttttttttggcattgctgtggaacgtgatttttctgcagacaactacaccatctagtcctcgttcaaggacaaacaaaatatcaggcatggcaactcatatttgtaatcctaaaactgaaacagcagaggtgttgggagtttgaggtcagcccagactgtactatgagttatagcccagcctgggctacagaatgggaccttggctcaaaatcaaaaagatgtttaaaagtctcaataggcgagccgactcgttcctttctcctcgttgggcgtctgaaggcaagatgggtcaccagcagctctactggagtcacccacggaagttcggccagggttcccgctcttgccgcgtctgctccaaccgccacggtctgatccgcaaatacgggctgaacatgtgccgccagtgcttccggcagtacgcgaaggacataggcttcattaagttggactaagcgaccttgaatggattcgactgactactaccaagtggaaccgatcatgctagtctttgtacacaaagaataaaaatgtgaagaactttaaaaaaaaaaaaaaaaaaaaaaaaaaaaaagtctcaatagacacctaagcaggcatgtggtattcggcacacaacagcagcttgtgctgccttgtcagtagaggaatgaactgtttgccagagctggggagatgatggctcagtaggtaacagagcttgccctgcaagtgtgaggaactgagttcaaatccccaggacccacgtaaaactctgggcatggccatgggtgcctgtagccccagtgctgaggatgggaacccccaggccagcctgtctgactggcacatcaagtttttgttccagtgagggactccgtctcacaggaatacagtagagagtgttagaggaaggcacaggacatcctgtgtggccttctcactcatacccatgtgacagacacacacacacatcacactcacacacgcagtcactgtgcacaatactctctctcacacacaaacacacaccacagtacattttttttttttaattgagggtcagtgagctgacggcgcagactaaggccctcgctacacaaacccaac

SEQ ID NO: 27546 - DNA, 1215 bp, Mus musculus
gcctcttaagggagtgagagggggatgatccttggggcggggaaacgcgcccttcgtcggcgttgcgcattatccgcgctatttgcgcgccgcagcgacatgggaggagggttgttgaacgagggcgctgtgcgccgaggtcgccgcacgccgaacccctggggcacgggtaaccggactgtggcgcggaacgcgctcttggcacctccaagcgacgcagcgcgggaaccttcgccagagggctcgaaggattcgtcccctcaggtcttagaccgataggctcacaacgaagtccggggagctcattgtccccgggggctctcgggctctggggcggatcgagacgggtggtgtgagcttggtggggcgcataggtgcccctctcctggcttgcttgttcgctgtagcagggtttcgtactaaccgggtctctcctgtttctctcccaggatcgccacgactcgagcagtaatggcaaccctcgcatccctcacctctcctctccgggacaacatctctacagtcccgcgccgcctctctcgcacaccggggttgcagagtaccagccgcctccttacttcccgccgccttaccagcagctggcatactcgcagtccgccgaccattactcgcatctgggagaggcttacgctgccgccatgaaccccctgcaccagcctgcggccaccggcagccagcaacaggcctggccgggtcgacagagtcaggagggctctagcctggcctcgcaccacagccgctctgcaagtctaataccccatatttcagggctggaggggggctcggtgagcgcccggcgggaagtctaccgccggtccgacctgctgctgcctcacgcgcacgccctggaagccggcctggctgagaacctggggctgcacgagatggctcaccccatagaggaggtgcaggtgagcagcgggggcgggaggctgggggtggggtgggggttctaccttaccctccagcctttccaccttcctccaaacttaaaagaaattgtcatttcccccccagaatgtggacgacgcgcacttgctcctacacgatcagactgtcattcgcaaaggtaaacactgactctttccgcttgtgtctaacacgtggctctgaccagtgaagttgccccttttctgcaaaggctggggtattaagtggccaacacggctcacgtagtggagaagaccacgcttg

SEQ ID NO: 27547 - DNA, 1285 bp, Mus musculus
ccttctggtaggaggcagaagtcagagatgctcttagcaggcagctacttaccagtggtatgtgacaggcttccagctactcattcaaaaaaggggtcccctgtttttaaggaacttgaaagcaaagcctgctgtttctttcctgtttccttcctcttttaaaaaaatattgaaagtttaaaattctttagataataggatttttaaatgatctgttcctttaaggtagagaagttttatttgcatatttatttcagatcttgatttttttttttccacaaaacttgaagagggtaggcacacagcggcgcctgccatccctaagtccccgaggaggctccgtgctgagaaactgttgagtgtacagattttatttatgcataatttaatgggatctgtaaatacttcttatgactttttgagaaatgggattcgattttaaaattaccttttaatggtggtgggtcatgtagcccctctagcttttatgcgagtgcacacagggtattgaaactgaagatgaagctgggcttttctctcttggctggtcaagtattatttgattggagctgtttaggaagcaataggcatctcatttctgcgggctgaaccggaagagaatggagtttagtttgtgtgggtgacgtgtggattgggactggacctctaagcctgtccgtgctccttaaataattgttgtgtgtgatacctgtataataaaaaatattctcgatagaatctctgaaagtctggttctgaccctttttttttgcggggggggggggggtgctgagtaggactgatcagggctaacttgaagcctgactgtggcttagctaattttataggtaagagtaagacagggcgctgtggaaagatcttgaggcttctttttcctcattagtgaggctgctcagctgccccacatcattctggcttccatctcgtcctcattagctgagtaccagcacctgggggtactggggctgcgctcggtgagcggcttgtcactgagagagggggttcacttctgttgtgttcctcgtggtgatgggtctggtatgctgagcctgtactctgctgctctgtgggtaccccaagcctaaggtcacagtttgaggagtgtcgaatcaatggatgactgttgaatgggcttgccgccgccggcctcaggttttccttgggcagatcttaaggagagaaaaacaatcaaccccaagaatggtggcctgcggcatcagcgagttcactgaaaccgggcttctccagcattgcagacagcgaa

SEQ ID NO: 27548 - DNA, 1192 bp, Mus musculus
tttggaagcagaagctacccagggcccaaagagagccagcttggtgctggccaggttgaagtctgtgctccctctcaacccaggcctcatcagtctctcgcgcacagcttgccaccctgaaccccagagcgaatcaatctctgctagcatttcccccctttgtaacctggtatttctggtgccaaccgtggcatgttcttcagagactctcctgtgttcctggtcagctctcctcctagattcttccctaccccagaatgcaggcaaactcgagatgctcttccccctctcacaagccaaaaagaggccagagccagcagctgccattcagaactcaagtctctcacagccctgccttggtactgaaaggatttctgctaggatttctcagctgcccaaccagaggagctgtgtgaagttcaatggtaaatcgacagaaactgtgcaccacgggggcgtgggtaaagaaaataattctctgtctcatgtggctgaaaagggcatcactgtccacctgcactatggacctgcaattatctgctgctttcaacttttctttatgtgtcccagttgttaactttagatacaactcagaacgggctggtctcgaactcacaggatctgcctgcctctgcctcccaagtgctggagtcaaaggcatgtaaccaccacctgggcccactttacaactttagacacaatcttagtcaaggatatgaaccacactcacctgcttcagctagcttaggtgtgaaaagcctttttagctttgtttgtttgtttttgttctagggatggaacctagggcttgacacttgctaggcaagtgctctgcccatgagctggactcctagcctacaaaacacttccagaagatgggttggtttaaaggttggttggggaagttgagggaagggaacaaagtccaacgtattgaagaccagagaaggaatccagatctcctcccagtccagtgtgttcccaaggaggaccttgaaccccttgccttcctgcctccacttctctggtgtgcacgaccattaaaatagcatttggggagctggagagatggctcagcaatggcgagctcctgtagttgagtcccatcacacccttaaagctacaaactccagttccaggggatttgatgccctcttctggtttccatgggcactgcatacatatgatgcaa

SEQ ID NO: 27549 - DNA, 1213 bp, Mus musculus
actttgctgacacctaaaaaaaaacctattttgtttacacatttaatatattatataatgtaaatataatatattaaatatataaaatatacaatctaaatattatatatgtagggattggagcgatggctcagtggttaagagcgctgcctgttcttccagaggatccaggttcagttcccagcaccacacagtggatcacaactgtctataactccagccccaggggatcccacagttctgagggtactgtacacatagggtatacagatatgcatttaggcacataaaaattaaattacacaaaggtaggttttctttgtgtgctggtgggtgtgatctcctttacccgtggagccatttagccgactcttatgcctgggtctggcgcaaggagaaagatgtaacttagcagttgaagtgtagctgaagccaagtgtctttgtttactgacttaaaaatggtttatctattcatttattttatgtgcattggtgttttggctgcctgaacgtctgtgtgagggtgtcaggtccctaggaattggagttatacacagttgggagatgccctgtgggtgctgggaattgaacctgtatcctctgaaggagcagccaatactcctaacctctgagccgtctctccagacctatttatttttaatcttcttttcacaatatgtgatttcttcaagggagggaatatcctgttccaagtgctgtcaccctcgtaggatgttgggcatgacagaacacaattaattccagcacttgtgtgttccaggtcagccaggaccgcaaagtgaggtcctggaggtgggggagggaagaggaggagaagagaaggggaggaggagagggaggaaagatgtgagggaaggaggatttagaagggaactttagtttgacaaatattccttgatttttaagggtcctttataggctggtgagatgggtcagtgtttgctgccaagtcttaagtgcgatccccagagccctcatggtggaaggaagggttttggaaaacacttctttcaagttgtcctctgacctccacaggcactccaaggcacatgtcccctttaataaacacgtgtaaaaaggtgacattgaatcacaggcctgcgaagagactgaggcaggataacaccatttaaaggatggatttgtaaacggaaaccacccttgcaagcttgtcaggggttccagagccc

SEQ ID NO: 27550 - DNA, 1199 bp, Mus musculus
gtctctgtgtagtaagggaatttgttgatgacttaaacatctgtagtccaactcaccaaacagtggtcagcagcagctgtgaatggaagttcaaggatctagcagttgctcggtcccacaaggcaagcaggtgaagacgagagcaaatcttcctactttcaatgtccttaagtaggtctccagtaaaaggtgtggcccagattaaaggtgtgtgccaccacctctggatctgggacttgctttgtcccagatgactagaagctctccctgccttagtcttaggggattcatagccactgtgcctcaagatctccatgccaagatccatgtcagaaacttgtatctcctggcctccagattaggatcacaggtgagtcttccagttctgaattgtagttcattccagatatagccaagtcgacaaccaggaatacagctggaatagcaccctcgtggcaactaataactgtagctccagttgtagggtctgatgccctcttctccgcctccccccatggagttcacaggcacataaacagctgtaaacacctgcacttttctgggagtgttggctgagactgaggtggacggatcacaaagccaagactcccctcaaacttgaagtgcctgtatgtatagctcagtagccgagtgcttgcctggcattgtgacaaggcccttggttcagtccccagcaccaccaaagacaaatgtttaggggggaaaaattcctgcatcctccctggagccacgtagcacttatgctcttgtgtgctgcccaaagccagaagtcaaacagctgagcacacctttaatcccagcgctggggaagcagaagcaggtgtattctactgcgttcaagaccagcctggtcttcatagtgggaccctgtctcaaaaaaccaaaactgaaaaaccagttgaagttgtaatttgttgaagcttgtgggctcacagtgttgtgtggataagtagaaacaggctcaggaatcctctgatcggaacaggagcatctgtctccagtgtgcagcctggacatagccattccctaaagctggacttcacatcctgtgataagctaccattgaccactgacacactctagagctttgtaatgctgctggggtgagactaaaaatagcaagagtgtgcttcagctgtgtcacttctcctggccacaccttcccaagtctcacctca

SEQ ID NO: 27551 - DNA, 1155 bp, Mus musculus
atggatgagttcagccctttgtgaaacctctggtcagggctgatgctaatcctgagaccctcagctgttgccttggcagtgaagtcattgacggaataccacaggcgcctccgagggtagaggctctgataacacagaactgttaacttccctccattcttactctgccttctcagcggtggctccagttctcagagcaggacttggtgtgtgtgtggctattgcttttaatactaaggtcatttctttgtttttccttctttagggacatgagttttataatccccaaaagaaaaattacattttcttgcgtaatgcagctgaagagctaaagccaaggaataagaaatagtggcctgaagctgggactgttggagtttcatctcctctctgcccaaacttgggctcaagccctcggtggcccacagccctggccatgggtgtccactcctggagggactgttcttgttgagcatcagcacagcatcctggcgacttgccgtctctccattcagctccctgctgcggttttcctgaaactgagattctcaactggagtcagatcttgggggcactgtgtccagcagtgtgtatttgacagtgttgggtgggaactgttggtgagccctgtgttgtgttttataataaaatattttgaagatggcctgccccttcatccctttccccaactcctcaggaaatagccatcaatctcagaataatgctatgttccaagtttctcatcattttgtcagctcctgagaagctgtgtgagccacatgccacccctgcctcagtgttgagggaaggtgctgctatgatgtcctgagagaggccacggggggtggggggtgtcttccttccacagctcatttatcccacagaaattgtagacagtggatcccaggtgactggcctggggtgcccttggaatcccagctactcatcttgaggcagaacttggagtctggcagacaactcggtttagatgggcagggaatgagggctctctttccagaggtgtctcagctcctctcacggagactcttggcctccatgacggtgagaggagtaagcggtaatgcccaagcccttgagtgtgtggcagttggtaacgagccacaggagcggaatataggagcttcttgcgctcag

SEQ ID NO: 27552 - DNA, 1279 bp, Mus musculus
tcgccctaccttgagtatacaccagccagcccagcctacgcccagtacccgccagccacttacgaccagtacccatatgctgcctcacctgctgcagccaccagcttcgtgggctacggctaccctgctgccgtgccccaagccttgtctgctgctgcacctgcaggcaccaccttcgtgcagtaccaggcacctcagctacagcctgacaggatgcagtgatgcgcgtcctgcccagggccacagctgccacctgccagcctctggagccaccaccatttgggtctcctcaggcccccgggcccacctgccctgaaggcagcagcaagtttcttctgcagccctgccgtgcttgaggaagggcctgaggaggaagggacactcactctggaagctctgcagccactccgtgccaggtgccttaactctgggacgtgtacagacgtcctccctcctctttgggaactgtcctcttggtggatccgggttcctgaccccacctccccccagttgcccctcagtcgaagcactgtgccatgtcctgctgggaattttctgccatgcaggcaagaccatcagcaccgagaaccccaaacctgttttgtacttagagactggctttggtcagtagttcactgtggagacaatgacagtattctctgtgccagtgtcgctgatggagctccccctccccacagggctgccattaccagaccacggccctgcagggccctgggctcctgtctgctgatgctgcccgcctcacctgcagaggtgcccatcagggcgagttctcaggtgtctgttgctgtgccatgggggccttcttcctggccctgtgcccctcaagcaggctctgcccacccaccctcccgttgtcacctgtgccagtctgacctagctgcacagagagaaggtccagcccacgtctaggaggggaggagtgggtatctctggcagcatgggctgcccgcaggctgggcagtgggtccctccacacctacctcagggagccagtgtgcgggcgggaactccacagcatgcctgttagtcaaggcctggaggacagagggagtaatgttataataatatttttattagaatgttctgattataaaaaataaaacttgttttctttaaagaaaaaggtggtttgaggtttttctcaatggcaaggtggtcctgtgtccagggtttttggcagctgtccatggaacccttaccctgcttcagcctctgctgatcactagcttcagtgaccagcagggcttgctccagt

SEQ ID NO: 27553 - DNA, 1381 bp, Mus musculus
acttcttaagagagaagagagaggaagtcaggggacacacaggctgagtggccgtgtggtagttctcctgtctgtgtataaatatttacatgttctgtgtggtctgaatgcagaagctcaaaaagcttgcaaaaaagaaaaaagaaaatgtttctttgttgagccgtgtcttgaaggcaaaagagaaaatgctctactagtctttccttcattgttcttagttgagctctgtgcgtgaatgcttaatttcttttgtttatgacggttttacttaactttaaagacatatttgcacaaaacctttgtttaagatctgcaatattatatatataaatatatatataaaataagagaactctgtatgtgggagagcaggagtatttttgtattagaagaggcctattcaaaaaaaaaaaagttgttttctgaactagaagagaaaaaaaatggcaattttttgagtgccaactccgaaagtgtgtattaccttgtaaagaaaaaaaaaacctacaaagcaggggtttagagctatttatataaatgctgcgattttgcactattttttaatataatatatcagtgcttgtttgatggaaacttctagagagtgtgttgagacttggagaaatgttgagtttaagtctgaacagagcagcaggggtgtgtccctccaccccctgggtctcagagggcccccactgtgcaggaaagccaggctcccccagggccacacagcatgccgcctgcaagccaatggatgcttctgtccagacaggctgtgaacagttacacattccctgccgaaggggacccgtgatgtgtcgtccctctgggttacagctgagtcaggaccgtctcccccgcaccgccccccaacagaggcatccaattccagatgcctttcccaatatgaaaataaactgttaccgaaggaatcttagtttttttttttttcttcctctttaaaacacaaaaactatgaaggttcagtgtttgggggcaaggtgcatccccaaagccaaagcagtccccgaatttggtgccaggtggatacagcagctggcttcatgcagaagcgggttagactccagtgtcccaaggctgggatctacgcagttccaccctggcatgtaggaacggcccagggtgatggctgcttgacctctgaccatgtgtttccctcaatattgattttcacttcaagaagccaattaagagtcagcccaagattgaaagggacaagcccaagtgttcccccaggaagcccaaaggggttaggaaagactgccagcaccagcggcccgtccctccatccctccgcctccagcgtaactttccttctcctcctggactctcccctccgacccggaaagagttgtat

SEQ ID NO: 27554 - DNA, 1217 bp, Mus musculus
ttttacagtcaggggcacataaggcggggacccctgggctgagtcttctttctgacacataaaggaggtggttgccctgggcatgcaccccaacactcaggacctcaggtaggaggaagctgctcacactccagctgtggccatgacgtggggtgaacagctccagccctcttgccaccccagcgtgctcccaggctgaggactttcctcctcctcctcctcttcctcctcctcctcctcctcctcctcctcctccacctcctcctcctcctcctcctcctcctcctcctcttcctcttcgttatggctttgccataatgaaagctgagttgtcactgaacttgtccttaaggcaaaaattccaaaaggtggtatttgagggtaagagacttaaggagtgacgcaggacagacagatagcacctgcccgccccaacttccctgcctgctcctcaggacccccatgggcatgtgccttaagagtctgggccactctcagagttctgagtcctccactgacagctacagctgtgccataattagggctgccctgcagtgattggtggagtggatgatagtgacccgtcactgagccaacgtggggtagcgtgcctgttctctccctaaattggccttgctcaccatgtcaaaagaattaaaaaacgcaccctgaggcaggtgagatggttcagcaggtagaaacatctaccactaagcttgagtctcaggacacacgtggtaaaagaatagaactagttttcagttgtcctttgacctccacctgtatgcctgtcatggtgactcccccacaccccacccccagtaaaatgataaaatgtttttaaaaagtgtgtcctcagctggagttgggagggacccgtcgtaatgatgatggtggtggtggtggtgatgatgtactttttaatagcaatcatgtctagtgacctctttttaagtgacaagggacccctgtccctctaacttcagtctcacattgctcaaggagagctgaaggccacacactgcacagacaccatagagaggagttgggcaaagtctgggatgacggggcttccccccccccacttccctccctgttttcttctctgtagttgaggagctggctctgggcaccgccgtatttaggaggcgaattgctgcccatgtgtcaggcaaaacagatgtggcggggagacaacatctattttcataattcgg

SEQ ID NO: 27555 - DNA, 1196 bp, Mus musculus
ggaaaaacctgcggagaaggagcgaggggaaaagggcggccgagtcagacggctaagtggggaaagcgcgcgaggaagtggtgtgaaaaaaggataaagattgagaaagagcgggcgaaaaagctaggggaaagcggtctagaaagaagaaccacggggcaagagcgatgttgaaaatgaaggaaggagtgagaagaaaaaaaaaaaaaaacggaggagaaagaacaagggagaaacggcgagaaaaagagcgcgggcgccgccatccgccgctcggctcctcgctccggctcgccaaggcgaccgggcaactgctgcagcccgtagctgcttttaagtggtctggtgtagggcagactttgtgtgtgtttaaaccataaccggacctgggagcctcaaaccctgaacgcacgaacccctattttacaaagcgcttgggtgcacagtacacggcggcttcggcacgcccgctgctcccgctaccgctgcgcccgcgcgcggcccacttggaaaggagcaagaatccattaaatgtggtaggggtccccctgcttgttcttataggcaacacagctgctcctgatcttggatctgtagacttcagcgacgttagcggttgcctgaaacacgttgccctgaagttgtgcacaaagtttttcgagtgcgctgcatttcattcaatctagtaaggagccgctggccttgcccgtagcacattcttgtaaatagctctctttctgtttccgtcttaactccattatttttttttctgggttctatttgtcattttctctataagcccagcttttaatttttgcagttagaagctatattgtttcataaattttcaggatagcctattaattttatgcttccataatgggaactgtgcagaaataattttgtatatgaaactctttaaataataatgtaggttttttgtttgtttgtgcatgtgtatgtttgttgttgaattctccacagctttgtagaacagttcatgatgagcaaagcctcgggcagaagaggcaatcctggtctttatggacgtctcccagccctagagaaaaacacagtcttacttgaaaatagtgatttttaagatttcttgatgataatgaaattttataaaaatgccatgccctcaaaggtaacagtgtactcattttgaagggtgatggttttaaaactgggcc

SEQ ID NO: 27556 - DNA, 1182 bp, Mus musculus
tggtgagggcaggacgtctgtgtgttgtgcatggcacaggcctgcttccttgcccatgtgctgctgtgtgcctgtgtggtgaggtacacatacgcagagtttggtatctctaggcagcacctgcttccgatgtctggcttccttgttgcgggcaacgtgtgcacagcctggagggaccccaggcaggacagaggacagtgctgggcacatcggtgctggtggaaggtttgttagctccagagacagtgacatcatttcccaagttgtgtatcctttctggccacaaacatctcaggcggccttcctttggaacccataagctcaggtcttcactaattcctatggtttctttcctaagcagataggtgtttttcatttcatgattaatgctcccacctaccaagtgtaggtggggtctaggagctggtctcctaatcccattgttgtgcaaccccagttagtcctcagggctctgcagtgctgtccttgggtttgtgccacgtgagagagattagagaaacaacacttgctgctgttgctgggcaaaggcttgccttgctctgaggagaggaaatgtgaagacccagttcgccccatgattagtctttgtctgccagtctctgagtgaaggaacccgtgattgccgaagggatgaacaagtggtccacttgtacaggctgcaggcagaggctgcggtgggttgcacagacaacagcttgtcccagtcacagccgatcagggctggccagcagtgacccttggagtctggtggaggggcttgtgtaggcagctctgcctgggtgaggtgaggcctgagagacgagtgtccagaagaggcaccgggcaggaagctggtcatttctgggggtagagaaaatatcaggggatcctcaccctgcaggtcctgttcctgggaggccgctatttgcactgctctgcacatatttacatagctaatttctcactaaggaaggactgttagcttttctcagatctcagaggggtcgctaaccctcagagattcagaaacaaatgacacatttcacattctggctgttgcaaagggcctggtgtgctgtacttgggaggtagacttatcccagcacagtggggagccagctacaagctctgagcattggagaggatatttgtattgtaggaacagcatgcaagggtgggggt

SEQ ID NO: 27557 - DNA, 1195 bp, Mus musculus
caatgaatgaactgcaccccaggccttgttttactgtgggtctttctaagctgtccagcttggccttaaacttttgaccttcttgcttcagcctcttgggtagttgagaaaacaggcgcataccaccagggctggctggttctcctctcctttgttgttgctgctttgagattgtgttttaattataacatttctcccttcccttccatccctccaagccttcccacatacctttcctcgctctccttcaaattcatggcatttatttccatcatttatatatgcatatatatatatatacatgtgtgtatgtgtatatatatatgtatatatatgtgtgtgtatgtgtatatatatgtatatatacatgtacacacacacacacacacacacacacacacacatatatatatatatatatatatatatatatatatatatacacacacacacacacacacacacacacacacgtatctccatatccatctatctatctattcccgatataatccttgggtccatattcttctgctttttttgagacaaggtctcaccatgttgctcaggctggctttgaactcttgggctccagcgatccttctgcctcaggattctgagtagctatgctctgctatggctgagcacaggcttatcttcaagagtagctctaacttttacatttcgactccaactcattttaaatgtccacctaattcccaaactaaaacttagtgtattgaagaagtttgatttctcttgctgcctgcctgacttcctccctccctccctccctccctccctccctccggctccctctgttctaagactgcttcctcaagctttgccagtcttgttgctttccagacagtaccctgtgtgtgtgtgcatcttgtctttctcaggtgtctgtgcctcccctcctgctgctctgcctgctttcctgcatgtcatatgtcctatgcttgggatagtgactcacatgggtcttgctcccatttcctacagtgtcagcctctggggatagggatagtccatgtgctcttgggcgctggagagccttctgctcctttgaatcttggacattgctgaagggattaggactgttcaggggctaatgcactgatggtgcaaacctgaagacccaggttcagtgcctggaacccattcacgaaggctcgatgcagcggagcac

SEQ ID NO: 27558 - DNA, 1134 bp, Mus musculus
atgtttttatctccttagtttgggaagccaaagtttaaaggactattgaacaaatgaatttgggaattactacattgagttcaattaaaaagcttttttagctgaaacatttgtttattgccccatattcaattcctatgaagctgttttctagactgtcttcagagacattcctgcactacagtctgtctttgcctttggtaattatgggttcttttgctgtaaagcattatggcatcttctgtggcttcagagaaagattaccttttgtgcagggataatggacttcaaagtctgctaaaaggacatctttccctgaccatccagtttcattgcttcttttccctctgcagtttcgtgcattggcaccaatgtactatcgagggtcagcagcagccatcatcgtttacgacatcacaaaagaagtaagactttattcttttcttcttagctgccatcatgtattgctcaggcctctagctactctcctttcacactgcaggagacgttttcaactctgaagaactgggtgagagagctccgccagcacggcccccccagcattgtcgttgccatcgcagggaacaagtgcgatcttactgatgtcaggtgagttcttagacgagattcccgggctgattatgtgttccttttctaatgagccacatccagggtaagagtctagcttttattttatctctgacattgaaaaatttcttgtgttacatggttggccctgaagttccaagctaaaatgaaaacttaaggcatttggagttaattatattacatgtagacaggtgcgtgatttactctaacattagtgttatcacacatgacgttatctgagatcattgcttccccaggctgctgtgacacagagcacctgaatacaaaaagtccattttatcgacaatctctctgtatcacatctgattcccaaaggaagggccttggctttgttttcccgggggacgggacgggggacggggggaggggggggtgaggggtgtttaatatagaggttatataaaaccttatcaggaagatcatgtaactggaaagactgcttacatgggggctgggggggtcttaaggggcagaacctctgactcgcagttgttgccttccaga

SEQ ID NO: 27559 - DNA, 1920 bp, Mus musculus
ggtgttggagagagagagagagagagagagagagaaagagaaagaaagaaaaagccaggatgtgcttgacagtacggtttggctggattgtgtctgcccagccctgagctgcttctgaaacgtgtccttgttcccccaggaagaagacggacttcgggtgaggaaggcgatgccgagcaacagccccgtggcggctctggcggccactgggaaggaggagggcctgagcgcccggctgctggccctggtggttctgttctttatcgttggtgtcattatagggaagattgccttgtaggggccgcatgcgaaggatggcaggttggattgatggatctaccacaccatgggattcaaatttatcataaccatgcgtaaaaagaaattaatgtatgacggcatctcacaggtcttgcctttaaatacccctccccatgcacacacaaatgcacacacaaatatagcataatataatgatcttttagaaagttaaaaatgtatagggaatggatggggaaagaatggtctgttgccgtaggacgggccgtgattaaccacagtggcatcttgtagctgtcacgctcaattcgggtaggcctgggcacgtgttgctagatcactctcttaaagcaagaagctcctcctcgcatgttggggctggcccgtgggagcgggagtcctgcaaggtggggcgagctgtctttttcttacccacgtggcttccccaggcctgctgttctgtccaggcatcgtctcctcaggcctacagagctgcaggtgccaaagtgcattgcacagaggccacatctcgtgtacctgtgggtcgtgtgggagagacatgagtggaccagcgggtccaacacagggaaatccaagtctgtgctctgttctcttgaagggaccaagctaaattaccgctggttcaagtagtgaaccgagttgttctcggagatggctgatgcacatgtaacctatttcatctcgtgtgttcctgctgccaccagagcacaggcagtgagtgctgcagaccgccagtgaggagctgctgctgtgggctctggaggtctgagggaaggggagggtctgagtcaggaagtgttttgttgtaggtcagtaatagctgccctgaggaggaacgctctttttaatgacagtcagctctggattacccagtcttctagattgccctaccatccatccttctaaaacataggccagccttgacctgcccttctcaggatgagtgagtcaggctgcagagggtgaagggcatagagggggtggggtggggtgggggagccctcagcaaatccatctgctggtgatgaagagtcctgactgtgaattaatttcatgccataaaagaccgatccagttctgctcaactatgtagcatcttaaaggaagagattaaaataaagccccaaattaagagtccttttgtcattttgtcacatttgctgtgtggggttcttattatcaatcatcgttagtgtgctatggaaggttgattttaaaatgagctctatcagtgggaaacacatgtgtaatgatttgactctgcacacatctgtgtacacacgcacacacatatattactattacttttattattatattttggttggcttcagcttaacagcaggagccatctcaggctggctgtccttccccttctgtgaccttggcccttcagtgacaggcctgagtctgagaggacaagcccatctaaaggaagactggcctagacacccgagatcacactgctgctgtgcctgagtgggcgggtgggagctggagacggggggggggggggggggcactgggcggtaagcagccctgcccgctctaatgcctcttaccgagtttccagaccctttccgtgtgcctgaaggagggagggtacgactgagctgaggg

SEQ ID NO: 27560 - DNA, 1155 bp, Mus musculus
agagtccacgccaaaatgcagtatcgttttgtcattttcaggcttctcaaaattaactggcttgaatgcaaatttctagttacagtttgcaaaaacctttattttaagggagagactgggacacgggacagttggtcctgtgatctaggtcattctgtattcctgagtgacgttctccttcccaggccttctccagtatagaggcccatgctcccctcgctgctgtggtagctgtgtcgtctcctgtggaccctgtgctgtgacagaggggaagagtaaactttgtaagtaaccggaaggcaggcactagactcgtcctagttacatttggccttgtctgctgttactgagaatgaatgcttctcagagcccagcagaaatgcaattgtgtttaacactcccctgcagagcatagatggacagatgcagcataggtgaggctgggcgatcattctctgggatcatggcccgatggctccctcagggttccctggcctgattggacttggaggaggtctttcctctccccagacagagctacaactgtgggaacctttgtcaacactaccctggctgcagagcacctcacaaaaccgcaagttaggctctgccctgtaaaaaagacccagtgcgtggaggtgggcagcattttagtttggaactaaatgagccccagtttgtgtgtgcatgctaaagcactgcttgttggagatctgcacatcaatgaagggaacaaggcggagggaggtatctgctccaggcacctcagctcaccagccgccgcgtctgccaccctgatgcagctgctgtttccaggctgagcaggaggaagagccagggctctagtgtgacctgaacacatcccacaagataaatgcatatggttgtttccatttcgctcactgcccatgtgcctggggaattgtggaagctttagaaagaaaattaccactgtgtctcagtgaggtgaggctgctgtgtctggaggctcctcataacttgtaaattaaatgtgaatgagagaagttcattaaaattggcattatagaagtggcctattgagatttgaaagcagctgagctcatggtgtctgggctccctctaaacctgtggagaaatgcatgaacaagtgacaggcgacagtcacaggagcat

SEQ ID NO: 27561 - DNA, 1193 bp, Mus musculus
tagatgattacaaggaaggaaggagtggaccttgctcactcacaaagcattgtctatgtggatgtctgtagaccaccacccattttagtggggtatcatttgggtcttttgaaattagcatttaaaaatcctgtgttttggaggacttatagatcctttcagatccattctttgcctccaggcaaaataaataaataaccaggctagtccttgtgacttccctcccactctcagaaatttcaaaggcaatatatattgcaaatttaaaaaacaaaaactgtctgtcatttcaaagtaagggaagttcagccagtggaccagtagctgtggcaaagactcaggtggcttgcagaaggcgggatggtgtgcagaaggtggggctggccaacactaacccaaggatggtcaaggcccatgcacagtattgctagtcctgctaagcagttcttggacttattttaacatgtagttaacagtctgctgaggtaactggactaacttgatgtccacagcaggcctgctgcagtcatcacacctgtagcacagcagcgcccagcacactcaccctctgcttcctgctgccttacctcagtcctgctgctgagagacttttccttaaggaactggtctctgacattttcattacatttctgtagccaagtcacgtcaaagtcgtgtccacaagaatgtccaagaaagctcagaagtggtgcatgaaaagataggaatggagctcagactctagtgtgtcagacacaagcatgtgacatgggcacatgcattccccttgcctttccacatcctcagggagggtggggagagccacatccacactgacctctgatcacctcttgatgcccgttatcccctgtagcttgctgatgaccgcatggcgctggtatcaggcatcagcctagatccagaagcagcaattggcgtgacaaagcggtcgcctcccaagtgggtggatggcgtggacgaagtaagtttctgcatgcttccttttgtgggtttgtcttttaagtttggatgacaacacggttgattgagaatctgtcatatgagccagtatggctgcagtgaaagctgtgtcctcagacacagccattcgtgagtttgctcatttatgtaccacacagtaaagcaagactgggtctggatggctgcctgcatgatgtgaacttagtgttagc

SEQ ID NO: 27562 - DNA, 2354 bp, Mus musculus
caagaggggttactaagcaaaacctcctgaatcagaaacttggtcatttgaaccaacctcacattacaagaaagcttgacagtgtgtccccagccatccttcctcagtccattacttacattctagctacgtaatgacctgtccaaacctgactccgtttaatgaactgtgaatttacacagaggccattttaaatgggtcaccccatttaggattagtggatctcaaattattaaccaaacatcactccatttcaaagtaaaatattctacacatgatttgatttatcgactcttgccacttaaatgcccagaaaacgggtgtattcctgaggacagtgagaacgtcagctagggaaaccctgtgtgtgtgtgtgtgtgtgtgtgtgtgtgtgtgtgtgtgtgtgttctgagggttttttggggggtttttgggtttttgtttgtttgttttttgcgtacgtgtgtgagcatatcatgtattatcagatggccaaagtagggttctgtttactccctgttaactctatggtgctcgtgtgctctacagaactagagcgatgcggaccaggctgtcggagctttgagagcgtgcgtatctcactcgctctgtttgcatcaacactgctggagttagagtgattgttgtataactgttgacggcttgaaaaaactctctgtgtctcttaaattatttaaacaccgtggccctgttaagtgtgttatatttttatttagaccaggcatatgaaatgcctctctgggactcactgaagggtgtctcaaaactccagctcagacctagaaatggagtcatgtagacccatcatgaactcactctccctgcctgggccatggaataatgagatctaaaggttttctggattctttggcaatgttagtagagaggcttagaaaagaggaggcagcacccaccccaccacttcagaattggggaagggactctgcagtctctctcaacctctgaggttagacaagctgttcctgggtagactggccaaattagggaaactgcttcaagcaatctatggagatcatgctaagtaattgtgaaagccttgaaaaaaagtgaccttttaagaaaggatcactatttatttataatttatttccctgaatagattttattttggtgggggtgttggttcccccccccccccaatccatccatctggttagaaactgtcccaaggacctatggggagagggactgtccccttctgcctggaggcagtgtggtgctggtctgggcccacgccaccctggtgagagtccggaagggcttggatactgggctttgccgagctccagagctctgtgcactcgctctctggggccccactgccctttgccgttgagcctgttctgggggaaagaggagaagttagtacccatgtcctgctaggtccctcacggtaatggcttttggaagaggactcttgtacctgctgacggccgctgtctgtgcgtccatccttcccttcaggctggccatggaggcgacaatcacacagactcgtctgtccctgtgcctgggaagcccggcctctggacggacaccacctccctctgctgccctgctggcttttgtagaattggggtggaaggggagagggaaagaactgttggtccttcggggcccctgatctttcctaagactagcataaaatttctgtctgtcattctgtttgttgggggtggagggacattggggtgctggctgggccactgtgtgaagcaatgtgtgtctaatttaacggatgtaccattttctctgctaattgagagagcattatttatttgttttgacacaagtgcgtgcagtgtttcatcccagctaatggcttcttaaaggtaataaaacccttcaacctaattggtcagataagactttttccttgtatgcttaaataaagcaattagtgaaacgcttcaatccaaaatgactttttttttgtcctttttttttttttttttttaaaaaaaaagctaatttactgttactggaaactttttgtacaataaagcaatctcacagattgaagagcatccagcattcctagtattaattttaacaatgggggtcatattttcttcaaatgtgtttgtgttagcagagggcctgaccatgtctgggatctttggggccgttgctatttattttgtgcctgaggcctctgcctcagagtctgaaagtcgatttgtctatctaatggaggcctgcaaagggaccaatcaatttgctatccaatatacaaagagagaaaccacataaaagacagataattatttttcgttatggaaacgtgctttactcgagcactagcgcctgtt

SEQ ID NO: 27563 - DNA, 1192 bp, Mus musculus
caccccgagctgcagctattagttaggctgcgcccaccacccagtcaccttgctggccccgagcgtgtcaggacatctgcagggaggtcctgagacacagccttgtgtcccaggacctccatgtggagaaggagggattagaagcctggagagccccttttacagagctgctcctctggctcagacctttccactgtccctgtcctgtctgcagggcgagcgagccacaggctttggggtggctctcctactggctctttttggccgtgcctccgaggacccgctgctgaacctggtatccccgctggactgtgaggtggatgcccaggaaggcgacaacatggggcgtgactccaagagacggaggctcgtgtgagggctacttcccagctggtgacacagggttccttacctcattttgcactgactgattttaagcaattgaaagattaactaactcttaagatgagtttggcttctccttccgtgcccagtggtgacaggagtgagccattcttctcttagaagcagcttaggggcttggtggggtctggagaaaattgtcacagaccccataggtctccatctgtaagctctgtcccttgtcctccaccctggtctttagagccacctcaggtcaccctctgtagtgagtgtacttcctgacccaggcccttgctcaagctggggctccctggggtgtctagccagccctgggtagatgtgactggctgttagggaccccattctgtgaagcaggagaccctcacagctcccaccaacccccagttcacttgaagttgaattaaatatggccacaacataaccttgtctccgctcactttttttctcaacttctttgtcttacttctttgtctaggtgtagagcctgtctgaggctgaggtacagaaccactccacccagcagccctcaagctccctcgctcgctctcctgggcctgagatggctagtggaactggttttacagcccagagccatggagtctggggcccgaggacagcaggcagccctcaggcccaggcctcttttccagttttcaatctccacacatgggggggggggcttctgagaggctctgttcatattggggtagacttggctttcctcaactctgaacatgaatctcacagttcctaccagagaagtcctagggcataaagggcctgattt

SEQ ID NO: 27564 - DNA, 1099 bp, Mus musculus
cacactgcgtcctcgctctctgagctttttgcccatttatttttctatacaaatttaaaaaccatttttatcaagttctgtaatggccttggtggtattttgcctggaactgcattcagtcaataaattaaatgaggaagcaccgtgatctcgtctgcatttagtcttaagcctgaagtctagtctctatgtattcaagtctttcccacattaagagtttgtattttctttatacaatttgaatataaaatgtggcatttgatgcttgaagaaatggcacacataggtttctcaggcatttgatacttgtgttgctttgtgaatgggtatatttttcattgggtttttaggctgtttataatgtgtttatgggatgatattggtttttgtacacttccctcatattctgctacatctagaattgtctggtggatgaggcttccagtagctagctctccagtgcatgctctgctgactcctggagggagtgcggagtgctcagctcctccaccactgaatgcccagcactgctggtaggaagagagacacatagacagggctttgagttttcgtgccaagactaatttagggagggactaacctttactgaggctacctaagcctctttcctaccttttaggtttttatcctattttgttttctagaaggacagaagatgattattagaagttttatatggtaagtttttagatattttaaattaagtgggaaattttgtttttaatcaaactgaattctactactccccaaataatttaaaagagagctgatattaagacacaagacaagccttaacaaatataggaaaatgaatgaatttcttgtgatagacaggtgagtgaggggcaaaagaggaaatcaagaaaccccaagaagcaagtggaaataaatacaacaaacatagtcactggctcataatgaagaggtttccagagcatttatagatctgagtgcttccttaaggaaaaggtcggcaggcatcagactaattcagtctccaggacccatgtggtcaaaagagctgactgaccttcctcaagttgtcctatgatttccatcggtaggtgtgtatgtgtgt

SEQ ID NO: 27565 - DNA, 1105 bp, Mus musculus
tccaaacctggggcgcgctgggaattcagtgtggcacaccgaattcaatgttgcgcaccgggtatcagctcggggacctcaggttgtctccagcgaggcgccagaaatgcctcaccgtccaacaaacctttggcctcccaagcgcccctgggtgccctggagagacttgaagagccctctctccttttccggggtgcatttcgggctgattaatgggcaccgctcccttcccaccttgcctcccatctgtctctttcctcccaccctactgtctcagggaccccagtttggtcagggcaactaacctttatccatgaaaacaaggagaatctggacggagtcacccattagtgacgccggatggggatgggcccctttctgggaggggactccggggactggtcgcgacggcgggctggcctcctggtcttgcagcggcggggctgcctgttttcctccttgcgctcctctggctcctcctcggggtcccgaggatcctgatctaagggccctcgctggggctcctccccctcgcttgcgctctcaggctcctgagtggtgggctgcgcacgtctcggggaggcgtcggcgctctgcaacttcagagcgtgcagacgctgagtgagtgactggttgaaggtggcaccccgggggccgcgctcgtcctctggctcggtctctggctcggtttctggctcggtctctggctcggtctcgatttcggtctcggattcgatatcggactcaggctcggtctcagaatcggtctcggtctcgtagtcgtcctgatcgtactctaggcactcggggcgggccagctcaggctcaacctcctcgtgctcgtgatcagactcagattcagaggactcagggagtacctgtgcggcagctgcagcggcagcggagcggtggtgggcgttaaggaagctccggcgctgggcagcacgctgctgggcgcgggcgttggaagaggctagggcgcggaggagagcaatggagcaggagagccagaggagagcggtggcagcccggcggcctatgggcgggcacaggtcgttgtaattatggcgagctcggcgccactgctgagcccgggacctgcgat

SEQ ID NO: 27566 - DNA, 1203 bp, Mus musculus
cttttccccccgccgcacggccaggccccggccccgaactgcgggtggggcgagggggcgacccctccgtggagccggcccgagccggacgtgggtgctgggacccctgcccggcctctgggcaccgcctcccggcgcccgcgcccgccctcccagccgcggccctcctcctcctcctcttcttcccacccccctcgccgccgtcgcctccgcctccccccgctcccccgcccgccgcggcgcttttgggtcggggcggcgggcccgggccgaggcaataagagcggcggcggcggcggcggcggcagcagctcccgcggctcctgctctgctccgcctcggccccggagcgaggggcggagagccgcgcgcttgccttagtccgagccgccaccctccccgcgttccccgctttcccggcccgcccgaggccgcccgccccgtccccgccgccccgcagcccggccgcgccccgccgccgccatgggctgcctcggcaacagtaagaccgaggaccagcgcaacgaggagaaggcgcagcgcgaggccaacaaaaagatcgagaagcagctgcagaaggacaagcaggtctaccgggccacgcaccgcctgctgctgctgggtaagggcggcccgggggggagcgggcccggcccgggagtgccgcggggcgacccgcaaggccgcgcgcgccgagcccgcccccctccccggcgctctagcgctcgctcccaggccctccggcccgctgggccgcgcgcgtgcagggggcgaggccgtcaaggggaccccggggcggaattcggccgggcgggggctgcaaattgggcgtgggaccccctcgttcggtctcgtcccctcagttggccacactcccccccgtccctggcttcgcgtcctcgcgaggcctacttagtgccaggggccagggtgcgtgtcgggagggggaggggaggctcacagggcccctcggactgcgacagagtagggctagggacaggaaacgggccggcgggcccagggagggggacccgcctcactggggtgtgcgatttgttgggagggggcccaaagagaggccaaggccactaggggggactcggggacctcggccgggagactctggcgagggaagtagccgccggggtgggggggcgggtgacatcagcccctcggaaaggacggggcggtaaaggtggtgca

SEQ ID NO: 27567 - DNA, 1234 bp, Mus musculus
gtatccatgaacccaatgcccaccaacaatgtggggacccaggactcctagccacaactgggggcctgttcaaaagtgctgtgagccacagaaccccaaacaacatcttccctccctggtgacagatgcatagatacttaaataattagatctacaaatatggaaatggaaaaccctaatatcaataataaacacttgtcacctctgggtctcacaaactactgaatcccaagttcagcatgtactaaccctacctccatacaaccctccctgtgctaatcaagagccacgcaggaagcagcagggtgtggttggaatggacagtagaccaggtgcaatttctggtccagttaatcaagatctcgatgccatgtctctaacccagccttatcaggcctgtcctcaggacatgattgggaaattatgatttatttttatttggatgccttcaatctatagatctagcccacaattccttggaaaacagaatactatgctttttagttgacgtgtctcaatgacgataacaccctggtgggcaggatgcaatatgattttcttttttttttcctttcaatcccactgtagtgagaaggccactaaagtgcaggacatcaaaaacaacctgaaggaggccattgaagtatgtgtctagctccttgctcttatcttttagcaagcccctcgccccacggtgctgccccccccacccccacgcctgaccaatttgctaaactgttttcagaccattgtggccgccatgagcaacctggtgccccctgtggagctggccaaccctgagaaccagttcagagtggactacattctgagcgtgatgaacgtgccgaactttgacttcccacctgtaagctccaccctaaccctggtttcctctgcccctctcaccttagtcccagtgggaacacgagggccagacttgcatcaggccagagtgaccagacacatacctgccgtgtgaatgcataagttaactccaggcatatgcctaagactaaaggatgataaagacatgattagggctttgtccaaaatggatgaacaaagttccatcaccttttctagacctcaacctagtcctccatttatcagatagtgagtttttttttatggaggagaggtcctgagctaaggcaagctcaattattcccctcatacacatgaggacagacaaaaccacatgtttgttacacatggcacacaagtcctaattgtc

SEQ ID NO: 27568 - DNA, 1186 bp, Mus musculus
gattaaaacaataagaacaacagcaacagcaacaacaaaaaccaaccctcccaacagggaaacacagcatggattctatagtcatctgattcccatgattcacagagacaaaatggcagcctacccacaatgcatctgatgtcattgacatctgctactctgatatctggacaatattctaaccttggcccatgtccctcccacagggtagtacatatccctcctgtacacataattctagggggagtttactcatttggtttgctcccacccctcacaagactaacagaagcagccacccaagactgtgagcactccccagagatgaaagcatgctaattcattatatagatttctgggagtttaacagaactgcaggctctttccaagcgctggttaacccgggggctcacacttggactcacatagcgagcgatggccttagaattccaggggtggggtccctgattggtttgagctcagtctgtcagccaacgtttttcctgggttctctttcaggaattctatgagcatgccaaggctctgtgggaggatgagggagtgcgtgcctgctacgagcgctccaatgagtaccagctgattgactgtgcccagtagtaagtagctgtccccccatggcaaaacagaagctcagaagccaggaagctacaaacccaccagtagtcagagagttccagtctggttcatttgttttataaagcttttaattgcactttatagaccactgatactgttttacataaacaattaatacctgctagagcaaggcaaaatacttacttgtaataaagtggtataactcacggatatgaactctaagcatttaggggcgcacacagtgtagcaaacacatactggcctcctcatataaaatacacagactttttattgttcagtaccttataaggcacttcagcttcatgatgggagggggacagtgaccctttcctaggctcactctcccatggggacttgttgctacatatatagcatgtcatgacttaatacacacagttatatattctttcaaggaactgaaaagcagccccacaggccccagcccccacacctcctccagcaaagttcctgatttttctcaaaagtttgtactaaaagctggaagcactaattatagaaacagaaaacaaatggagatcctggaatt

SEQ ID NO: 27569 - DNA, 2498 bp, Mus musculus
tctggcccttggcccccaaatcctccaaactagtattaatattactttttcatattacattatctcagtcctgcaaaaggcaaaagttaattttcctgtgtttatagtcgagcaacttttctttcttcttgttttgttttgtttttgttttttttaaactaaaagtttgctatctcaaactttttctgtttcacagacccagtagataggaagggaacttcgtctttgcttcctgttcaaagtggtgaatgcaagaacagcccctttgtgcccacagcttgtcttggctcagttctcaataatgaatgagagtcttccaaagcagacagggagagggctggctctgctttgtcctggacagagacctgtgcacccttaaacccgcacttgtacattgctttaggaaagggatgaagttttaaacttctcttacatgtcaaaagcaagggcggatcccaccaccacttgccttacggggtacacacttggcacacactgaccaccgtgtctccttttctttcaagcttcctggacaagattgatgtgatcaagcaggccgactacgtgccaagtgaccaggtacgcgtgcgcctctgtcctcaagcctggggttccacgttgctggttcttctccgggcaattagggtgagacctactgacccccctctttgttctaggacctgcttcgctgccgtgtcctgacctctggaatctttgagaccaagttccaggtggacaaagtcaacttccagtaagtgaatcgttgtcccgccccaactatctggcctggagagtggtgggcccagggtaacccagtattttccggttccagcatgttcgatgtgggcggccagcgcgatgagcgccgcaagtggatccagtgcttcaatgatgtgactgccatcatcttcgtggtggccagcagcagctacaacatggtcattcgggaggacaaccagactaaccgcctgcaggaggctctgaacctcttcaagagcatctggaacaacaggtgcgtggggtctccctgacttggctcaacctgtaggtctgcagcttgctctggccccagctctcacctggcccctctctcctcagatggctgcgcaccatctctgtgattctcttcctcaacaagcaagacctgcttgctgagaaagtcctcgctggcaaatcgaagattgaggactactttccagagttcgctcgctacaccactcctgaggatggtacggtcatggcgctggtttagtcaggtggttcttgggcacaaggtgtggctgagagtccctagcccctcccactatggggaagccagggacatttatttccctcattttcataggcagagatcaagagtttgggggtgatgagctacaatggtgtcagactaggtcttctaagctaattagcataattaataatttttttttttgtagcgactcccgagccgggagaggacccacgcgtgacccgggccaagtacttcattcgggatgagtttctggtgagtaggacttgtagtcccttactcctcctcacgagtattctccagtcagtgctggatttggagactgagcggtccaggccttccattgtattgtactatgagttgatggctggtcctctggtggtggggtgaggggctcctggagagggttgcttgaccgagcccctctctctgcctacagagaatcagcactgctagtggagatgggcgccactactgctaccctcactttacctgcgccgtggacactgagaacatccgccgtgtcttcaacgactgccgtgacatcatccagcgcatgcatctccgccaatacgagctgctctaagaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaaaatacggtgttgctctttgatttgcggcaagtgggtcccagggtccatgggtgggattggtctcggcacccactgggaggtggagaacaggtcccagggctaaaagtgggctgaggagttggcactatagactgggggaacctagtttttggcgcatcaaagcttccacccattatcctgcccccaggcagttgctagctgccctttgaccaattacttccccgaatgaggcaagcagcctacagagaaggctggggatgtgatgggtgggggagatgggagttatttgggaaacatttgaaagca

SEQ ID NO: 27570 - DNA, 1198 bp, Mus musculus
gctacgccttgaggaccagctcatgcttgctcctgccatgtgtttcattcaccgtgtgtttcattcgagctgggtcaaaggtccaggggaggataagtggccacaagtggggtattaacagggagacaatcacattttcttgcattatttagctgcctgcagagttaaacatttaactgagaggggccgtatcagagctttgctgcttatgtgggcctgagggagcctgtctggaccctcagattctatagggctagtctacggatggtggctgagggcagggcctgggtctacagaacagagggaccatgtcctgaggcactaatgcagagttcttgctccttacagggtgagaaaggctggatgaggatcgtgaccagcacctacaagggaggcacaggtgacagctacaaccttgccatcgagagtgcctgcacatttggggaccccattgtttaggtagatgtctctggaagcagcgctgtgaaccatgacagggaggggtgattaattactgacactggacatgtccagacagctataaacagtgcttgtggacatgaggaccagagtgtggactgcatcccgagaggagacggtaaaggatgaaacacaactgcactgggaccctccgccgtaccctccaggcctgcctcctccaccactgagccctccaggcctgcctcctcttctacagtgcttgccttcagccacccggagaagagagctatggtttaggacagctcaacttatcaccagatctggagccctggaatccatgggaggggggaacaagtccagactgcttaagaaatgagtaaaatatctggcttcccacgcttgtgtactttatttacacgagactagcacacacaacacacgcacactcccacacacacacatacaactcaacattactcttggaaacttaaagtaactgaccatctgggtcataggaaggaaacttacataaacccttcatgaagtgtcccagctgctagattcccactacccagaggcccactgggtccctgttcagaggtggcacacgcctgggatgtgacatgtagcacagagccacactgcgacacaggggggctgtctgccacagaagctacctttgagaagagttgcctgcttcttcccagcagaccctgcttccaggaggctggttgagcctcttcacagagcagctttc

SEQ ID NO: 27571 - DNA, 1455 bp, Mus musculus
aagaacattcgagtgggggctgccccttcattcctcaagaaactgtagagccacgggaaggaagagggcgagttgggggggggggggggttaaagaccagattccaaggtgtgtgtatgattgatttacagtgttgatataaaaagaaaaggggcgtgaccaagctaaccagtcagtcagcaagacaccctgccactcaattgtacgattctgagaacatcttctgtatacaaaataaaatttgtttctggatcaagccaattgctcaaggcatttggtatttggtaaataataactgaaaagagaaagacagcgaggacaagagatctgtccctgtggtttagttagcctgtaacacacacacacacacacacacacacacacacacacacacaccaaacgtggtcacaccttcactgttgctaacaataaatgcgttgcactttttaagggccgagaagcaatggagtgggtgatacataaactgaacgctgagattgaggaattggcagcatcagcaagaggaagcataaggacaccaatggcggcagcggcagcactggtggacaaatgacaatggaaattggtgtgcagcatcagggctccaggactctcaagctggcatcatattatttgttatttaaaagacacaattattttaggtagatctttttttttaatgaggtggggtaaggctgtgacttttgatctaaacaaaagatccagaacctctaaatcagagggatcatctgaggggaggatgtaagactgggagaggctgtgttcatgtgaacagttaacgggtttgtttgctgttgttgttgttgttgtttaagtacttagaagaaattggtgttgatctggagtctcttaaagctccaggtactggaacactacctggctgcggaccaaccagagcagagcccagccgccctcctgtccacagctgcccgctgctgtgaaccagaactgcctgcatgagggactcactctacaaagagaacctgtaaaatttaaatgacattaatttatataaaataacctgccctgctggaaaccagtgtttggatttggtacttttaaatgatatttttggagtgaaaattaacagtaaggtaatatatgactccagcaaaaatagtattttattgtattaacgggtactataataatttgccaaattttgtgacttagtaaaggcattcccttccttgaatttgtactttgtgatttcgcatgctgtactgtgggctggttatgttaaccgaaaaaataaagtcattacctgagtgtctcatcactcttaacagaacactgagacagaagagcagctcttcccatctctgagcacttcacattgacttataaatgtcatgggtttgtagttgctaagacatggtatgtcaggttatcggaatatgagtacttcttgaggcagttaagaccacaaaacag

SEQ ID NO: 27572 - DNA, 2402 bp, Mus musculus
aatgtagacaaaatgctgagtgtatttaatatggtgaagatttttgaatatttctagagtcttcacaatcaaacaatccatactgcaaagaaatttaggaatataatatggtgaaaccttttcagatttcccaaatcttcatcattatgaaagagaaacccatgaatgcattcaatatggggaagcctttaaacatttctaattcttcatcatcatgaaaataatcatacaaaggagatcaagggaatacaaggcatgattcttattgtcttgcttgagttacagtcctgacaatctttggagataaatatcaatgtggaaagtgtaagctggattaaaccctttcctccccaactgcttcttggtcatgatgtttatgcaggaatagaaactatgactaagacatattggtatgaggagtggggtattcctgtgaaaacctgaccatgttttgggaggactgtggaaggactttggaactttgggctagaagatccattctgtgttaagaactctgtgggatgttgtgtaggagtttggaagataatgttgagaacagtgcagaagatgaaggcctcgcttgtgaaatttcacaggaaaaattaaagactcttttgaggtccattgctattttggattgtgaagattctgtggttctggttagctaggtctgaagaatcagctgtgatgaacaagataccagaatttctagagtgaaaactttgcattactgggactattgatgctggttagctggagctgagaaattagcagtgattaagaagaaaccaacatcattgaggaggcatcatctgggaagtgttttctgagagcacagaggcagtgttagatagtcaaggttgtaccttgtgctgtgcctggacttggtaatgtgttacagttacccacatggtactggttttgaaagcatgaagggataatgcagagcagctgatgccctgccatttgagaggccatggaaggccattggtgaaggtgcaaactcagatgaaattgatgtcccagtactgaagagatcatgtagtgttttggagttactaggtccatgaatgaccaagaacagcagcaacaataaagtacaggcttctggagcctagaggacaatctgtgtgctacaaaggacagggctggagaagtgacccaagcccttggaggagcccaaaagatcgtgagtttgatcccagacattggacagttggagtttaatttttgcttttgattgtgactgtacactaatatttttccctcttgaagggagaaattattttagtggattctatagttaatagacttttaattgtaaaaggctttggattttaaaggatattggatattttaaaagatttaacttttactatgtaaagattgtggggctttcaaagttgcttagaacttagggatgaataagaaactaagggttgaggcttagttgtgatgtgtttgtgtgtcaagttgacaaggggtcaattgtagtggctagttttgtgtcaagttgacacaagctggagttataacagagaaaggagcttcagttggggaaatgtctccatgagatccagctgtaagacattttctcattttgtgatcaaggggaaaggccccttgtgggtgggaccatctctctgggctggtagtcttgggttctctaagagagcagtctgagcaagacaggggaagcaagccagtaaagaaacatccctccatgacctctgcatcggctcctgcttcttgacctgcttgagttccagtcctgacttccttggtgatgaacagcaagcagtatgaaagtataagccgaataaacccttctccctccccccaacttgcttcttggtcatgatgtttgtgcaggaatagaaaccctgaataagacaaggggtataaagttggattgtaaaaaaagagattatacaataaagaaatgaagaaataaaaatattttaagaaaacgatgggcaggcagaaacattccttccaaattatagcttcattttcacaccaatcaggatttagggataggggcttatgtagtttacagtgtcaactgttatagaatatgggtgttatagtttaaccaagcatatggatttgttctttggtggtaaagtacaggtcttatgttttgaggagcacaatgaaaagcagaaagcattgtacagacagtcattatgttttcaagaagaatatatgagtaaagtgaggttggatctccacaagacaccatgcctggaaacttgaacttagtttcagcgtatgagtaaatgcagggtaataacaaaaaggcaatacttagggcctggtgtttggtttggtttggtttttctgcttattcccaatcgtgtattggttctcatgctactcctgttaaattgttcccaaat

SEQ ID NO: 27573 - DNA, 1181 bp, Mus musculus
taaaccctttgaaggaagcagtggtcttgaatataataatcgaacacaaacagctgaaaaaccctatgaatgtaaccaatgtggtaaagtctttgcaggaaggagtgacctttaaagagaaaagaccatacaggagagaaactctatgaaagtatctgatgttgtaaagcctttgcagcaagcattgatctccaagtacataaatgaacacataccagagaggaaccttttaaatgtaaccaaagtggtaaagcttttttgaagggtaaaaggctggaaaacaattttccaagcaaatggtctgaagaaacaagctggagtagccattctaatatcaaataatatcaacttccaacctaaagttatcaaaaaagacaaggaggggcacttcatacacaccaaaggtaaaatcttcaaagatgaactctcaattctgaatatctatgctccaaatgcaagagcatccacatctatgaaagaaactatagtaatggtcaaagcacatattgcacctcacacaataatagtgggagacttcaacacacagctctcatcaaggaacagatcctggatgaaactaaacagggacacattgaaactaacagaagttatgaaaaaaatgaatttaacagatgtctacagaacattttatcctaaaacaaaaggatataccttctcagcacctcatggtaccttctccaaaatcgaccatataattgttcccaaaacaggcctcagcagatacaaaaatattgaaattatcccacgcatcccatcagatcaccacggactaagggtgatctttaataacaacagaaataacagaaagccaatattcacgtggaagctgaagaacactctactcaaggaaaaaatatagaaagaaattgaagactttttagagttaaatgaaaatgaagccacaacatacccaaacttttgggacacaatgaaagcagtccttagaggaatactcataactctgggtgcctccaaaaagaaactatagagagcacatatgaatgaattcaatatggagaagtctttgcacacttttatagtcatcatcatcatgaaagtaatcatatgcaaagaaagtctatgcgtgtaaacaaagtgatagagcctttcttgtatgaggtcctctctgatcccatacaactgaaactcggggaaagcaa

SEQ ID NO: 27574 - DNA, 1187 bp, Mus musculus
tcagatttcccaaatcttcatcattatgaatgggaaacccataaatgcattcaatatggggaagcctttaaacatttctaattctttataatcctgaaaataatcatacaaagttcaaggggatacaagaaatgtttcttattgtcttgcttgagttacagtcctgacatcctttggtatgaatatcaatgtggaaattgtgagtggattccctttcctccccaactgcttcttggtcataatgtttatgcaggaatagaaaccctgactaagacaaattggtatcaggagtggggtattcctgtgacaacctgaccatgttttgggaggactgtggaaggactttggaactttgggttagaagatccattctgtgttaagaacgctgtgggatgttgtgtaggagcttggaagataatgttgagaaccgtgcagaagatggaagcctggcttgtgaaatttcagagggaaaattaaagcctcttttcagggccattgttactttgtgaagattctgtggttctggttaactggggctgaagaatcagctgtgattaacaagataatagaatttctagagtgaaaactttgcattattgggactgttgatgctggttagctggagctaagaaattagcagtgattaagaagaaaccagcatcattgaagtggcatcatctgtgaagtgttttttgagagcacagaggaagtgttctagagataatcaaggtggtaccttgtgctgtggctggacttggtagtgtgtaagtcttaacctcgtggtactggttttgaaggcatgaagggataatgcagagcagctaaggcccagcactttgagaggccatggaaggcaactggtgaaggtgcagactcaggtgaaattgatggcccagtactgaagagatcatgcagtgtgttggagttgacaggtccatgattgaccacgaagaacagcagcagcagtaaagtacatgcatctggagcctagaggacaagtggtgtgctacaaaggacagggttggaaaagtgacccaagcccttggttcttttggagttgtccaaaagatcgtgagttggatccgagacattggacagttggagtttaatttttacttttgattgtgactgtgccctgatgtttttccctcttgaaggaaacaagtattttagtggattccattgta

SEQ ID NO: 27575 - DNA, 1157 bp, Mus musculus
tgggcagccttgtctagtccctgattttagtgggattgcttccagcttctcactattttctttgttgttggatactggtttgctgtagattgcttttatcatgtttaggtatggacttgaattcctgatctttccaagacttttatcatgaatgggtgttggattttgtcaaatgctttctaagcatctaatgagatgatcatgtggtttttgtctttgagtttgtttatatactggattacgttgatggatttctgtgacttgaaccatccctgcatccctggaataaaacctacttggtcaaaatggataatcgttttgatgtgttcttggattcggttagggagaactttattgaggatttttgcatcgatattcataagggaaattggtctgaaaatctctatctttgttgagtctttttgtggtttaggtatcagagtaattgtggcttcatagaatgagttgggtagagtaccttctgtttctatattgtggaatagtttgtgaagaactgggattagatcttctttgaaggtctgatagaactctgctctaaactcatctggtcctggacattttttttttttttggttgggagaccattaatgacttcttctatttctttagggtatatatgactgtttagatcattaacctgatcttgatttaactttggtacctggtatctgtctagaaacttgtccatttcatccaggttctccagttttgttgagtatagacttttgtagaaggatctgatggtgttttggatttcttcaggatctgttgttatgtctcccttttcatttctgattttgttaattaggatgcttttcctttgccctctagtgagtctggctaagggtttatctatcttgctgatttactcaaagaaccagctcctccgagcctcagcagcagcagtcgccatcttgttccgggaaccgccgaacttaggaaattagtcaggacaggtgagagggtgcgccagagaaccggacagcttctggggcaggcggaagcacagagccgctgaggcagcaccctttgcgggccgtagacagccggccaccctccggaccagaggacaggtgtctgcctggcttgggaggcggcctcagcctcagcagcagcagtcgccatcttgttccggg

SEQ ID NO: 27576 - DNA, 1134 bp, Mus musculus
ggagacttcaacacacagctctcatcaaggaacagatcctggatgaaactaaacagagacacattgaaactaacagaagttatgaaaaaaatgaatttaacagatgtctacagaacattttatcctaaaacaaaaggatataccttctcagcacctcatggtaccttctccaaaatcgaccaagagaaccaaagaggattgccatgctagtaaatgaagtggatgcaggcttgagagctgggaatggcagaataccagccatgtaagagccagggaagagagccccagtggcccctcctgtgattgattctggggtagcaaaaatggcatagagactttagtaagtaataattcaggattatcacagaaaagaattagcaatgtggaagtttgagagtgtcccaaccaattagctgatttaaaatagtaaataaagctgtgtatctttatttgaggatctaaagcatttgcatgctcagtgaggaacttgcacaggaagcatcctatagtagatcagagtaaccaaccaactctgcagaatgtacctcacctgtaggcttgaactcaatattaaaaattaattgtagattctcaagtggaaaaccatgtcatgatgtgagataaagagatgtggaaaattggattcttagcagagatgctggtttactggagacatgaggtgtgtcaccaagctgtgcaggttcacaactagaacaaaaggtgagctgaactggtatgcataattcttggttccatgtcataagctgggatgtagcaaaatccccctagctgatccagacatcctgcctttgtctcctgcctagccattggctgttggcactttttttacccatttacaatcagcttggggcagggaatctcagtgtcccaatatgggcttatcatgcaatttgaacaatttaacaggagtagcatgagaaccaatacacaattgggaataagcagaaaaaccaaaccaaaacaaacaccaggccctaagtattgccttttttttgttattaccctgcatttactcatatggtgactctaagttcaagtttccaggcatggggtcttgtggaaatccaacctcactttactcatattctcttcttgaaaacataatgactgtca

SEQ ID NO: 27577 - DNA, 1176 bp, Mus musculus
accatgtgtattgagatttgactccctcttatggagtgtctgaagacagctacagtgtacttacatataataattaaataaatcttttatttaaaaagtatttgaacatttctggatgatcacttgctagatattagtttgtcccattatggctctggacaacccactttcaataaaataagagaataatgtacagaaggtattagagttacaagggccagctttgaggaaagctacaagcaggaaatggaatttactgaaaagaagctatgtgtgctgcaggtgacagagctggagaagtgagagtatggaaaaccatgtggctaaggcaatgtcatcataatctcaagatgctgaacaagaagctataagttttgttgttttcactgataaattttggtgtctttggtcagttcatttttcagatgatttcattatttctgctaaggattgtttcttttgtgacattggatgtgcaaaagagaacaatctctcttaagcatatggtacagtgtggacagataaaaagtagttttcatttttgaaaaaacatgtggtagttaaatgataatggctcccatagattaaaagatttttttaattattatatgtaaatactctgtagctgtcttcagacactccataagggcgagtcaaatctcagcacagatggttgtgagccaccatatggtttgtaggatttgaactcaggaccttcaggagagcagtcagtgctcttaaccactgagccacctttccattctccatatgttcgaatacttttttttttttttagtttatcggactgattatgaaggatttaacatcttctaaccatgcccactttgctagctacctcttgtctaggttcaaaatatgagctctcagctctacctgatgccatgtgtttatcctgccagtattgactctaaggctttggaacagtaagcctacaatgagccttcaattatattttcctttgtctaaggtgtttttcatgagatcaacagaaaagaaatatacagaggagttccatggaaaatcagaaatcagaatatcatcccttccaactatagaaaccaaggaggaatattttctatctctaggtcagtatgatctgtcccatacctttgatttaggagtaatcccaagattgacaattatctacttccctta

SEQ ID NO: 27578 - DNA, 1134 bp, Mus musculus
tcagacactccagaagaggacatcagatttcattatggatggttttgagccaccatgtagttgctgggatttgaactctggacccttcggaagagcagtcggcgctcttaacatctgagtcatcttgtcagccccatatttatctttttaaaaagccaggttttggtattaccttttttttttttttaaagatttacttactattatatctaagtagactgtagctgtcttcagacactccagaagagagcatcagatttcattatgaatggttgtgagccaccatgtggttgctgggatttgactcaggacctttggagagcagtccgtgctcttaaccactgagccatctctccagcccttggtattactttttaaatttcattttctttatgcataggtgccctgatcttttacttgtttctattctccaatgtttccagaaatcaatagtttcattcctatttgtaaagagattacatatctgtctgtttacagcaacatctgtagttcaggctttccttattccatttagttaatacttgctttgagcatttgagcctaaaaactttcttgctctttctgagggtagaagactgatggctactgtgattatcacctgtagcctaacagctgaggattaagcaatgtggcctttgctctatctcagaaggaactgctgggctctaacttttagcctgcaagtcagaagtcacaggaagaaaatgggatgctcaaagaagtggttatggagtttattactaagttgtcacaagttacctatgaaagctatctaagaggaaaagcgaaaagatcctaagtggggaagggcaaaaaacttctcctttctcttttctttatctctttgtcctcattacttatacatccttcagtatacgtgatcacatgttaccaagttcatcacaagttctcataaaaatcaaatcataaactgaaatagaagtttataacagagaatggttacatgcatatccattaggagtaattactaatggctaagtatccatcacctgtatcagatcctcaggttccctgaaggtttaaaaccataactaagttattagtaaagttttgcagagataaacacagtccatattttatcttctagcctag

SEQ ID NO: 27579 - DNA, 1173 bp, Mus musculus
agattccctgccccaagctgattataactgggaaactaaagtgccagcagccaatggctagggaggagacacaggcaggatttttggattcatgacaaggggaacaaagaggatctccatgccagtaaaggaattggatgctggcttgagaggtgggaaagacagaataccagccacataagagctgtggaagtgtagtcccagtgttccctcttctgattggttctggggaagcagagataggctatagattttagtaattcaggagtgccatggaggagccattagcaatgtggatcattgggagtgtcccatctaatgagctgatttggcatattaaattaagctgtttgtctttcatttcagactccaaagcatttgcaagctgagctaggaacttacacaggtggcatcctatagtagagcagagtaacaactgagtctacagaaggcatcacacctataggctgaaacgcagtattcaaaacttactggagattctcgaatgaaaaaccaatgctaagatgtgaaattaagggatggggagaattggattcttagtggagttgctggttttgctgagccatctagttcctcaccaagttgtgcaagttcacaactaaaacaaaagttgagctgaattggtttgcataattcttgggttcttggaatgtgctgggactcaccaaaatcctccaagttgatccggacatccttgttggtctggatttaccatgggcccttctcaaagaattctgtctgtctcaaatagtttgagcttggaggtgcagtacagacagacaggtagctcagaaagaagagacagaggtagatagtagaagctgcccagagctataatcataaaaaagaatagaaatctatgagatttgtttaattgcttttagggataaatgagacagaagtaattgtttaggagtgtttgaggcggtctctgtggagggccctaaggtccccagaggactccccacaaggctggcacattagcacacccagttccttgagatcactggtgagtggaacgcaacatcaattccaaaaaatccagagggtcttgtgctagcaaaaacagggtcaaagggcataggcaggccctagcacacccagaattttgggatcactgaaaccaatttatgcagaagagtacatgggcag

SEQ ID NO: 27580 - DNA, 1110 bp, Mus musculus
agaagtgagaaaccctatgtctccaagctgtgtggtattgctttcacttgtcagtcatattcaaagacacaaaagaaaacaaaatgtagacaaaaggctgagtgtatttaatatggtgaaactttttgaatatttctagagtcttcacaatgaaacataccatactgaaaagaaatttaggaatataatatggtgaagccttttttagatttcccaaatcttcatcattatgaaagagaaaccccatgaatgcattcaatatggggaagcctttaaacatttcaaattcttcatcatcatgaaaataatcatacaaaggagatcaaggggatacaaggcatgtttcttattgtcttgcttgagttacagtcctgacatcctttgctgataaatatcaatgtggaaagtgtgagctggattaaaccctttcctccccaactgcttcttggtcatgatgtttatgcaggcatagaaaccctgactaagacaaattggtatcaggggtggggtatttttgtgacaacctcaccattattttgggaggacggtagaaggactttggaactttgggctagaagatccattctttgttaagaactctgtgggatgttgtgtaggagtttgaaagataatgttgagaaccgtgcagaagatggaggcctgacctgtgaaatttcagaggtaaaattaaagcctcttttttgggccattgttactttgtgaagattctgtggttctggttagctggggctgaagaatcagctgtgattaacaagataccagaactactagagtgaaaactttgcattactgggactattgatgctggttcgctggagctaagaaattagcagtgattaagaagaaaccagcatcattgaagtggcatcatctgtgaagtgttttctgagagcacagaggaagataatcaaggttctagagataatcaaggttgtaccttgcgctgtggctggacttggtagtgtgtaagacttacccacgtggtactggttttgaaggcatgaagggataatgcagagcagctaaggcccagcactgtgagaagccatggaaggccactggtgaaggtgcagactcaggtgaaattga

SEQ ID NO: 27581 - DNA, 1134 bp, Mus musculus
gttttggagttgccaggtccatgaatgaccacgaagaacagcagcaacagtaaagtacaggcatctggagcctagaggacgagctgtgtgctaaaaaggacagggttggagaagtgactcaagcccttggagttgtccaaaagatcgtgagttggatcccagacattggacagttggagtttaatttttacttttgattttgactgtgccctgatatttttccctcttgaaggaaaaaagtattttagtggattccatagttaagagacttttaattgtaaaaggctttggattttaaaggatattggatattttaaaaaggatttaacttttaatatgtaaagtctgtggggctttcaaagttatatatatcttggggatgaataagacactagtgatgtgtttgtgtgtcaggttgacaaggtgtaaattgtactggctagttttgtgtcaacttgacacaaactgaagttatcacagagaaaggagcttcagttgggaaatgcctccatgagatccagctttaagacattttctcaatttgtgatgaaggggaaaggccccttgtgggtgggacatctctctgcactggtagtcttgggttctacaaaagagcagtctgagcaagccagggaaagcaagccagtaaagaaacatcccgctgtggcctctgcatcagatcctgcttcttgacctgcttgagttccagtcccgacttccttggtgatgagcagtaagcagtaggaaagtgtaagccgaataaaccctttcctccccaacttgcttcttggtcatgatgtttgtgcaggaatagaaaccatgaataagacaaggggtataaggtatggattgtaaaaagagattagacaataaaaaaatgaagaagtaaaattatttattttaaaaaggagggtcagacagaaacattccttccaaattatagcttcattttcacaccaatcaggatttagggataggggcttatgtagtttacagtgtcaactgttatataatatgggtgttatggtttaaccaatcatatggatttgttctttggtggtaaagtacaggtcttatgttttgaggggcacaatgaaaagcagaaagcattgttagaaacagtcattatgtttt

SEQ ID NO: 27582 - DNA, 1437 bp, Mus musculus
gagtgagaggctaatgaaggatggtttgaaggttggttcacaaaatccccatggatgactactttactatctgccctcattggccccttattaattttgcttcttttacttacaataggcccctgcataattaacaagataatgacttttgtcagagagcagatcagtgctatacagggtctttttttttttttttttggtttcggtttttcgagacagggtttctctctgtagtcctggctgtcctggacctcactctgtagaccaggctggccttgaactcagaaatctgcctgcctctgcttcccaagtgctgggattaaaggtttgagccatcattgccggcaatgtacaagttcttatgctgagccaacaatatcaaaaagtagaacaggctgatacactgagtcagaggtttaatttttcttgttctatgattagaactatttactagaaggagtggggaatgtaagactccaactcaattgtttcttagacccctagaaacaaagcccagcagggaggagttctttgtttttttgcctttagcctaagagaatgatgaccactgggtgacccaccaaggcacctgacccatagtgtaagggacctagaatgtttgccaaaggttaatctgtaacctttacgtgagagatgagctgtaattcaccatctccattcttaagatgtttactcaccttccccattctttgtggtcttatcctcccctcactttgtggtttattctttaaaaccctcgactgcaactgctgggggtcgatttcctctgcccctgtgtgagttacgagctcggccttagcatgctgatatccgaataaacctcacgcgacattgcatcaagaactttttctttagagttactggttatagaagtttcctttactttttgttaaagcctttttggttcttaccagttaatttgaatctcacttgatagcacctaacaaaggcttatgttctcctgtggtgagtttaaggtgaggtctttagccaattaacatctcccggaagcttttgaaaataaaattttgaagcaaatttgtaccacaattttctagtataactaaaaaccctaaatattaaaaatattgcctctgaatcttatggaccaacaattattctctagaactttaaacttccctttagaggcattggctaatagagtacttttcacttacgaaacaatatatactgaaagatttaaattctttgtttcttgtattgaagcagacaataaaattttcttacatattgtaaagctatgttagccatatctacaggcaaaattatctagtgatcaccagttcattaaaagcaaaactctttgaatttaagcattattttaaacatctgaatagatttgcaataaagctaaaaagaaatttttttgaacacaggggaaactttcttaggctt

SEQ ID NO: 27583 - DNA, 1221 bp, Mus musculus
cgcaagaccctcgtctctctctaccccccatttggttcttaggaggaggtcccctcgagaccctctaataactggacctgttggacgggtcaagtggcgtctaacgtggggcacaaggtacgaccacccttcggacagcagattaaagaggtaccgcgcagacagtgagacagtgggacagtccaccgccacttcgctcaagtgtcgaggacggtcgtctgagaggtaagcctaggcattcagttgttgtcccattaactatggggaaggttctgtccaaagaggcagtctttattcaagagatgaagtgttctcttaaggagagagggataagagttaaaaaaaaaggaatttaataaaatatttttgttttgtggacgagagatgtccatggctggtattgaatggttctgaaatacaccctttaacttagaataaagtaggcaaagatattgatgcgttgataaaacaaggagaagatgtccccaagtcctttttagttattggggaatcatcagagacctccttgagcaggcagaaaagggcggaaaaggtgctagcctcctagcccttactgaagattttttagaaaactcccgatcaccatcgccatctcacaaaagcgaaactaagccaccggtgcacagtatctctattagaaggtttagcaggagaaggctacttaatacccaatgaatgaaataaagttgttcagtctgtcctcactagaggccaatatttaacttggaagtcagagtttagggctgccctgagaagtaaaaccaagagtttaggtataaatggtatgatcaagctttgaaatgaggtagatgtgttttctcaacaagtttctaagtctattaacctggccattagggctgctctacaagtaaatataggagaaaaaacttgatatagatgcaaccaacatagacatttttgctagagaatgccctacacaaacacagaacaccctagtaactgcggtccagggaaacggccagagggcccccccttacaaggcccgtctcccctaataacaactgcagacaaccccctaacccccacgggagattgtgcagggttccaaccgagagcacagcgagctcgggagtgtggccttcttcgccccgggccccttacggcctcagcccatgctgggtgagcccgaggagcccgggagcagcctcggtccctaccctacaaatgccaggagccttt

SEQ ID NO: 27584 - DNA, 1180 bp, Mus musculus
agcgcctgggcaataaccaccttgtctctcctagtttgggccttaagcttacagaccaaccagagaagcaacactaatccacagcaaagtgtatctccaaataatcccactcccacccattctttaaagaaggaaaatgctgaggagatccaattgggtaatcctttggtcagggacaggtccaagcgtgtggagttgacctgaatgatggcaagtctcaattcctgaagggtctgttcaaattcagccatccaattctgtaacatatactgagaaagtctttttgacaaattagctgccctagtaaatttctcatactgaatggaagtaacacacaatctcggaaacttttgttcacatcccagctgagctatttgccataatacatctagtttttcctggacaagatctatgcgttgattaaccagcatgagacctccctgtatcttgaccttagctgaggcctgtttatccatggctgtggtcaccgaggctgacaatgtgttaatggtgtcagtcgtctggacctgtccagacagagccaaggctgtctgaacaaggccaaacccagttccttgttagtggtaaaaagtcgggggaatacttgagcattatacatcaccggcattgggagtggaaatgttgacattatcccccaacgctgctctctcttcattattgtcgccctggacatcaccaagacgagggacatcagtattcccttggtcagtctggatttttcgggtgagtctttctggtatccaaaatgggttgtcttcattctgtggaaaaacacaaacagctcccctggatcttatcaaaataggatccgggccataccatttattatcaaggacatttttccatttaaccatctcattgggcctatctggctctgaacaatgacgttcagccgcagtatggccatgagcatcaagatttaaaaaattgagtgtaaagagtgccatagacagacactcttggtactcggggtagagcctcgactccccctttctgtttttttttttttaaagatttatttattattatatgtaagtacactgtagctgtcttcagacacaccagaagagggagtcagatcttgttacggatggttgtgagccaccatgtggttgctgggatttgaactctggaccttcggaagagcagtcgggtgctc

SEQ ID NO: 27585 - DNA, 1215 bp, Mus musculus
agcagtggtctccaatgccataaaagatcacatacaggagagacaccatatgaatgtaaccaaggtggtaaaccctttgaaggaagcagtggtcttgaatataataatcgaacacaaacagctgaaaaaccctatgaatgtaaccaatgtggtaaagtctttgcaggaaggagtgacctttaaagagaaaagaccgtacaggagagaaactctatgaaagtatctgatgttataaagcctttgcagcaagcattgatctccaagtacataaatgaacacataccagagaggaaccttttaaatgtaaccaaagtggtaaagcttttttgaagggtaaaaggctggaaaacaattttccaagcaaatggtctgaagaaacaagctggagtagacattctaatatcaaataatatcaacttccaacctaaagttatcaaaaaagacaaggaggggcacttcatacacaccaaaggtaaaatcttcaaagatgaactctcaattctgaatatctatgctccaaatgcaagagcatccacatctatgaaagaaagtacagtaaaggtcaaagcacatattgcacctcacacaataatagtgggagacttcaacacacagctctcctcaaggaacagatcctggatgaaactaaacagggacacattgaaactaacagaagttatgaaaaaaatgaatttaacagatgtctacagaacattttatcctaaaacaaaaggatataccttctcagcacctcatggtaccttctccaaaatcgaccaagagaaccaaagaggattgccatgctagtaaatgaagtggatgcaggcttgagagctgggaatggcagaataccagccatgtaagagccagggaagagagccccagtggcccctcctgtgattgattctggggtagcaaaaatggcatagagactttagtaagtaataattcaggattatcacagaaaagaattagcaatgtggaagtttgagagtgtcccaaccaattagctgatttaaaatagtaaataaagctgtgtatctttatttgaggatctaaagcatttgcatgctcagtgaggaacttgcacaagaagcatcctatagtagatcagagtaaccaaccaactctgcagaatgtacctcacctgtaggcttgaacttaatattaaaaattaattgtagattctcaagtggaaaaccatgtcatgatgtg

SEQ ID NO: 27586 - DNA, 1842 bp, Mus musculus
ggggtattcctgtgacaacctgaccatgttttgggaggactgtggaaggactttggaactttgggctagaagatccattctgtgttaagaactctgtgggatgttgtgtaggaagataatgttgagaaccgtgcagaagatggaggcctggcttgtgaaatttcagagggaaaattaaagcctcttttcagggccattgttactttgtgaagattctgtggttctggttaactggggctgaagaatcagctgtgattaacaagataatagaatttctagagtgaaaactttgcattactgggactgttgatgctggttagctggagctaagaaattagcagtgattaagaagaaaccagcatcattgaagtggcatcatctgtgaagtgttttctgagagcacagaggaagtgttctagagataatcaaggtggtaccttgtgctgtggctggacttggtagtgtgtaagtcttaccctcgtggtactggttttgaaggcatgaagggataatgcagatcagctaaggcccagcactttgagaggccatggaaggccactggtgaaggtgcagactcaggtgaaattgatggcccagtactgaagagatcatgcagtgttttggagttgacaggtccatgaatgaccacgaagaacagcagcagcagtaaagtacatgcatctggagcctagaggacaagtggtgtgctacaaaggacagggttggaaaagtgacccaagcccttggatcttttggagttgtccaaaagatcgtgagttggatcccagacattggacagttggagtttaatttttacttttgattgtgactgtgccctgatgtttttccctcttgaaggaaacaagtattttagtggattccatagtaaagagacttttaattgtaaaaggctttggattttaaaggatattggatattttaaaagcattgaacttttaatatgtaaagtctgtggggctttcaaagttgtgtatatcttgggcatgaataagaaactaagagttgagcattactagtgatgtgtttgcgtgtcaagttgacaaggtgtcaattatactggctaattttgtgtcaacttgacacaagctgaagttatcacagaaaaaggagcttcacttgggaaatgcctccatgagatccagatgtaagacattttctcaattagtgatcaaggggaaaggccccttgtgggtgggaccatctctctgcactggtagtcttgggttctctaagagagcagtctgagcaagccgggtgaagcaagccagtaaagaaacatccctctatggcctctgcatcagttcctgcttcttgacctgcttgagttccagtcccaacttccttggtgatgaacagtaagcagtatgaaagtgtaagccaaataaaccctttcctccccaacttgcttcttggtcatgatgtttgtgcaggaatagaaaccatgaataaaacaaggggtataaggtatggattgtaaaaaaaagattagacaataaagaaatgaagaaataaaattaattttttttttgaaaaaggaggatcagacagaaacattccttccaaattatagcttcattttcacaccaatcaggatttagggataggggcttatgtagtttacagtgtcaactgttatataatatgactgttatagcttaactaatcatatggatttgttctttggtggtaaagtacaggtcttatgttttgaggggcacaatgaaaagcagaaagcattgttagagacagtcattatgttttaaaaagaaaatatgagtaaagtgaggttggatctccacaatacctaatccttggaaacga

SEQ ID NO: 27587 - DNA, 1722 bp, Mus musculus
aaattattgtttgcaaggcattccattagttcaaagaaagagatataatggcttaacagatatgatactgtttaaatcaagccatgtagagctatgctgtacaagtgcgagtgtcttcagtcttatatcgcttagatattgcaaaaggaacacacagtgattaggtgacaagtatatgtctaaaacctagtaatgagcaaataatccatagtatatctgagctcaatgatatacttgtaataacattgctaaatttagtgagatgaacagttcataagattcaaaaatggttttgtggaaaaaccttaatctctgtaccacatttctgtgacgaaaaaaagtcagctgtgaatgtaatgtggaattttcacttgttattcttcttttgatgtggatgtcataggttaagatggatacaagtcttgtgatcattggggcattgaaagaagccacatacctttcacttttccagaacaattagaggatatgcagtataacatattttgagcaacatttaaatgtgctatataagtttataaataatttgcttcgaacattgctggggacatttaccaactcaaactgctgaaaatagtaatgagaattaaagcagtagaaaattttttttcttttgcatttgttcatattccaaatgtagtattactctcatgataacaaaatttgtgaaagcaatcattgtgcaaacactgggagttcttcctgttttttttcaaatatgtgagtaaccttttatagaaaaagtatgttataaatgtgagccacataatcagtactgtttccatttcatatatcctcgaagatgtaaaacaattcataatttagtaaaactcctttgaatataaacaaagtaatattacgttaacattagattgctctgttcaatgaaaccaaaatttaaaagaattcatacagataaaaagactcatcagtataatcagtgtaagaaagatttcacgtgtgcaaattttatttgcaggcatgaaagaagttgttctgcagagcaaccctctgagtttattcaatgtggtaaagcctttgcatatgagagtggtagacaaaggcatcaaattaaacatactggagagaaacaccatgactgtaaccaatgtggtaaggactttagaacatggaatgtcctgcaaatacataagcgaacacatacaggagagaaaccctatgactgtaaacaatgtggtaaagcctttgcaagaagctgtcatctccgaatacataatcgaacacatgcaggagagaaacagtatgaatgtaaccaatgtggtaaagcttttaaaagaaggagtgacctccaaatacataagcgaacacatacaggagagaaaccctatgaatgtaaacaatgtggaaaagcctttgtaagcagtggtgaactccaaaaacataaacgaacacatacaggagagaaaccctatgaatgtaaacaatgtggtaaagccttttcacaaagcagtcatctccgaatacataagcgaacacatacaggagagaaaccctatgaatgtaaccaatgtggaaaagcctttgcaagaagtggtgacctccaaaaacataagcgaacacatacaggagagaaaccctatgaatgtaaacaatgtggtaaagcctttgcacatagcagtcatctccacatacatgagcgaagacatacaggagacaaaccctatgaatgtaaacaatgtggta

SEQ ID NO: 27588 - DNA, 1179 bp, Mus musculus
aggactgtggaaggactttggaactttgggctagaagattcattctgtgttaagaatgctgtgggatgttgtgtaggagcttggaagataatgttgagaaccgtgcagaagatggaggcctggcttgtgaaatttcagagggaaaattaaagcctcttttgagggccattgttactttgtgaagattctgtggttctggttaactggggctgaagaatcagctgtgattaacaagataatagaatttctagagtgaaaactttgcattactgggactgttgatgctggttagctggagctaagaaattagcagtgattaagaagaaaccagcatcattgaagtgacatcatctgtgaagtgttttctgagagcacagaggaagtgttctagagataatcaaggtggtaccttgtgctgtggctggacttggtagtgtgtaagtcttatcctcgtggtactggttttgaaggcatgaagggataattcagagcagctaaggcccagcactttgagaggccatggaaggccactggttaaggtgcagactcaggtgaaattgatggcccagtactgaagagatcatgcagtgttttggagttgacagctccatgattgaccacgaagaactgcagcagcagcaaagtacatgcatctggagcctagaggacaagttgtgtgctacaaaggacagggttggaaaagtgacccaagcccttggatcttttggagttgtccaaaagatcgtgagttggatcccagacattggacagttggagtttaatttttacttttgattgtgactgtgccctgatatttttccctcttgaaggaaacaagtattttagtggattccatagtaaagagacttttaattgtaaaaggctttggattttaaaggatattggatattttaaaagcattgaacttttaatatgtaaagtctgtggggctttcaaagttgtgtatatcttgggcatgaataagaaactaagagttgagcattactagtgatgtgtttgcgtgtcaagttgacaaggtgtcaattatactggctaattttgtgtcaacttgacacaagctgaagttatcacagagaaaggagcttcagttgagaaatgcctccatgagatccagatgtaagacattttctcaattagtgatcaaggggaaaggcccct

SEQ ID NO: 27589 - DNA, 2100 bp, Mus musculus
atttaatatggtgaagctttttggatatttctagagtcttcacaatgaaacaatccatactgccaaaaaatttaggaatataatatggtgaaaccttttcagattctcaaatattcatcattatgaaagagagaccctatgaatgcattaaatatggggaagcctttaaacattactaattcttcatcaccatgaaaataatcatacaaaggattcaagaggatacaggggtgtttcttactgtattgcttgagttacagtcctgacatcctttggtgagcaacagcaatttggaaagtgtaagctgaagaaaccctttcctcccctctgcttcttgctcatcatgtttgtgaaggaatagaaaccctgactaagacaaattggtatgaggagtgggtatttctgtgacaacctgaccatgttttgggaggactgtggaaggactttgggactttgggccaaaggacacattcagttttaagaactctgtgggatgttgtgtaggagcttggaagataatgttgagaacagtgcagaagatggaggcctggcttatgaaatttcagagggaaaattaaagactcttttcagggccattgctattttggattgtgttgattctgtggttctgactagctagggctgaagaatcagctgtgattaacaagataccagaactactagagtgaaaactttgcattactgggactattgatgctggttagctggagctaagaaattagcagtaattaagaagagaccagcatcattggggtgacatcttctcggaagtgtttgccgagagcacagaggctgtgttccagagatggccaaggtttaccttgtgctatggctggacttgtaacgtgtaagagttacccaggtggtactggttttgctggcatgaaggtatcagacagagcagctgaggctcagcactatgagaggccatggaaggccattggtgaaggtgcagcctcagatgcaattgatgacccaggactgtggtgtcatgcagtgtttggagaagccaggaccatgaatgaccaagaacagcagcagcagtaaagtataggcatctggagcctagaggacaagctgtgtgctacaaaggacagggctggagaagtgacccaagcccttggtggagcccagaagatcatgagttggatcccagacgttggacagttggaatttaatttttcttttgattgtgactgtgccctcatatttttccctttgaaggaagaaaatattttagtgaattccacagttaagagacttttaattgtaaaagagtttggattttaaaggatattgaatattttaaaaggattgaacttttaatatgtaaagactatgggactgtgatggtttgtatatccttggaccagggagtggcaccatctgaaggtgtggccttgttgcaataggtgtgacctggttggaatgggtgtgtcactgtgggtgtgggtataagatcctcaccctagttgcctggatgtcagtcttccactagcagtctttggatgaagacatagaactctcagctcctcctgtgacatgcctgcctatccatgctcccaccttgaaaatggactgaacctctgaacctgtaagccagccccaattaaatgttttttataagacttgccttggtcatggtatctgttcacagcagtaaaaccctaactaagacagaagttggtaccaggagtggggtaatgctgtgataggcctgaccatgcttttatttgaaagaatgtggattttggactttggatttgggaagcagtggaatgctttaaatggggcttaatgggtcatcctagtaggaatatggaagactttgttgctgggagtgatttgaactgtgttgacctggcccaagagatttcaaatgagaagaatttcaggatgtgacataaagactgtttttgtggtattttgatgaagaatgtggctactttttacccttgtctgaaatgtctgcctgaggctaaggtgaagcgacttggattaattgcattaattgcattgacataggaagtttcaaaaaagcccagcagagactctgttctctggttaagtctcacaaag

SEQ ID NO: 27590 - DNA, 1135 bp, Mus musculus
tgatctctgcattcaaggtcaatctacagagcaagaaccaggatagccaagcttaggcagtgaaggatttagaaaacataaagctagtgataatgtaatagtacaaggggatcatgttctagttcctgtaagcagcagatctcggcagcttcagccatgtggctctggctctagagttaagaatggaaggaactactgggaaaattgatgctggttagctggagctaaggaattagtggtgattaagaagagaccagcatcgttgaggtgaaatcttctggaaattgttttctgggagcacaaagaagctgtgttcctaagatacccaagagtgtacctcatgctgtggctggacttggtaatgtgtaagagtcactcaggtggtactgcttgtgaaggaatgaagggatcatggagagaagctgaggcttagcactgtgagaggccaaggaaggacactggagaaggtgaagcctcagctgtagttgatggcccaggactgaaggggtcatgcaaaggatttgaggcttggcaccctgaagatagcctatgagaggctattggtgaagcctagttggagtggaacaccccagtgtattgaagatgtcagtaccatgggatgatcaccaagaacagcagccgtagtggagtggatcaacctgagcatagagtgctacagagacagagatggagaagtgatgccagcccttaggaggagtccaaaagatcaagtggaatcccagacactgaaagaagaagctgtaacattgaaattgccttggagactcaaagatgttaaagatgccagagccatgggatacatgctgaggaaaactgctaacagggagtggaaccagcccaggagaaagcagtttgttgcagtcaacaaagatgaaaaaggagtggagatctgaagaccactttgacatcagccatggagatgcagagtttggagtttgcccagatggtttcctgccttaatttggggattacagttaattaagttgaatgaatctcagaagagaccttgaactttggacttttaacattgttgcaactgctatagactatgaggactttgaaagttggattaaatgcattttacattatgctatgtttaagtatggcccccata

SEQ ID NO: 27591 - DNA, 1187 bp, Mus musculus
gtctagaaagcacctggagggctcacagtcataatgatggaagtgttagcaggggctcttctttctctagccaatgactagactctggttttacttttttatcgcagtataaatgctggctcatcttggaatcaagtacagcattcaaagactacttcggggaaaaggcagagtggatcacaaggaccccacgtctcctcccagctgaggagcagcctccttgggatctcccagccagcagcagagaaactcatggaaaccgttcccacggaaggaatacaggagcaggctgcgctcagctccaggtatcaggctgcctctggaagcaagctgttccttgacttccactccatggagatcatgaagggtgctgatgaggacagtgccagtgacctgtcagactcagaaagagtggccatccccccttctccattcacgcctccagagctcaacctcagagccgaagagatagacccggtttccttcagtcttcacccagagctgagccaggcagagtccagacaaacctaccctgactttcttccacctccttttaactcctgggacctccgggatatggctgttgtcatgaactcagagtgcaggagtgaggccctgcctcgggccacgggattccttgggaagtacatagacagacttcttcaactagaatggctgcaagtccagactgtgcagtgtgagaaggcccgagccgccaaggccaagccccctggtgcctctggggtgctgaaaagccctggacggggtaagctccttaccagtgccctgtccaaacccttaccatccccagaagggatttcaaagtcaggcccttctcgaaagaaaggttttcgccacgaagaagcccacccatcctactatgcatttgagactttgcctaactctgtggatgggcctggccgacccaggctgtgttcccagaagcaagccccggaactgagaatggagaagaagaagaaatcaagtaagggccctaagcttcagccccgtgctccaccctgcgccgagggcaaccctgcaatggaagccaacggcaacatccgaatccccaggcagtctgcagtgcttctggacccagtggattcccatagggcctccaggacacaggcgcacgtggacctgaagaaaaagggaagtgcaaatacctgtggctatgccccttcatc

SEQ ID NO: 27592 - DNA, 1181 bp, Mus musculus
tgctggatgtgagtctgagctaaaactgtcacaactaaggaatgcaaagacagtgactcatgcattcgttcccagcacacttaaccgaacttggttcctgatctagggactagaattcatgttctgtgtttagacagccctagaagcccaaagcacgactttgtttacctctttgcccaggttgattgtccgagttgagcagtgttattggatctgggtgctattgagcagcacagtttgttacagtcacgttgagtgtagttatttgagcacagccttttccacgatccctaaaaacataccccacgtaggcaagtagacaacattgggcactgaactgtaaactcaataagttcaaggccaaaccagagtatccagcctcagtgacagagggtgcccttctgggaagttcttctcactcagggatggttaaaaggccctcccgtttaaaccagtcaaacccaggagaaatataaggaaaacagtatttcagacttaataacatcaatgagtggagaaaaaaaaaatcacaaaaggttctaagtattcactgatggctttggtcattttccaaatctcaaaggggctgaaggtttgtaaccaacttgaaggtcatagagtatgtggcctgtcacagccctttggaggagaagacagacgccatggtcttcacgcaaaaggaaggcccctgaacctgtgagctgttgggcttatgttctagaagacctaaggataacttcttaggtggcttataccttctttatctttctttccgttcatttccttaaacaagtagaaataggcactcctggaggtactgtgttcgaggtaacagcagtatttattgttttatttgtgtacgtgtagacggctgtagtaaagtgacctataaacacattcagcatgttcatttgctgttgtactgctgtgtgtttggttttatacgtagaaaaacaagtcacgtaagcttttgtgaacttggactgttccttcctggagacaaattaaacaaacgttacctggaactttctggtttgatgtgatttctctcgtttttaatgcagttgtcttcccaattggtctttattttctggttattctcgagagttgcggaggatgggtttccgtccccctgaccttcatgctgatgctgtccaggaacaagtgctgccatgcggatt

SEQ ID NO: 27593 - DNA, 1198 bp, Mus musculus
ctgttccgtctcagattggcactgacggctcacagtgtcctgagccttgctgagcagcaccaggtgtgtttgtagctagtgaggatgaagaagcactcccttccacaggcagaagagtaaagatgaggggcaggtacctgggagtgggcacattatgcttatgttgatgatgtctccattgtatatagactaatatgttctcttcactctatgatcaacccaggtttttttttttttttttttttttttaaagaggttagccaaggctcaaccaagaaaggctagccttacatgttcaggcgagctcccagcatgctcttttgtgctactcatggtcaccgagagaacatcagaggctgcctctgttccagccagacttttccccatctctgaaccccagattcttcagttcttctcactgaagtcaagagtaacgcacacagcccaaggcttgttacagagagcgtcactcgccacccgtgttccaggcaaagtgcgtcctcttcaagcctgcgcactcagcagctgccactggacacataaaccatctcactgaacacataaatgccagcgttgaggccctagcgggtgatgagtcctacctgttcccaagatttacatccagggtgtgaaagtcaataaaaactaattagatgtttacctcatttccttggtaatgacccttacatgccactaattgtcaaattgaatctatatgcagacgttacctctatcagggtcagggctaatttctgcatacacaaagaaacaacactgtggttatttatacccgtggccggccagcatgctttgcgcagatgctcgggagctcatttccataggaggaggagctgcggccgagtttcagtatgctgagcaggggaattaggtatgcaacaaccattcacaataatgagagttatgcacttaattccctggcatcgctttaaaatttgttttattaaataatgctgtaatgttatgttaagtaacattggcttcagcctcattaaataatctccttaactatcacactggaaaactagtatcattagacaaactctatttgtcacgggctgtgatgggctggctacagaggactctgtgttgaagattaatcaataaataaggtaccaccactcgagagtcacagaaggggcagaggagtgcaaggaagaaagcccccaaaatactaact

SEQ ID NO: 27594 - DNA, 1181 bp, Mus musculus
gggactgaatctgggtcctctgcaagaacagccagtgttggtacttcctgagcttcaccgagccatggctcctcacccccaaacattcttttataattcatcaagaagtgtcttttgcccatgtggcttgatgggacccaactctaaacccagtgattctggcagggaggaaggcttgggcaggtgtgaatgtgctcagtgcctgtcttgcgctgagcttctttgagaagctcagtcatgcatgccatgtgattagtaaatggcctggggtagcattcttgctcaacatgcgaccaagtgggaactgctgcagagactgaaatcaaaacatgaatggatgtccggaaccctcagaccccatggccgcctggccatggctctcctcacttgatctctgtaccagcctatttggctgactatgggactcatttaaaatgtctataggcttttacacccacatgccaatgtggcctctttctggtcagtggtatttaattaggttaggcttctgggaaagctagatttaaaaaaaaaaaattgtgacagagaacaaaaggactaagttggccatggctgtgtcctttcccctctgtctggaatatagacataattcttgttggtcaagtagctttttgtgacgatcagaatggtggagctggcctcgccacagattaccctcgaaccttagcaagggtaagacaggtacattggagacagcccagtgagtgactaagagcgacccccaaaggaaggggcagtaatagctgtgggtgccagctgtcaagcccctacctgagctgctgtctctggctcttccacccagcctgagacctggcctccgttcctttgtgctctggagtttcctgctggcacactggtgtgcagggagcgtgtagggcacattggaaaatatttgatatttaaaacaaacagctaccccttcagattctcatccagccaggaacaaagatacattgaatgtgtcagcacagggccttcacccaagcctccaggagtgtccttggcaccctgcaggagcagaggccatgctgggtgtcttaccttaacaaaccaattctccatcaacacatcagagtcttgacaaggtcagagtggtcatggggctgagggagacacagccctggacactatgctggcttgcttgctgctcctggcgtcgg

SEQ ID NO: 27595 - DNA, 1227 bp, Mus musculus
tgcttcaggatgcaatctgtgaggaaagccatctgtaagcatcacctgctgcatctccttcacctccatgtgctgagtcattagattcacagtgcagtttctggttcagagaaggctctgcctctgattggccctgcatccagactctgcatccaggcatgtaaatgtcccataggggtggagccagtctgtttgctaaggggagggcaggggtgcccgctggcctggaattctgccaggggtcattcttctgcaccatttcctctcaggcgtgcatgaaatggtgtttctcagcctggtgtttgttaacctgtggagcaatatttcctctggctccttctctccttctcccactttgtgaattacctgcctgtgactggcagcttctctcctgggggccagaaccaggaaggctttatacagtgaagacgggttcaagatcaggtggtcatctggcttcactcacaacacagctttggtacttcagtcatgcctaaggtttttatacagtcctggtgcattctcaaagatttgttcctcattgcttagcatgtaggcagcatgagagtgctatctatgtatgtggttggtgggatgtgtttttatttgacatggaatggagctgtctgaggccacaaaataaggattcctcagacagttccatctctacagaaaggatttgtgtgagttttcataaaaagccagagagtgaaaaacttaggccaggtaggatgtggttggtcactcactctgcatttggctcaagatgccacagagaacagacattgcatggctgaaagaagcgggtgtatgtgctaataaaactttcttagtggcagcaactggcactagattccccccttgagctgccgttcctccctctctgtgactgagaacaccaagcctctcatggctgcccactcatgttatcaaactgcttatctccccctctttcctgttttctgcatgtctggaggaagaggactctgggtgtcaatgctgcctgcacacctgctcctgagtcctccatacaagtttgtgagagacggggggagctgaggctggaatgctgccacccaataatgacactgcccatgtaaattcaaaagtggagccgaaggtcgtcgtggctgcctgtgagccacagctcaaccagtgccacccggcttcaggaagcagaggaggcaaggacccagaagcagcagggagggatacccagtgctgccc

SEQ ID NO: 27596 - DNA, 1120 bp, Mus musculus
ttgaatttggggaggtgggtatcttggctgtgcggcataggtaggtgggcttaagaaacccaaggctcactccctcatgaccaacttcctccagccaaactcgactttccaaaggttctacaactttccaaaacagcatcaccagtggaaccaagtgttcaaacacatgagcctgtgtgggtcagttcacattcaaactgtaacaaccagcagggcttcacaaaggcatggggtgctcgccaggactcttgggtcggtcatccccagttggagtcagtgtgcctgaaggaggctgtcagtgcagggaagactgctcagagcactgtgacctccacgtcctcacagcctccacacaaccttactggcctccatctcctcatcctgcccactgcgattacaagtgtaacccaccatgcccagcccagctctgacatttaaactcttatctgaagaggcttcagggcacccagcatgtgtaggccatatttcatgtgtcaagaagacactgtgtgacttcactgtgtggttggcagggctggagacttactggttttctggcatcaggaaaaagagaaccagatctgtgcccctttctcaagagagatgagaatgggaggcttatctgaggccagaggatgtttgagaacctaaaggaccctggccccttggggttttgcgtctgcagttttggggatgggttggcacttaggctagatgcaaaccaggcgttctggcagagctgctgactgccagcagagggtccccgggaagctctggcactaacactattgccacaggcatgctggaggtctgtgaatgcaattgccgatctctctgcagctctgtgactgcacactttgaaggcctggctccagggagtccgtgtgctttactgggaattatggaacactggaacggccccttccctgcctttggacttttaaacacacacacttactctaatgggtttggccttgcattcctgggagtccctactccccctactcacggggcctggctcccaccatctgtgatggcatcagagaggatcttggtgatggcagtccacgctgtgtcctgagtggacttctggtaacagccggatgaggaaaaagaccct

SEQ ID NO: 27597 - DNA, 1240 bp, Mus musculus
aattgtcgtgtgctattaataggaagctgagtaatcgcggtgattggcagaagatggctggctcatctgcttactgcatcctaatggctgctcgcaatgcagagtgtgcagggtggtggggcagcaggctgcgtgcaacaggccttgcagatgcagagaccctgtgctggaggccctaaaatccagcaccactcctgctcccgtctcataggcagaaactatggatgcaagtacacactgaggcctggctgtttgactcagagggagataggcatagtcggtgtgctctttaaaacgggccgtggttagcaaggcccgatgacctacagaatatggtgtaccgggcctgaattgctctgggaactttactttctgggagggcactggtcgagaagttgagaccagggagttctgactatccatcctgccatggtaggcagaaatggactgtgatcctgccaggagggacgactctgctctcccagagcccatgctatgggaaacagctgaagtgatggtgttagagcccagtgatgtagtcaagggattcgagatgagaagtctctgttcccaaactctaggtggtcgctaggacagacagaaatagcatctgtgatggtggatattggtcgacgtggcgggatggagaagcactgggagacagaccttcaggcatatgtgtgtgcggggttggttacctacaatgggttgaggtgggaaggcccaccctgagtgtgggacataccattttctggcctggagccctagactgaataacaagaggaagccaagcactgctttcttctccctctacctcctgactggagcagtgtggccagctgcctcacgttcggccacagtgccttcctgccagggtggacagtgctttaaaaccgagccaggatccagtctgccttgtttgttcctttcttccttcccttcctaccttccttcttttttcctttctttctttcttccttcctttcctcctttcttccttccttccttcctccctccttccctccctccctccttcccttcctttttttccttccttccttccttccttccttccttccttccttccttccttcctccttttcagacttgcatcagagcaacaggaggaaggaaggaaagccactaatacatcttaagtaaagattgtccccttccatttaaacaaaagaatatgaggaattgaagcctcctccatcttttgaaactacccgcctgtggc

SEQ ID NO: 27598 - DNA, 1151 bp, Mus musculus
aataaacagcggttttgggattggtcctcagactttgctggacttcagtacccctgagtgctctcggtgtcctggagaggcacagagatcttggtcaccaagccttcctgaggaacctccaggcacagggcccactcagtccacctaccccacccacccacaagcaggccagacaccagtgttcactcctctgtgaggaacagcagagctaagctgggtctcagcttggcaccaggtagatgtagctgccttcttcccatgtctgttgcccgggccctggagtcttaggataagagcaaaggcctcagacctttaacatcacctggccatcgtagctcagtcagggctcacatcccggccatttcttttatttttcctgtctgctgcttctttctgattttttaaaaatttagctgtgatctcttggtcacttttttcccccagaaaattctgtttctgggctgagcttttaaacactggagagggaaagtcagggttcatattccactgggtccctagtgactggatgtgggtgctgggctagcagctccccaagaactggctgtgggtgctgggctatcagggcttcaaggactagctgtctcaatacagccggcacatccttcctggcctttgtcctgcacttggagttactgagactcccggctgagagcccttgggcagggcaggggggagggtagctctgggtatctgtctaggtaggcaggcatttgctctgctttgcatggaggagtgaacaggggcaagccctttcccttcccattttgaattcttacaggtttatttcagagcctttttcattgttctaaaaacagcaatgatattctttgttctacggagataatgtggccgagattccattacatcgccataatgaatggccccctgggcctctcgggtcctttggacttaatggagaaaaagcagcaattcagactgcaggattcctgtatcgccagctgctgagccacacagacgaggagcctagggcaggtgtggttacactcacaccagagtgaccttggcccaccatggatggcaggctcttctgtcagactcagaacacagggaccattctcctctttggatgagatttgaatggccgttgagaccatggggggggggggggg

SEQ ID NO: 27599 - DNA, 1151 bp, Mus musculus
tccatacctccagagccttgcctctgggtccactcctccctctctttctatcccccctttctcttttctccctttcctcctctgccccttttccattatccctccctgtccctctccttcttccttcctgccccccacacctttcccccccacttcctttttctcctgccctaccttcaactaacactcaagtttcctcttctaccttgagccagttctgagctgagggactcacgcttaagcaccagctgttgcctctaaaaataccaccagtggacatgagtgtggcacgtgctgggcttggccctgattcccagagctttccttgctgataatggtcaactgttgacatgcccaatcctgattctggctaagatgtgtttatatattgatatgtagtcaggctggaaattagctccatttttctaggaaaatgtctgcacatttgtggtgagccagataccaacctccttcctgacagaaacacacgccctcacataggctgagtactattctagacaggacacagtgggtcttcctatagcctaacatcatgaaggggcaggtggttgatgacattttcacaatgaggtttagtgtgaccatgagaacaaggactggtgtctgtcacactgtagagtgatattcacagacacaagtcagagcactgaccctaggcagctgccccagaacaccctgtacacctgtctctgtgagcacacatgcagatggcaggtgtatctgcactgccattcaccaaggcctgagttgtggcacccagagcaggctggcagagactgacctgctggcagtcagggctatgtgactgcagaaattcctccatgtaataaatcagggcctagcacaagccacaaagggttagctgcctccctccttgggaagctgccgggagtcacacttctggttaacaacaaactctctgcaggtaaagacttatggagagaattgctttttatgggggaaaaaaaaagcatccagggaaatcaatgtttaatggaaatttccaattttgtgtgcatgtgttcttttagatctgaccacagaacggtggccttattctttgacacagctaagtgttgtaatctcgtgggtgggcactttgtttgtctaattaaaccatcaatggatca

SEQ ID NO: 27600 - DNA, 1099 bp, Mus musculus
cacatttggccatccctagcttttctggattgcagaattgtctgcatctcagaggtgactctagaagttgactctatccaaggcagaggaaggctcaacccaagtttcctcccaagaattaaggcacacatgtaagccttgtggctgattctccaggctggaccacgtcagaaggagagtgtttttgtgtgtgtcatgcgctgcatgttaagtatttccaaacctggacacacttgtctacagggctcctgctggagagccttcctgcaaatccgcgtggtcctgggctgtgctcttgatttttgctatctgggagtgtgttccaggtaggtgatgattctccttaataatgtccctgccactcatctgtgactgaaatgagctctgtgtgacagattctccgagtctaattaggaggaagaaaaatcaggaagtaagcgtttttccgagccagtgtctttgaaacaagaaattaaaagccatgcaaaagcccgccacatctcttcctgacgtgtactctgagataagaacaggcatgagtgtctgcgctctggattttgggggatttttgccctgtgctgtgctgggcacttggctcgcatcccgccatgtcctgtcctgtgtagcttcccaggcggggctcacaggcatggttctctgcaggtccaggtagagcatgaatttctctttaacattagcagctccaaagccagaggcatctgaggtttttctttttctcctggattttgggaatttaggatgaactttggcaccatgttcatgcaatctgcatctgtgacccacagcaaatccctgactgaaattggtttgcttgttggcttggtccatctgtccagtcacatctcttactccaggacatcacatgtccctctctgtcatcagactgttctgtctagcatccttatcacaatcacatgtttggagcctctcggctatgctgcccttctctgtgtcctgtctagaacgccagctccagaccccaatttcatacccaatcagttatgtgtttctctcctagcagcatgctgccctgaaggcagctcatctctgtgcctacagcaactccaggtcaaaggca

SEQ ID NO: 27601 - DNA, 1166 bp, Mus musculus
ttccgatctcatggtttttctttccgttgcaatcctaccggggccggaatcatagccagaaggagccacaagacacgcttcctgcttcacttcacgatcagagcaggagcgtgagggtctgagtgcagtcccttgtctcaagctcacacttggagcatccttgcgggcaacattgatctagaagggcatgtgctctgagtctgtgtgtggtgcgtgttctttctaagcctagacatgtaataaccatgcatttattaatatcatcacatgaaatttaatttcgagactggctgtgaggtgtcccatggcttccctgttaatagctgaggaaacagacacttggggagctgaagtaactgagccatagacacgctattacacatgcatccatatgtgttactttagtcccgtagaatgtgaacaggacctgtcatggtgtagggaggctcactgggtgtttaccacatatgcagcctctgctagacgctgtgcttcatgctggaatgaaggggtctgtgtgaacatcctcccaggatatgatcacgaactcattgttatggtgtcatgaaaagtacagctggtggtgagctcggcttcacgtagaattgaagagttacccttcctatgaaggttttctgggtgcccacctttaccctgtggagacacaggcttctgtctggtggcacacacttcctcctccacctggaagaacccccaagatgctcttcacaatgccggtctgctgctgctgaatcctagacagctttcttatgtctgataaaaaaaatctgcattttgccatttttgaaagacatttttgctggctcaagaatgccaagttagaggaccttaaaaacatggtgccacagttctctgactggcaccacctctaatgacaaacctcccggcatccttatctttttgtccctctgtatgaaatgcttcccactgctgggtgcccctctgtcactgtcttgaccgtaaagctgccttggtctgtttgtctgctcactggttagcttgcccatctacagagtgttggctcttcaagtgtatagttttcatcaagactggaaaattgttctcattattttgataatttcttcactggtctccctcctccttggtgattctaatttcatgtatcaggttgcctgaaactgcgc

SEQ ID NO: 27602 - DNA, 1193 bp, Mus musculus
gatatcaatattgaaggtgttggcattagggtgctgctactgatgttgtgaagttgatggtgctatcactgttattgatgagaatgctgattgtcagcgcttttcattattgataggttgaattgatggtgctgcttgtcttagttattgttctatcgctgtgataaaaccaccatgagcaaggcaactcaaaagagaagtcatttaatttagggctcagggctccagacagtagtagagtccataagcattgtggcaggaagcatggcagcagacagactagcatggttctggagcagtggctgagagctgacatgtttaaacaaccatgaagcagagagagaactgtgaaagccacaggcttttgaagccgtaggccatcctcagtgacacacctcctccaacaaggtcacacctcctaacagttccaccatctgtggccagaaattcaaatatacaagtccttgggggccatactaattcaaaccacttcatgcttggtggtaaggttggtgttattgcactggcattaatgtttttctgatgtgagtgtttgtagtactgataataataatgatgatgttgatattatcaatgctggtgttggtagcatttgtgttggtgatcttggtggtggttgtggaagtgatgttagtgtatagcatttatgttggtgatcttggtggtggttgtggaagtggtgttagtgtgcctgctctgaccatgttggtattttgtttatgtgggtgttagtcttgtcaatggtggtgtcaatgttattgatgctgatggtggagttctcgtcggtgtttttgacattgctgatgctgcttgtagcagcgtcaatatcagtgttcttggtgttgacattttgatgctgatgttggcatttctcatgatgatattgatgttactgatgcagatgctgatgttgatggtgtttaattttggtggtcaaggcattgcttatttggaagtcaaaatcagatactgtgtctaggattggctttaggtttaagagacagatttcctgctcaggagttgggtagctgctctaagatgctggggagccatcagtgtaggtggcattgatatcaatgctaaggtgctaatatttttgtactgatattgatgttggtgatgttcagtgtggtgttacttgttcatgttgatggtgctggtggtggtggggt

SEQ ID NO: 27603 - DNA, 1151 bp, Mus musculus
gaagaaacccacaaagcaacaaagctgatggcacctcggatctgtagctgcagacaagtggagagatcaaagcagggctgctctgtagcagacactccagcaattaggggcgttctcctgagccagtgtatcaactagcaggggtgagcaagcgggagcacacttcacatgctcccggaagctgaggagaagagtgcagtgccggccaggctcttcccttcctccgcaaggattctccctctacacataacctcttcctggtctttaaagagttctgcccgaaccctccacttataccccaaggctctgtagctggtcccgagtggaaacagattgtgccattctctttagatctgtagttctgtccgagaacgctggcagttcctggagatgcatgtggttgtgacagtggtgtgtgttggggctccagccattcataagtcacaggtgggagtcttcagacactaaatttcatagtcaagaattgcccagctccaaatgccaccagagccactgaggctgtgaaaccctgcttaaatggtgcttccaaatggcatgcttagctgctgtgacttgggacttcactctgtgcctacactgctctgatagcagcatgccaggggtcacttgacagcagtagctatcatgaccgtcccagagaccaagtcacctgcatttgtaccccacatcgcatggttttcctcagccacaccaccactcccgtttcccagaagacattagggaccaggggaacattgtgggatagttatgcagaataagcaatatgaatctgacttcagccctaggcgcacaccttgccgccctgtctggtcgcagaaaagagggtcttgtcactggccccaagatatcagtcacagttagaagccctaagcatggagaaaggacagacctactactggagtcttagaacttgccgggtacaaatgtagttgaagccaccacacatttgctggttgtagaattaaacatccccttgctaagggactgtgagtctgccctccagaggctgtcccaggcagcggcagccgctggatgctgcagggtcagtctgactgtgtctctgggcccttttccgagcccagggcatttcatcaaaaggaacgctccacgtgagtctccagcttctcgga

SEQ ID NO: 27604 - DNA, 1164 bp, Mus musculus
tagcactaagcatggaggtacaagcctctctggagtgtgctaacttagaatttttcagttagatgcccaggagagcacagacagatctatgacagtgctacctttagtatattagatgcccacaaggacacagatgggccctatggcagcgctgcctttgatgtattagagaacccctgtgcttctacacagtgactgcactggtttacactctgagcagcagtgcacaagggctccccttcccgcctcctcattggcttttttgatgataaccattcttatttggggtaaaatatctcaaagcagttttaatttgtatttccctgatggataaagatgttgaacagttattaaatatttatcaaccttttgtgcctctttctttgaggactgtctgttcagctcatctgtccacttgctgactaaacagtttgttttgatgtttaacttttgtggttctttgtaaagtttagttactttgaatctagaatctagttactttgtatctagaatctagttactttgaatctagaatctagttactttgaatctagaatctagttactttgtacgctccagttacattccctatcccatgtaaacttggcaaaggcagtctcactctttggattctctttctgttaattgcttccattgagaaacaggagacttttatttccatataattttaattataagttcctggagttattatctccttcatgcttagggtccctttcggaaattccttgtctattcctatatcttgaaatatttagagaaatgtataaagatccataagaaggaaaattcttctctttgtcaagaagaaaagtgggaaatgtttgactttaaaaacagaatccaggaaatagctctcaaccagatgtttaaaagttcctaagtgtccattgcttctgcaacagaagttattccatagatgtctctgtatccaactctggctgcccagtctaagcccccacccgcctgttgctagtgaatctcctccactgccatgttgaattctgatttctgaaagaggaggctgacagcactggcctacctatggattctggcaggaactgagtgatttggtccaaagagttctgagatactcctagcatgcttcagcaggcctgtaacatgcaccatccagggtgccag

SEQ ID NO: 27605 - DNA, 1100 bp, Mus musculus
cagtgtccctgaggatgccagcatccacagggctccatgaaacttgaaaagtggtacttattcacacagatatcacttaattactttctaattcgacagccgttgcctgagaggctttagcaggtaggaaccagaagaacagatgagtgaggtcagtctgtcccaggaaagggtcactgggatcctacgcagctccatgttggacaactctgtagtcttgacccaccttgtggggttctactcttgccagcttgtcatttactgtgttccatgggtaaacggggtatagaggctgggactcaaagcccaaactgcatcttacgaccctctccactcctgctgacactggctggtcaggcgttttacctgtagcctgtcttttgctgctttgtgggttcttctttcttctacactttaccccttctcttccaccctttctacccccaacactggataagagaggaacagggatagagaggaacggaaagagatgcgtgaataaagtcagggggttggaaagagggtcatgtcgttgttagactactgcctgctggtttaaggttttgagttcctcagggcaagtttgatcttcaccatcaggatatctaatttcttcttgttctttcttctttgggagtgactattaacaaaccttgagcaacaactaccaacaacccttcacacctctcagggccctaacatttgtataccttctttttaaaaaaaatctcagaattccaaatgtcacacaaccgcagaagctatctgcagctggcaaaattatgcccctgctagaacacgaggcaaatcatagtcagctgctgtggacagtctgaagcagccccatgtcccacacccaagagtgtaaaacaaaaacatattcttatattcctgttgtttttttatttatttaagaaacccaaattccgaaattgtcactacatttttctgccttagggaagggtgatgaagagaagtatgtaaatgagctacacaagattaaaaaaagagagagatgcattctgaactctgtgctcttcagtgagcgagtcaacacttcatcctaaatccagctatctaccaacatgccctaggcatga

SEQ ID NO: 27606 - DNA, 1144 bp, Mus musculus
gctctgatgggcctgtccacctgtctattgagccactaaaagaagctggtctttcagctgtggagcacctccacactttccttgtacccggtgcttttcgtgaggttttatgacaagccgtcaccctgtgctagccctgccagtgtcgtccgggatgagagcagacacgtttccgagccacacaggctggtctagaaagcgttagcaacgtgctcactcactatcaccagaggaagatacagctgtccttgtgagaacaaaggagaagggccagtctatagttaactactcaaactgtcttttcccagccatcacacttggcctttttcatggagtggccatgatgccagggagtgtctgccagcctcagccctgcagcaggagggttgtcgtcaggaccctggacagagcttccagcctggcccacaggggtccaggatacgggcagcagaaaaccagactaagtccggagcctgctgctctttatactttgtccattccgctgcattctatactgtggagacattagacatagccagggcacagcctgtgacaatggcctcattcctttccatatctaaagagcctgcaccctgttctgcccaggttcctaggaggtgggcagatcaattgcaggggtctctggaggcttttgccaatgaaagcatcacaagattaaccaactgcaaagcagagcgtggcctcccgggttacagagcaaagcccggcagccaggcccttggaggcagcttcagcattcgttgtctggcacccacagcaagacgtctgtgctgaagccagcctgagtagccttatgtttctgggagcacagggcagccacacacacaaagctttaggccgtgatcttcccatctgtggctgagtaacaggccagatttcctgtctgcacttggagttatgtgagaccctccatgtgtttgggtcataccatcagtgcagtaagacctgactctgtctctgtgtcatctcctccaaggcaaatgctggggaatgttaaaccctaatgctgttgatcgcacatgaccctgtgcctgctggaccagacactgaaagattcgaaacatctgctgtgaggtcttttgctgtggggtcccctctttctgctatgggggtcccctctagg

SEQ ID NO: 27607 - DNA, 1135 bp, Mus musculus
atgtggaccaatgtcacagaattggctcccacagacatgcccttcaagtacactatgatgttcagtgtcttagtagatgttatattgctgtgaaaagagatcgtgactatggcagcttttagaagataaatcatttaattgggatctgggtgacagtttcagaggattagtccttttcgttgtggtggggagcacgttggcagatgtggtagtcatgatgctggagatgtagttaaggcctgcattctgatctgcaggcagagagagtaaaatgtgtctgacacagacgtttgaaatgtcaaagcccacccctgagtggtacactccctctaacaagaccacacctcctaatccttctaatcttacctaacagttccactccccagtgactgagcatttaaatatctgagtttctggggccactcttattcaaactgacacatctgactaacagcactctgcagtccagctccaagaccactcaggaaaaatggtgccacctggtagttctgtcccactctagacccctgcgtggcttatgaactatgcacccagcctcctggtttgaatcagggaggctgtgtttcagactcaactttcctcctcgttcatgcaccttcatgggcggcagtttcagtaataattttatacctacctttgtcttccccactgtcctccatctttcctccccactgcccttctttcctcctccacactgccctgcctccctcttccccattaccctccttcccgcctccccactactctcttgccctcctccccactatcctgccaccctcttcccaactaccctccttccctcctccccactactctccttccctcctcctcactgtcctgccaccttcctccccactgccctccttccctactccattacccccttcctccccactgccctccttccctcctccctactactctccttccctcctccccactgccctgcctccctcctccccactactccccttccctcctccctacttccctgcctccctcttccccactgctctccttccctcctccccattgccctgcctgggctcctttctgatcaacctcatgtgtgccctcttctcttgtgatttctgcctcttctatccttcctccc

SEQ ID NO: 27608 - DNA, 1133 bp, Mus musculus
tgaatgcccttaatctcttttcattcatcaattatttcctttggtaaaaatcttaaaaaaaaaaaaaaaaaacccgtcaggtcccaatgcaccgacatttaccatgcttttaataaacggtgcatacagtccttcaggacaattgattatatatattcgccattcgcatttgagaaaatccattcaaacctttcagctttgaaatttaattttacccagttacagtctcagagataacagtagtgacatccattctccccccaacaagaaaaaaaagatgcattttcattcctcatagtgacaaataactttcgaaaaggatgaaaattttcatgattagttgtgtatttatgtcgtatgagaagctcgctgactttaaaaatgcaggattatttcatctcgtaatttaccacacgcttttgtaatttgttaaatgtgtcgctctctggggttctttgacatccatgtggttaagactcggccggatcctggctggcaggcctgtgggaagtgactggatcaaggggcttggccggatcctggctgacaggcctgtgggaagtgactggatcaaggggctctgatctgtccaaaccttactgttggactcataatctggtggactgttgggagtgggtagagggggtgaaattgggggaagtaaaccatttcaaggtgtggcctgtgatggcctcttcctctgtctctctctgtgtcatgcacatcatcaagtgaccctccaccatgatgcctgcctcactgcagacccccaaaccaaagaaccatgtgatgatagcctgaaaccttggaagccatgtcacacagtaacactagcacttacttcagatattcttggaagaatggggtgacagcaggtggcctggaggtgacattgaagtaagaaaggaggctgtgagattcttcagagaacagcagctcctgaatggaaccacatacagtccgaggttgactcatgaagcaatgggcacctctgtgtgtgcttccacagagagggaggatgcagagagcctgggcaggcttccatgctgggacaagcattgagagggttggtggtcaggacaagggcatgcttggctccccagcagaaggccaggacagaatctctactacca

SEQ ID NO: 27609 - DNA, 1126 bp, Mus musculus
ggtgggggtgccttctacaaggaaaaacgaccctataggactgggggtagtgatccagccaggccccccatagaaggtgcatttgggttaagagggtgttagctaaaagactgggaacgaagtacagaagctcatgggtggaagagcttgtgccagtcatggaaaacaggagactcaattccaggcacccaggagtagggtcaggacagccatgctctgggagccattttcctgccattggctcacggaggtggaaatttccacacgtatgctgcccttggcaccctgagttctccagcagtcacagttaaaagattgcagtaatcagggagcgtccattctaattttgcatcttacttaattcagtgggtttgaaatactgtctcagtgttcagccaacataactgcttgtgagcggttgacacttgggaggtctgcagagccctggtgtatgcaccacactgtgggacctcccagttcagctaagctgtccggtgagactttttctagggagatgagaagaaacatcaacccaccccagacagagcactcgagaccaaaggagcaatcccaccaaatccgacttggtgcagcgaaagacttaccaagtgactgacggtagtgtggaggacccaaaggtagatatgtcattggagagcccactggatctgggctctttgccacctcacaaagttgcaagcctggcgctctctgcacctcatgaaggcagcttaaaggatcagagtctcctccccagcaactgctcactgcctttacagtcttgggagggtcctgcgaattctgtacattttggcttttccaatcttgttagcctgctgctatccctctgagtcctgtgagcctgtattatctccaggagagagagcttccatttggaggtagttattatacaacagtgtgctctccagtttcagtggctctgaagcaccacctagcaagaggtacagtgaagcctcagacccccgttcaggattaaaggcacatggagactgtcagacctgcctcctggccctgctgcctcttatgtagtcaagtttggctggcttacacccttcacttagctattgcctatggcttttgcccttgggttaaactgactgatcgg

SEQ ID NO: 27610 - DNA, 1148 bp, Mus musculus
tgagcttcctccttggcctaaccctgttccaacagtaacccttggtgggacagaactactcacagcccagcgcagtcctcagccttattcttggtggagttgccaatggctttgagcttcctgcccttaggctctatattgttgttgtttagatttatatattttatctttatttatgtgtatgagggctttgcccgcatgtatgtctgtgcaccatctgtgtaccatgcccacagaggtcaggatatggggtcatctcccctagaactggagtcttagatggttgtgagcggcaatgtgagcgctgcaagaataacgagtgctctgaagcaccgaactatctccctatcccctgtgtctgtccttatttggtccttggaaatatcccacagataaacacaggcagtgattattgagtgcctactgtatgcaagatcctgctctccgccccgcttcctgacccacctgcttgcatgggttctgacagaccactggactgacacagcacacacacctaacaccccatctctgtgatctccagggactccgagctgctgacaatgaccccaccgcacccccctacgactccctgctagtcttcgactatgaaggcagcggttctactgcgggctctgtcagctccctaaactcctccagctccggggatcaagattacgactacttaaatgactgggggccccggttcaagaagctggcggacatgtatgggggtggcgaggaggactaaccaacctcaccaccaatgcaagaagggcactggaggcgagcagcagaactgagccgaggtgccagcgccgtctggtgtcgagaggtccctccccgctgccgtcccccatgtggagctctgcagtatggacataggccaccgggcacccatcatcactgcggcatctcggtagccacagccacgtactgcgaagggagagccagaggcacagccctaacttgaatttcttaccacaaaagcactgttaaaacaaaacaaaaaacaaaaaacaaaaacaaaagtgccttttggtacatgacagattccctaactcaggagtgactgaaagaggagagacagcccgaggcccccacctctgtccaccttgccccacagccccagtcccacctggtaccttcta

SEQ ID NO: 27611 - DNA, 1162 bp, Mus musculus
cctatgcaaattgctcgaatcggcaaacaattcgggtggtgctgagcttggcatggccactggtgtgtcgtgggttagggctggggaattgagaatagttttctgggtttgattttagaaaacccaagaaggttcttggaagtgtgcatatgtttggtaggcatggtagccaagaactctcctgaagtcccaaggctttcttaaaaagcctgggatgagaggtaccaaatccatcagttacctggaggcatggctcacctgcctccatctcctcctccccactcccaaggcctctgtcactgccaggcccctgcaggaacatccacggggtttcctaaaagctgaacagcttgtccctttcaccctgcaccccagcagcccctagggctggaggaaaatagggtcttacacatccccagacccatcttggaactctgttcccaggccaacaagttagcattagccaagcatacagtcagtgtcaaatgtttctcttctgtagctcgtagatacaacgcgtctgtggtcagggcccagccaagctaggccagtggccagctctgtgcagtacaaggctgtggtttggctcctttaaggagaaacgtacatggcttggaagaacacctggccatggtcagccttggtcacacctgactcccggccagtggcttctctctctcatgtctttcagcaaatccataatgctgggtctcctgccaccaaagtgtcagagtaatggccaaaagtcaggccctcagagatgcctcagtttccccatagtgagtatgtggtctgttgagatgacacctctgtgctctctaaggtaaacgggaggggaagtctctatttctacccacactgaaaggcaaaaccaaaaactcacagcagaatcacccagcacagagcaccaggtgtggtagtacatagaccacatacctagcaggctctgccacaccagtcggctggtggaaaccacctccgtatacaccggggacgcatcttgcttttccttcctctcctgttctccattctgatttattttctgcatgtttatttttgaaaatggacaaatgtgcagcagcccgcatgaccgtggttgtttcgggaaagataccggagtctgacgtgttcacactgcagctctgagcgccatgcggtgaga

SEQ ID NO: 27612 - DNA, 2170 bp, Mus musculus
agttcaggcctagtgcctctgtcagccaaggagggatgccacggtcccaggtgtggcatcaagtgtggtctttgatcccctcacctgagcctcttgggtagtgttgtgttgtgtgatatggaaagtgggggctgcgcgttcagaaccttctctcccactcagggtcaagcttatggggacattggaggtggtgggcatcctgagcctgttgcagagtggggagtaggggcctctgccctgcatagggacttaaagtagtagaactgtggaaggagcttggcagggtgtttcctcaaaaccagggtctttgggatacttgaatctcctcctccctcctaactgttctatggtcactaatgcacatgtcctcttctttctccccaccagggctcaggcccgggcgcagcagtcccaggcggctccggcgtgggaacccccagacagttcacacggcaaagaatcacgcgggtcaacctcagggacctcatattttgtttagaaaacgagcgtgagacaagccattcactgttgctctacaaagcattccttaagtaacaggatgagccggcgtttctgatgggatgcttgcggacgtttttatatatttgcagattacgcctttttgtaacaagcaaatgggatattgtttaaaaacagccacctctttacaatggagcagttttatactcctgtttataaatcagctcttcagtgcggcagaaaccgtgtctgcagcagagagaacacaaaggcctgtgggtgctctcacaggacagctgacccgagctcatcctcggctgagtggccttcttgccaaacaagccatatttaaagactgatggaagcgcttagcaaataattagcagttgctcatcctgtgtgcgttttggttcagctcaccctgactcccgctaggtgtatgtctacagccgatgacctcatctcttcctttctgttgtagcagtcagttggcgaagcaagctgactttttagactatttatcacctcgcccctgccctgtcctgtcccttccctcccgtctacacgaagctccccaggaacacaagctccaagcagggtcccggtctgcagtagaggccggggtgcaggccgggggcagcacctgtacaaacacaattgatttgctgcagtttggaagctgtgaagtggaaggaagtgagagcctaggaagtgagaaccttttcagcgtaaatatattttacttgcactgtgtttttagctcagagtgaagacttagatgaaataaaatcagagttgagaagaatcaacaacagactgtttctcagtgtggatcaagtgttggaaatggttggtgtattttgtcagtaattgtacataatttttggcacataacataaaatggctatgtaaactataattattttgctaagagactgtatgcaagctgtggccaaccttacaggcgtccagagcaaagccccttctttgtacctatttttttattacaaatatactaattggttctttatattttcagaggttattgtattaaattgtctattgatagtacttttatgactgtaaatacttggctttctccgtgtggattctcatgttagacttcaattcgcacgtgtgaactgaacgctgatcagtattttttacgacacccaagaactgttacacctttcattttatcttttaggaaatccctgtctttccattttttcatgtaaattttgcacagttacttgttaatatgtaaatattttactttcagaaatgaagtttttaattgctattgttttatataggattgaaagaaaattaactcctttattaaaaacaaatttatctgtatttgtcacgcctgcttttccattcctgagtctctctctggtccttatgaatctaggagttaaccaagcacaggcccccttctgggctggagttggggccagtcttctgttctgttcacccagaggacaccagagctgtgcttttcccattccaggccttatcctgtagactgtctgagggcaggcatagaggtgtatgatagacagatacccctgtaagcttgggctgcaggtggtaggtaggcttacctgaagactccccctcattgccatccctgatgtcctcatcaacagctgtagagatcaaggacacaaactgtggacagatg

SEQ ID NO: 27613 - DNA, 1606 bp, Mus musculus
tgaagacgttggttttgagacagtggccacatgtgaacaggttcttatgttgggccattttcataagcagatttctgtctgggcctggctgggagagctctgattgctctgagttttgtgctcgctcttcctccacctcctctgaaagctgtgactgagggaagaaatttttttctttccttgagaagttttcaggtaacatggagtcttcaaatggtgttctgggttttgttttcttgggacgtactgtgggcacagagctctctgtggactcagtttacctgtgaccccacaaagttcgtcctctgaacactaatttttaaacaaggcagcaaagcactgtcagacaaaaggacaaggccagtgtaggaacctcatgtgtgtgtctgtccatctcagtgtccctctgctattccctgtcccctgcaagctgccactgaattagaaccaccttagtgagttatgattccttcatgcaacaagaatgttcctctccttttgcagggatgatgatgacatcaatgatgttgcgtcaatggctggagtgaacctgtctgaagaaagtgcaaggatattggccacaaactctgagttggtggggacgttgacccgatcctgtaaagacgacaccttcctcctccccgcgcctttgcagaggaggatactggagataggtacgtttgaaccagatgatgtcactgggatgctgtgtgtccagatcgctgtctgatgtgctccatgactctggcaagactcagtccaacccttctgcagtagctccactgccttgtcttgggctcaccccatagaggctccactgttggttggcaggtagtagaaggtgggcagtggccatctgcttcctgcttagattgcctttgattgtgcagagcagtaactagtgggtgagagaagccagtgccgtgataaagaaaaactgggtaagtaccataaagtgctttttttctgcatggcctgcaggtaaaaagcacggcatcacggaactgcatccagatgtagtgagttacgtgtctcatgccacacagcaaaggctgcagaatcttgtagaaaaaatatctgaaacggctcagcagaaaaacttctcttataaggtaatgaggctgttttcccggggagaatgttcgtgttctcacctgacctgggctctctggaagccttgttgtcctggttgttcctgtgctcactcttggccacacacactacctgtaggaggtcttgcatctgggctggggatgtgctctgcagttagcctgctttggaagatggggctgtgagcttaagagactatggagggagtcttgtattcttactccttttaaagtgcccagttcctgtagcctggcccattttgagccatgagctgcaactacaggctctttgccatgtggggtgtgtgtgtgtgtgtgtgtgtgtgtgtgtgtgtgtgtgtgtgtgtgtgtgtgtgagagagagagagagagagagagagagagagagggttttcgaccagaatatgtcttgagcaattgcacagatgaaggagtctgtgtctgattctttagagcagctcactgtgaattgtcagctttaaaacacttctaaagtt

SEQ ID NO: 27614 - DNA, 1126 bp, Mus musculus
gcctttcatatctagaaaacagtttcctagcggtcttccacagtctcttggctcttagagtctttacacctcctccttctgggttgatcactaagccttgaggggagaagctgtggtaaaggtgttccatttagggctgagcatactgcagtctcttattctcagcattctgaccaaggtgtgtgtgtgtgtgtgtgtgtgtgtgtgtgtgtgtgtgtgtgtgtgtgtgtacaggtgcccacagagttcagaagatggcattgaatccttggagctgtagttgcaggtgttatgaactgggtgctgggagccgagtgtgggtcctctaaaaagcagtgcaagcacttagtcactgagcagcccagccctgtaacttaaatacgtgtacactgtagagctcagagttttgagagtgtcactgtgatgagtgaagagatggcagtttctccgtgggcttgtaaagccagcagagtcagtcctccaataagagcctctggtgtccactgtgtctttgactttgcagtccctgtggtgaaacccaccgtgttacctggaaccaaagccctgtctactgtatctgcacaagcagctgctgcccagaaaaacaaactcaaggagccggggggaggctccttccggtaaggactgaagccctgtaggctttagggagagtgtgggaggggctcaggtcatccctgctagcttttggtactgatagtgtcaggactgtctgctctacttgggtctgaccacacatctgtcagtgtgggctcccggcgtggatgcagagtgtcatccctctgcagggatggagaacagggcagctgacttggtgccagcaaagtgcaccaaggtgactagatttataacacagatggccttgtcactctgctcactgtgactcttgatgaacagaacagccttcctggacattgctttgtcttgagattcttgtgtgtgcaccagaggccaaactgaccttcactgtgactgagcctatggtggttgtttgaatttcagggagactcttcatcgccaaagctgttaaatgaggctagatagaattgggtgctatattggctctatagggtaaagagcaaccaggcagagcaggacaggttacctg

SEQ ID NO: 27615 - DNA, 1174 bp, Mus musculus
accatttttttttaaagcagagttggagttcaaatcctagaagggtttcagaaccctgcagacactgtgatactgtgtacaccaccagccacacaaaaaggctcctttatataaactagaattcttccagggaagctcttagctcagagatttatggtcgggccatcagggagcttcctgtgggccaaggctgtacgcaggacagcagagctgagcaggccctgcagtgtggaccaaccacccttgggctatgcatggttctgaggtggacaggctgtgtttggacagagaaccaagttcagggtaggacttggagagccatcttcactccagtagaaaaataatctgaccttaaacagaatttagaatagaaataagtcatttgacgtatgtccatcaggtaacagtgtcagtctgctgacaggctgggaaatccatgttccttgtggggcctgagctcggtaaactttgttttgctgctgccctctaggctatgtgtggggtcctgagtttcatgtgctccgtgtacttgctctgctgtattgtggcctggtgtggcaccattctgtctttgtctaaatcttttgaagctgtgtgcagaggcttgttggagacttgttgggccaggcttttttagatgtggaatgaggtgtacatctggacttcctggagcttctggcagggcaaggttggggtagcgccaatgaagcaaatagctggcttcatgggtcagtgcggtggcccctaggatgtgtgtgctcatgcactatgctggctgtgccccaggtgatccagcagcccccgaagcctggagccttgatccggcccccgcaggtgaccttgacgcagacacccatggtcgcattgcggcagcctcacaaccggatcatgctcaccacaccacagcagatccaactgaaccagctgcagccaggtgaggccccggctgctgccacccaggactggcttgtcccggaaatggccagttgtgggactgctacttgatttcatttaatcgttgtgataaaattaatttacgcacattgctcagtgacttcatttatgaggtttgtgcaagccattacccttgtcaacgtgatttttaaattccctgaattgtatacattacatggttagtatctattagatacttctagctagaccttctagctgc

SEQ ID NO: 27616 - DNA, 1660 bp, Mus musculus
agcaggagaagtgaaccttgtgtaccagcctggaaaccctcatactgctacttagtttggacttaacctaacttggacatggtctgagatttagaaccacttggttttggggaagtatttgtaggtgacctctgaaggtttctcgacctacatttccttcttggttgcacacagcctaatagtaaggttttggtattttgcaaaaaggtttctataggcaaaggctcaatcctcactttgtaacttttttttttttaatgaccgctttgactcttaaaatggaaccaaattttatttggcacatgtggtgtccaaatgtgtctctgcaacccatctggcccctggtgctgctggcctggtaccccaactgctaaaagtgggaagtctcaggagccaggcagggccagcacagggtgagccagtcacacggggtgggagggccagggcagggacagggtgggggggtgttccatggatcatgttgtgtaatgaaccagtgatgttcagtgctgggggctaacgggatgagtgaagtagtgggaagggcgtgagtgtcacgtagagcctgcctgccttccacaggcactgaggcatagtgttgaaacccaaggcaagctcgtgtggtgtggtgtgtccaaccttcctgtctgcttcagcctctggctgcacttaagtgttctcattcacttttaaatgagccagtctttttttttttttcttttttttaaggtcactggccttatttccttgattgtaaatagttatgtgtttattttaaaggtggtggagggagggcggggacataaatttgttgcatgagtaaatgtgtcagatcttctctataagcatgcatcctctgactgacagggcactgttgaaaacaagcaccttgataacccaaacccttcagaaagccacagcgcttcagtgctgtgctgatgaagtcacggcgtaaaatagccacagagctttggttctgtactgatgaagccacagcgtgaaagcttggctttatctttgtgtaggacttcagagctgagagtagaacatagcactggggccactgttggggaaatgcaaactaaataaacattggactcttcaagtgctgcctctgtccgtcacctgtgtcttgcctgtcgaaagcacatgcaggttaggattcagaggtacttacggggaaatatatggtgcaccagaaaagtgacctggtggccacagacaagtagacagggcggttcttgctgggatgaacactccagtcctccagagagatgcatggtcctcaggctgaaggagcctgagggcgggaggccatcagccttgggaccattgacaagaatgtatgtgctaggtggaagacacctcctaaagcagaagactgaacggggtttctttctgtgagtcagtgttaaatcagtgttgtgctaggcgctaagtttgacccaagtttgtttttacaaaacttgtaaaccaaggaaggggcagggcaaggggaaaagctgtaagctaaagcaggtggcaggaaaaactggtctagaagccaagaggaagtacattctagccaagggaaaaaaaggtagcctcatagttaacgtagaaaatgtggcaaacaggaaaatggattgagcactgagctgtttggggtggtatgggagat

SEQ ID NO: 27617 - DNA, 1182 bp, Mus musculus
ccgccatcagggtgctgtgtgacttcatcttgccagtctgttgtctcttctggcttggattcatcctgactctgttctctggaggggagtacgagtatttgtcttgctactctggttgagagggtgctgaaaggcacccccaactctgtagtaagacactcaaactttagagacagcttatagctggaacatgtcagcctgtgttgagatgacttccaataatctcagcagttaaggacattagctgctctgaggacccaggttcaattcccagcactcacaaagtagcttacaagcagtctctaactccatttgtgagagatctaatccctcctcctgacacaagacacaacgcacataaataaatctttgggtgtgtctaagaggaaggggtgcactaaaggctgttctccatccatctgaattgcaggtggcttccttttctctcggcactaaccacttgtctggcatgaacttttgtggttgatggtgctcactttttttttcctttcagcgttatacacagagcaatgggcgcaggccatttggtatctcggccctaattgtgggttttgactttgatggcactcccagactctatcagactgacccctcgggcacataccatgcttggaaggtaagtcgtttcaaaacagtggaactttaggctattggaaggtactgagctagcaacagcaaacagataatctctgagcttagttctacacgcactgcctgtttgttccatgtcgtgtgtatgaaatcggaacattctacattcccatttggcattgtatcaatggggaatgggattgtgagaggacctagagtgaaatctccctaagtggctcttgataataaagaactttcaccgggtgcggtggcgcacgcctttaatcccagcactcgggaggcagaggcaggcggatttcttgaggccagcctggtctacaaagtgagctccaggacagccagggctatacagagaaaccctgtctccaaaaaaacaacaaaaaaaaaaactttcattgttggcaaggatcaacaccaggtgataatagccttttcaaaaaaaaaaaaaaagtaggacttgggtctgtgccttcacttctggagagccaactgtagaccatgaaggagggaggcagcctctagccagctacttagactggctctactaag

SEQ ID NO: 27618 - DNA, 1232 bp, Mus musculus
tttatgtatgcatacatgtgcaagtgtgtacgtgtgtgtgtgtgtgtgtgtgtgtatgtatgtgtgtgtatgtgtgtatatatatgtgtgtatgttaaagtgctgtattagtgtgtatgtgtgtgtgtatatgtaaagtgctgtgttagtgtgtgttaatactttttgaaagaaaagaacacttaaaatatgtatcaccccaaaagttcaatttgaaatgtcttacattaagaatttcttgaatgttgtgtatatatttttaaaagcactttgtgaaatagtttgtacatttatttcctaatttatacctgattttggtgttaatatatttaatgattaatattgtttatttaatgttttattgatttttatgtaattttgtgggggaaagtgatgccagtctttttcattgcctgtattatagcttttcttctgtaacatgaatgtttgaaaagtcctaggctgaaatgaacccttcgtgcaggtgtggttgactgtgttttgttttcaatggttcctcctactgaaggccagaaaagatgcaaagggagatttggaaatcgctgctcattcttcctcctgtttcccagcatccgttcaatacttggtgaacttgaccactgaggactggggttttcagatgtgctgaccactacgcgctgcgcttgtcaggggctatgggtggatggacatctctgcagacttagcatatagcacagtgggagatgggagatgtccgcagaggcactgggcagacacaggcctggcccagaaaggaggtgttttcctttcctgttgtacctgttctcagacgtgggcttcagtgactgagtgtccgttcaaacttgtaaaaagaggaagactttccatttccattaaaacacttttttagccattacctcatttctgtttattgagcatgttacgtctgtcttgttatttgtgaacgaagtacagtttttaaacaccctatcattttcacccttgtttggttggttggttagacggaggcgcactgtacaaacctatgtgactctcagacattcccggcctctttttcccgagactggaattaaaagcgtgcgacccggcacctggctttttcctggttttgtgagacaggatcactgtgtgtctcaggctgggcaggaattcacggcgatccttctgctcagcttccttggtgcccagactttggctttggagccacagagaccacgggattcgggggg

SEQ ID NO: 27619 - DNA, 1201 bp, Mus musculus
aacatgagatctgggccagaaagggtctccctgaggggagtctcctgaccgcaattgggaggccgagaacaggaccctgacctgacataactcttacttctttcagtggcagacatcccaggcatcatccgaggtgcacaccagaacaagggcctgggcctcagcttcctcaggcacatcgagcgttgtcgcttcttcctgtttgtggtagatcttaccttgcctgagccgtggactcaggttgatgatttaaaatatgaactagagaagtttgaagaaggcctgtcagagaggtcccacgtgatcattgcaaataagatcgatctcccgcaagccagagcccgcctgcctcagctgcaggcccgcctcggacaggaggccataggcctgtcggcgctgactggggagaacctggagcagctgcttctgcacctgaaggagctgcatgatgcccacatagaggccgagctggagcagggccgccagcctctcaggtggtagtgggcacagggccgtgtgccccagggccagcgtggaacgggggtgggccatcaatcacaggaagcaaaagcaaccttttgtaaactgcgggccctttgaactcccgagactaagtacttgcaaatatatggatgtgtctgtgtctttatttcccaccaatttggggcaccctcctaaagtgccccctgccccctggcccagcgtgatggagtattctgtgccacctagtacctgaattgctccctgtgcttggtgtgcctgtcatccttgctgctgactggtttgctggagttgactcatttgtgctaattaacacctcattagtaggaggacagtgctgctggctgaaggtagcaaacactgctgccaggcggcctgggcaaacgcagctgagcagccgagccatggctgggcttctcatgctcacacctcagggtttgtggccctcgtgtgattgggtctgcccaccgtcccgcagagcagcaaggtcccacaccagcctctgtgtggctctctgctgtgccaccgtgtcagggaagcagggtgcagtggccatactttgttctccagtgccagctgactgagaacagcaagggccagctccttccctgttgttcccagagcgctgagctctgtgggggctgaacaccaaggcagccttgagcttcacgactgaatgcacccaatatccgaccaggca

SEQ ID NO: 27620 - DNA, 1613 bp, Mus musculus
aaagctagccggccagttactgtcagggatggggttcctcgggctgcatctctccagtgctcacactgccagtgggaaggctgactggatggatcctgccgtctgttaaccacctcccttgcattgcaggtggttctctccaggcaataacccctacacaggagctcctgactggctgtacgccggccattactttgagcgtaacttctcagactgcccagacatatactaaggcctgtgagcccaggagcagccttggaatcctcaaatagcatctgagctttatggtggcagacaccacaaatcatggagatagcctcggacgtgacagaggccctcagagagcctcagattgcccagtgcgtcactatgttgcagccccttcatgaagctccagttgggtctttctagtcactgaggcctcagaactccacagtcctttcctagatgacagagtgtaaaaggccagcagagctggcagcacactctgttataaaatgtataatgaaggaagacccagcagggcctgtgtgttccactcaaggctgtggcgtgggttctggaagactttcaaactcagacccaaggaggaggggagcatggatcctggaagtgtcctgtggccagggtccccttctttgtggaatgaagtgacaagcctccagattctgtattttctaccaatcttgaataaggtaaagatgactttagaaaatatttaaattgaaactacttgaattatctgctaaagtgcagcaaacacataatcaccactgtgtaccgtccaaacaaagtgtccccgtgccaagccagagtggcaggaacactgtgacttagatgaggaacccccagggccgctccagcctcgaaggccctgcctcatccacagcgctccatagcttcactgtcactgtggaccacacctgtctctaaggtcatttcttcactcacctcgcctgtgtgccctccctgctcccccaaagtcttgtgttcggttccccagtgtgcatgtttcagtccaggcaagttacattcggttgtgtgcaatagaaggtcagaagcaagatcttacctggtgtcattaaaattgttttaacacaagtaggtgtgtccacctctgcattcctgtcacatgatggactttatgtaaaaatggtgacaccaaggctcacagtggagctctttgcatcaaagataatctactgtgtacacacctgtgcattcatagtgtgagtcacaccaggcatttgtaaatgagaaggtatgatcactatgtccaggcttccaaactgcctctgtcattaaaacactttgaaaatccaacatgggttgaaggtttgatttaatagctgtggaaactaaaaacaggtgtttctgtggcagccaggagacctcccaggactagcgtctctgctctatctactgaggcctctaacaaaccttctgatggctctgagatacgtctgaaggttatggctttgacatctttccaagaggaagttgtgaagtgtctgagacaacagggtaactgtgtttgtctgagggggacatttgctgttccagaccatggcagtgttcacacagctcattaccccaagttgaagactacaagt

SEQ ID NO: 27621 - DNA, 1162 bp, Mus musculus
ctgttgtttgctgcagactcgcacatggtacacctacatactaaaaaaaaaaagaaaaactttttttttaagtcagaaaaaaaagacatgggggaacttaattgtcattgagagacgttcctttacataggccacggtgcactagtacaacatgatattttgggaaaaaatgtgcaagaagggcttggggtgcaggtgagctgtgagctgtggcactgttatgggagtgtttgtcaatatgaatagggaacatgccaggccccgtagtctaagtgtggtgtactgtatacttactacccagtggctttcagggggcttctgaatatttggaggccattctggggtatgtagtgagactgtctcaaacaatatatgtgaacagtgttggtttggtttaactgtctccagggacaactcaaaactttgtgataacattgtgaggcaggactgtcaggtgaggaggccttgagggtgcctccctcatgcataggactaagcccttatgaaggcaggtgtcctaccacatagccctactagacaccgaaactgccctgctttgaccttggtcttctgctggaaactgatttgtgttcatttagaggaacagagtagcacctgcccagtgagccccgtgcatattgtggatgtctaagatcatgaacttgggagaaacattactggttctcatagacccacctggaaggtgcagcctgggaggcaggggcaggggagtgtgagctgtctgtactttctgctcagttctctggtgaacctaaaattattctgaagaattaagtctattaataagacaaatggagagaaagccatacctgccgaagtcagctccccagtggctgacttcccttatggaaactaaagacagaaaccatccacaatgtagtccacacaggtcagggccaaggtaatcactgcagcctacccactgttgggttctactacaggtttggacattccaaggactgtatttgtgaactgcagtaactgtggggaccagcatctttgccttttttgtgccgttatgcagcactcaaatggagtggccacgaacacagccttctcagcacccagctaggatggtgtgcttcccgctacagaatacttaaggaaggcatgggaggtgccataggactgtaagctttcc

SEQ ID NO: 27622 - DNA, 1053 bp, Mus musculus
agtttgcagccgtcagcatcgacaggtagggttgccttgatgggaggttagacttgtatttccaggtgctgtgtctgtgtctcacccctcacctctgctcttaggaccctccagtttggccacatgtctgtcaccgtggagaaacagatggttcatgagatcaagggagacacggtggcccctgggagcgagggactactcaacctgcatcctgacgattttgtcttctacgtgggaggataccccagcaacttcacggtgggcctggctcagccttggggttgtcttcgagtgtctgggcaatcctgcctaccctgacctaggaatagtccttgtctgcttttaagttcattctcctgcagtctgagtgtggttggtctctgggaggtaggaaggtgccctgaccatacactttacccccagccccctgaacccctccgattccctggctacctgggctgcattgagatggaaacactgaatgaggaggtggtcagcctctacaattttgagcagaccttcatgctggacacggcagtagataaaccttgtgctcggtaggtaaggcccagcagcaccctgtaactccacttacccgccctccactgacctgaggcctccaacctgcagctccaaggccaccggtgacccatggctcacagatggctcctacctggatggcagtggctttgcccgcatcagctttgagaagcagttcagcaacacaaaacgctttgaccaggagctgcggcttgtgtcctacaatgggatcatctttttcctcaagcaagaggtacagctgacccccatgtcccaccctgccctgtgcctccccccattctggctttgccctgctgtgacccttcctaaagcccctgagctcacctcgctctgccctgtccctgcagagccagttcttgtgcctggcagtgcaggaaggcaccctggtgctcttctatgacttcggctctggcctgaagaaggccgacccactgcagcccccacaagccttgacggcagccagcaaggcggtaaggcaaggaaggggcctgg

SEQ ID NO: 27623 - DNA, 1164 bp, Mus musculus
ggcactggggtagttactggaggatgtaggagcgtgccccttggtttgggagaagggcattcctggaaaagacctgctgacctgtgagcacagaggtcagagtggggttcatctggctgcctttccaagagagctcagaactgacaacagcatggtctgaccctgtcgtctgggtttctctgtagccaccaaaatgtcccaatgtcccaggcactcatgggcacaaacctagaaaccaggcaagacttgggagttggtaatagcccctgggagggagggttacagggccatgaagagaagcgtgggtaggatcttgaatatattgagctgcaagtatggcgcttatgctatccacaggggtgggttcccgcagcagagggccctaggaacatgaaattggctgctgctgggaatggtctccatctgttacaggcgagaccagtgagaagattgctcacgccaaggctgtggctgccgaagccctcagtacggccacccacgtgcagtctcagcttcagggtatgcagaagaatgtggagaggtggcagagccagctgggaggcctgcaaggccaggacctgagccaggtggaacgggatgcaagcagttcaggtgagcaagtggtccttgccttcctgggggccaaggtgtgggagacaagattctcatgccacccctcctgcagtgtccaccctggagaagacattgccacagctgctggccaaactgagccgtctagagaaccgtggagttcacaatgccagcctggctttgtctgccaacattggtcgtgtgcgcaagctcattgcccaagcccggagtgccgccagcaaggtgggtgctcaccttggatgtaggcggtgacggtggacctgggaagccaggtagtaaaccctctcgtgctacactcacaggtcaaggtgtccatgaagttcaatgggcgttcaggggtacgactgcgtaccccacgagaccttgccgaccttgctgcgtacactgccctcaagttccacatccagagcccagtgccagcgcccgaacctggcaagaacacgggggaccactttgttctgtacatgggcagccgccaggtaccaagcaggccggggggcgggggggggggaatgggctatatcggactgcaagttagaaatgggtggtgtt

SEQ ID NO: 27624 - DNA, 1231 bp, Mus musculus
tgtttttttaaaagatttatttatatatttcatgtatgtgagtacaccatcgtcgctgtcttcagacacaacagaagagggcataggatcccattacagatggttttgcgccaccatgtggttgctgggatttgaactcgggaccttcagaagagcagtcagtgctcttgaccgctgagctatctctccagcccagggctcccaatcttatgacaggatctggcacagccaaaggagtggggaaaagtgaactttctgcttgaggaaggctgaaccagcatgtcaggattaacagaaaggcagagaggggtcttaatcttgggctccaagagcctgtgaagtgctgctgggatatgtgctggcggcctgccgaaatgccttgggcagctctcaggcttggaagtgggtgatggagtctagccccagaccctgacaatcccctctctgtagagctggcatctcgcatgggccaaggatctccaggcgatgccttggtaccgtctggcgagcagctgcgctgggctctggctgaagtggagcggctgctctgggatatgcggacgcgtgacctgggggcccagggggcagtggcagaggccgaactggccgaagcccagaggcgtaagtggggtcaaaccctgttaggcagggctgctcaggatcacggcctgggagccctggagccaaatgtaaggttggcctgcttctgaggtggactagaccggtgctgggcagtgaccaggggaggggtgtcatgacggggtctaggcagcagggtgaccaccttcctactctggtgttggccagtgatggctcgtgtccaggagcagctgaccagcttctgggaggagaaccagtcattggccacacacattcgggaccagctggctcagtatgagtctggcctcatggatcttcgtgaggccctgaaccaggccgttaataccacccgggaggctgaggaactcaacagccgcaaccaggaacggctgaaggaagccctggtgagtatatttgcttcttgccctgtgtccctgtctcccaccctttccactctctggccacctcttccccaggccctggtcttctgtcaactatttccctgttctccctcctctctctacatctcccctcctcttcttggtcctttctgcctgtcccccatgttctctcagacccaggcctcccctccctcctgctctccccctcccccacttagtgctctgtggtg

SEQ ID NO: 27625 - DNA, 1186 bp, Mus musculus
cccctcacaggccaatgccattgcaaggtgagcaggggcttgtatcccaggctccttactacgtatctgcttcagttgagccatggtcctcctcagcagccttcctgggcagatggggctttctggaagctttgggggacaaggacaactggtctattgtctggctctcagcacatagccaactggccttgattgttctctgcccataggagaacgtgcagggctcaagatgtgaccagtgtcgcgtggggaccttctccttggatgctgctaaccccaagggctgtacccgctgcttctgtttcggggccacagagcgctgtgggaactctaacctcgcccgccatgaggtatcctggtctagcctgggactgaggtgggagccactagaggggccccacagtgcagggcaaggccacatttccactctgtgaccctcacatgtgctcacagttcgtggacatggagggctgggtgctgttgagcagtgaccggcaggtggtaccccacgagcatcggcctgagatagagctgctgcacgcagatctgcgctctgtggctgacactttctcagagctgtactggcaggctccgccctcctatctgggagacagggtgagcatttggtttgaggggttgtactctgaggggaggaagcaccctggggcactggggagcatgggtggcaatgtggtccctggatgtgaccttggagctacattgtattgtaaagggagcaggagagaggtgcccaggtaagggtgcttgtgggtaagggtgggtgtgacaaagagggagaccgttcccactgtgctggctccaggtgtcatcctacggtggaaccctccactatgagctgcactcagagacccagcgaggtgatatcttcattccctacgagagccggccggacgtcgtgctgcaggttgtggggcgcagtgggtgtggccaacgggatagtggaccagcccagttgccagccctcacctggtccatgtgtctggttctcagggcaaccaaatgagcatcgccttcctggaactggcgtaccctccgcctggccaggttcaccgaggacagctacagctggtagaggtgagcagagctggcctggagcccaacaagggcccaaaggagccgctgctctcattgtctccacgatggagaatgctgatgttagaaggag

SEQ ID NO: 27626 - DNA, 1114 bp, Mus musculus
gatgtttggcttgctgtcccttcactatctgccagactaggactaccatgctctggccttaaccagtctgaggagtctgccccagccaggcccttctgccagacccttgcaaagatgaccacctggtcttgttccataggactacgtactcattgtccctgaggatgcttacagctccagttacctccaagaggagcctttggacaaatcctatgacttcatcagccactgtgccacccagggctaccacattaggtgggctgggttggggcgggagagggggtccggagcacagggatcaggccaggagccaggctcactgtttacccccaatgtagccccagcagctcatctccattctgccggaatgccgccacctccttgtctctcttctacaacaacggggccctcccttgtggctgccacgaggtgggtgccgtaagccccacgtgcgagcccttcgggggccagtgtccctgccggggccacgttattggccgtgactgttcccgctgtgccaccggctactggggtttccccaactgcaggcgtgagtatccagtgctcaaagaatcagagccagtgtgcatggtgggcaagggaacgttctggagcctcactgactgcatggcacttcctgtctgtgctcactaactgcatggcacttcctgtctgtgctcctcaggcagctagcagcctgggtgatgcgcactgtttcgtgggcttgtctaatagggtctaggaagtgtagccctaacagtgacacataggagcctggcaggggtaaaagtagggtagtgtccccacccctccctaccacatccttatgggctgcacctggggcttgaacggggcagaggggtcaaccggtgctgtccaccccaacagcctgtgactgtggagcccgcctgtgtgacgagctcacgggccagtgtatctgtccaccacgcactgttccccctgactgcttggtctgccagccacagagctttggttgccaccccttggtgggctgtgaggagtgtaactgctcagggcccggcgtccaggagctgacggaccctacctgtgacatggacagcggccagtgcaggtgagttcagccgacggcacc

SEQ ID NO: 27627 - DNA, 1099 bp, Mus musculus
atgtatgtgtcccacatgtgtcccttgtacctgaggaggacggaagagggtgtcagacccatgcgggtactagaaatccaaccctggccttggaaaagtagcagcgctctaaccactgagccagctctccagctccaggttctattcccagagtctctccatgtggctctggttggctcacaatgtagatgaggctagcctggagttctctatacatacaagattagccttggtttcacagattcacctgcctctgcctcccaactgccaagattaaaggcatgccccaccacactgggcttggcttttttttttttttaataatttaataattgcattctttcgattctagaagttctaactagtcatttttcacatccgcctatttttagattcctttgtttatagtcattccaaaacattcttttacagcattttaccagattgcttcattaaatggagttgggcccaagtctgtcatgtgtggcatctgtagacgctcttgtgtcctttgcaaggcctccttgggggctctgtctcccaagggagaagcccccagggcagagttgtaggacttttacccattggccagccttgcactttatactgactccttccttcccttattacttcaaggatgcctcttaaccacgtagatcgctcaaaatgagctgcccatggtagacctgagctctgcctcagctgggttaggctgacaggtagttccttccttccttctacaccgaggctgaggttttcccagaagccttcgagatggatcaggaagcagaattgactcccaaggccctgggacccccaatggggatcagtgggagtcgagcttgatggcgtgaggctctgagttcctggcacacacagataggcttctggcctcttgctcaggaaatgcgtatgctgcccctttgagcgggctggctgtgaccctgccacacgctggtagaacgtgggaggtgttggtttatacaacgcagatgctccagtcttgtgctcatctccagccagctgtccccctgcccactgggacagcggcgggcctccggcctttggaaagaggaagtagttcttggccactagcccc

SEQ ID NO: 27628 - DNA, 1221 bp, Mus musculus
taaaggggtatggtgggccaagagcctggccccggctgctgccctggagacgtgcctgccccaaaatagcaagaattttaaaaataaccgccagcttttgtttgctttttgctttaaaagacatttttttccctctgcaaagagctgtgcagcagcagaaaggtcaggctgccttggcagcagagaggagcaggcgtggcgggggaggggctgaagccaggggtctgtgcccctcccgggtcatacctcgggcactgctgtagtcctgggagcagggaccaggttggagaccgatgagaggtgtgagggcatagccttcctgccctccagtgtctgcggccagcaagcccttgaggacagttgacaggtttaacctgacaggtagacagaggtgggtggctaagtacatcccatcccagcccgggcttagaagtttccatgtgcccttactctgcccatcagcagcttggaattggtgtttgtaaaagtgctctcagctgggaaaaatgcagggccagctgactggggaaggccagagcttccagcaagggtgcagccgggggccgggcccagggaaaggcgggggtgggccccagggactcatgagggccaggctgccagctcccaggggcagccagtgtccctattgctgtccctggcctgtcttcttcacaagggtccctctgtcattatacaatcccagacctgctggacctgcttgaccttcagtttggggccacagggcacaagaggctgtggcatgaggcagggtgcaaagtaagttgtccctgaagaggccagaatccctcctccagctgggtggggcatctccctgccctccccccaccccattagggaagtggacaatgacctcagaactggcagcctgtgaataggcctgtgcccctaccctgggagagagtggctgtgcttggtcccacccctttatctcagcaagggctgctcaaactgtgtctggggtcctggtgcactgcctgcctgcagtcggtcagtccctgtgtgtgtgtctgtctgtttgtctctgtctatgactctgtgtctctgtctctatctttctgtgtctctgtctgtgtctctctgtctgtctgtcaccccacccccacccccttctctgagtagtcctccctgtcctggaactagctctgtagaccttgctggcagtgaactcagatccacctgcctctgcctcctgagtgctgg

SEQ ID NO: 27629 - DNA, 2253 bp, Mus musculus
agcccctccgtcctccgctggagaggttggacttggcttgtcttccagccgccctcgaggctagcttgtcagagggagcccagccgctgctggatccctgactccaccgacctgaggcgccgccagagcctgggaggggaacgagcgtggcggagggaggcgggaacgggaagaccaatcctccgaagaggaaactgaggttggatcaaatgagctggaccgctggctttccgctgcacattcattctcttcaagaaccccctactcaccctgcgtccttgccatcctgcccctcctcgccccaggccctgccctactcctctggctccagccgccacccggtccacacgcctagggaagtgagtctggcctgagagtgcacgcctttaatctcagcattcgggatgccgaggcaggtggattatctatttgaggccactctggactacactgagttcccgtctcgaaaaaggaaagttcccagaccacagtcaccataatgctcagtaagcctctttgtttacgaggtcagagagcagcccggacacaagactgcccacgctgttgacgactctcctgagattacatttctccgtgagtgaatccactgctcactcatctgtagaactttatgcctgatatctctctgggactggagctgcagtctggagctgggacatacacccagttacatggtcttggggagaacctccctgccatgtgcacactgactggtgatcaccttccaagactgtctgtcacggggtctggtgaaaccgaggctacactttcctcctcacacctggaaaccagtagtcatgtatgcattaagagttcccgcgcagggcgtggtggcgcacgcctttaatcccagcactcgggaggcagaggcaggcagatttctgagttccaggccagcctggtctacacagtgagctccaggacagccagggctacacagagaaaccctgttttgaaaaaaataataaattcccgcgcagcaggggttatctttcagattaggcacagacaccttacccaagcacctgttttcacagagagctcctttaaatgggggtggggaagaggagttaaagtggctgttttctacttggtcagaaaaacacaagcaaatgaccttgcaggtgtaacttttaataagagaaaaggggggttccatgctagaccgggctgcacagtggtgtattttgattggataggacttttaatagctggactttggtagtcagcctcacgaggaggaagtgaccatataagggagtagagtttggtggctaactttaagaatggaatctatcgtggttttttttttttttttttttttttttttttaagcaaggcaaaaggaatgggctagaagggcaaggctagctgggcgtggtggcgcacgcctttaatcccagcactcgggaggcagaggcaggcggacagcctgcctgagttcgaggacagcctggtctacacagtgagttccaggacagccagggctatacagagaaaccctgtctcgaaaaaccaaaaaagaaaaagaaaaaagaaaagaagtgaggataccagagcctctgaccttaggaaaatcactgttcatatcatccataaggcatgtggacaggggtggttttagttttgagatctgcagctgctctggctgcatccgtgcatattgaattgaaccctcaaggcctccttagtggccacagatgaagcagccgatgtgccaggaaggagagcatggccaaaaggaagccccagaaatcttagtaaactccactctgcaaattcagcactccttgaaagggctgggactggagtcaagtagaaaagcttaatgcaaatgatgctaggcagaatgttcagaaaggtctagcctgtggtaactgccaaaaacaatgcccagagcccacctaacatggtaaaagtaagattcgcaaggatcaaagaagtagtaactccactgcacctccaaaataaatgaagcaggaaggctgcatgaagcccacaacaaggaaaattcacatggcctggtgtccattcagtgattgtcagattagctggtcactagagagagagagatccagaactcactcagatgttaaattagcagacagggctgtgataagggctttcacagaatgtacaccatctgttccagacctttgggagaggcaggacactgcctgcctgcagcttggcactaggcagatgtgggcagaagatcaagagtttgatctt

SEQ ID NO: 27630 - DNA, 1235 bp, Mus musculus
ccacgctcgttcccctcccaggctctggcggcgcctcaggtcggtggagtcagggatccagcagcggctgggctccctctgacaagctagcctcgagggcggctggaagacaagccaagtccaacctctccagcggaggacggaggggctggactccgcaatggaggcggggcctgaggaagaaggcatgtcttggctggaggcggagacagggaccgatgcctgtgctttgtgcggaaagagccaggctttctttgcaccggaagcggaagttaaaacacacaaacaggcctccggtatggtggatacgagtaccctgacccggaagcacttaccgaggacccgccctcctgcccaatagtgctgcggaggcacgagctacttcctttctgcgctctcgctggacaagtgagcaggtaggcctcggtgcgggctgtgtgcgagcggggccgggctgggccgggctgggcgcagttggggaggtcgcggtcacatggccgagagtgcttgcgggccatgggtctggttgggcccgcagactcggagtgcgggcctgaccagtctcaagacctgcgtggtaactctgcagggacggcctcaggatgcagaacgacgccggcgagtttgtggacctgtacgtgccgcggaaatggtgagcatctgcgggcccgtcattctcgcgcccgctttccccgctcccattcatccactgttcttttgcgacctattaaacgcactgtgcatctctttacccagctccgcaagcaaccgcatcattgctgccaaggaccacgcgtccatccagatgaacgtggccgaggtgagctgggaacctgacggttcctgagggaaggaattacgaggccctcaggcctcagcctggctcttggtgtgtttactaacatcggggtgaggtcgaatcttccaacctctttttttttttttttaacccaggttgataggaccacaggccggtttaatggccagtttaaaacctatggcatctgcggggccattcgcaggatggtgagttctaccacctggtctgccttgtactgttcatgtgacatctgagctctgatggtggtgtccttttcttcctgtgggaatggttttgggcttaatagtgcatgctctgcctgctaagcagggagccagctctgtgtggatactcaggtatttatttttaattttaaagggcgagtcagatgattctattctccgattggctaagg

SEQ ID NO: 27631 - DNA, 1235 bp, Mus musculus; identical to SEQ ID NO: 27630

SEQ ID NO: 27632 - DNA, 1133 bp, Mus musculus
gaaagtttttaattttggggcagagcacgccttgacctcgagacgctccctgttgagggttttcctgaagcaagtgaacagtgtggggcttggtttgttcttcgtgtggcgagaccagcctggcttatgttgtgaatcctgagggccagccttccttctgcctacccatgaaaccattcctgtagagacctaggtgtccagaccttctgaacttgctacaattgtcaggcttctgtcttctggtgcctccacccaggcagttccccatcagcactattttatctttggtcaagatacaggatagggcagacaccttgattctgagtctgctctcactgcaccttgttaaagcatctgccactgtgaaacccgtgtcacatgcacagcagtgctttggccaacccctgctgcctcctgccagcacagcttttccctgtcactggacaaccactgactgtgggctcttgactttcctaagcaatatcgtgatggagaaaagtcattataacttgagatttggtctctatgggaacagacaatggcccattcaggcctgctgctgactttgaaccacacttgatcctcaagcaggaaggcaccgatcctgctacctactgtcaatgactacatgtcatcaggccaagttgccctgtgccactgtcatcactcaagagctatcctccacctccccaggcctgttatccttccctagaaactggtcaccagcctggcagacgccagccaccgcttggttccagtctcatgtcccagagatgctcgtcctcaagcctgacaccgaccacctaggtctatcggatcagtaacagctcagacaggagctcaaaggatagtaaatacgttttagcctgtccatgcttatgctggtgtaagcatgccacgttctcagagcatctttaggtgcaataagtcgttcctgcaaacaggttatcttcagggcagccccatcattttttttttaaatgaacttagatatatatggctgactgatgggataaatgttatttaagcttctagatgtagtaaggtgtattcattttaccaagctggtctgctgttagtccttcctaagcttcgctaagagctgctggtttgtggtattgagcactgttaaa

SEQ ID NO: 27633 - DNA, 1196 bp, Mus musculus
ggctggcttgcagggaccatctagagtccttactctacagatcatggcttccctaagctgagggcagggtacatccttgatgagagaggtacacctctgcctggagatgcccccatgccctcagtggtcagtgctgagatcagcctagggcactgaccagtatggatagaagccatcagatgcagcccaccttgcaggtcttgtctgggtagtgagagggtatcatattggtgactccactctctccagacacatccttatctggcccagatgcccacacctgatagctcccttccattctttgcactttcctatgctgacaccctcaccccatgtacacccaccctatgcctttttcactgggctctgggcttccaggtccactgcacagagagaacccaccctactcctacagctatccctgagcagagatgggcagggatgattctttccattcctcagtgtccgcactaatgcagcagaaatgacaggatcagggggtttttggccctcactaagtgagtttcttcttcaggatacctggtggtgccagcaggcggtggtggtacactcctaggtggcttcctggtaaacaagttcaagctccgtggctctgggatcatcaggttctgtctattctgcaccttgaccagcctactagccttctttgtcttcctcatgcactgccccaatgtgcacatggcaggtgtgaccaccggctacgttgggaggtgagcctagtagagaccctacacgtgggggccctgcgttcctgaggagggctggcaccgttggggagggggtgaaggtcactgtaacatgtgtagggaagtctaccaggaagcctgaacacctgctaacataccgcctgatgccggttctgtagcctcctgcctaaaggacagctggacctaaaggcagcttgcaacgccatctactgttgccagccgaagcactacagccccctgtgtggctcagatggcaccatgtactactctccctgctacgcaggctgccctgctgatgccgagacagacctgggtggccagaaggtgagtgtggccacgcccacatccccctctctggccgggacccggaaacttctgcctttgtgtgatcagcactgttgttgggctccccaggtataccgaggctgtagctgtatccttgagaaggcttcctctggctggggcaat

SEQ ID NO: 27634 - DNA, 1199 bp, Mus musculus
ctctggtgtccttgggcagccaaacacacacagatacacacacacacacacacacacacacacacacacacacacacacacacatacaaagtgagctatacagagggcagccaggaagatctgcagttagacaggtcgacaaagattaggaacctgcacccagacggctggcaggaagaggcacttcccgtaggactgaagagaaaccttcctagcatccctctctggatagtctgcagggaagtgaaatctcaagggggcggacctggggctgagtccaaagtggtgcgtcttcccggaggggatagaggcaggaatcccggtgcacgcgcctccagggttgtccttctgggcggggggcggggggcactgccttctccaggacaccgcttcccgcctagctccgagcgtagcagcccctgctgggggactccgcgcaagggcggaaactgagcggtgggcgggacctggcgccgccccgcccccgcgcttcctcctctttcactttcctttccgcggaaagcgggtccagcctgtcgagtatggacgacccggaatgcgattccacctgggaggacgagagcgaggaggacggcgaggatggccaggcggatgatacgaccgatgaggacacgggcgacgatgacggcgacgcggaggaggcacggccaagcctgttccaggtgcggtgcgggaggaccggagggcgacaggacaacgccaggccgtgatcgccgggcccaggccgctgtcccctagggggacgccgggcccaggccttggcggaccgagcgctggtgacgtcaaggaagcgactgatgggggtcgtccgtgggtgacgtcagagcgcgccccagggcctcatcctgcgtgggtggcctttcctcaggttgccctccctccaccccacactcagcccctaccccacttcagacagcctccactggctcagaagtgaccccggcctaggacgccgggagcaggggtctgtctatctgcccttagctctggtaacttttgttgccacccggagcatgttccgttatacttttgtatcaagccgcatgtaaacctcagtggcgttctgtaagacgcactggcctgcttatagctgtgattccgggtgtgatggagaacctagaaaaacgagagtgaggattatgaccccaaaatccattctccccatcgcttcgatctct

SEQ ID NO: 27635 - DNA, 1317 bp, Mus musculus
ccccctttcctctcggggtcagttatcttgtaggaattcccacattctgcatttcacaaagttatggaaatggttaacttctttttcctgttatcttctagagtagccttcctgagttgtcgtcccccaatgcttgggtcatcagacttcgtagctatctggtgacactggggccaatcctgtgtttagggagttagccttgcctagcctttagatataatgctttttaaaaggcagggagagcttgggtgagcaagcagagtctagcagctggcagggagctgcttttggtctattcagaggaacctcagggactgcacctagcccttggctggccagggaatcctctccagtgtatgtgaagagatagccaccaacctggacacttaacaaatgtaaaaaataaaaataacacatacaacataactgtactggggggattagtgtacatgtctgtgataccttagaagactgtactttgaatagtttacatgcctcttaatttcagtctcttgtacttttgaaactagaagcattgattcctttgaactcagtgcattaacaatcacttcttgactttaggaatttgagagcgtgttttgcggtaaaactggcagaaggctaaagctgactagacccgaatccctggtgacctgccctgcacagggcagcctgcagagcagccctgccatggagatcaagtgactggactgacccaggacctgggagagaaccgccgttcctgcggcatcatgcacatgcctgccatcccggagttcagctctgagtcctctcgagggatgcggctccagttgtgggactccagtaaggacgttgagagcacatttcgtgaaagtatttatctaaacaaaatacttacccactaatgtccgatgaccatttgaggatgaagacatcttgataattagtaatttttcaattacctgtccgacaccatcatgtgttcttaacatgataacttttaaaaaattaacatccttggtaatttcttgagtcttgagactaaagaaaacattgccgtttacttattttgtttacattttaaatgtgcccctttagcaattggaagaaggtaaattgttcttaactagaagaggtttggaaactttatttcatttgttctgtcccccctatttccagtctcatggtactctattggaaaatgcagtgccattttaaaactttgctaagaattttccagagacttcttttaaagctccttttgcccataaacattttcgcagtacattgctttaatgcccacatttccatattgtgaggcagtgctttatgtgt

SEQ ID NO: 27636 - DNA, 1683 bp, Mus musculus
gagaaaggcggcgagaccgagacaggtcccgcagcagagaccgagacagggaccgtgagagagcacgagacagggacagggaccgaggccgggaccggaaggaccgcagcaagagcagagagagccctcgggaccagaagcctgaggccaggacctctgaggggggccctgctgcagcccaggcctagaggccattgcactcggggctggggacacgacctgctggtgtggacaaagacctgtgtcagttattgtgtatataggctcagcctggcaaagacccctttaaaagccaagtgcataaaatgtgttgagcaaagagtttttgaaatagctatgaacttatatacaggatataatattctggacttcaggaattactgtaattttgtgtataatggtttgttacaaattttcccaactttacaattctgattttttaaaaatatttccatttaaaattagagaaatgggaaaatgtctacaaaagcatattgctttttttcagattataaagttttttccaataacttgactggtgtaagttttaaggggatttcagtggaccttagagctagctttccctgtgtagccatctctgcttccgtctatccaggggctttcctcagtgctgtcctagtcggaaagcactattgtcgaggtgagctgggggctgtgcgcaattgcagcggtggaagaactgccttctgaggcccgcccagctcccagcaatgcagcaccttacaagttttttcagaacttaattagaaatagcctgtcctagtagaaattgtaacatttttaaataacaatttatttttaaatgttcaaatttatcagcctaaagaaagaaagattcagttcagagcatttaagagggaagagacaggagtcaagcattgcccattgctgccctctgagtggctctgcagactgacagactccagataggcgatgggtttggaagcttctcagtgggatggggcaatgtttgtaccaaatctggaaacgaagaggatggtggtgaagcagcctgcttcatggaaggataactgctgtgtcgccccggttgcctctaaagatgctgtaagaaggctggctaacgtatctgactgtgcaaatatgtttgatagttccttttatattttcataaacttactttttcagatagagaattagcttcgtttgttcttcggagtcttatttcactgtacatcactacagattttttcactttatagcacagatgtttaagttgaaaagacatgggaaaatagcaatttgggatatttgctattgtaaaccaaatagtaggctaaattacatgaaagtgtcagtttcaacatctaatatgtgaaggttttttgtttttttaaaaaagtgtaaagtaaaattttctaacttaaatgcacaagcataaaaatcaagtgtgtttctttaggtttactttgtagaaatttctgtacattgtattttgtattgcagagtgttatatcactgtccattgaaacacaggactccataggttttgttacttgaagtagaataaatatctacagagttcttgtctctctcttcactcaaccttgacccctagttgtcacaggtacaggcaaaggcatcccactccctactggcaaccctacttgtgtgttggatgctgccggctgtgctacggtatca

SEQ ID NO: 27637 - DNA, 1198 bp, Mus musculus
tagctgtgttccaggcaagctgagacagtggtttctgtgcttgtgtacccttgcctcgggtgtgcttttgattgacattccctttcactacaattgagctgagctcttgaacgtcttctcctcccctcacattcttcaggtcaggttccatcctcggaggatgaaccagctcctaagaagcaaaagctttcagcttcttctaagaaggaagactttaagcccaggcatgacagctctccacctaatgcagttcctaacactgctgatgaagggattgcagacacgctgcctgaaaatgcctctgagccagacccggagagtacatctagtcttaaccaggagagaaagtgtttccctgagtctccaggcgatagccatcctgagccctcgtctctgggtggcctttctccctcttctgcctctggtgggagtggggtggtcaccacagtcaccatgtctggtcgagaccccagaactgccctgagtgggtcgtgcacagtcacagcctccatggcagcccatctggacaactcccaggcttcagaaaccaaactggacatgataaagcctgcattgacttctgcagtggtgcccaagtccatactggctaagccatcctcctctcctgacccgagatacctgtcagtaccaccatcaccaaggtatgtttttaaaaggatggggtctgagcaaacctccaactctgcctttagactgaccagggaagctggtgattagacttaccagaaacctgataaatctttactgtcctaaaaatgcccaatttcttggctgcctagttaatatttaggtgcgattcaggtcttatatacaaaaaatttaacttaatggctatttcagcttgttgcttgttcaacttattttcttgaccaaatgtctaagtcataaatagttgcttgctaagtagaagctatacaccttagggttctcttttgctcccaagtatgaagtcatcataatttgaaatatccattgtacaaaaggaaattaatatgttttttattgtttggttttacagcatttcagaatcacgatccccaccagaaggagatacaaccctctttttgtctcgactcaacacgatttggaaaggatttattaatatgcagagtgtagcaaaatttgtcactaaggcatatcctgtctctgggtgtttggattatctcagtgaggttag

SEQ ID NO: 27638 - DNA, 1227 bp, Mus musculus
gtctgttggcctcactgtctgatcgtgcttttatgctgctggactgccctcatgtcatagtttcctacccattttgcatatgtttattcttgcctggatgattttctgcagaacattcactgactaacttagagtctcttcttagttagctcacatcgtctcccagacagcatagaacacagtggtcagaagaagcatctagctcatgtgtggctctgctcctgtcagaaaccctatcttaccaccctttgtaagggcacccactcagtgctcctggtgtgcattccaagaccacatggtatggtgctgtggtaggttgttagtcacatgtgattgccttttgtcattaggtatggatgataaagggcacctgagcaatgaggaagcacccaaggctatcaaacccaccagtaaggagttcaggaaaacctggggttttcgaagaaccacgattgccaaacgtgagggtgcaggagacacggaggtggaccccagtgagcagcaaccacagcagcataacctctccctgcgccgcagtggacggcaaccaaaacgtactgagagggtagaagagtttcttaccacggttcggcgccgagggaaaaagaatgtgccggtgtccctggaggattccagtgagcccacatcttccacagtcactgatgtggagacagcttccgaggggagcgttgaaagcagttctgagatcagaagtggccctgtatctgactccttagggaaagaacatcctgcctcttctgaaaaggcaaaaggaggtgaagaggaagaagacacctctgacagtgacagtgatggccttacgttgaaggaacttcagaaccgccttcggagaaagcgagagcaagaacctgtggagaggtccctgagaggcagtcagaatcgcctgaggaagaagcgcagagaggaagattctgccgaaactgggagtgtccaaataggcagtgccgagcaggacagacctctctgtaagcaggagcctgaggctagtcagggaccagtgtcccagtcagagacagatgacatagaaaatcagttggaagggaaggcgactcagggaaatacagaggaaaaccccagggaagcgggcaaaccaaagcctgagtgtgaggtttacgaccccaatgccctgtactgcatctgccgccagcctcacaacaacaggtaggtggaggaagggagctggtagagaaccaagggatggagaca

SEQ ID NO: 27639 - DNA, 1186 bp, Mus musculus
aaacaaaaaagagtttgatctccaatcccaacacatggtggcataattacttgtaactccagcttcaagggatctgatgcgctcttctgaactctacaggcatctgaacacatgtgcacaaacacctacacataatttaaaaataataaaaaaaaatatttaaaaagaaccaggacagcagttgatctaccatgggtgtgccctgctagaaacacctcagattcattatgtgtttaattttgatttgttacatgcttagaaactatagctgttgccaaatttttcatgaccttcccccgtttcagttctagaatcccatacaggattgcagctcacagttagaaaaatagtttcggaactggagaggtggctcagtagttaagggcactcctgttcttaaggagaacccaggctcagctcacttggagttactgcctgtaactccagttttgggggattgggctccctcttctggccttcatgagcaccttgcccgtgcatatggtacacatacatacagatccaggcaaaatacccttacacataagcatggtaatgcatatctttttttgttgttgttgtttttcgaggcagggtttctctgtagccctagctgttctgaactcactctgtagaccacgctagtctggagctcagagatccgtctgcctctgcctcccaagtgctgggattaaagacgtgcaccacccctgcctggtggtaatcccagcactcggggcagaggcgatggggtcagcctggtctgtacagtgagttccaggacagccaggttatgtagagagaacggtttcttggtgtctcaaagaaagaaagttctaaagtgctattttgcttgactttcaacaccctaccccatattgccattgccttatatcatggatcccctaaaaccaaggtttactgtgctgtggagatggcttagtaaaatgctcaagcaaagggacctgagcttgatctgtgtacagaagactggtactgtggcttctgtcatcccagagctggcaggcagacacgagacccctgggacttcctggcaagcccatgtctctgaactggtgagctccagattcagtgaggggtcattctcaaaaacaagagattgaggaggaggacacctgcctgagtacacatgtgcagcttcacatacacacgtgaatgaatgaac

SEQ ID NO: 27640 - DNA, 1188 bp, Mus musculus
tgtgactggcagattgtcaccacagtagagaacctttcccctgtacttttctttggccccattgtttaaaaggggaaaatggcctttttaaaccctgtcaagcccatgatggaagacaccacctctgccatgccctgtatcccgagagctgcacacactgcttccagattgctggttccagaagatgtaatttgccactgtgtgctgcacggctagggagtgtcatctcagctgaaggcctcacccaagacaggcagacagacatgaacattactgatgtgcttttccgacctgctatgtgcaggcaggcaggggttatcttcctgggtctcacagactttcatggttttccttaccccttcttttctttttcttcctcattttgttccttcataggaaaaaaatgtataaatttgtaaatcttaattcaaagataacttttgtgtgggtattgagtttggatcggttttttgtcttggtgtgggctgtgtggcttttgggaggggatgtgtgtgagagaggtgaggttgtggtggtttttattttttaaaatatatttttggtgctgtatgtgatgagagactcattcatagtggatcaatgaataatctcttgtaggtaactttatttgaaaataaagatttccttttacttccagaataaccacaatggcttctaaaaagttctcatctcacacagcccttgttttgggtgtcctttaccttgcacaggggcagcaccttaactcacagctgaaagactaattgccatgtgcctagggaatgccctgcgtaataaatagcaaagcagcctggtgttgatgggatgactggctggcattacccagctggatgttcatgctagccagattgaacttaagtcatttcttatctcttccttcagtgtcagcagtgctgtgtgtcctgcttctcatcagccattttttacctgctcagtggaaggcagaaaagacattacctgtagggtatggtatgcacatgtaggtcggtgctctgagtgatgagtgtatacatgtattgtgcctgacaccggtgtgtttgatttttggcagtggtccaggcctgatggtgtcagtgctaaaggctggggtgggggtgcacaaacctgcaaagccctcagacagttatccatggatgtggatggtgaagatgatgtgggtactgtcct

SEQ ID NO: 27641 - DNA, 1445 bp, Mus musculus
tacacacacgtctttttttaaggcagaggaaaaggaagttttaattttcaggtagctaatagattaaatgaaacagaagttgggaaggagtatcgaagattaagtgtttgtttttaaagcaccatataaagccaggcatggtggctcctgcctgcaattacagcatttacaaggctgaggaagggtttttccagtccagccaaggctatattatacataagatcttttcttatatgaaaaagtaccagatagctagcatatttgtatcttttgttaatatatatatatgattacttatatagctaatcactttgacgtgttcttaaaattagagggcatgagatgtatagtaatggaggttctctctgtagggattatcctcaaatacacaggaggcttgttgcatgcataaaatgttcagtggctgtaagacaaggagttgacaatttaccaacatttcagtcagtagcttagctgatgccacagataccagtgactctggagaacgtcaaatagaactgcttgcttatccatggtctgttagtgcctagaaaccccctccaaggatttacatgtagacttttcctgttagagcagaccaagtagctttatttctatttgcaccttttgatggaaagtgccttgaaataaacgagacaagaatattctggtactcttctccaacgtcatacgtagagctgtgcaaggaaaaaccaagtttgaaattttctaaagcgtggtaatctttgcacactaaagatgagaatttgttttgtctcttgaattatgatttgggtttggcatttgagaccccctcctcgcccccatagtgtatgtagttgaagactttgtatagtgactttgaggtggggcctgtagaactgaggtgggcagtatgtcatctttattttcttttgtgctattagttttgaagaggagaaaccaggagaatccttccagagggattcttagatgttccatgataatgacactgatgtgatcaagagaaagaagtgggattcccttccaggttgttgctctccagtctcagaacaatcaaaagaccaaattccaaatgtcaggttaacagaacagtgtgtctacacccctgcatttcaacatgctgaattgtgtgcaggggacaccatgcaggggtatagactgttcaccagcctttgcttactgctgctttgttgacatgtctcgttctgacaccatgcatattttttgtttcacaaacattgcttttttcagattcttagtaagccgccttgccagcaggagatgcagagtctgtataaacctctagctcgctggagcactcatgtgtatatgtaattgtaattcttcattgggggtatttgtatccctgccacatatcatctgagtacaggtcgggtagcttctgggtgcctgctgtgaatttgttagtaaaagttcttatg

SEQ ID NO: 27642 - DNA, 1187 bp, Mus musculus
aagggatgggcacagccacagttgcctgaaagaggatcacatatggttgggaggtgaccatcacaagctgttggcagtagctggggtagacattctctaggcttctagttgatacttgtgagctgccccacacccaactgacaaaaccatccttgcacttcaagatgggaaatttgatatggaaacattacagagtcaacgtctggcaggggggccactttcttgtgctgactgactcacttgcttatagtcatcttgactgctcaaactgaataactagattttactccactgttactgacgagcaactgtgagaagtgagacttgaggagcccagattgtagtgttggatgtctgtagcagttagggccagactgggctacacagtaagaccctgcctgaaaagaagagagatttctgtactgaacatcatttgcatccaccttctaagccaaatgtgtacactgtagagaaaaagttcaagtagccatgtctgagtccacaggaagccatagagtggacctcacgatgaccgaagatgctcctgtatggccagttttattcacaaaacaatccctggggctctggaacagttcattcttttttttggatgctggtaccatcagctgaaccttgtaaacaccccaaatgctgagaaacactgtcaccctcagccagcagtatccctcacttgctataccagagttctgggtgacaggatagcctgttttacttttgagaaccatgctggaggggttgtcaggcatctgacctacaagaaggataattcctgtgtatgcatgcacatgggtgagatgtgtttataggaagggggaagtcagagccatttagagactgacttccaggcactgcaggtcccacctctgaggtctggcagtcatgcatggcagagtagattcaagagatgatcagtcacatgaaggaaaagcaactacactgtagtagccaccttccaaaaatctcccaatccagagtctccaccagactttcagaaaggccaggcaagagaacgtttatcaggacctgtaagaaggtacttccttgaaaagtcacatgtgaggagctgattaagagccctcgttcttgccaggcgttcttgccaggcgtggtggcgcacacctttaatcccagcactagggaggcagaggcaggtggatttctgagtt

SEQ ID NO: 27643 - DNA, 1138 bp, Mus musculus
agctgttgcaggcctgtgtggggtctagctgcccagcaaccttgcccagcccgacccctgaggacctttgagtactcactgtgcttgcttggagagacttctgctcccccggagctgggttcacctgcttagcacatggcaccgcaggttatgagctgtctgctacttctggatgccttcctgtatctccatggtctacaggaaacatgagaatatgctcagtgcttgtgtttgggatcctggtgtaatcctggcagccagaggcatgggcccaggttctaagccctgtgaatggtctgccatgtgtttaacctgccccacatcctgagggcccttgtgccattcttagcccgtgtttatgttctagaagtcatcagattcagtgctttcgaggttttattaacctgccgaaatccccaccgaagaagttatcttaactcccttactgtattcatgattgcgttttcctgcccttgggaaggtatctaagtgattaaggctgtgtgtgggcctccccaggtcctgaccctctctctgtgtctcacaggcctgaatgccaggcctggacaggaatcctgctcctgggcacctgcctgctgtactgcgcccgagtcaccatgcccgtctgtactgttgccatgagccaggactttggctggaacaagaaggaggctggtatcgtgctcagcagcttcttctggggctactgcctgactcaggtggtgggcggccaccttggggatcggtaaccaaccccctctccccactgctcaggcctgagggggatcattaccatcacctgacacagtgtggtcagtcccgcccttgcacacaggagaggaggggtggataggggaggagttcaacaaatatttggggagaggcttagccttcggggagaggaagtcgggtgtggcagtgctgagccacagcagacaggccaaactcagtcctgtataccatacctcagctctgggcccttctatagggcaggtcactgcagtgtctaccacagctctctgtgcattggttcacagtgatgaccctcagacccccctcaaacagccaccccatcctgtccctccctgtgtctcctccagcatcggaggagagaaggtcatcttgctgtcagcctccg

SEQ ID NO: 27644 - DNA, 1271 bp, Mus musculus
gtctgagtctcctgtggcgcatagctcatagttcatattttatccctgggtctgccctgctctgcccctgagctcactgatgtgagggggccagcttccccggaccatcagtcagtccctgcctctcttgtccaggtgtggtaggcgtgtgtctgagtggctacctgatcgagaccactggttcctggacctgtgtgttccacctggtagccatcatcagcaacctggggctgggcaccttcctggtgttcgggaaggcgcagagggtggacctggtccccactcatgaggacctctaactccctgacgatccagtcacccaggacctgatgtcagcagcctgaggataacaaccctgtcagtgaaacggaatctccaccccagacgtatgagcatacagcaagaccacagtttcctggggaggcctgagtacacacaggcctgtgtcaggaggagggtcatggctccaaatccgcttgccagtcccgccctctctcaggttcagtgggactgccactgttaaggaagccacgttgctgatgggaggtctcaccggccacagtgagggttgtttcctgacaagacttttgtgttaaggatgtgttgtgtgctggtagatgttcaggagtggctctgacccccaacctactctgggcaccttcctacccccatctctccagcaacaataacctaagatgtctatagacattagaccatgtctccataagacaggcccactagaaacaccgttcagaaccatagagaagccatggtttctgcttctctccaggagtcaggcttgccactccagctgggccggtgtgcagtgggccagggtcctcacctgccttgcagaccctggttcccgccctgtggatctctcagcactactgatgtgtcctgggttggcaggtgcctggcagtccagacatcacagaccccagaacaaggtgaaaccccccccccccatttctggccttgtttttctacctcccgcacttatttcttgtagagcttgtggtttcatgagctgataatgaattctccaagatgcctattagattttctttatagatgtggtgagtcttgccagagccttatttaagtgaaaactattaaactatttaaagtaagattgttgttttattcaataccttttgttatgtgagcttttcctaaggaagacaaacaaaaatctattcactcctatttagatcatctatgacacaccagaaaatggttccacatagccaggcacagtggcacacatc

SEQ ID NO: 27645 - DNA, 2290 bp, Mus musculus
tagaaaaataattcctttgtactaggcatgctagagtgcctgccctgtgcatgctggtccctccctggggtgcaggtgcttttgttgttctactgttttttcactgggatgattggcacatgagggagagctggctgggttgggggaggggaggcatgggatgagtgggcagaagacacatgattggacatgtctctgtaacttctgtgcagagggtcttgagaaaggataggacagcatatggtggctcctgccctggtctgtgggaccaggctgcttggtagttcagaactagatccgcagggacagaccagacaagcacacatccccttttgctgcagctaacaaaatggcctgaggcctcgactttgtgggccttcatctgcaaatcaaagtgcttcatgaacttataacctcttctcttctttttacaggaaagacagaatcgaaacaaacaataagaacaagccagtttgtttttggttaatggttgactttgaaaacagagttttaaagctgtatgcttggtgctgtctccgagtcagctccagtgtcgtcctcgtgcggggttgattgttgcatctttatctttgtagttcatttttgccagatggatctgcattcatttgtatttttctatgtattataatattgtagaactcactaataaaggagtattttgtttgtcagcttatcagtcagattgacctaatgcaaaatataaatattcttcaaaacaaaacacctaatacatcccaaagatatttttattttggcagaaattatgttcttattcttatatctagccatttaatatccctataggatacttcatatttcttgtcctctcctgctttacagcaaacaaaaagcccattcagcatgtgctgttgatgtctcttcacagtactgaagtggcttgccattttactatctgtggtatccatcatattgctgacctgcccttttgagtttcctactagacaaataacttttagttttaagtgtgctcacagctgtctatgggcaagctgtccatagtttagtgcccacacagagcggtgctccagttctccttgccaccgtctgccactgcatgaggtttgggctctgtggcaaggaactagaaggtgttttaagtctggttcagctttgcgacattcttagttgttcgtagatcatttttagttgtcctctttcttctctagagaatcctgatgctgtcttaagtttttataccagtaacgctaagctttaattgtaggaatctgatagtacaggcagtgtgatggatgctgctgccgactgtaaatttcactgtgtgtctattttttttttctgttgaatgggtgaaaaaagcaaaaaaacaaaaaatcctttagaaaacaaatttgctatcatgttttgtggaatgaggagcctcggaggagctcaccgccatctggagttggagtttagcatgaaagtggtgctcatgcccgacgccctcgcatactgaatctgcacgcgcccactgtagaggatctttactgtcttagagagcagataccttccgaaactatttactccaaaagaccctctgagttaacatttaagctgtattatttagacttgtatttagaacgtgtcacttcctcgagctgttactgcctgtacggagtcgtggacaacatcggatacctgtcctctaggagaatacaagccttaataaacacctgttgagcaagcttgtgtgttcttgttttccctgctatatgtgccttgtctctctcttatagctgaaaatctatggggtctgctctaagcagtggaagccaagggctgcagttttgcttactcctgggtactaaagggacagagaaactttcatagctccatgtaggacttggaattcagtccccaactatgtaagaatgtgaagctgacagaggtggacgagctgttcagcagccatatatgacttcgtttgcacacttgcctccaggctggtactccttgatctctcccttatgtcttctgaaaattcactgttgtagacatccaatgtactctctctagtaactaaatctcacatgttaaacatttctcccccccccccccttttaactaggtattttatttatatttcaaatgctatcccgaaagttccctgtatcctccccctgccctgctcccctacctacccactcccacttcttggctctggcgttcccctgtactggggcatataacgtttgcaagaccaaggggcctttcttcccaatgatggccgtctaggccgtcttctgct

SEQ ID NO: 27646 - DNA, 1284 bp, Mus musculus
ccacagcctgtgtggcctgtgctgtgaaactcaccttgtgaccctccgcctttcctgcatcagcctgtccagccctcagttaaatgggacaaactctccacagatggccacacaaagcagactgggctctggtcctccttggacacctgatttgaacttggccagccctggacagctcagaaatgaggaaaggagagtaaaggggccgggagcatttcctacgtatctgccgctcccacctggtacaggggagcctgagcatggagggggtgctcaggggccaactgccactgccagggtcaagcatcttaatggggaccctccatccgggcagagcacctgttagtatttgccatgcattgtgtctgtgacagcccaggccttctcccagcctgttcaggctgctcagagcacacttggttgtgtctccctcagcatgcagctgtccttccccacttatcgccatgtggattttgtggaacactgcagttgagacccatgtgttatcagtggttggtgtgacagccgccccctcctaggattccgtgactgctgtgtgctgtggctggagagaccagctggggtctctgtctccttaaacccactcctgtctgaccctcagtttgaccagcagtgcatgacctgaagttctgtggtttgtgtgtctgtcatgtttgctcctactttctaatgttgagctgtctgggccctaattttccagtgcttgcttcaccccccgcctcccccatggggattcatggttctctgctgaactggtagggcttaagtttggggaatcctctgggattgctttgtcctcaagtggacatgacactactcagtagtcatgtaacaggacatctccgagctagggaagcaagggagaagatacccaggacttgtgcctgatagagtaaccactgatagatgacatcataggtcagagacttggggttgttgagtacacagaaagtcaggagtcaaggaagtctgaacatggaagaagaacctcactgaaactggaatatccccagaatgaaggagtccttgatttggtggacataaggtgataaaaggggaatgaaatctattggttctggtccaggaagctgcctgcctcaggtcatttgggagtggcaaatagccctagctacaaacaggtttctggtgctatgttgagtacaggagctgcatgttttgaggcttgtttttaacataatccagagccctctataccacgtttctaatcccttaaaggacaggataagtaaagcccagggcaag

SEQ ID NO: 27647 - DNA, 1194 bp, Mus musculus
gatacagactcggcatcatggggccatgggggcttctgaggattgatgagctatagggtaaggggctcctggcagggactgaacagtgcccgactttgaaaaagaaacacatcagccttaaacacccttgagacatcagttcctctctgatgtggtcagcatacaatgattacctaacaacctggtaatgttgttctcctagagccaaaaggactgggcccaaggcagggagggaacattcggtgagctccgactccaggcctcggaataagccacttgtttcttccacccagtcctccagtgtccttcagcccatccatcaggccaaacccttcatgaaaacgtctctgttatcagcctggcttcctagaaggctctgctctagggctggctctgaggacagttctaataaggaattgtgctttgccaaggcttatggcttgggcttttggttccacagctgagtactaggagttgattgtcctacttacagatgaggagacatagaagagggaggaggagaagaagaagaggaagaggaagaggaggaggaggaagaggaagaggaagaagaagaggaggaggaggaggaggaggaagaggaagaggaagaggaagaggaagaggaagaagaagaagaagaagaagaagaagaagaagaagaagaagaagaagaagaagaagaaagacctgctcaagcaccaaaacgtagtgattgttggagctgggtcctggctgctgcccatcagctgcccacatgtcaagttgagactattgcctcctgagggatttccaaagagaacagaaagaagccattgtgtgtggggagccagctgtggttatgcattttggcagtagcaagggactggaggtaccacagatcaaaattgaccctttagacatacttaactgggcctcaaggtgactctcctacaccagagggacaacacaagaacccagatttgccccggactcttctagcacacagtgagcgccacagagaacagtggggagcccagggtatggtttctgctccttgggctgtaccgggaggcatggagatggggctactgtctcagagccccaactacttggcatagacctggtctccagctgcagaccaaggctgaaacccagtctgaagctgatactcagactgcaaagcctgtcagagccacttcacttagaagattg

SEQ ID NO: 27648 - DNA, 1162 bp, Mus musculus
aaggccaatggctgccccatggcaaaattttcctcagaaaacatttgtcctaacacattccatcacatgcccaccaacacatgcccatacactagacacaaatgtatattctcataagtgcacaccaaaatttaccacattttcatatgcacacacaagaatacatacaacaggtgtactttcaaacatgtatttcttattatacgtgcaagctcacacacagtttgtcagaccacacataacaggtatacatacacacatgaacacaatacaaacatataggcttataggctacatcctattccacatttacacatacagcaggtacccacttttatacctgaatatttacatatatgaacacatatgtatgagtaacctgtatgtataatgcacacacacatgtaggctgtctctctctctctctctctctctctctctctctctgtgtgtgtgtgtgtgtgtgtgtgtgtgtgtgtgtctacacacacaccactttttctcttgtgtcttcctgatggaagctgcctaggcagggtgcacaagaattaatggtgaatgttctaaaatggtgaacactgactggggtcagagtcctggttatctaggacttctgagcaacagtggtagagagtccacctagagaccattgagttcccacactgccctctccctggactaagtggtggctggctgcaggtactgagggtgtggctaggtcagggtgagggtagttctagttcgtactgaggtccagaccagtctttgccttgggttaatcttggtattggccatttcccagtgtccgcctgtacacatgcccgccttgttgtgccaggctgtgattggcatttcctggcttgagttcctgtcccttttgattgtggcctctggaaagtgcactcttgtctaacagggccaaaatacctgggctgagagcccatctgctgtcttacctgtggtcttggcagatcaagtggccatttgaggtcataaattagctcctggttatgctctcacgtttagggccctcactggaaagccccatgtagaagctggggagtcactagacactacatgggcctcctcggaggagacactctgaactgtagtcatcctcagatcctagacacaggagatatacatccaggaccaccgtcca

SEQ ID NO: 27649 - DNA, 1222 bp, Mus musculus
caacccaggcataagggtagatgcagcaggagatgcagagctgtgtgggatgccccttgatcccctgtgaaatcctgtgatcttccactcttcctcttctcatagacagtatctggagattggaaattcctaagaggggtaactgttggtcatgatatgcactggagagtccttcagcaggggcagccactgaagaacttgccagaagttgtacatggcctatttcttcacccccttttcctttcccaatatccaccccccactctcctggaaatggatccttaggagccaccacaggagacccttctgtgagctggcctgagctcaggcacatgctgaccagtaagctcagtgtttgagctgttggagtctggggtagagaaagggtggctctggggtcccttcctctgccccctttcacctgggtacaccctgggtcttttcctcaaaagcccagcccagcccagcagctgccattcttacaggtcttgtccatggaaaagaagctcgacttcttggtgagcatctatacacagagaatgggcatcccaccagcagagacagaggcctattttggggccaaggagcctgagccggcaccaccctaccacagcccagaggacagccgtgaccatgcagacaagcatggctgtatcattaagatcgtccgctccaccagctctacgggccagaggaactacgcagcacccccagccatcccccctgcccagtgtcctccctccacctcgtggcagcagagccaccagcgccatggcacctcccctgtgggagaccatggctcactggtacgcatcccaccaccccctgcacacgagcggtcgctgtctgcctacggtgggggcaacagagccagtaccgagttcttgaggctggagggcaccccagcctgcaggccctctgaggctgccctgcgggatagcgacacgtccatctccatcccttcggtggaccatgaggagctggagcgctccttcagcggcttcagtatctcccagtccaaggagaacctggatgccctgggcagctgttatgcagctgtggcaccatgcgccaaggtcaggccctacattgcagagggagagtctgacacagactcagacctctgcacaccatgtgggcctcccccacgctctgccactggtgagggcccctttggagatgtggcttgggcagggcccaggaaatgagtctgggctgggct

SEQ ID NO: 27650 - DNA, 1168 bp, Mus musculus
ccctgcattgctgagcccacgcactgactagggcaaaggccatctaatggctggtttccttttgaatttcactctggagattgcgacagaaagcaagaggctggggtttgcttgcttcctggattctacctgagctgacctctggctggtgtcatgcccctcacaaactgggtagttctgttcatgggctctcttgctggggctttagggggagctctggagaccttcctacccgatgcttgctttgatcttggcttggtggcttgggaggtgagagagagtcccttaagctctattcaggccctagagatgtggaagactatagggactctgtcctggcaatggcaaaccactttgtccctttctctgtcagagcttccttcagaggaagggacagtgtggagagttgcagacagaagaaccaagactaagggtgggggtttctttcctggaagctacaaatctgctgtgggctgcagtcctctgtagggctagattccaggccgggtttgcatggttgataacttcttctggcgactgtggaagaaattaccactaggatggagaaagtggctggctttgggtgacctgcttggagagacatgctcagtctttcttgttgcaaccctttgcagagggcaggggtcaggaggcagtaagaacctgacttaccatccatcaccagccattgctcctcactctgcatgacagccagagttaaatgtaaactgatcgtaagttgttacaacagtgaatgagtcctgggaccccatcaggaagtcagctctgtgacttggtcagcaccagactgcttagtgacatctcatttcccttcctgagtgctattgggaaatgtgtgcttcctcatcctagcttctaccttgcctacacccagtgaactgtgaaagacccattatcttgagtcttcaatagttcctgtgatcgagtggcccataggaggagaaaagaacatttagaagccacaaatccccgaatatccagttttcttcagattcaactagaactttctacttagaaaggggtcagaaagtcatgtggattctgggtgtccctggctaccacctgtctgttgtgtgaccttgggtgttttagtggcacactgaagtctagactctgggctattttccaaagctagcagatgccactg

SEQ ID NO: 27651 - DNA, 1221 bp, Mus musculus
aaaagtcagcccttctcatagtaaggcattctaggaaccaggccagttcttcccacaaggccttactacgatgatgtcacccttagttactgtagtagttactcagtctacctggagctgaggagaaagctcaggtggcaaaggcttgccttgccaatgagaagacctgagtttgaattttggaatccccataaaagctagatgcattgttttctacctcagtgctgggggtacgggctcgttaggctaacgatgagagaccctttctttaaaaaatggcgcacacctttaatcctagcactcgggaggcagaggcaggtggatttctgagttcgaggccagcctggtctacaaagtgagttccagaacagccagggctacacagagaaaccctgtctcaaaacaacaacaacaaaatggcaccctaggaacaacccctgttgttgtcatcagactgacatgcaaatgcagagtacctggtaacactgtaggttcttaaaaaagaaaatcagggggataaaagatacatatttcacctttcacagagtaagctggagacagcgaaaagatttcctttaaaaagcaaacacttcagaaccagcaaaacttaaagtcattttttaaaatttagctctcgggctggtgagatggctcagcaggtaagagcaccggactgctcttccgaaggtccggagttcaaatcccagcaaccacatggtggctcacaaccatccgtaaggagatctgactccctcttctggagtgtctgaagacagctacagtgtacttacatataatcaataaataaatctttaaaaaaaaatttagctctcgagccctttatctttctctcccctcaccctctccatgtagagtgtcctggcctcaatccttggggcccataaacttgccttcaatacaatctttaaaaaaaaaaaattaaaacatcagtccactgataatgaattcttatctagaaatggcagtgagcccaccagcttcatgtatagaaacactgagacaggtgattctaagataatgtgggcacctgtcggatgtaaacatctggaagaagtttgagacagctggtagacactttccatctacaggagtcaaagtaaacatttgtgaaagaaaattaagcctcagctaaggagctaacaattttctgtggcatggcttcaagtatgacaggaatataaccaatgacattcctagata

SEQ ID NO: 27652 - DNA, 1411 bp, Mus musculus
ctggcacttgtactcccctatggttgccaccccccgccccgccccccaatctctccctctcctggaggtggagctaggcctctctggccaatactcagtgtctctatcctgagagctccggggtatgtaaggctgtttagagtggtgggttggtcagctggaagacaggatccaaaatgttccatggaaggctgtctttaggctgttgggcctgtgctaggggctacctaggcaagagtttttggagccaaacaattcagggaacaaagttttggcctcttggtaaaggatgtcctgggatagtcctaagttgtctcttgaatctcctgttctgtcaattgaaggctttcctttcaagggccccacagcaggaagggccactgtcccatttcactgctttgaaggctaccttgtccttccatccatgcatcccctcgagtgcccagattgcttttacaccattgctgtgactgggcccttccctgcccctgctctcaccccatgtcatgctactgaggttcttgttttccctctgttccatcactgttcactgtggccacgaatcagctgggtttagcagatgtttacctgtttatgtatatactcctttttaaaaacttgttttattttttcattgagtttcaagtcctgttatatgcagctgtgtgactttaggggcattgggaggaccagcagggtgggtacttccttgaagtccctgctctacaagctcagactagattaatgtcacaaataaaaccttcctgccctaggaaccaagagtctttccttggcacaagccccagatgtcatttgctttgggggatgtgggccagttccctttcttcataagagcaaggttgaaacatttttggcccttgccccttagagcatggaggtactggaaggtgaaatttatttcagagccatacgaaaataattctcaaatcagcttcagaattagttcatagcactccttcccagtatcctcagaggctgtctacagcctaccctccaaggcagcttctagcaggacagagaaggaccaatagtcccgtctgcatggaaccctcagttctgggagaggaagtgttatcactgccccaccacctgttagtacctgcctctctggttcctactgacttctattgctgtgttccctgcttgttgggccatttaggacccaggaaggaaggtcttccccctccacatgcaaacacgggtgcttgtggctgctttcagtttggttttctgaaaagataggacaggatttggttttgcagagggtgcaagctcctttccatgcctgcccaggaggcacgcagaagggcaagtttgagttctttgagttctactttgtatgtgtttagcaagtatctgcttggtactttgatttaaaataaaaacactt

SEQ ID NO: 27653 - DNA, 1173 bp, Mus musculus
agtactgcccataggctaagtatagctagagcctctggccttctgtttatgggtcataataggcttgctgaaactggtcaagtttaatccaagacctcaaagagacaagaggaagtatttagaaggcaagaccctggtgggtgaaaataagtgactgtggctttagatattatcttcatttaagctttgagcaactccctttcagtccttctaaaaggtaaggctgtgtccctggaaatgattcctacctctcttcttcagtaccaagctagtcaccacctttgttagctgtgggcctgctccctaggtccaagctcacagtatagatacttgctagctagtgttttcatctccctcatgtggatagaatgctgtgtgggtagcctggggtggtggtgccatctgttctgctttgtgcacagtgaaagttgcagcccatcttctacctcagtggaaccagttggcaagtttggcccctgcagttagacagtagatgagatatttttagttaggtctcacctgaactgctctggcctctctacaggaagatcatggactctggagagctagacttctaccagcatgacaaggtctgctctaatacttgccgcagcacgaagattgacctttcaggggcacgtgtatccctgagcagtcctacatccacagaatacatcccactcacaccagctgcagctgatggtaggtgcacgaggctgtcagtcttgcaggtcaattgcagctatcctgaccagtcctttctggctgccatataccttgtctgttctcttccacatggggcactacagtgttaggtcagccttctttgtagccttcctggaagcacatgtgggaatttgttggttttgctaatggagaatcttttgcctgtttgttttttggtttggtttgtttttttttttttctcaagacagggtttctctgtgtagccctggctatactggaactcactctgtaggccagtttggccttgaacttagagagatctgcctgcttctgcctcctaactgctgggattaaaggcatgtaccactgccacctgtctgctcttagggagtcttaaaacatttctgttattttctttttgttgttgttgttttgttttgttttgttttctgagacagggtttctctgtatagccctggctgtcct

SEQ ID NO: 27654 - DNA, 1234 bp, Mus musculus
agcaacaaatgcatgtgtgcctctcagcttccctcctctccttacacagtggagaatagccctgtctataattgagatgggtcttctcatagcaattaaggtaatcaggataatcctacattaggcatgggcagaggcccatttcacatgggattcattctagattttaaccaccatagcaatctgcccaggatgtcagtactcaaagccactgtttttgtcatgtatggttaggatcctgtgaagctgtgtatagtatgtttttcctgtctgtaccatgtccctctctgactccagggactctttttttgtcttctggctagaaacccatgctgtgcataccccaacatttcatgacttggtctaggcctggcatagaacatggtgtgtctctaagctctagagacatagtcctctattgaagaagacatccattctgaatttggttcatatgatggtagtctactaccaccatcataaaaaaatattttttcagttctggaaatgtaaccattaaatccctcagccctgaactattctgttgtaccagtgtggaaatgaccctgtgacctgtgtcctgctttgtttgctttaggacttcagactctggagaagtgacactgctgacttctgagccatggcaaccccagatgtgagcgtccacatggaggaggtggtggttgtgacaactccagacactgcagttgatggcagtggtgtagaggaagtgaagacagtgcttgtaacaacgaacctagctcctcatgggtaagaactcagcctcggtcctgctaagtcacagtggcagagcttggtgtgcaggggtagggggagactcaagatgtctttacacacaaggtcctaagattgaacccagcgtgttttaggcacaaaggtgaagtacaaagtacatcaagcaataggatcaatggagattctaggatgatagctcatcactgcaatatggctctaaatctcttggtgatatctcttttgataagtggaacagtggaaactaaatattttctttatcacctcttgttctagatgtcattattgagagctagatctcaataaaagtcacatctaatcaaactgtttgtgggcaggggttgggggaggtgtgcttcagggtttctgtgtacagagacttattctatagaccaggctgaccttgaacttagagatccaccttcctctttctccctagtgctgggataaagagcatgtgcca

SEQ ID NO: 27655 - DNA, 1623 bp, Mus musculus
cttgctacagagtatgtaatccttgggtgtagggcataggttctgggaagggtggtgaaggctgtctgtgagaagtatgtgcagagcttgagcagaagtttccccacaggatttggcatgtttgtgcgtcggcatcataagcctcagttcctacagacctgtgcagacctaatgggcctgcctaccacaggcaaggacttggagctcgaaggtcccagagatgagagcccaactgtgcctcctgagcttacccatgaggacctgaaaccaggtgagggcccactggaagactcctacccttgccctgtttgttaccctgagtccactgcaccgggggctaacaggaagcccataagtttctcgcactcgttgctatctttagggccctcgatgtccaagaaacctgagaagacccagagtaagatctcatccttctttagacagaggccagatgagagtgtgaggtctgatgataccaccccaaagcccatgcaacttcctcctagactaccccatgagcttatgaagcctcatcggagtaagcaataggggctacagtgaatgttggttatggtagggcactgaacagtgtgctcacttagacctcctgcaacagaatttgtatgcccggcctgtgcaactgaggatacagtgcttttccagtgcccctcctgtgacttctaccgctgttgggcctgttggaaacttcaactccaggttggggtctaaccctctccagcccatcaggcatctctccaggtggtgggggctaagggagcaatgccaagcttcagtgcctagcaggtatctccacaggcctctagactgtgtccggcttgtggtgctgttaacaggaagcagagcattacacaggtcatctggccgaagccccagtgaagacagatggagccctttgcttgccctgatgtggttaaacccactgcaggtctcatgcttggctgtccaatgagatctgaatctacttgtgaagttctgaaacctcaaatagcctatattggcattgcacatgtaccactgaaggtgtaggctgtccaataaaactaagttatcaggatggtgtctgtattgtggtcttaaactgtgtgtcatggcagtgccaagtgtggcacactatcaatccctgcaaaaacaggatctcctgtagttccagggcagccaaagctacagaaagacaccttttttaaaaaatatgtgggaggataaaggtctgttaagatcttttccagacttgcagcattctccataccagttagctttaagccaataaggagcttccctccatccatcccctgtattgcccctttcatcagctagacaccattgtgtccccacaccaactatgcacaattctgtagcttaaccctctagaacacagctcctactgcagtgtcagctcatccacagggagcatgagcataccacaccacccacaatcgcttgttgctgctgcctaggctacttaacacacgtaggcttctgcctagaatgtatgctttgctcaccttgtgcttgcatgtggtgagactacgggagcttgggattgtagggggatctcaagtattccctgacactgcctcttccacccactttatcaagccccta

SEQ ID NO: 27656 - DNA, 2421 bp, Mus musculus
ccctagaaaggaaacatagcaactgcttcattcttacactaacaacctggctttggcagaagcagatttactattttttaaatgtgatagtcttttcaaaaattaaataggaaaaaaaagtgaggcaagacagctttagcctcattgttgaatattatttctttgaattcaagctgaaactcaagccttacattgccttatgctttgtttatagtctttttatatatctaaataaatgaaggttctttaatgggttatgatacaatgtagaattttattctggcccatctcatactcctgccagtaccagttattacattttatttctttaatactttctcctggtgtgcaaaacttggttctcttaaggagtggcattttccaatagctttccactctgacccacagggctcttgtgctgtaggttaggagagctgagagaagaaaaaaaagcctttatctttagcacctgaatgggatgtgccctgcacagtgttgctttactgacagtgggcagggctctggtccatagtctctgcctgtctgtttattacatggagaataaatgaaccagccttacagatcaggtaggggatgtggttttggttcagccagaactctgctgtcatcttttctcaggagcttcaaagatttctttctaagttctttcctcctgcttccaattgccacattctgcagcctctcaataccagggccctgtgtgttgagatcatgatttggagagagggccagcactgtgccttaatggctcttagcagggcaaagactttatctgtttgtacacatctctacactcctagggtgaggtgggatttgtccattttagtttctggtttgacacagtgtgaggtgtcttggttatcaagtattcctggtttctttggacacccttagaatactctaccacacaaagcaaggaacaacgaataactggggagctgaagaagagcacaccattggtgtcttcttttccagggttaaaaacaatagctgtgtgagggaacacattacaggagtgtaggtcactgatatatcttcctacaaatattagcaggcagcttgtcaataaagcattcctttggaggaaaatccacatccatttgtttggtctgtcttttaggataatgacaagagatcagagtaaatgcatatgattccttgctttgaacggggacaagcaggagacaacatgtataaattacgagtctttggtgtgcatataaaaaaggagggaattgtgtagaaggtgtatctctggataagaccaagaatatataccaggcatgcaatgtagaggtttacagtccattatcaagattggctacactaaaggggcctttttgtcccagtaaacatcttgttttgctgacttttgctatgaagctatgccaggagctcacctggcagaagagggcattaaggaagaccagcatcttaagtcccactgagagaagactgttaccccatggtacaacaatccttaggaggtatgctcttattctgcagatgaggggccatgtgaaataatgagtaattgaagacccttaagtgcttatcgaacagggtaagttggagttgtgggccagattaaaagggctaagtggtatgggtgggatggggagtgaccctcgcactgggcaagcctcgaccacagggcaacaactacatctgggctagaaagtcaatatttgcactagatgatattggaagacaattcactatgctccagtcattaagcaaatactataacatgctctgtggatgagaggttgcctactgggctttgtgggtacatgactgtgttcatggacccaggcctcgactgtactccttaaaagatgtgttcctcctcacaactctggttctcatcacatgaggtgatgaaggcctcagagagtactgtagactggagcaagctgagaatgggtagaaccagggcatgttggagggtttgtactagggaagactccgactgaggatggtggaatctgcctaattgatataaagggacaaaataaagcttagcatcaaaggcaaaacctgaaaaccccctcaaatatgtaactgctgccagaattcctgtcatacagtctcttaaaggttgacatactagattggcatagtggcatatacaccttcagcacttaggaggcagaggcaggtaggtgtctgtgagtgtgaggccagcctggtctatgaagagagttcaaagatagcaagggctacacaaaaaaaccctgtctataaatcaaggttacagttaggttataaataaacaaataaacaagcttgctaatttgtgaacatttgtaaggtttttttttttaaacatgcttttggagtttactgtgaagaactgtcacaagcattgtgtgtgtgtgttgtagccattctttgcct

SEQ ID NO: 27657 - DNA, 1359 bp, Mus musculus
cgatgaggttgtctgcttacttttcagaggctacagacacaccgatcgtcatacagccagcatctgccacagagaccacccagctgacagctgactcccaccccagctatcacaccgacgggttcaactaaattcaggagaggctgtgattagaggatgaatcagcatctggccactgcaaccttagaatcatgaactgtagtcactgagatgggaaggcagccgtcaacctgacctgctctggctggtcagggccactcccacctcctctaagtccacccatctgtcaatccttgatacatgaagtgcgtagcatgcagtatttaaagcagtgtagctacggtcttcttctgttttatcctttttttaatagcatgtatgggttatgttcaatgtctgtgttgtggacgtgctgcagctgggctgaattaactggatggtagtgcttattttgggttttcagccaagcgggtccagtgaaggttcagctgtctccttgtgcttacaggagtcaggtaagcacctggagctacatctccttgttggcctctgtgtcctgtgatatggtctagtccatggctctgatctcatcctcaaggctgcagacagggctctgatatcacctgcaaaggagggaactgggccccgtcttccaggcaccaccagcatcagtcgtttgcacggtgttcgtgttgggaagctttcatagggtctctgcatcatctcactcggcctcgtgacagttttcctgttagatctgctatggagagtgcaggtatgccccttctgaaagtgggagcacactctgtgtaatgtcactatcttgggtctcctggccttgtggactgaaatcctatcattggaggcatgtctcttgctggtgtgtgggaaatcatttgtctctgttctgcacctttccaggtcaaaagctggattgacggggccacagcctccttccctcattcctgggtcatcttccacattccttcaagccaaccttttaatcttttttggacttttaagaaccacaaatggcagcacctgccacttagtcatagtcagaaagtctcttgagtccagttgtgggtggcatgcaactgcttatgcagagtctgagtgcccaggctccagaacctcctccctgtgcttgccagtgccccaccccctgcttgccttcgcttccacctgtcactatcaatgcctctggcagctggagtgttgggttcctggagcaggtggctggaccctggtgctcctggctcagaagggttggcttctagggaagctatggtagtagtcactcaacctgggaggccagctcccggccacaggattcctttgtgaacctctctccagtca

SEQ ID NO: 27658 - DNA, 2446 bp, Mus musculus
gaacagatgaagaaggagaaggctcatgtggtggctctgtggcccagacaaaccatcatgtgtttctgaagcccaccccgcccacctcctggccccagctcaccagggccttcaggaccagatcaggttgtcaggaagttacaagaagaggcagcactgtgaggacaaacatggcagtgatcaagggaacccatccaggtcctgggagacactgatgccaagttcccagttgaccctacaacagaactacatgagccaagatcctcccatggatttgttagtttcgttctttaaaggattttagggatatccactaacatagtcagttaaaagtaatttgtaaacatcagacctgtgtctagatgtagtgggatacgcctataatcccagcactagggaggctgaggtaggaggaccttgagttgtagaccagtctgggcttacacagtaagaccctaactcaaataaaacaacctaaaagaagaatgagaaatctattaattggcccatatttgggacaaaggaaaaagaagtcactggtcaacctggggtgctgggcctcttttcctacagtgaccaggaaccaggtccagacttgtagatgatcagttgcagtctggtagcacacccctcctgcatgtagctctgtggccctttccctcacatcctaacgagctagatcctgaactgggacttgtggtgctgtcaggatgagaacatggaagttttgaacctagtgtcttttggaattcgtaaagctaaataaatgatgttgaacttgaaaccctccatatgtagatcagtttcaaagtgataatagtgattgccacggccagtaagtaccctgacctgtccctgtgcagactcccttgcagggttttactatgttgatctaaggtctccttgatttcatttgtcctaagctaagaactggtgagtctcaggatcagtctgactgttcttgtccaaatataaatattaaatagagaaacacacacactcccctaactcctatactggcaggcagtgtagatggtgctgtgctgtgttgcccagagagtgctggaatctgtgcatgcaagctcatcctgtgcagtggagaccacttctgacctacagaaagtagtcgggagagaccctgggggacccgtctaccaaggctgctggagtgtaggtttctgtttgtgcccagtgatgtctttccttgtcttccttttgactgtattttaagattactttagatgattctgtgcaatgtttatgacctttcctacccttctaatgttcagttaacacagccagtacccaatggggaaaaaccaggctgggtgatggtggcagatgccttatgtcccagcacttgggaagcagaggcaggcggctcacggagcctgttctacagaactagttccaggacagccaggactacacacaaagaaatcctgtcttaagaagaaaaaaaaaacaaagcaaaacaaaacaaaacaaaagaaaaaagccagtgcttactgtggttaggcaactttttcccaagttacttgctggatttgttcctgaatcataaagccagtctcttcagatgtcaagatttaatatcagtcagtacccgttgtcctgctgatccatggtgtctgttacaggtgagccttgttaaaggaggtgccagtgctgcagctggtagactccagagagagtgacataatcattcaagctgcccctgagggtgtgggtgctgtagtacagagaacctgtgggccgtgagcatcctactttggctttcagtgcaccttttattgaggaacagttgtgaacagtgtaaaccgtgactgatcttattctttttccagtattttgagctgtgaacccatgtgtcccagcactggcttgttcctttttagtttgattgaattatcctcctatggaagtggcaaaatctatgtctttactgtccttacaagcacagtgtgtgttaccacatactgtgagtgtgggttgtggtgtgtgtcagtgtgtgtacatatgtgtatatgtatatatcacacagcaggcctgtcatgcctctgtttggtggcaaagcaacaagtacaataaaagtcagctccaaaacagctgtggtttcttgaagtgttgggcaggggtagggtctccttgcagaacacaaaaggaaaccctaagtttattgtgtacatagatacatgaacctgaatgcataagccctggccagggttggcttcagctctatgtggataaaaggatgatcataccaaatatatccctgggaaccatgtgaaggtcgcctgaccctcaaggatatgagggtctaggacatgactagaaactcctctcttgaaaactaagactagttttataagtaccaggtaaaagtcagtaatctgggtgcatgtaaaggacaggctagttagggtctctgctgccaaggaagggc

SEQ ID NO: 27659 - DNA, 2560 bp, Mus musculus
cacatgcagtcatgaatgccaagaaaacattaataaaaggattttttgtttgtttgtttggtttttgtttagttggttggttttaataaagaaaatgagttagatctgtagctttagaccaaatttctcagtctttattgcaagttttcttgccctagaattggttccggacctcagctgacccgtcttccaaacacaagagccaggactccttgatgcctaggaaagagaagaagaaaagtctgtcaggaggaaagaagcggggccgcaaacccaaggaacgatcctccgaggagccagcatctaagctcccccctaacagggatgactggcccccaggaggcagagacagggggtcccggagctccactgggaagaaggctggagctgggaaggcacctgaaaagtgagcctagtgggcagggcctacccatcatgccctgcattgtccagattaggggagccagttctagactggtcctccacctccaacacacacccccatctgtccagagggttggcaaactactctgctctccctgaaagtggtccttcccctgtttaggctgcctcaacaaggctagatggggctccccgggagtgccagggcagcagcaaaagtgcaataggctggaggacccagccgttcctacaaggacattcatggcaggagccttggcatcatggggcatgaagtgtgcttaaacagtcaaatggtcccagtttccaccttcctctggcccagtaggatccccaatctgactctttcaaggctcagacattcctggtgacccatagttgtggactgatgaggcacctgagcagtctggctgccataacttgggcctcgcctccacccaacactggaactccagtactcccagctacctcccaggacagaccctgtctactgccatgctgccctgacagccacccactcatctgtccttttgcatccacctctgacccccttgcttctgttctctacctctctgggcctgcttcctcctctgtcatccctgtgtgcttcaggcctctcctaacttgactggcgtgatcatggtggagtatgtaaccttccaggcaaggaaagagctctgtgtgttctaccttcagggaggcccagactaggatgtttcacatccagcctttagcttctaattttgtggttatcgccctttggggtgcctccctggggccacagccatgtgaagcagaggctggccagaaggagcctagctcaggagtagtacttaggagagactgcaaatgtctgctatgctaggtgggcctataagccaagttctgtggaaggcctctttttcccttttattttatctgcccttgggatctagtggcagtcagtcatttgatatagaaatggaaggatagtgaaagatggggtctcagccagtgtagcaactctaggctgggcctcacccctttctttaaggggccctgaggctaacagggtctgcaggttggacaaggccaggaagagacatctggcctccttcctggttctaccttctaaccctatccccatctcccaaccctgctgtgagccacaccaggagaaggctggagggggttggaacgagctttttatagtgttggtaggggtggactgaggtctctgcttctgatcctggatgatgtgaattttgatatttgcctctgtgtgtctcctggatgttgttgatgccagtcttgttgctgtgacaagtagcaaccttttttttttcttttttttttttttaattctgggttttttttatacaaaactcaacaatcttaatgtcatggtgctaagggtttcctggtgccgaaggtattgctgtggtactgactagcacctgcccccagcctcagcagggagcgtttccaagaaggccagctccagggagatttggggtgaggtccttgtacacatgtatttagaaaggctctgactctgggcaaggtaaccatggcctggtgtgttgtaggtgttgaatggactctccaattcctacacactttgatgtggtcagaggtggctacagaggtgggtatgatccagtgtcaaagggtaggctggggctttggagtggttgtgtgcaactgtggaagggaagggggccaaagtgcacttttcacaacacctctgtggggtgtgaccatccaccctagcctctcaggtacttggcacttgtagggagaagtaggacctgggtttgctgggggctgagttttccaggacgaaccagaaagcccatatacagccttgctatgggactgttctgggtaacttgatgttagcactttaactcagtctttgaggtcagttttggggcagctgtcaaaagctgcagttggataggtaccagcctgtggtgactggtaagtagtggcaaactagactgtaaagctcttccatggtggcagggctcatcggtctgcccacctccctactatggcccaaaggtaaccaccagcctacacagatcctcagtaagagggaccatcatggcagagctacagaaggtgggtgggcatagacttagagggccaaaccaac

SEQ ID NO: 27660 - DNA, 1197 bp, Mus musculus
acggtgattgaccttagacctcctggataacgcagcccctacacatcccctctgatttgagttgatcaaaaactgttaggagaggactcacctgcttgaaccttgctctttggtaccgcccccttctgtggctttgggtgcctctgcgaggcctcaccattctatgcttagagccttcctcggttttcagggtatgtgatgctgcaagcagaacagtccccagaggcccaaccccagggcagcagcatgcatactctatagcctctgcttgccagtattgactataacttgtttagctgaagtggcttcctaggcagggaacctagaagctattgaaaataagaagaaatggtggctgcctaggctgtggtggctgagggtctgatgtggtgtattcatctgggtggaggggccctgtctgcacagaaggctgagaaggcaggcaggtaggatagctcagcatgggactaaagtgtatttctagtggatcttcactttaccaaccagagggatgagtgcatgtggtggggacatgggccttcaggacccatattggcttctttgcctagagagaggtcttcaagggctcttatctgagtaggttagtattgtgtatctagatggcaggggccaggactctgaggagaagctatccctgaggtgtggtgatgtggctgcctgtgagccagcaaccattactagtgttaattgtcccctatgaggaatattatcagtcttcttcaattgcgtggaccctctgaagacaggctgatcctcagcagcctttggtctttgtgtgtctagatgagggtgtaggtgagggtgtcaaatgtagtaagagtcttggctctttctacacttctcatgtcttctgggttatttagaaagaccttgtctgggcaaacccccttctctaagttagaagcttccattacttgctttttgatgtgatcaatataggaggtcagggctagagagacatattgagggcctctaggatagccccagtgaaagtcctgggttgagcctgttcgtctcataggtctgtgtacttactctgcagagatgactgaatccttttgtgttggaggaggccgtcggcttcaaggatccagcaaaagtggacctggaaagggaggcagccggaaggaggcccaacttcccttgttgcaggacccaccaaagctaggtgaggag

SEQ ID NO: 27661 - DNA, 1105 bp, Mus musculus
aggtttggtagttttcaattagcaataattgtgcctctgataaaccttgttggctatggtgctgttactttgcaaatctgtggctggagtagagattcctgagagtttaggtagaggcttttaaggtaggaacaggaagagcctgcctactctggaggtgcagcctgcctgtagatgctggggaaaagccagggcagaggaaggcagccagggttgtctgttacagtacccaggagtagtgctgccctgatgggtaggcgctttgaggagaggctgctctcccaccacagcacagatggaccaaggttaaagaacccgtgctatacccgtgaatgtccttccgtgttgagcaggagttggggcatttattttctctagtagtttgttcagtgtcctcctgtggttagttaccatgatgtctggagatcaccgtagatgcaggatgagaaaccccctgatctttgaggagagcactgttgagctgtttgcctctattcctgccctatggcaggagcagtaaaaagcccctgttgtgatgtaggaacaggtatggagtgctctgggaatctcagggtagaggagtggcttctttctgacatgtaagttgccccctggtgatgacaaagaggtaggattgtccactatgccccctgacaagtgttttctgtgtaatcctggccattctggaactcctggcctcactctgtaggccaggctggcctttaactcaagattcaccagcctctgcatcctgaatcctggggttaaagacatgcaccaccactacccagcatccactaaggtttaaagtcctttatgaacatcccgtttcctttcaggagggagctatggatttgctgcgggagctgaagaatatgcctattacattgcacttgctccaggtaagtgcttcctgtcttagcagggctccctatattaactcccacatggcttaattggcacaaacaactttgttctaaggagaggatttctgattctctctggtcataagagaggtgggaggtaggtccctgggtcccaaatagccattgggagagatgttttctgtccctgccattccccagctgtccactgtgggagccaa

SEQ ID NO: 27662 - DNA, 1333 bp, Mus musculus
ttttcattttatgcagttctggggattaaactctaagcctcatgcatgctagataagcattctaccaactgagctatatctctagccctttttttctttctagagaaattatgaaaaatacttataaagatactgaaaaatcactttaaaagtctggaattactcgattcatcttgtatgattaataactaaacaaaactattctgtgagttggactttctggatgattttgataggaattttaaaaagtaaccaaaaccattttctattacctgatttggagaaaggtctacagtagagcttgtgccccatttgaaccccatccaaaaatctattttaacctcaataaatttagaaaagttacatattaaggctatgtgaagaatgagcttatatatggaccaacttcagatgagagtgtctgagagtatctcagagagctcacaagcacgaattcctctaacaaacaagagtaacagaaaagttgcatatttgttgaaaccactaatggtattgctctgtaaggtggacatatttgtatgtgggaagtcctggtctgttctgtgtaactggacagttctacacatgataagaaatgtagctagtaaggaaatctaaaataacagattcctcccatgagtatctgatgttttcaaaatccttaaatagtgatatagatgaataattcataaaccaaagctgactttgaaatttttgatctctggttgctttcaagcctttggaactttgttgcttatctcctttaaataactccgttacaaagtagagccacgaagtcttctttgaatgaggtgtattgagtattaaagcacttgtatatgccaagctctggcctcagttcttgtactggatggcagaggtgtgtggaagaatgaggatgtttactgttggtgagggttaggacattctcaccttgctggtgggagtagaagatggtacagtataggaagggaagataaagccccatgcttctgcctgcgtcaatctcagttcgttcagtaaacttttctcagcaaagctggtattttgattatgtagcaggattttccctgtccaattaatttaattattaatacaataagaagcctgtgattggacagagttgtagagatagggagccacagaggagaagaggaggaagaaaatggaggacaaacaggacaattcagattctgcgtggctttaaatagccacaggtagctgtagtatagggatagaataattgggataacttgtctaatctaggtgggcagcttgtatcatcgattgactctgaaattattgtgtgggtatcttgtgaattgagaattta

SEQ ID NO: 27663 - DNA, 1099 bp, Mus musculus
acccttgatagaactgatccaagcattactgaggactgttggctatgcctgtcctcgggtttgccttattatgaaggaaatgccttcaatggagatttcaacagaaccagcagccatacttcctgctcttggggaacaggacaaaaactgaccctgactgaagtatccttgaagagtccaggtctctgtataggtaccccaccttccacccacaaatacctatgcggacaaattcagtccgtgtccaggatggaagctaattactatcttgtaccttccccattggctggtgggcttgcaatacaggacttactccctgtttatcaattaaggttttaattcatctcatgatttttgtgttatgatccagctgttaccccacgtatattatcaccctgcatccagtttagaagaaagctatgctggccgatggtcaaaaggagaaccaattactttaaccctggctgcattcatgggaataggtatggcagtagtagtggggacgggagtgtcagctttgatagaaggaagacagggaattcagtcattgagggatgctgtcaatgaagacctagaggcaatagagaagtccattgatgctttagaaaaatctttgacctccctgtctgaggtagttttgcagaacaggagaggtcttgatttgttgttcctaaaggaaggaggactgtgtgctgcccttaaagaagagtgctgcttgtatgcagatcatacaggagtagttagagactctatgcagaaactgagagaaagattagagtgaaggaaacgggaacgagatgctcaacgggggtggtttgaatcatggtttgagtcacgaccatcttggataacttctttgatttccgctgtagccggaccaatccttgtggtatgcttagctttattttcggcccttgtataataaatagaggaatgtctttcatccagagtagaattgatacagtaaaactcatggttcttcaaaggccatatcaacctatagttcaggtagatgaagagttaggggacagcaatctctaaaattctatgattagacttagtctaaacagaagacgaggggaatgaaaagaaatgaaac

SEQ ID NO: 27664 - DNA, 1219 bp, Mus musculus
ggaaactttatatgccccagtacaggggaacgccagggccaaaaagggggagtgggtgggtaggggagtgggggtgggtgggtatgggagacttttggtatagtattggaaatgtaaatgagctaaatacctaataaaaaatggaaaaaaaaagaatcaattgaaaggtcttttcctcctctacagctccagcactatagccatcatgaataacacagtaaccatccggaccacaaagttcatgataaagtgtctgcttcagaggaaacagatggtcatggatgtcctccatccttggaaggcaaaagtcccaaagacagaaatttgggaaaagctggccaaaatgtacaaaaccacaccagatgtcatctttgtatttggattcagatcccacttcggtggtggcgagaccactggctttgacatgatctatgattctttagattatgcaaagaagaatgagcctaaacacagacatggaagccatggcctttatgagaagaaaaagacctcccgaaaacagcgaaaggaacgcaagaacagaatgaagaaggtcaggggcacgaaggccaatgttggtgctggcaaaaagccaaaggagtagatctgcggtgacttgatgttttcctgtgatgtgcagatttctgagaggacaaataagctaaaaagtgtctacaaaaggaaaaaaaaaaaaagaatcaaatggaagaagacgtttatcaccgttttctggcagaaagattcttgttagaaaatgtaagccgggcagtggtggggcacgcctttaatcccagcacttgggaggcagaggcagctggatttctgagttccaggccagcctggtctgcagagtgagctccaggacagccagggctacacacagagaaaccctgtctcagaaaagccaaaaaagaaaaaaaaaaaaaaaaaaaaaaaagaaagaaaagaaaagaaaagaaaagaaaagaaagaaagaaaaagaaaaaccaaaacatacagaagaattgtttgcagacatggtgcacatggttaaagtgagtaagtcatggttcttttctgagtttcctctccagtgagtagaccggtctgtctcccccatagtcctgccatcttgcccagatttgacactcccacctttttttattcttttttttaattggatatttcctttattcctttatttacatttcaaatgttacccttttcccatttccccgcc

SEQ ID NO: 27665 - DNA, 1275 bp, Mus musculus
ccctacccacccactccccctttttggccctggcgttcccttgtactggggcatataaagtttgcaagtccaatgggcctctctttgcagtgatggccgactaggccatcttttgatacatatgcagctagagtcaagagctccggggtactggttagttcatattgttgttccacctatagggttgcagttccctttagttccttgggtgctttctctagttcctccattgggggccctgtggtccattcaatagctgactgtgagcatccacttctgtgtttgctaggccctggcatagtctcacaagagacagctatatctgggtcctttcagcaaaatcttgctagtgtatgcaatggtgtcagcgtttggaagctgatcatgggatggatctctggatatggcaagcacttgatggtccatccttttgtcacacttccaaattttgtctctgtaactccttccatgggtgttttgtttcctattctaagaaggggcaaagtgtccacactttggtcttcgttctcttgagcttaatgtgtttagcaaattgtatcttatatctacggccataccaccctgaacgcgcctgatctcatctgttctcagaagctaagcagggtcgggcctggttagtacttggatgggagaccgcctgggaataccgggtgctgtaggctagctgcacttctaacacaacattggtgccaaaacccaggaatccttacccaggagagcttcagagtccaggtggctgttgccactgcccactggtgtgactgtggatgatcaagtgtaattatgcagtgtggactgcggtcactaccactgacaacaccacctggatccactgccacctgctgctacagccacaccacatggatttccactgctgctgcagaatactgccacctgctgctgggagactcacagacttctaccatgtgagctgtgctgccacagtccaccatgtggagttatcctctgccacataggttacacagtcaggcagacccacaccaaccatgaagttccacatttcctgctacagacagaaaaacaaaaaacaaaaaacaaaaaagacaaaagacaaaaaacaaaacaaaacaaaacaaaaccagaaaaacaaaaaactccaaaccaccaaagactccagccaaacccaacagcatcagtcccttctctaagggaagttgttggggaggatggtcttgtcagagtacatgctccactctcactgagtgacctttctcaaatagaaagcatactgag

SEQ ID NO: 27666 - DNA, 1250 bp, Mus musculus
ctgaagttctccttaatacatacacacttactcactcatacttatacagtcatacacatgggcacaaatacacacacacatgcgtgtatgcatacacacatacatataccacacacatatacacacacattcatacacacatgtatacacacacatgcatacatattgtcacagacacataaaaactcatacacattaccagatcagcagaggcagcaaccagaacagctgtagcctgtgccctctcccacctgctcactctctgctgccctaaccttgcccctgcggtgtcttcccgcttcccccacccccctctgctcattagcaggggcagccctcatcttctagcctgcccccattgttctgccccaggcctcccttgcaccccattccccttttccccttagtataatgtgcctccagtttttggctttcactttcaccagtaaccaaagacttgaccactcaaagtccagctccttgtaactgctagacatggacaccagtgtgattaaaagtggattaaatgtcactctcaccatcaggctacttatgcatggaaaagaagttggcagtatcatcagaaagaaaggagaatctgttcagaagatgcatgaggagtgtggtgcacatatgaacatctcagaagggaattgtcctgagagaattatcaccttgactgtacagactaatgccatcttcaaagcctttgctatgatcattgacaaactggaagaggacataagcagcttccagtagaccctcggttaccttatggctggtggttgtctactggaaaaggttgttgcaagatcaaggaattaaaagagagtatagggacacaagtacaggtgacagaggatatgctccccaactcaactgagcaggcaattactattgctggcattcagcaatccatcattgagtgtgtcaaacagatctgtgtttgagactctctcctagtcaccccccatgaagggcatgaccatcccgtattggcccaagctgtccagttctccagtcatctttgaaggtggtcaaacctatactggtaattcaaagacagtatgtcattccacggccagatttgatcaagctgcaccagttggtaatgcaacaaatagtctcattttccaatgacccatggcaacactgaattcagtggcattgaatccagttctccagaagtgaaaggattgggcaggtttgaatgcacctgctcaaactacttctcatgaactcacaattcc

SEQ ID NO: 27667 - DNA, 1170 bp, Mus musculus
aatgagtccttttgctcaccttatgcttcctttcttgttgcatgttttccccttatgtattctatttggtcatattgataaatgcattgaaaactggtcagcttctataagcagtagcaggccgagaagactaatctaagaagacactttagattttcaagttagtaactctttttttttctttaattggttacagacatctgaacttttaattcaccaatatgttttttatctaggaatgagcagtttccttctgttgtatttctaattccatggagtcctttattctacttaaggagtagctggatacattggttttaagtaaataggcacatgtttgttgtcattggcttcaacagtagcaagtaagtgttacagcatgctgccaagagacaagccaatcatccatgaaagatgttacaataatgtttaccatgcctctgtggtccatactttactctcatgctgctgtgctgggcaatagtttttaagcagacttcttgtgcaccattcatttttatttatttgcacaattagtttcgagtgttgtagaatgaaaaatgattgtatggttaagttaaaatggaagatagttatagatcactctgaaagttactcatgggaaaatatgaccattgtgactgcggttgtctctcactcaactggttttttaaaattatagatgacatatccattgacccaataaagtcacaaaacataaactgctgcttgttatgtttattgatacttatagaataaggacaaaaaagaatataaataaaacactaagaataactttttcttttttttcttggatattttcattattaacatttcaaatgtaaatcccctttcctggttcccctcacccctcccccactcccagaaaccctgtatcctatcctccctcctcctgtctctatgagggtgccctctgacccacatacccactcccatcttctagccctggcattctcttactctggagcattgaacaccctcagtcccaagggcctctcctcccactgatgtccaacaaggccatcctctgctacatatgcagcctgagccatgtctccctatatgtgtactctttggttggtggtctagtccccaggaattctgggggttctggtcagttgacactgttgctccctccatgaggctgca

SEQ ID NO: 27668 - DNA, 1118 bp, Mus musculus
ctgtccgtatcactcagtcaatgtaacctcaccctaaaaatccttgacagaagatgctcttttattcaacactgttgccaacatatcagttgaaaagaaaaattactgtttttttgtttttgttttttgtttgtttgtttgttttttgtttttgtttgtttgtttgtttgtttttcaaactgttcctgaggtggagaacagtggctgctcggagcaacttctcgacttcaggattggcaggctggttggccgagtggcgccaacgaggccagggaggctgtggggtcccaagcaaagccagcgcagcctatggccccagtgtagagccagatcctctgctgtccccgctgactgctcccctcgcatgcagttccggctgcggaggtgaaacttttgggttgtagctgctgccaccatcaccaccatggatgaacaagaagcattagattcaaacacgaaggacctggtggctctccagatgagcggacctccccgggtgtctggatatgagaccacaaagaacaaggacacaggtcacccaaacaggcagagtgatgtcagaatcaagtgtcaacacaatggggagagacaaattataacagtctggcctataaaatatgaagatgtggtgcacagggtgataagagtctttgggcagcctcttgatttgcattatatggataaagagctctccatcctgttgaaaagccaagatgatctcgacaaagcaattgacattttggatagaaactcaattatgaaaagacttacgatactactgttatcccaagacagaaaccacactagttcctctccctacctagagtgcccaggcaggagtctgcagggaatataaataccatctactaagcccctgagcccagaagcaggcacctgtccgcacccagaatcctggtcgaagctctcctccccctggttatgtacctgagcgaaaacaaacagcacattgccggcagggatcatatatgagcatcaacagtaaaggtgaattcatcccagagaccagcaaacagtgtatgctagatcccctgagcggtgccaaaaattccttctcagaaagctgccaatacttggacaggtcagtagacagcccattc

SEQ ID NO: 27669 - DNA, 1760 bp, Mus musculus
aggtggctctgtgagttcttgggaccacatgcactgacccctctgcccttgctctttctaggagaggcatgctgcagaggttcgcaggaacaaggaactgcaggttgaactgtctggctgaagcaatggcgggtatggcaagcccctcccatagtaaatccccctgcctatattataatggatcatgcgatatcagtatgggaagtgtatgacatggtttaaaaagaactcattatgaaaaacaaaacaaaaaacagaatcaaaaataaaataaaaatcaatgcggtctctttgcagaatgttttgcttgatgtttaaaaaagtaccttggatcttattttgtaaatatttacatttttgttaaaaaatacaagtattgcattatgcaagttatttcatgatcttacatgtcctgtaacaggcttttgacgttgtgtctttccactcagatggatttgctaggtctgttcttttggaagccccactcagtccctgcccttttcattccaaccgaaaaatgaggtcagtagacagtctatggtgctagaaacccaccattgcctaatgacctagatgactccgtaatctctgagcgtgaccaagaccacacctagatcgtgggtactgtgtgtccatgtgaacctccacatttgctcgtaatctgcttcctgcctagaagcggcaaagccaggctaagggaatctaccagtcatagcacttatgtctgctcctcatggattacgcgctacacatgtgtttgggttttagaaacaggtgcatgtgaagacaaatctgagctcagtcagggtagaagcgaaaggctgaaccttccaacgtgctgatcacaaacgcaaagccagagggttcaagcagccatgggattgttcttcatgaagtgggcttatttctctcattttagttattatgatgggatgaattaattgacatgtcgggtggcttatctgtgggtgccatgggtgatgatgttcattttaagcttttgcctgtagtacaagcacataatgctactgaacgtttttccacttggagactgtgagctggttgctgcattaaaaacacaaacaaaatcacaagcactgtggacttttactcaagctggtctttcttccccagtgtagggcaatcctgcctataaacaagaccaaaccactccatctgtgatgctgacgcagtgaaggggccaggcagggcatttgtgccaagtataagaatcagcagacacccagcatacgtacctattgcagttttgaagttgtttctccctaactcccaactcccaactcccaaactgcctgcatatttactcttcgtcagtgctatcttcttgtatgtcattgtgagcaagctgtgatgaataaagaattggagttctgtgaactaataacggtttggtctggtctctcggccctgtatgctcagagcctgatgctgagattgtagtaggagggctgttggattggacagtcttgggagcaaagaggcagtactgagtttggaggaagccaagggcctgctggttgacttcccttgtaaagcagcaggacagctcttttcccgcttccttggacaggctgacacagtggggaaggccttcaacctgttccccttagcaacaggcacagtgaaggagaaactgaaggtccaggctagtggtcctgagcaatggagcctcattctggacatcgtggggttcctggaaccacctcaagttctcatgctgcccacaggacacccccagc

SEQ ID NO: 27670 - DNA, 1203 bp, Mus musculus
atggcctgaggcttcaccagggccttgatggcctctgcgcgcgcgcactcgctgcctttgccttgctggcctgcatcttcttcaggcctttcttgttgtgcttcttggcaaagcgcatgttcctcgggaacttggggtcaacccccttaagagattcgtatctttgcgaccaggtttcttgatgccatttctgtgccatttgcgggactggctgtgtgtggtgaggttcttggacttggccgtgtctgcacggtaacccgcggctcccgcagcgcccgagaccggaagagaaagcgctttttttcttaaaaatactttaaaaggaaaatttgtttgtactttttatttacagtttatatttttgtacatattgttaggggtcagccatttttaatgataacgggtgaccaaaccagccttcagagcgttttctgtcctacttcagactttacttgtggtgtgaccatgtgcattataatctcaaaggagagaaaaaaaaaaaaaaaaaaaaaacaacaacaacaaaacaatcttattccgagcagtccagtaacttttgtgtatgtacctagctgtactataagtagttggtttgtatgagatggttaaaaaggccaaagataaaaagattttttttccttttctttctgtctatgaagttgctgtttatttattttttggcctgtttgatgtatgtgtgaaacaatgtccaacaataaaccggaattttattttgctgagttgttctaaaaaaaaaattagtttttgctatcttggttttttttttttgttgttattccaaatgaatttgcaaattgctctctataactctatgaagaattgagttggaattttgatggggatttcgttgaatctgtagattgatcttgggaagatgacaatttttactgtattaattctgccaatcaatgaacatgggagatcttctttgatttctttcttcagaaacttgaagttcttatatatgatctttcacttgcttggttagagtcacctcaagatatgtaatattattgtggctattgtaaagggtgtcatttccctaatttctttctcagcctgtttaacctttgcgtagaagagggccactgatttgttaattttatatccagccacttggctgaaggtttttgtttttgttttttttttatatcagctttaggagttctctggtggaatgtt

SEQ ID NO: 27671 - DNA, 2793 bp, Mus musculus
acagagagcccctgagctgccgacctgtgtcctgctgcccactgccaggtgctgccggcgagagccaagtacatcttgacaacgctcatggctgcggatttccaccagatgtgcttttatttagctttacttatttctttgaccaaatagttgatgaatgaaacaaagtgaaatcacttgacctccactccagggaaacactgttagcatgcatggaaggccctttgtataggaaacagcatcatagagcctctggtagatccctgcaggcaactactgtgtttctccttaaaatcactgtacatctggattctagtttgatctttctttactatctacatgaatcattgtttttgggtctctgtacacttaatcaatttctaacaaactgtccttttctaaattctggttattaaaagtcttggaattatttcattcctttcaaaggagaaactaccagctacattttttttctcggataaacagttctgtgaggaccatatcttgggtttctaaagacaccagactaaagtagacaggtgtgtatgcagttctatagttctgtaaattaaaaacatgcagacactcaaacttccagtggggagagtgtgggtcctgctcttgccttggtaactgtcatttgtagctacatctatttgagctcaaatatgcttatcagttatttattataccattctcacacatttttttacaagattaaaatttaatttcaggtaaattgagagaataacattgtgagttaagtatatgatattacagtaagttggaatgttcccacattcatcactgataattccaaaagtctaaacgtctttaggtctatacagttataaaaatgctaaaaaaaattcaccataggggaaattactgcctccattaaatccatttaacacctttaggaaggacagaaagttctatgagaaatacaacttgaatattttttatactaagggattgttgataactccgaaagctgcgaggcgttactatgactgagctgatcaggcagtttctgttctcagtgtgttagtgcctgagctgttctgtatgtagaaatcgttcccactctaagaactgtcggggctgtgagtcaaagcttcccagtggctctgctaagcccctctgttaactgtggtcactcctgactcactcctgcttcctttgctgtgtatgtttatggcctatgaggttgtatctgttacttctttctctattgtggttttaccagtgtccatgccaaatgttaactgccaagcttggagtgacctaaagcctttttcagagcatggctagatttaattgaggataaggtttctgcaaaccagaattgaaaagccacagtgtcggttgtcacaaaatgacatgctgccattcctggttgctgctcggatgcaatggaaactatgcttgattacatgtgaaaatcttaataaagtctgtgtctcagtagtataggtttcaatatttattaagaggacagtggtctggacaaaacttgttatattctaaaatcaactggtattctggaagcattttcctagaggactggaactgtagaaatttgtctctagagaaatattgtgattatccaatataatgatttttctaccaattagtctttttatttttcttcttcttcttcttgctaacatcttgttaacagattgtttcctgggtgcctactctgtatttgtaaccaagcaaaaacagaataagatggtagtttttttgttttttttaaataagaaatcttcaagttttgtatagagatttcatatgaggaaaatgattaagtggagagaaggagaaggaatgtacatagatcagaccagggatgagtgtggaagaaactcttcccacacttcatctagaaagttaatctactggaaggcaccctgcctcatcaaagatgttacaaaacgatgaaggactaacacagaaaattaaatgggagttttagaatattcacatatatccagaatatctgttggagattcattgtgagttagttcacagatactgaggaaattacagacagctattaacagaaatgtagcagaaaggttggggctgcttactgggatttgtgtttatgctggcaaaacagcaaaaggggaagcgtgggtttcctgggaaatctcagctgtgtgaggacgcaaacggtgatggaagagctccgaggcctttctaaaagcagtgctccctaactcgaggttctgggggacactagcaagaattcttaatagttagaacctgagaagtgaataaaagaacttatcaccagcactcggatttcagccactacacacaattcttggaatacagaaaagtttaatttgaactccttctggatcttttaattaagttacacactgttttctgtgaagtgtttgaaagcaataaaaactataatttgggtaggggttcttttttatgtatttcccctttcaggaaagggtgagtcatttttgcaacttctctcagactcttcagatgctgacatgtaaaacagcaaagtaaagctacaaactcagccacccacccatccatccatccatccatccagccgaccggcagttgcaaaggtagaagcgagagtgtgcgaggggacacagcaaccgtgcaaacgtcaggatcctgcattctttagattgtttccttttaaattaaggtttatttgattatgtgtttgtatgcaagtgtgttatgtgcttatgagtataggcgcctgtggagagcagagacgtcagggtgtcccagagctgggcgtac

SEQ ID NO: 27672 - DNA, 1220 bp, Mus musculus
ttcctttatgcagatgtctgcacggggagcaatgagtacacagtcttctgtatgggccagtgtgcagggttgaaagtccttcgtctactctctgctgatttttctgtgcagtgttttagaggtttgtgttgttgagacatgatctcctgtcacccaggctgggcttgagcttattcttagccaaagatggccttggctagtgaccgtcctgtgcctgtctgagtgctggaattaaggcatgtgttgaatgtagtataaagggggtcatggtgatccccactcttctgctctgctgtaattagcctgaggctgaagtatgagtggaagcagagggaagggaattgttttagttcatttgttagcgtgctatgttggtggcttttattggttatccctggtttttcttttatctttccctgatttctcttgagcacacctacagaaagaaagaggacggctacaacctcaatggctgttctcgttgggacagtggggcagctacagaggaatttagtttcgcattcacacttgacatgattctctttttttctccttgaccctaaggtctgctgaagacagagccggtggccgaggaaggagaggatgctgttaccatgctcagtgctccagaggcgctgacggaagaggagcaagaggagctgaggcgggagcttactaaggtgagggacgtagtttgtgggccctgtgctttactaaggtgagggacgtagtttgtgggccctgtgctttactaaggtgagggtcgtagtttgtgggccctgtgctttactaaggtgagggacgtagtttgtgggccctgtgctttgccttgtgagtttgcagagcacctcatggtaaaaggctcaaggtgaaagaaagcttacacagcccagagtctcaaaggacagaggagacaaagtgatcttagatggctttcatatgacagcatgggtgagttgggtgagcacgggagtcggacgggtaggagagagtggggagagctgcgttgtccgcctctggcccctggcgcgtgggttcagcagcctcgtgctcacctttgcttgcgttatggatctcggctagcctcctcccccttttcctttcttctttgcttcaggcttcagcccaacttctggacacatttcagctcccttctttcctagcttccttctgtaacatcatagaatggtctgtctcacagtgcacagtcagtatcctgc

SEQ ID NO: 27673 - DNA, 1195 bp, Mus musculus
atggagaccttgaggcctctgcttgttgagctcaccatgtcaccttggcttcccttctcctcaggaggcatgggccttttgtgtctccactgaagagctcagatagacttgggttggtgaactttccctgtcaagcctagctttggtgcatggatggatgaagggtggcggcacctctacttataggcgattaaaatggtgtactcgacaagactttctgaaaggacggcctggtctgactagaaagctgttctgtagaaagctgtggtgtcccagatccactcggtgaagcttttggaggagatacaatgcagacacacagtgcagggcggcatgggaaggcaacagttggggtagttgcttcaggttccaccaattcaagttgtcaaccacaggagcctgtaggggacacttcccattcacactcaatactaccggtacggatcctgcaaaaataattgtacaatcttaaaactcctgtcccccacttacttatattccagtctcctgatccctggcagccaggtggtcaagactgattttttttttccttcctcgagacagggtttctctatgtagccctggctgtcctggaactcactctgtagaccaagctggccttgaactcagaaatccgcctgcctctgcctcctaagcgctgggattaaaggcgtgcgccaccacagcctgtcttggtcgccatagttttgcttgttgcggaatgttgagctgttgtggcacgactgacttctgtcacttagtaatgcctgtttacagttccttcatacatctgtccatgatttgttgggtggccctgttctctctaatgttccgttgtctgctcattattattatattattctgtcatctgctggaagacagctctgtgcagttgagggtgaccatagctttagtaagctatgatgattgcagggtggaaacaggtgttgtaccctttctgttcacagtgtctgtttgggtgacaactgccttccttccctgcgacatcctgaccagctctgcctcaccccagacttgatgacctgtactgttctgtctgatgatgggaatgactttctccagtcatatccttcctctccttctctcccactcttcctccctccctcctctccctcctcctccctttgtccttccccccatcccttccttcctccatagagagggtcttccaaca

SEQ ID NO: 27674 - DNA, 1143 bp, Mus musculus
gtaaccctgttccttgcagcctgtcaggctttgtattagcctggttttgttttgtaccagttttttgaaacagggtcttactcttccttgtctgactttgtttcaacctcccagtttggggtttttattgttttaaaaaaagaatctgtgggaggtgtggtggtacaggttggtggtgaggcaggggtcccaagttaaaggtcattctctgctaccatggcaagttcaaggccagcctgggctgcataaggccatgtctcaaattggaaaaaaaatgaaatggctgtggctgaatgcaaactgggaaattatttggtggccactaaaaaagaagccgtacactagaattgatggttgattggatcaagtggcaaaaactaaagataaatgtatatatctatagatgtctgtgtatatatctatatatccttatacaggaaaaatctttgacccaataaattatatataaattttaaataggattaaattaagaaagaggtaattcctgactgtgttctggttttagttactgtagactaggcctttgttgctgttttctgtggcttttcttttttccattaagctcagactgttggaggttcaggtgtttatatcctttgagtgtgggaattgaatccaggagctcgggtttttgttcgggttttggggggaagacagatgggaaggagttgggtagttttgagattgggcttccttgtgacacatagctgactctgaattcagtcttccaagtatgagccagcacatgcagcttgatttagtttatgttaagataacttatcattgttcttataattgtattttattttctctggctctaattaagagtttttcccaaccattacttcaaaatcacttttcaattgtactaggagcatcacatgatttcaagtatggtttgatgcctggcacttcaagtgatttcaagtatgggttgctaccaagtacttcaaatgacttcaaattcggattgctaccgggtgcttcaaatgatttcaagtatggattattgccagaatcttggcccacacaagaaacgtgggaaaatggcaagtattggtcaactaaacaactacaaaattctaaaattccatgattaagtgcttctgagctgtgttaata

SEQ ID NO: 27675 - DNA, 1111 bp, Mus musculus
acagttaactatttgggttgtatgaaaatatagtccttgtcctttacagagcttgcttacattcatgtgccatttaacatgaatgaggaaatccatttatggaagtacaatgacagtgacccaatcgctctgccaatcaaaccactcaggctagtttgtactagtagagttttgtttctatttttattttattaattttattttttttaatacagattttcagtgaggggctttttcaaccccattggttctattttcttgtattttttttttcattttatttgcttcataacttaaaccaagtctcctctagtcttagatattatttcttaatttcgtgctgataggcatgcttataagaactggagaggtaatttattggaatgaactgactggctccccgccctcccttccctttttgacatgaattttactacttcacagatgaagaatgatgttacaaagttaccatggtgacgctgacaaataccactaaactgattatgacttagaagtaactttctcctgctgctctgatctgatagatggttgctctatgatgtgttctgacatggggtctggtttttggggatctgttactttggcactattcttgtttgcctcttagtgtactatacctcagccttatttgaaatacagaagtctaattgaagaatagtcctaggaaaatacataaaatgatttgttttataattcatcccccatgtccagtttggttagcttgttatgcaatataagtgaagtatcaggttttttttctcctgtgcccatttttatcattaaaatgaacacaaaatgtgcattctctttttgtttcatacttaccgggatgttgagtgtttttaaattgtagctgataatatatttttccattccttaaagtcaccacaccttgatgaaatctttatagtctccatgattcagcaatctacaaaaaatactacaagtaaaatgttgagcctttattgttccattatctaaattcctcaggagtcagagttcttcacacagttgagacttagtttatgtagccaggtgacggacgactgagcggacagcagcacgctcagcagcttgtgacaggctaacg

SEQ ID NO: 27676 - DNA, 1161 bp, Mus musculus
ccatctgttcaaagttgaaaagttgattttctttttgaaagagacaaacttcatcattgcctctgatttcagtagaataatggtttgatattggacagtgacttcctgcatggataaatcagagatgaagtagtcatgttacatgttgagacccacctattgccctctgactcgtatggcagtctctgcatcccttggggatggcagaagagtttcattctggtttctgtttgaaatgaagagaaccccttattctctgtgtttgaaacaaatgagtgaagtgtaattctagaaaagtccaaagtagactaagttgggcagagatattatgatgaaaaagtattttaaacgtaagatgttgtgctttgtgaatatgtaagtataacataaagatttcttccatcccacctatccccttcctttaaaataaaccatagtttacaattggtagatctgtctatatataaatatatattaaagagcaaatatatatatttaaaaaaagatcacctaaatctgctttattagacagtagttcactgttgcgtagaaactggacgtggctttacattcttaatgtgctttattttcctcaagataggaccttatcttgaaacagaatttcctttattacttaaatcatttatgtatatctggtaaattatgaccaaatttttgttagattgcacacagtaaattgaaatacacatttggtacactacggaattgttgtgcttttgtttggtttcagttggaaacaggttcgatggagatgactttattactgttaatttaaatagtctataattgtccgttgccttttatgtcgtgttgtgacagatttggctatatttttagtcatctgaaatatactttaaaaagtttgtttttaggtaatccaaaggaaaaatgtttatactcttgaatatatatttgcctcagcctatattaaagtttctttgaagtaaacactttaccagaaacagaattgacagatttttctacttgctgactgcctaagttattttgtttcatggtcttgagaattgccttttctctagacctttttttaaaagtagttttagtactaaggtatactactggacgctcctatttttttaagtatattccttttctgacagtacaacttcaggaagttga

SEQ ID NO: 27677 - DNA, 1073 bp, Mus musculus
ggatagtttcacttaattttaaaaggatggttttacaatatgaagaagtagatagaagccccagcttgtgtgccgttcacacccggatccttaagcttaactatggtacccaatctacacagttagaactaacaggtgttttcttagtttaggatttaaagtaggattatttattttgtttcttccctatctgctgtatcccagtcttcaagtgaagttgaactaggtagtttaaaacatgttagggataagcacactttgaaagatgttttcttgccctgaatttgagggcactgggcagtaaatttggaatacactagctattgagaacaaaatttgggggttaagaaagggatgattgaggccattatgatctgggagaagcagcatcctaaacactgtaaacaactcttctgcctgctgtttgtaaaagctctctggcaagatcttttacaaagaccaattttcttttttaaatgtaatttacctacctaatatttaaatgtcctgagacatgtatgtaaacttccaaaacctgtttgtctgtgtatttagaaaatacacaagaatctttatcaaacataaaatataaacttgtgagcactaaactgcttctggctttgtgaattttattgacccttaattgtgatttatttgcaggggtgctagtttagactcactgggtaagggaaccaccgttggaaggttagacactgagatagatgcctttgtacttggagtttacgagtttggattacagagtctgaggagggttgctaatggttccttggtatggaagtaagaaataaagctacctctttgcaagaattcttattcattatacttttagaatttttacaggatttaagaaacactgaaaagttccctctaatcacttctaatcgtttctcttggaaatgggatcgagactcaaaggtgaagcactacctcatatatactgtttattagacagaacatcaacttgtaaacaagtaaatatataagattacaaatttcaagcctttgaaaatttacttagagagttgcctctttgctgggcagacctcacctca

SEQ ID NO: 27678 - DNA, 3661 bp, Mus musculus
ccttcttgatcctcatctcctaacccagaagccaaatgtgtttgttgccagatccagagacagccattattgttacttggttactgaatgcttgctctgaagtcaacaccccagtacatggatgcttccctctagacactcattctgctcagtgagtggctaccctccctgcaagagaaagccgttctctgtctgagcagatgtagtctctgggctatgaggacagggtctgcattggcaccaccctgccacactcagcccacggcaaagcagcagctactcccgtccatgtgccttaagacactcagtgtggtcacctagccagagctagagtcagcaagacaggatgctgtgttagggtggaagagaatccaagagggctcagactaaatccttccaggctcaaggattcaaggggatgggattggccttctccacgtggcgatggagtttagttgctcctgttatatatctctggaaagcaaacactgcttccatttgcttacctgtcaaacattcattccttggcccaggacaggctcatccctcatttcaggcacagacagcaagacagagtggacagagggctccctgagggcttgtgattgtttgtgggtttgagctgcccctcagggatctgtccctgcatgggggaaggatgcctaatgtggcagattgcactcagagagagggataacttttaggcccttactctatatccttactggaagtatgtggctgtgacatggcataacagcaggagctgatcacagggagaaagcttcaggtgaaacctagatgtttgagaaaacacgtcacactcctaaagcatgctatttccatggcttccaaaactaaaagcacctgtggctcagctagcgcatgaacatgccagtagtcacggtttcctatcgtgcaccctgaaatccctatttttgtaatttatgattagactgtggtcagtcacttaaataaacactcttatgaattaactagtataccctagtatagtttccaaaatatatcatactgtatagccctatgtgcatgaagatctcagggggaggaagtacacgctaggtcccaaagggtccagactatcatcaaaagcgcatgccaagtggcctgaggccactgctcatacacgagggggcgggggaggggatatgggctgcagcccctcagctgcccttagtggtgggaatcagcatggtcgctgttaaaggaaagccatcttttgaatttttcaacaccaaatcttaaagtatcaaaaaaagttaccgaatgttaaaagtggggtcgttagtggaaatgttgtctgtaggaagtttttctcatagtgtttgataaaaacaacaaaagccaaactgaagcccaagaagtgtcctctgggggacactggcattagggtggtcgatgactgaaggatacagcagtgctgtcctgtacacagagctcttttgaggtacaatctttccatcgtttcaggggtaagtacttccttacaaagtctttaataatgaatgaatgtataaatttataaactatgcattttcagagagaaacatgtattttgtatcaaatccgagtacttttttttttcatagagatttatcacaactacagattattcaaaataaatgagaatgccaatcctcataagggtgtggggtgcctttgtttttcactctgatggtttcaagaccatgcatccagactttgatctgaaaagctagccagtacagtaggcgaaggatgattcgccttctcctggaggggaccactcgcacaccacccagttcttagggatggataatttagtaacactgggttagcggatagaagggccagggtgtggcttacagatagagccctggcctcacgtgtgtgaaggcctgggttcagtctccagtacccaagtagtaacaataagcaggcaggcaacgctgttaccatagtaacattacattaccattgttaccattgcatcggctaaagatgacccagcttaggtagttgtggctaattgtcgatccaactgtgggtgaggaagagtttaggttatagttttcaaagaacaaaatataaagttattgtctgacaaggcaaataattgtttttttttttttcaaaattacttggaggtgatctcttatagaaaatgtagactatacccagatttctccagccttgtgctgataggccttttcacggagcctttcccactggtaattgttctttcctccttggtcagtactcacctcatcactccagcagcctccccgctatctgacaaggaggaagtgaaccccatttctttgctgttccggttctctttctgtatctgtcgaggaggtttctaggctgtctataaaatatggggaaacacatttctaaccctggtacttatggtcatacaagatatgtttgctccctaagtaggagctagaggggagggcaatgtgtctttttacatgatttttagccaaatccagctgttctgatactatgtttctgaatccttttctgactgtaaatactgcctgcagaggtcccggttgacagccttttctgagactggtcctcagccatgctccttgccagctgttggcacattgtacatagatgcgtcgagtgtttcaatgatgttggttttctaaatgctattctctaacacattttttgaaaaaaaaaatgtctttgttgttctggactttgtgtgttcgttttacaaaaacatttcctaagatttaacaccaggaaaaaatattttaaaatacactggtgctaattggaaaagaagaaaatttttaacttcaagatttacaaaagaaaatgatcacagcagttaactgcactttcccacggggatggctgctgtccacttacaatgggcatcaagaggaccagcaaaagtttacagtagtgatgacccattgatgtgtcatagagcaaggagtccttgtcccccagagaggaggatttgctgggtagtcctcaaagcatgtagtagagaagggatatagagttaactctttagaaatagtcttctggtccttggactttcatgttctgtaatgcttagctgtaacaatgaatatggtgttgccaatctagtctgacttcattgtcaacctgtactgactctgtgtatggctctgtccttggcttgcactggcacaaaccaagccagaacacaagtctttcagaaagaccattctgatttctatgatgttcacacacatgaatttagatgcacttgtaactggttaattaccatgaagtaagtctaacttccacttaataaaagtttttttgtgtatctgcttctatctgggagccattcatttatgtaaagcttaacattcatatcaagggttgttgtattggtgatttgtttagttttccagaagaatgtctaaaacagcctgagggggggggggttatttggctcatagttcatacaaatgcacactccctgtgctcagcctgctgtcccactgaaccactgcctgtgaccctgtgctaggaaaacaatatctagtgtgcattctggttctaagccagctggtcttcctctgcagagacctgctatccactagaactcactatgtccaccttcaaaatcacagatgctcttccacttctgttcagctgttag

SEQ ID NO: 27679 - DNA, 1193 bp, Mus musculus
attgttctgagaaagtacattattttaaactcttgtcttctattgaagtctattgaagttctgatgtcacagggagagttctgtatggtaaagtatgtgtcattcagacattacttcctttgatcttcatatgaatctagtatagaaaacaagtcctaaggccactaatagctatgccaagacactggctcaaacctatgagtcagcaccgtcattacctgcagagagagacctggcccagctggcctccgctgtgactcagccgtggattccctgggcccaccatgttctcagcccagaagtaaagagcaccctcattcatgtcactaagtgcaagtttaatcatccccaagttccgtccagtgaaatggtaaagtgtaggaggagtttgttagctaaagcaatattctgataaaaatgttgactccttaggaaaaaatagcttgcttctggcctctggcctttcagactctaactttaagctgatgctggatggtggttaacaaccagctcagaattaccatgtgtagagacgactcaaaacgacctgcaagcatgctgcagtgcctaggtcagttaagttgtatgtgtctgaatgcagtttctgctggcaagctttgacattgctcccactgtggatgatgataaggctgtccagtatatgaatacactccatccaaggcttccagggtgtcaggtgagcatcctgagttcagaggaaagctctcacaagaaatcctgtcataagaccagaaggaacccccagacagctagactggccagttccctagctgatgagcagggaggcagttagtttgcccctttctcctctgacaaaaggcagtgggctgtatggtttggctgcctgtgcttggctggcagtgcacagaaagggcctagtgttagcaagggaaaaaacaaagcgcataccagatactgaaggattgggttagagtcaaatagtagttggttctttttaaaaatgttccttttcagtggggattgctgcactgtgaccctccgaggagaacaccctttgatgtgacaaggccacctgagcgatccctaagactgattaactacttcactttctattacaatcagtcttcccaaaatgttcattcagaaaatagccaaagcagagcatggcagcccctagaaaggacaagaaagggattactaaagaacggaat

SEQ ID NO: 27680 - DNA, 2004 bp, Mus musculus
aacatacagttaactgattatatgagttactttttgtgtgagttacatttcttaagtagttattttgttatttggggacccaaacaaagtgccaaatgaagcctgacttttcatttcatgccatgtccatgaaactaagttctttttgtgtcttcattttgtggagaaacagaaagcatgagagttggtgagctggctgctagcctgaggctctgtgcaccccagggcttccagccctgtctgtcaaaggagcagtgatgtaatgaattcttgtccatggaaatgtctagttcttcttcttccatgatgaaaaaggtttctcatttctcccggaaaaagcatgtcacagtgactagcaggacattctccagccagctaggaagcaatgtgtgcaacaggcaatagtttccagccttagccttcctggaatatggacacttattttgtgaaaatctgtgagataacgtggagaaacccccaggtagcatatgtgtcaagggggcagtgcgggagacctgcacacccctatcttctgctcatgttcttgggctgctcagctaggactcctccatgtctgctgtagatgtctgacacaagacaggagctgcttcggccaggaactatccatcaggctcacctgccaccttatgtctgggaagttaggttctctggattagcaaaagctagcgccaggaagaagacagtgggtttccaaaccagagtggacctctcgtgcacgttgatagtaccatgtccaggaggctcccttatgaacctcccatgaccaagctataaaggacgatcatctctagagaaaagcattactgttgagctctccaaaaattccttcagacttcatgtatgttggaaaaattatttgaagccaaattgttccccattgcaattgaagatgacaagatttggagtctgccatctctggtatccaagaacaagtacgtcacactttgccagaagccctgggcttaaagtgagtagtgagcccctataaaagagtctgtttcatctctcacttcagctgccctgcaagacaaaggtggcattcaccggagaaggttctgagaaaagaggtgagaactgtacatacaagaatctgttgagcatagcagcagaatactgtaaatactactcatttcctcagggagacaaggatgctgtgggaagagatctggagaaccccgagaccaggaggatttttatctcctcaagtcttttcttgtcagaacaagtttttctttatgtaactctccgtgtcatttcaaaacaaatccgtgttcagctggacaggcagacgacttccatgaggtgtggcagagggactgtctgttcgtagctgccctaaagctgattgaggtttgagccacaggtgaagagcctgctgggcatccatagacatggtgaggcttcctctgaatgtaattgggaacaaaaagccttgctgttccttgttgtagttcctcagtctggatgctgtttattatacacagcatcctctaagggagggaaagctggccacgacgtgtggtttgctttagtggcatgttcaggagcacactgccatggactctggtggacaaggtgctgtctttgctcttgtccgtaggatttccaccacccacatcagctgtggcattgacctgtgtgaatatgtgcggatgagtggagccagcatggcccgtcagtatgacagcgttgggagcgtgggtcattttgaagggcatgttaggcatatgagtcaactgacaattctatttctgtaagaaagaaacctaccagcagcacacaggtgccaccaatcctcccacgtggagggatttctccatgttacgatttcatcctgtattttctgcattgtaagtagccacaggggaagttagtaaataagatgaggttagcacttttaggtaccagttgtcctgagtaactgtactccaacagagcaaggacatatgaaatgtactcaagacttgcttctggtgacagact

SEQ ID NO: 27681 - DNA, 1243 bp, Mus musculus
tcctgtattgatagatcagtgctgaatggctcacggtgactgtgaacccctcagtcacccagtgcacttttggggttaatgtgagaaaactcgctgcaatgttgtgagtttgggtagctctggcagaaattgggaatacacaggaaacctgactcaggagtctgtctactggaccagcaacagtaccccagaggcgcttataaacctggttttcatcactttcccttggttcgtaggtgtggtgaccatggacagttttactgggggttggttggaggggagcttgaatcaaaacaggaagctgtaagctaacacaggagtttcggtagctgtgtggtcttcaaccacgagttaagcatttgctgcactctgcattttttatctttgggcttatacttatcccccaaaacacacagatctacaaaactcataagtatgatgtgttgttttaaacaaaatcccaattgttcaattttaccaatgaaaacttgggagccagatgctgcagatgctggagttaaagcctgctagctcagacaggcagagaaagcaccaactgaccttcctccttagtggacctcccaaaaccgaatgtccctcccttctacttcctgtgcatctgcctatcaggtcctcctgactccctcttactatgtctttttgttaataatcacatattcgctccctgtcaaatgcctcttgacctatggttgattttacttaaatcttgtttacagtattcaagcaaaaagttcctggattaaaagtgtgtgttagggctgagctacaccacaactggaaataagtttttccaataaataacacaatctcggggtccacagtgtggttacatatcctgcaacagtggtgcccacctgcatcgtgaactctacagcgttcattccgaatctgcttctcaggagcaggaaggtctcccaagggagtgctgtgcagaagcggtcccaatgaggatagtgcgtgagcacaccaaccccaaaggtacactgggtgatggagaggctcaccaccctgagccactcggcactgacggatcaatacgtatcaggatggaggcaagtgttctcttgtttccatacctagggttccctagccccccacctgcccagcatccaaggcacagcacagcacagcaagcattagcagcattcatggctcttccatcttttcatccgtgtgtgtttctctggaatgacacatcatcaggaagagcagcaagcagtta

SEQ ID NO: 27682 - DNA, 1240 bp, Mus musculus
acagtgtcccgtctgtaaggtatgggcagttatggaaaggcccgtgctacagtgtcccgtctgtaaggtatggacaggtatggaaaggcccgttctccttctttgcctaagcaaaggattaagttagataatagatgtttagcatttcgcacagctcccagcttaaagcaaatgctacatgagcgccatggacgacttccgtccccagaacactagaaactgggaacactaaagaggtggaggcaggaggatttcaaggtcatctgctgccacatagaaagtttgaagccggcattgggttcacagagacccctgtccccacacagaggagatgtacgtaaataatgatcagtactggttcttgatactatggtgtggtaatgttttatactcttggcataaaagtctttgaagaacactgtacttggactttttagcctgtaagtacagcatttgtgagttgcttactgataggctgggagctgatagtaaggcaggcgatgtattatgcatcccacagcacactgaaataaaatgccatttccttaggaacagctagaaatactggtgctaatttttcctgtgctcaggaaaagcaagcacgctgtgcgcagctgcagtaggctagagagccctccagaaacatgatgtcatcctaatctgtgccgccaagggatgagctcatccaggcggggcctctcggggctgcagctgtgccagctcctgacttgtgatgctcctcttacaggcttgctcaccctccctcccctaccctcccctacaccacccctgcctgctgtgccaaagagacactgaaggatgaattatttaagacccaaggtgaactcctgccaaagataaccaggcttcagaaagcactcaaaaaggaaaatagaactgcatgggcttttttttttaattagatattttctttatttacatttcaaatgttatcccctttcctagtttcccctctgaaaatcccgttcccccctcccccttctccccaacccacccactcggttcctggtcctggcattcccctatattggggtatagagccttcgcaggacaaagggccactcactcctctcattgatggtcttataaaggaaagaactaagcagtttgtagaactgtcgtcagtgagaggacaatggtgttggttctctctgcctctgcttgctctaggagcagtctgtccctcttctacttaaataatggctgaatctgtgaccga

SEQ ID NO: 27683 - DNA, 1132 bp, Mus musculus
ataaagtttaagattacatttaaaaaaatagagctaactccatacaagtcccaaaatgtaaaactaatttagttcctaacttgtaaaatttggaatatcaagcttttatgtcatgtatattggattttgctatacatattacagctatatgtatatatatgtatacacacacacacacacacacacacacatatacacaaatacgtcaaagtaagagtagaaaaggaatgtgacagaaatgaaaaagagtgccctcttaacactgaagtttatcagcacatgcaactgtttattttcatttatttgtttgtttattcagtttgtttgaaatagggtttctctgtaaaagaaccctggctatcttggcacttgctctataggcctgggcagccttaaactcatagatccaccagcctctgcctctctgcctctgcctcgattcatactgggaataaaaggcatgggctttttacttatttttttataatttagatttttttttaaagtagaaatttgctattgctatgtaataaatggaaatttagaagctaccagctcagaagactgtaaggaactaaggaaacatctgtgtgtctcccagtttaaacaaaacatctaattagctacttgagtattcagtactggttagttagtttctgggtgtctcctcgttgctgttgaacttgcccctggccagtgggataatccattagttaagcacactgggagttaagattgctcttttccccagcgctgtgaataagtaagggcatttgtgccagctgactgcattcttgaattgtgagagaaacaccaagcattacactgcacccagattagatcatgacagatttggcagggatgagaagattccttgaatggtgtttgcagtttacccaaagtccttgggccctttgctttcataaaggattacaatcgacatccagggagaccgtccttaatgatgcgattagcagtttgcaacatgttttcctttgtgttctcatgtgattgaatactcccagtagcaccttggggaaatacgttagctctcacagagcccggagacggaattcagtgaagtaattgtcttccacttcagcactctacaaaagtaaagtctcaaaaatat

SEQ ID NO: 27684 - DNA, 1330 bp, Mus musculus
aaggaccccatgacctgagtgggccacatgttggggtggagtggagcgcagatgggtacagttatgcttggacactcatggatactccctgtgtgcagagctcatgtgctgcttctgtgcacaagattggaggtcagtgggaggtgccagaaagctttactctgcctgcagttgttacagtgattcaaatatttgccataattttagcacctagggtgtacattattcacctcacctccagtcaacactttcactaaaaccaagcgtcttctgttcctggctatgttttattcttgtattttattacttgtggtggctttctgaagacgtgctctttttctacgataataatcaggagtcttactcatttcttggtaacaaatcctgccccatagggctgtgtgcatatttacaaagtgacaactgttacaggccaggaccatggcttagacattactggaataagagagtccagtgtgctaatttgtatcacaacccaggctgggcaggtagcagtcccatctctgtgtgtacttgctgattagatagagcttattgtgagtgttacagaccaccccattctttttttctaataaagttctgatttttagttatttttctttaacttcaaatcatcttgctggttcaacttactcaggtgttcaagtgcaactgtcatatagttcctgaatgtcctcttcagcctgcgcatccctgggaagctgaagaaatgaggaacagtgtgtgagtgtgtgcagcaggtcgtgggctgcaggaagacatcaaaggttgctcagggggagctgtgtgcacattgacccgcaggagtttgcattcaaaagggatttcaatgcagatcactgacctccagtgcatgtgcaacatggagtgtcccatggtgctttgctcgtcactctttaatcttcaaaacatggttttcactcatttctgggtacttgttccaggcagtgcttagagctccaggtcctgtagataatcttggtagaactcatgttccttttttttcttttttctttcttttcttttttttttttttttgttttgttttgtttttccgagacagggtttctctgtatagccctggctgtcctggaactcactttgtagaccaggctggcctcaaactcagaaatccgcctgcccctgcctcccaagtgctgggattaaaggcgtgcgccaccacgtccggctagaactcatgttcccagtggagcatagtgcacaggtgactcaggaaacagacaggaggatctcaagttcacatgctgcctgggccacctagtgagatgccatctcaaaactaaaacga

SEQ ID NO: 27685 - DNA, 1756 bp, Mus musculus
ctgcttatctctcaagtttacatggttttccttttggttcactcctgacaaacagtgcagttgtattttccacatgcctgcagatgttccaacctgaaagagtcatatttggaattcatcctactatgtttccattgctctgataaatagagtgaccaaaagcagccgagaggaggggattcctttggcttgcacatctgtcattgaggaaagccaggtaggagctcaagcagggtaggaactgatgcagaagccatagagactgctgcctaatcactggcttgccactgcttgtcctgccggctgtcttgtataaccccgaactgtctgtccaaggatggcaccacccagagtgggctggaccctccacttcagtcattgatcaagacgttgcttcactgagctgtgcagaccagtctgatggaggctttctctccaccgagatgactccagcttgggtcaagttaacaggaagctgatacagagctgaagggagcgagcgctgctgtccatcaggaagagctgcacttgcagttcagcaccagtgggttggacctcagagctgcctcctgtccagttaatggctgtgccttcctctgcatacagtgtaaacaaagtacagcccacagtggagacgtctacttgcagttgcagagggacgccattgcaaagcggaagagcatgtgaagtgtgtctacccctgagaaaaggtagcataggaaacagaacccatggtcaggagaggctcagtgcctggctctgctgctctctggcctcggagtctgcctttgtgtcagctcacacctgtatgagcaagcaaggcccttctcatgtcctacagtgtgaaaacaatgtcagctacgcctatctgtgctctaggtcactaccaagccttctttcccacagttctgtgacactaaagccagtggtttccctctcagaatcaggctcgagcttaaaaaaagattaaaaggcaaaagggaggtgaggggccacacacgggagatgactcagtgactaaggacacactccacaagtgtgagccaccaagagtttgaatcttagcacttggataaaggctggatacatatacagatacgcccctctgaccttagctggtgagagagggaggtaggaagatcactgtagagtgctgtctgccagcctagcttcaggttcagtgagagacccctttgtaagggagcagagtatagagaactgatggatacctaacagcttcctctgccctccacatgtgtatgcaggtgtgtgcacactgtgcaatacaccacaccctcacatgcagacaggcagacaggcaggcaggcaggcagacagacagacacaaaagcaaaagccttttttgtttttaaaaacattcacctgttttcttggtgtttgctccttaaattacaaagttagtatatatggttagtacctctacgtaggagacataagaagaggttgtctctcatcagtaattaggagtgttgtacttcagctactctgagaatgaaaatacacaaatcaggactgaccgcttatagctaaactagctcatgtattttctgctctaaatgttggtgtatcagcaggccaggtctttttattgcatgattaattggagatatagaagtaacagttgtactgggctgcccatggcctctatatttaaaatctgtgtttccttctcattgttttgtttgtttgtttgtttgtttttaataaagtaaaacctggcatccctcactggaga

SEQ ID NO: 27686 - DNA, 1147 bp, Mus musculus
atgtagtccattttctttggtcctcagcagttgatgaatacttgaggctggagagtcaggaactaggtcatattgggttatagtagttgtgctacattttaaacatatatttttaagtgttcaaaaagattttatagtgggcattgttaggcactctttagcaaagggcactttagttgtgtaggataggttaggggggacaagaacagacaggaggcctggtcaggacagtgttgcttaggacagtaggcagctgggaattagaactgaaatggaaagagagttgacatgatgcaggaggaaggcctctgggctgcgagctggagaacatggctctggcccagtctactagaatgggccttattttatttttcttttaaaaactaccagttcattttcagagtcacagaggggactggagattagacagtagacaatagacagctaagtcagcggagcagcatccacaaagcaggctccggggcttctaaagtgagaaatgcatgtaagacgtatgtctgtctgtaagatgatgtctgtctgtctgtaagatgatgtctgtctgtctgtaagatgtctgtctgtctgtaagatgatgtctgtctgtctgtctgtaagatgatgtctgtctgtatgtatgtctgtggacacaggcgcaaacccagccacttgcttaagagtgaaatgaccgatgctgtgcttagtcaccgtgattgccacttcataaatgagtggaaagacacaggatgtcagacaacatgtaggaggagcatgttggaaaatacatggaaggttctggccaatggagatgttgttctttatcattgtcaccagtgtttatgggagaatattaataatttattgtccttgtcaactgtgatgccataaaacacataatagcagtagctccgtcacctgcaaccccaatgtctgtcaggcagacactgtttgatcgtttagaccagtggttctcaaccttcctaacactgcggccatgtaatagttcttcatgttgtggtaactcatccataaaattattccataactaattttctactgttagaataataatgtgaatatctgctgtgcaggaagtctgacattcagcccctgtgaaatggtccttcaacccccaaaggggtcatga

SEQ ID NO: 27687 - DNA, 1288 bp, Mus musculus
agttgctggtttcaggaagggtcattgtattacccaagatgtgctaagcttgaccatctcagaagcaagagccaagacagaattaagcatacaagcaatttattggggaaattccttgtgcaaaggtaggagcccagtgcagtacaaggaagaggagtgaaccagggaaggaaggaaaatgagagggtggatgaagtgtgccagcagtctcatagcccatgaggaggaccacctcatgtccatgaggaggactgccttatgtccatgaggaggactgccttatgtccatgaggaggatcaccttatacccatgaggaggactgccttatgtccatgaggaggaccgccttatgtccatgaggaggactgccttggactgcctatgtccatgaggaggaccgccttatgttcatgaggaggaccgccttatgtccatgaggaggaccgccttatgtccatgaggaggaccgccttatgtccatgaggaggaccgccttatgcccatgaggaggactgccttatgtccatgaggaggactgccttacgcctctgttgtgtgctgatcttggctgggagaagcttgtgagacttgggatctaggcaagtatggtagatgctcttgagtcctagctctggttctggtcagcacttttcttatggacgcctctcctgcctggaacacagctctgagtgttttctgccgtgaggctggagcaggggctggactctgttagcaggccccttatgttagagaaccaagcttcctatggctgttgcttcaagcatcccaagaaccatgcttttgagtcattagatgaaaggccttttgagccccctgcatgggaaaaggtgatgttggtttaggagagttcccttactgtggaaccttaccagtgtggctgattggtctcgggaggaagctgtgtttctttgggaggacttggagggttagaccctcggagtatttgttagtatttttcagtcctgagaccgtgagggtaggtggagcacatgcttagtatgatggcttgcatcaagagcgtcatgtaatgtggtaaggcagcttgtgcagaggtcaggcagcctctgagggactaatgtctgtaacgctcccgtcagtgcgtgcgttctcattacaaacacaagaccaggcctcttctagagcagtgacatgacaacagcgattagctaagtgtgcactcttagatggcttaaggtgtctcgaagggaaaggacaagcttcattgatctttatggagagttgaagaaaacaaggggcgggagagat

SEQ ID NO: 27688 - DNA, 1172 bp, Mus musculus
ttccagtgtctccagagttggggataatgggatttacttcgctgagctttggcttcatatctgtcttataccttattcattaaatctaagatcagcattaatagtcaaaaatagtgtgcctttgtatgttagctctcttctattaaacgtgctcatggctttaaaatataaaactacagagacctaatgctttcaagtgttgaaaaaaaatttcttgagttggtgatatttttactgttttgagacagggtctttctatgtaaccgttgctgtcctggaacattccatgtagaccaggctggccttgaactagctttgcaatgctactgtttatttctgggttacatctctcccagttaaacaataagaacatgaacaggaggagtgagtagtctctcttcaccacagccctgcagaaagaaacgtaagatttttgtgttgtactttgcaggtggggagttttaagcgggagatgaccttcacgtttcaatcagaggacttcagacgtgactccagtaagaagccgtctcatcacctgttcccactggccatggaggaagacgtgagaacagcagacaccaaaaaaaccagtcgggtccttgaccaagaaaaagaaactcggtctgtttgtcttcttgagcagaagcggaaagtagtttcttccaatatcgatgtccctcctgcaaggtaagggggtatcgcatttgtaggagacaggtagagagcaggcccgctctatcctgtctgtttcacagggtctagacttagcaagagctgtctgtcaagttttctccgttccttctgtgaagtagaaccaattttggagctgctgtggttaaaactgttgtagctgtagaaaaaaaatgcctggatctttgacagaagaaaatgtgaaaatacgaacagagcagaccattctgtttaaggttgatggtgcttgaaggtagctatgctcatatcctaggttggcaaattacaactcgaggctgatttagcctcggcctcttacgtgtggactatgagatgaatttaccaattcaaatgatatagaaagaaagtgattgtgacacagcccattggtgacctgtaaagccttcagtgtgtaaaagtgtttggtgatgtctagttgatgtcattcataaggtgatgtcatttttaaggcttatctggac

SEQ ID NO: 27689 - DNA, 1110 bp, Mus musculus
gtttatgcctgtttttttgtgcacgtagcccgagggtgaacagcttctacctgtaacaccatgccagtgctgaacgactttgagaagtggaactttttgggttggattctaggctgcagacactgtctgttcttctctgctcccacctcctccctgtgcagcagcctggagccttcttttgtgcaggagaaactgtccttaaattctgcatgacagtttcccacaagtctctgctctggctggccgtttccccacacttcctgtctcgccacagggtctcagcttggcagctttacctgaaggtctctcccttcatcctcagatgctgagttaatactgtggttgcaggtcagcgatggcttgccagggaagttcttgcccatctcgcacggtttctgctgcaagcagtgtatctgtctgagtagctagtcagattgcccgtgttgccagtcggagcacatgacaccttcctttgcctttcaacttttcatatgctaaagggaagaaagaaataatgctgacagcttagtttttcctggatgagtatttaaggctactcgggtgattgttaatgcatttcctgtagttatccattcagagatggtggtggtgcggaaccaggaggcttggggaatcttaggctcagcaagatagacaggcacatgcctttgaggggctacagctggatcctgctaattagcaccctttcgggaagcagctgccctttctacccattgtggtcactactggatatgtaagagactcttctagcccaccattcttcgtcacatgcatgtggactcacatacaagcatgcacacgtgcgcgtacacacccccacacccacacacaccattgatgctcttctggtttctctgcactcacattcttagttactattgtttctagctgttgtctgccaaatatttgcctgtttagagccatagcatacagtaatctctcagacggtgccattgagagaatactggcttgtatttatgagttacttaactgaccataaatacatcagcttcgaagaatggaacagcctagaccttgcaggtctccaggaacactaggctgagaaaacacaatggggaaatgtgcctt

SEQ ID NO: 27690 - DNA, 1157 bp, Mus musculus
tgcaggttaggttaggcaagctggccttgagtccttggatcctcctgtcttcccagcattgggattgatgaatgccaccttgactcactgtttacgtgggtgctagggatagatcaaactcaggttcttaaactcaatagtcagacctgcaccaactgagccatgtcctcagccctcagctgtcatgaggatatagtcctggcctcttaatccgaggttgcagctctgaagtgtgtcactcactgcgcagaaaccagtacccatctgcagtcacacgcagggttccctgtagccaccatctagtgattccttttgttttcagtgccactaagtctttatttgttcattgtgatttcttccggagaaagatggagcgaggaggagagttagggtgttagaaagctttagggaccaaggggaaagaagcctgggtaacaaagcaaaccgttcagtaagtgtgctcaagagttacgttcaccgtgactcaagggggtgagtgttgaggacctgagagaagggtccccatttttcttctcaactcaactcttccttgtaaattccagaccaagttttggtgttgagtggtaactgtagaggtgacttacatcaaagctgcattgctttctgatattactgtctagctttaggctggcctcaaaccctcactgcctgccttagtcaccagagtgctgggatggcttgtaagcaccatgatgcctgcctggcttgttggataatcttgtggccatggggatatgaatttcttctgtgtggatcaggtttccatgtggacgaccgatccattcactcttcattttccatcctggaggatttggggtaatgagatctaacggactaatgccatggagacagtcaagaattgactttccccagagggcaatggattgggaacaagagaagagaattctaacttcctgtcgggttttacagaagaactttgggctgtagatatatatgcaggagttacatatatatgcgtaccttgttgctgttttggctaaaggagaggcaggagctttgtgaggggtggggacagtccttccctggtgaagagtgcaccagccttatttcaggtgctttgccatacataggatttcctgacaaaattggtttttttttgttttgttttttttttt

SEQ ID NO: 27691 - DNA, 1191 bp, Mus musculus
ttcaaagatgaagaatttgtaaagaaagcattagaaactatgaacaaatatgaccttagtggaaggcctttgaatattaaagaggatccggatggagaaaatgctcgccgggcactgcagcgaacaggaacatcatttcaaggatcacatgcctccgatgtgggatctgggttggtgaatttaccaccttccattctcaataatccaaacattcctcctgaggttatcagcaatttgcaggctggtagacttggttccacaatttttgttgctaatcttgacttcaaagttggttggaagaaattaaaggaagtgttcagcatagctggaactgtgaagcgagctgatattaaagaagacaaggatggcaagagcagaggcatgggcactgtcacttttgagcaggcaattgaagcagtccaagcaatttccatgttcaatgggcagtttttatttgatagacctatgcatgtgaaaatggatgacaaatctgtccctcatgaagactaccgttcacatgatagtaagacatcacagttaccacgtggtcttggaggcattggaatgggacttggtccaggtggacagcctattagtgccagccagctgaacataactggtgtaatgggaaatttgggtccaagtggtatgggaatggatggtccgggttttggaggagtgaatagaattggaggaggagttgggtttggtggtctggaagcaatgaatagcatggcaggctttggtggagttggccgaatgggaggcggcagcatgagcggcatgagcactgtgactggaggcatgggcatgggactggaccgcatgagctccagcttcgacaggatggggccaggcattggagccatactggaaaggagcatcgatgtagaccgagggtttttatcaggtcccatgggaagcggaatgagagacagattaggctccaaaggcaaccagatatttgttagaaatcttccttttgacttgacttggcagaaattaaaagagaaattcagccaatgtggccaggtaagcaacagcagccggggaaggtgtgaacatggagaccaaggaaaaggaagaatggctgtcttcagtgactaggacaggagagaaaagcagccaccagcagttttgaaggagtcagctgagactgcaatagctgttgaagtgaaggttttgagaaac

SEQ ID NO: 27692 - DNA, 1723 bp, Mus musculus
tttgatttcaggtggaccgttcgatctgatgtctcggagaataattgccgcaaatagtataacattagccaaaagaatagccaaagaaattgagataatacctttgcaaagagacgacgaaagctagtcacagagaacagtgtccagctccagtgtcatccttgctgtccctggggtgtttcagatggatggtgtcactgatttagactgaactttgaggtcctgattttaaaatggaaactttttttttacagatgacatattcaaaattagatggaatatttgattattgaaagaaaatttgcatgtagtaatattcttggggaaaatatacaaaaagtatacttaatgaactagccattgaaattgtccctagtccttatgatccccttcaacttaatgtactgtttatatgcataattctcaattacaaagtttctttttgtaagtggctttctctatgttccagaagccatatttgattaagtctaaaggctgtaacaagctggctctccctgtgcagagggcctttgtgttttattaatcactgtaagatagtgcctggcccagtgcctgtcagacagtaggcagtctgaagtccacacctgacaatgcgtgctcgaagctgcagctgctgcctctaatgcgtcacagtaagataaccaccctcctgttgcgaggtagaagttacttcactgtcctttttatatttcttattgctatgccatttcacaggatcgtgctgccagagacgactgcttctagtggacatttctgcagttagtacactgctgtatgttgtaggttctgcttaaagctgccgtgctaaagagattttcacagacatcttccaggtacctggtctagttagtggcagggatatgttttacaaaaggcagctttctcattcagatccgtaccctggtgctgacctgtgtactgtggtgtaatggtgaactttttgatttctttccagacttgctgaatttcatcactgctaactctagatgctctctctataaggtcttgggcctctcaaactcaagaaaatttaatggctcctattcctttgttaaagggttaattcattgtctagccttggcccttggcatatgaacagatgttttgctcttagtatgtttgaaccttgcatttgatacaatgaagtgtttttgtaagtttcaaggcagttatcttgattttggggggatttaatatattaaagctatataatactcagatttgggcactgtaatgactatatctgtgctgttaattacatgtatttaaaacgtcacgtaccatgtaaattctattacaagacaggttgctttgcaattaaatttattttagttaagacttaggaataccattttctttcattgtattcatttgcgtatcccaggctgccctcagaattgttgcatacccgaggatgaacttgaacttgtgacggctctgcttttctctcttaagttctgggatgcagagaagatggccacaggccaccacacacagtttctgtggtgctggagactgcacagggccacacgtgtacttagcgtaagcactctgctgcccaagctgcgctccagcccatgaacacacgtggaattaaaggagtaattaatgatatcttatcaaagttaatagcctcagccctttttaggggttttgagtttagttacagatatttgaagctaatattggttatgaatattca

SEQ ID NO: 27693 - DNA, 2334 bp, Mus musculus
gtttgtcttggcattctttctgccctgcagggcatacatactctagtttctggctaacattttccagcctaattagatctcaactgcatgcttgtttctttttgttttgtttgtttgttggtttgttttgcatcctgcttgctctgtggcttgtttgtgtgtttgtttttcatgctctctttcctgtgtaaggttagctgtgtgaaagagagcatggtaaggtcaggggtgagaccacatgtctttaatagtctatttccagggctcttcaaaatctcgtatgtccagcaggcagtcagtctgtcaatacgtcctcaatgcacatcgactgactgactgatgaggtttaccttctgcccttaaacaatgagaagactggaccctgcctgtgaagcagtgatacaggagtaaagcaacaggatttagacatcactggacagtgatgcccgagagaagggagagccatgtggtgaacatgcctagtgtcctggctttacaaggggaactggacagagtcaggtggtcttggtgagtttatttttgtggggaagtgtcctagactgttatggagacagagacaggtgtgtgtgaacacaaaggagtgatctgtagtgtgaatgtttgagtgtcccccagctcacatttgcaatactacctcaatgatgatgggggttttagttagggtttactgttgtgaacagtcaccatgaccaccccaactcttataaggactacatttaattgaggctgtcttatagattcagaggttcagtccattatcatcaaggcgggaacatggcagtgtccaggcaggcatagctcgggaggagctgagagttcatctgaaggcctctaggagaagattgacttcaggcagctaggaggaggatcccccacactgtcacacttcctccaacaaggacagactaactccaacaaggccacacctcctaatagtgtccctccctggtccaagcttattcaaaccaccaaaatgggtttaggcagttggtcctttaaggatgtgcttgggtcacaagagcaggacctctggggtgggaatagtgatggaatttgaacttgaaggagtttgttcataagctttctccatgcaagaagatggccagacggtagtctctgacccagtgtgagtcctcctcaggcttgctgactgaggaatacgttcttgacatttgtagggtttaggacaatgacatggaagctcagtctaccagaataaagcacatgggtagagaggtcccttcaaggctggatctgcaaacacgcctgagggaaggactggctaaaggaaccaactgctggggacatgtggacagaccatctccacaggtcacagtgcctgttcctcatctccagttcccaggatggagagatttcttaaccatggcagaatctggttgaatccttagggcaggaggccaaattccacctatattgaaaactattctagttctatcctaagaagctcaaaagcaaacctcagagcatccaatggtcctaacacatttaaacagccaccagagggttaaacactagtaactgaaagaacaccatgatacccaatagcatgaaattctcaatcattcagcattcagatatgtgaaaaattaggaaacaaaattaaattaaaaaataaagaaaaagtaggaacagactaagaatcggcgtgggtaatagaaggcaagagttttgaagtagctcttacacgtacatttcatatgatttacacaacatatatctgcatgttagagaaagaagaacaatgtatatctgggctaaggagacgatgtccttaaaaattacccaagctgaaatgctagacattaaaccgacagcaactgggggtggggagcaggaggaagactacctcaaacagccactaatttcaacaattgagacaattaaaggtttagtattgaattggcttgatattttgatgattatttatagctgttggaaataaaaattaattattaaataaaaatgtgtttatttctaacaacaacaacaacaaagattgccactggtggtattaacaacagctaagtcattgcagaagaaacgaggtgtctaagtggagcacagcaagagatctgactgcaaacagacaaagaacaagaagagactggggaaatcagaaagaaccgagaaagagcgcatagcaggatcatatcaagtctcctagcaatgggagtcctagcctgctgtggatgggccagataagtgagttaggggaaccagacaaaacatttctggaagaaataatggtcgaatttaaaatttgacaaaaggataaagttatagcttaacaag

SEQ ID NO: 27694 - DNA, 1162 bp, Mus musculus
aaggagcttgtttagcttttattatgtttaattttaattaaaaactttatccatacatttattagaaacactgtagtatttaaataactagattctgctttatatatatattctctatgtctgtctgtctttctgcttacctagtttcctctgcctgaggttttgagtcagagcttcactgtgcagcacatgagtttgttttatacctctggctgaccttcattcatcttgctttggcctctgaagccctagaattacagggctgcattgctaggccaaacatttgtggcagaaatttacagctgatctgagatgcactctaaatgtaaactaccccctggatttcaaagacttggtgtagggaactgtaaaatatttcattaataattgtgaagtggaaacttctggtttctttggaaagtcagttgggtcagatggtgttttgctgcggcagagacgtgcaggagtgttttcctgaagtgggcaaaggtgaaaggatgctctctgctaatgccacatgtgttagttcaccttacattgcgttgctgagctctgcttgttgtgacttcgtggaacgaaatgcaccaaaaacctggtgtttctctggcagcttcttgctccttccagggacttggaccgattggcagaatgatgtcagccgatacaggctcttgtggagtttttctaggcaagactcacccactgaggcaacacatgtgctgaggcaaaacctgtggaggacttgtgatgtttggagggatataaataggactcagtgaactgtgaacagaggcttgcttgcttgcatagatagcttggcaacgcttccttggtctcaattcttcgctgatcttcacgtggttgagagagacacagcaaagaacttctcctggtgtctctgttggtgtctcatgctgatttggtggaggcctggctgtgtggcgtttgctattctgacagtactgaactggactgctggtctagtcgtgaagtgtttgagtggatcgagccgccgccgccgccgatttctatgagctgaactgctgacttcctaacaacacagactggagttgctccaaagaacagtttctaaacagtccacttcctccgtatcctaataatgtttgttttccacgacttatgatgggtggtgggctagaag

SEQ ID NO: 27695 - DNA, 1339 bp, Mus musculus
tgttttttcacgagatgaagatgaagcgcggtggctgccagagagattaattcgtcagatgaacacagattctgactcttctggtaagtatcattctaaagactaaaattccttttgtgcttaaaattcagctgagagcaacagctctcaaagctgttctccagctactctctgagccagctcccgacaggaggccggagactagcctcagctttacaatttgcatttgaataaagtacctagacttccctgaaaaaagttctgctttcctactttctcactgtctttcaagattttgtctttcaagcaggtaaatcaacactctcaaagcggaccagcagatgtgcatccccgcccccctagagcacacaggtggcagctgttatccccagactcaagacatttccagcatgtggctttcagtctgagttaaaaatttaggtttacctagagggctaaaagagtagatttttctatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttacccgcaaatcgtggtggtggtgttattaacgacataattcttgcttaggctttgctaattctgaggttgataattctcctttaagagctgcacagcactcagaactgtgcatactggtttgtgattgtacaaattcagtatggacaccgcttggtgcagaagtactgcaagggaaggtccggcttgaccgtttctgagtttcctgtgagataaacccggtttaaaagaggttggtatcatattttggttaaaaataaaaaatattttccggctctaccttgcctccccaaaaggtaccgagagccacatgtgtgggttttacccacgggaggaatctggtccatgtccacccaagccaaggttaaaagcccactcatctacagatgagaaaatcatttgatcacctcagttaagcgttgccttatttaacttaattaataggggggagagagattggagacgtactattaaaagggcaagcccttcactgcctcccacccaaataaaaaagccaattggccttgtactacaagagccggtcactccttctccctgtttcccacctatcatccaaaaatgtggagatcaactagaaagttacctaccaagtactaattagcatcttaaagtcagagcctgcagccccgggcctttcagttagttgtttactagaaaggacagtcttaagccagatacagtttaccataaa

SEQ ID NO: 27696 - DNA, 1207 bp, Mus musculus
aattaccatagattagtaaatcaaatttctgtttggtctgtttactaatatttctaaaatatcagtgcctgttgccagcccattttagaaaacaaagtcatatggtatacacatttgctgtaggtaataatataataagcagaactaacaggttcagtatcacacaactcctctggaacagaactcaggaaagtcttgttcccactattgtgggaatctatataaaagaaaaatgggattctccctgtaccttggctgcctcgtggtcaggaagtcctggagggagactagtgcctagtatttgcagaacctgaaaatttccttgttggcctcctaggatattcagcagctggtcctgtcaccttccagaccttgatgtgaaatttcaagaagaattcaaactttgttcttcactggaccctgggagaaggacaacaacaagaatgagtgtgtgtctggtaaatacaccacagggtctgttaactttcaaggacgtggccttggacttctcactggaggaatgggaatgtctcagttttgctcagaggtcattgtacatggatgtgatgttggagaattacaacaatctgttgtttgtggaaaatcattgcatacgtggaaagaatgggaaggtattggatcaagacagccagtacattgtccatgaacacatgaatattcaagagaagtcttctaaatgggacaagcttagcaatgtcattcttgaatccctccagtgtacaccttacaaaactaatcacagctctgatgctcttcaattctcgaaccaaaaaagacttaagcccaggaacactaaagaagtttgcaaatacaatgactctgtaaacagtttaagtttgttttctaccattagtctcaatcaaggaattaacatgcagaagaaaaaacacaaccgaaatgcagaattagacaagatttttgtttctaaacataaagtcatggtgaaaaaagacaatattgcagggaacccttacaaatgtagtgaatttcacaaatatcttacccagagagaaaacctacaaagtcagcagagaatttatcatggaaagaaaccttacaaaagtagtaaaagtgacaaatgctttacccatcagatccatcttagtattcatcaggaaattcatacagaaaagaaaatttacaaatgtagtgaatgtgacaaatgttttaaaaacaaattcaatct

SEQ ID NO: 27697 - DNA, 1158 bp, Mus musculus
aagcttctaccctgggagatatcccaggagttctgagggagctccagagacacctggagattccccatctgggtgctgagttggaattcctcctggagaggagagattttgtgctcactcggccatctgattctgtttctgggtgttagaagtcccccaggaggtgggttctgatctcggttatcataatctttttttgtgtgtgtgtcttgtttgtcttcctgtatgtgacttagacgatggggaagaccattagcactctccccttcgactgactcttaaccattgaactgaagttagaactggagatagtttacatgtgagaaaatgagtttgagaaaagcagtactctctgactatctggagacaatttggtaaaagagaaaaattaaaaataaatagacagtatcaattggtctttggagccttgcacctatagttaggagtctagtgtggctagagaagccctgctaggagctgattgtaaacactgctcttaaagggaccagcagcttctcaagttctatggtaaggtaactgatggctgtttttcctaaaaaaaaaaatctccgtgcttgtgattattggattcatcaggtgacaaggtgctcctcttttgaaattacatctagaaaaattaagaattttgtttcgttttaataagcaaatgcatgcagccatctcatttttgtttctgaatagttttaaaggtataaatatgttttacatgtcttggctatagattgttggctcataagttgttggttatgattaaaaatttgtaacattggtaacaaaaagttggcttaaaaatggtaactctgggttgaaataatttagaactacaacatgcagcatgagacaacccaagaagacaagtctctaaagatacgcctgaattgagtaatattctatgtaattcttatcctagaaaccagacatataaaagataggacttagggcagtgtatctttcaagtattgggggctgcaccttcttgcgtttgtgtgcaggaaaaggcagccaaactttgccacaagtagtgtttttggtgttgatttttaaagagaatggattgtttacactgttaaaattgggttttgcttcccaaaattgtggttgtactctcatgttacaagaggaattgaaggcttcttc

SEQ ID NO: 27698 - DNA, 1172 bp, Mus musculus
caggcagatttttgagttagaggccagcctggtctacaaagtgagttccaggacagccagggctatacagagaaaccctgtctcgaaaagccaaaaaaaaaaaaaaaaaaaaaaaaaatccagaatgaaaagacccctactaagaggcaccagaaagaggtatagatgcagagactaactcaaaccaactctcgggaatcccatgtacgcataccccacccccccaccccacacacacaccaaacaaaacaagcaaaaaacaaacaacaaaaacaacaggaagccagaatatacaatgtatagttttgttttattttgttatgattttaaaggagaaaaatactagtttactttaaaaaaaaacaaaaaacaaaaaaagccttacaggacataatgagacaagaaacttctaaaacgacaaaaagttcatttactgttggacatccactggtgagcagagagcatgtagtaggcattaagcatagtccaaacacatatgggcacaggggaaattttattgaacagatcaccagtggcttatgctctaagatcaagaattgacaaatggtgtggggtggtgagctgtggatagggagcctggtccctggtggagctcaggcttagaaccccagagagctggcaggtgattctccactgcaaggtgttctaccacactccttgggcttctggctcctgtcatatccacagcctcccacagtcccccacaaagatgtgtgtggccaacagtcacttaggagctgcaccaagccctcccacatgcaaataaagttttccccaagctctcagaccaagccaatgagaagtatctgctatcagaccctgacccaccccaaaactgtatataagaatcctatccagaaggattaaaggtgtccaagaactactctatcatccaacagcttctgtcataagagctgtgacatttgggaaggacactgctctcctgaaatgccacctgaagctgcacagcactcctcactggctaatcagcctctcctcggctcagccctacactattcagtgcagggcagtgtggagtaactaagatagccaggctgaacagaggtagagtcaagtgcagccgcagaagcattggaaatcccagaagacgctctaacatataacaaggacacatgctccactatgttcaa

SEQ ID NO: 27699 - DNA, 1125 bp, Mus musculus
ttctcagacctcaagggagggagccatgcctctaagttaacttagaatggagaaagaagaaattggagttttattcttttaccttagtcccttcatttctttaagggatttgtttcctctttaagggcttctacctatttagctgtatcttcctgcatttctttaaatgagttatttatcttccttaaaggactctattatcttcatgagataggattttagatcagcttcctgattttcaggtgtgttggtgtattcagggcttgctgtggtgggagaactggcttctgatgatgtccacatatattggcttcccttgcttatggtcttgtacttgcctctcaccatctgattatccctggtgtttgctcttctgggtgactctgtctggagtctgcctcttttgtccctaggttgcttcaggtctcctggtaggcctgcggccctggctctagcagatctcctgtgaggccttcaaactgttgggtcttgagaggagctgtggagctattctccagtggggcctatgggctgtgggctgtttccctgtgtgcagcagatctcccgagtgcttcagtctgtggagtctacaggggagcagactagctaacagtctgtcccaggagaaaggatcagccagaaggggacagaggttttggggggtgatgggtcctgagtccactgggctccctagtagctctgggacttaggtatggtccttacctaagtctgagtgcagcagatctcctgagatgcctcatagactagtatttttaacatactatcattttaagttgtatgtattaacatatttgtgttgcaatgaggcgagaaggatacatatttttagtgtaccaacagacagaatgcagtattgtggcttaggacagagctctgtgaatattattgttattgtaaagttccttaaataattatgttcagttctgaggccataagaactgagtagttttcagttttgaaaaattaatttgagtttaaaggaatgttgcctaatgttatcccaagaacagttattgtgatgtggtcattgtgttctttacacatcaccatctttccttagagaccttggagatttcttttatgtgcttgtttacctgtactttt

SEQ ID NO: 27700 - DNA, 1200 bp, Mus musculus
tggtagtttacttcggagattggagttgatgcctgtggagcagttataggacattactgagcaccaccaggtaacatcacagacagtgaagtggatggcagtggacccaggttataattatcccagcaagtgagagactgaggtttgaagccaacctggacaacgtagtagtaaaaggctatcaaggaatgatggaggggcgggggcaggagagaaatagaagggaaggggaaaggatgggacaggttaattgtgtagaattctacaactacttctttgataattaccatttgagcaaaatttaccatttaggcacaagttaggattcctgttttactaaagtcagtttttgagtttttcatgtgttgtaaccaagtgactttgttccgtgaatttaggtgttagatcctaatgactttcctagtctttgcttgaatctttcaagttagctaggtgtttttaatattgacttgtttatacccaataacttcacagggacagaatggacaaaagaaataccagataaatctgaagagtcactcagggcctatccatgtgctacttataaataaagagtccagttcatctaagccagtggtttttcctgttcccccacctgatgacctcacacagccttcctcccagtcctcaacttcagtgactccacagaaatccaccatggctgctcaaaacctgcctgagcagcatgtttccgaaagaagccagactttccagcagacaccagctgcagaagtatcttcaggttggtacagaggctttggtgtaaaaacgtcatatgaaaacatgaatactctatgaaacagcccagagatctatcctgaatttgtcatagctgaggcaaaataaccttattctatagtctatatgcctgtcactagaatagatattaggaagattttatggcatatcctttctatattgctagacatatacatgtgtgtatatatgtacataatgtacatgcatgtatgtatacttatagattacagaaatattcagttacaatgtttagaacttttgtgtctgagcaaatacaaacgtcactgcaaatgttaaaagcttattttatatatataactttgagatttcacaatgaataatgaagctagaaagattttactttactgatctttgacacagatcagtttttaaactttgtgttgcctatgttatgtatat

SEQ ID NO: 27701 - DNA, 1922 bp, Mus musculus
tgacctataactttgaatttttacattgcattcgttttagctgctggaagagtaaagactataactctttcatcttttccacgaagttcattaagattggtgtgactttctgtggtaaattaattctcctctaattgtccacagctggccagattccgaagcctcttgtgcacagctgagggagagagtgcggcttttttgttaagcaatcaccgtccaccacagcccttgaagggccgcagagtgagagcatctttctattagcagtcaccagtgggtcaacccaatcggaacacggaggtagcaaatacaacggaactcagacattccaataatggcttttcgagaatttcacgtttgtggattctacttgtccagcacctctggcacggcagagaaaaccagaagtctgaaataacttagcccatcactcctagatttgccccaatgtatgtccaattgctaaatatgggatgtaattaaaatcacaaagtatacctgcttcagccttcctgacaataatgtcagccttaccaacctcagactgtactaaactttatggtgggcttagactgagcctatcccattctagatagtgtttgataaaaactttaaattcactttgaactgatattattcccaaacaagcagttcttacagtcttgataattttctgattaatcaagagtatatatttcctttaatacattttctcagattctcattttatgtactgtaatatagcacataagacaaaacacacacagactaggatagaacaatgtggctactcctgtgattaaagtaacctacagttttagtgaagcattcctcaggctaagaacagctttttaagacactattccacgtaatatattcacccaagaatgttaatgactaccagggtgatgacatagtgtgaggctcatgatattaacgtgattcagaccagcaatgtatacgataccactgcagcagaactgccccgagctggtgaacagcttcctacaaacagagtgggacgctatcctatatctgctgttttttctgtcacccattaaaaagatgaaccacgtcttgcataaatgcctaagccattcattgcattttctaggaagagcttatttcccatttgtacatgttaactaagctgtttcatgattttataagatgccatttgttactaactttagactattctatctggagaggttttcttttgtattcattgaaggaagacaggcaccacattccttttgctttgccattgtaaggtgattctatactcaataaccacacttaagacttgaatatttgttatacttttggtattttgtgagactgtgtccctgggtttcttaagtttaataatttgtttcagatctctctcatcttctaaatgtaaagttaattactgaaaactttcttcatattcttcttaatagaataactttattttgagtaaattgtacttgataatgtctactgtcacataagatgagagcccaaagattagaatgaacaccttagccagtgttctcccctgccgagtccactctaaggcttagaggaagacctacatatcataaatattttatgagctggatagttaaaagatttatttaattatcttgataactgccatctatctgagataaaatgcagccaagttaataaaataattaaaataggagagctatcttttggaagatttttaaaggtaatatttattaatccatatttttataaccagaggttcttaaaaatagtttttaatagctgaatagtattccattgtgtaaatgaacaacattttctgtattcattcttccactgagggacatctgggttgtttccagcttctggggttataaataaggctgctatgagcatggtggagcacatgtccttgtggtatggtg

SEQ ID NO: 27702 - DNA, 1143 bp, Mus musculus
ttataaagaaaacagtggtgtgaaatctcacatttccaccccagttactgctttaaaagtgccgtgtccagagctgaacactgtgttttaattctaatggatctctgaaatatcattgcaaaattatcaccttaccatcaaagaacctacatttctattattgcaacctaattatatttaccattttagtggtaacaatatagctttaaatgccagatgtaatcagttaagggcactgaaaaaacctaaggaattgttttgatgacaagatgaaacatagtaattttgaacgctctcacttgccaatctatgtttccaagcaaaatgtccagtgctagtcctcttcattttgtttgtcaataaccctgaaacctctgcacaaaagccttgcaataagagctgactagacctgtggatgacaatctttcctgctagagtcttgtgctgactgttttctgtgtatttgccctgcaggggaagcgtgcggcctttgctaacttcgatccttgctcccttcttcctggaaacttggactactggacataccctggctctctgaccactccgcctctgctggaatgtgtgacctggatcgtgctcagggagcccattactgtcagcagcgagcaggttggttttctagggagagttctctatcagtggaggcagaaaagctgctcttcccagtcaggcctgggatttaatcctcctgtggtctcaccctgtggctgctgtcacagagtgtttggcagtaaagatttgctggtattagccagcaccttcggcagtacttagataggttgtttaatctgggaaagtgttgtttattgtgaggattataggagaatgatatctgcttattagcttattcttttttaacagctaggaggaaagagagtctttgaaaaacaagatttcatactgaaagttatacagatgtcagtgatagttcccagcctcttgctcatgaagagtttagcataatcttttgattgtgaggcgcacttctgaatcctgacagtcctcctggcttccttagcataaagctgaaatgtgggaaatggacatttctcaggaattccaaaaggcagatccctataatataaaagaaagcctcagccagttttgaaatgacaattattt

SEQ ID NO: 27703 - DNA, 1212 bp, Mus musculus
actgctcacttcactggcatggttctgtggcatccagtttgataattcaatttacttgtaagctgcagtagctttattctggctcccgggagctaaatgtaacatgtctaggacttggctagttattaaatacagccattattctaaattagctgacataaacccgaaattcagtgacttctactgaacaaaagcaaagaaatacttcaggctcaagagttctcaactattttacacctaactttgggtctctgcttattttatatttgctgtggcttcctggggcaactatgtgacatcatggttttgtgcatctttcccattgtctgctagtttgaagttgaccatggtggagtatttacactacagacagaaaggggccagagctgcatattagaacttttgttgctttcttgactgttgctccttccaatatagtgaaagagtagtaaactcagtgctcccaggtatgctaatcataaaacagatagcgacattcctccacccacctgcttcctgtgttcaaagagtcttaattcaaagaaagtcaccctgaccattaccggaacctgcaatacaaatgtgctattgttaggggctcttagaaactgtcttgagagttaacaattaccaggtattccttgtgacacctgtgactttgtacttccttgtgactcttaactggtatttttggtattttccaacaacgcccttcccacctccttgagttgtgtttttttcctttaaatacccccttactcagctactcggtgcgccacggtcctctacccctgcgtggtgtatgaccatgggcccgagagcgctcttgaataaaaatcctcttgcaatttgcagcaagaccgtttcttgtgggtgattttggggtgtcgcctctcctgagtcagaatgtgggggagtcctcacgttgtgggtctttcaatagcagccattaggtacctacatgatccagagagagatgtgttataagcatgaaatgcacatcatatttagaaacatttagtacaagataagaaatatactagtagcttatataaaatagtattttgtctgtatttaattatatgtttggttattgtgagagatacaataaaacaatgttcattcaattctttgctactagaaattagaaattaagtatacagcccctgttatgttggcatttaacattgctctaaattttgcacagattaa

SEQ ID NO: 27704 - DNA, 1787 bp, Mus musculus
ttttttccctgtgttcaagagaatttctttttaacagcgttgcagatctattcagatgtttaaaataatgcttaaattcaaagagttttgcttctagtgaactgtaatcactagaaaattctgcctctaggtatggctaatatagctttacattatgtaagaaaaatttttattgtttctgcttctatacaagaagccaggagttttaatctttcagtgtatattgtttcctaagtgaaaagtattttattaactaatgcttcttaaagtttaccttaaatccttgctctcacccaaaagattcagagacaatatccttttattacttagggttttagtttactacaaaagtttctacaaaaaataaagaaagcttttataattgttattaattggtaattaaaacttggttgtgcccaaaacaattctttggccagagaaaacattattgtaaagtcatttttctcatcctcccagccaatcgttggcccacttgggcccaactagcttctgtggggtgaagtcttaagacacacagtttcctctgtttcagcacagatgatctagttgtgtgctgtagacggtgttttaaaatgctgaacaatcaaaccttaatttgtatattaatagtcaatgccatatctctgagctcgcaattgcttaaattgttcatccctcagatactattaattctcaaatttacaattgcttatgcatattcctagttaataaataaataaattatgcacatgtgactcttaataacgttataagccttctagttacaaccgctccttaagaaaattgattgaaagtgcaattagtcactgcccctttacagccaagtatttaaaatatttggtcaactagttattaattcaaaagtttaggtattgtgaaattttaaaactttaacttcttaaaagacaaaaaaagagaaaaattgtatccccgtgcatactatttagtgcattcccatgcacactatttaagtcttagctttattttcaaaatttaatattttaatgtcagagtttaataaatgctttatagtatcttaaaggaatctacttattggcttatagattgatcctaaaacagctaccttattagaaaagggaaaaacaggttttctccacagaacgctgcagaagcatattagtaaattcgtgtgacgagctggtaggtaagttggctcatgtcctgattgaattgactaaaaaactaaattaaattcatgttttagatccatccttacttgccatttttccagtttagactagcttctagccttttaactttatggcaatagttcatcagagactatatattcagacttagtaaaattagtcatttaatagagtcataatgatttttctcctttcttcagtgtgaccagccagtctaactcaatcttagattggtctaatattcagtccaatgttagagattcctatattctaaattacctagcaaagttaattcagagcacatcccccactccccctagatccctaacctcagaaggattgctggccttacagctactagaaaaagctattaaagagcaattggtcacttaatacattggtaaaataaaaggaccccctgactaacaaattgaagggtccagatccagttctaatttggggtaggggctcagtttgtgttttttcacgagatgaagatagagcgcagtggctgccagataaattaattcgtcagatgaacacagattctaaattttctaaagtatcaccttgaggactaaaattcctcttttgctt

SEQ ID NO: 27705 - DNA, 2022 bp, Mus musculus
caaccacatggtggctcacaaccatctgtaacaagatctgacaccctcttctggagtgtctgaagacagctacagtgtacttacatatagtaaatagatcttaaaaaataaataaataaaataaataaataaattctgactaactagataggtttttgcctacctttcatgcttttacagctgtgttctgggtttcagaaatcaaacatagaacaaagaatgagacatctgtcatcagagttatttattttttcatcagtagagactggtttttaattttagacaatcagaattattttaaagaaattgcctttttattagtttccctctctttaaaaaaaattctgtttttttgtcaaagtaaagcataacaagataaaaagaaaatcatcattgaagttggacaaggcagaccaataaaaggaaaagagctccaagagaagtctgaagagtcagagacccactcatttatacattcagaagtcccataaaaatattaaacttagttataatatgtacaccaggatgtggtgcagacatgtgtggggccctgtgcttgctgtttcagtccttttgaattcctaggagcctggttcatttgatttggaaggctttagtctcctgctgtgtttcatctctcccccgcccccctctggctctcactcctgcctcctttcatacagttccttgcctgaggtctgagggcagagagttgattgagacagtcaagagctatattttccaaggcctctgctcctccctccctccctccctccctccctccacccacccccctctcccttcctccctccctccctccctccctccctccctccacccaaccccctctcccttcctctctccctccctccctctctctttttctctctctcctccccccccccccccccccagtgtctggctgtgggtccctgtatttattcccatctgcttcaggaggaagcttccctgatgatgatggttgagtgaggcactgatctatgagtttagtagactattaatagttattttcttgttactttattgttgtttagaccagtagtacttggttttatcctaggtctctaagctatctagtttttggttcgtggtcacacaagcagtgctggatatgggttccatcttagggagtaatcagatactggttggttactcctataagctttgtgtcattattgccctagcatgtttttcaggcaggatcgagtgtagattaaaagttttgtggctgagttggtgtttgtgggttttttgtttgtttgtttttgttttttggtttttttttgctttgttttgtttttggtaactagtagaaaattgtcatgtaccaagacactagaacattccggagattctatgtaggcactagctcaactttgagttgtgttggtgttgtcttcatcaatggggcctttgtggaaaacagcctattgtcttggcaacagcctgggttgtttgtggattttagtgggacccctttggccagcaactcaattggatataacatggtcctagaattggaagctttgtgtgacagaaatggccagctgggactctctcccatgttatttagaaacttcattaagatcaacttcatatattttaggaggtttccactgtactaattttccctattactcagttctagctcacattctccactcacattcttccccttaaccctataatcccctccccctacccaaatgatcttctcattccacctgctccctcctcccgccgccacatccatgtggggctttgggtgtgggggaagaggtgggcaaggagagagcctgtgtctggccagagttcctgtgctctgggcaggtggacgtggggaggactgctaggtgctttccactcggccctgggtgggcatctggctgtatgaagccactgacctcactcggtggaggttgggggggtagggggtggacaaggggtagcccctgtatcaggttctcagtctccggcatcccacactggatatggcagagg

SEQ ID NO: 27706 - DNA, 1089 bp, Mus musculus
ttattacctcaggacttggggtgtgggaggcaggaaataatagtatcaagaccagtctgagaacatgacgagttagaagtcagtttggcaagatcttgtctcaccaaaagaacaacaaaagttgtaactgtgtaatataaaatgtagtaagtagtggatagcataaaaggattcccttagtatccttaaggcaagatacagaattttctttcacaatttctctctttcactcttgcgtgcgcatacacgcgtgtgtgctcatgcacacacacacaacatacacatacatgtactcacatgtgtgcacatatacacatagtactttggtaaaatttccttctgttatattcttattcccttaccctctaacccagtctccttctcccctttcgtcgttttgtgtatgtgaagcctactacagttagagttgattgcgtgagcttgggtagaacactactctatcccagctgtcattatttccctgtaactctattgagaataatggattatgagtagtctcttcttatccatagtatgctttgaacccaatcttgtgtgcattttgtttacatagccactgttcctgagagttcttagatataatagctgtacaatgtccagaagatagatgttttcacatgatcacgatatcctatgtagtgctaagcacccaagtcacttcttaacacttggatcatggaccagctatgatttcctgtatattaattaccccctgctacaagcaagcttctctgaccagtgctgaaagcattgttagtttatgaatataattattttgactccctatccatttagaaaaggaacagtagtaggttactttttagggcctatgacctcccgttcccaagcatgatcttttgaccaggcttacagtattacatttgtattccacacatctaaaatctgtctgtatttattggttacctctcagaacaattatgccagcattgcacgcttgagtacatcttgcctgacatattggtattgtttgcaagctgggtccacacttgatgctttttttcccataagatccactgtcttttgacactgtgaaagctagccagcaga

SEQ ID NO: 27707 - DNA, 1155 bp, Mus musculus
ccagcagcctcagccattaattcaaccaccaccattggtgcaaagccaactgcctcaacagcagcctcagccaccacaaccacagcagcaacaaggacctcagccacaggcccagcctcaccaagtgcagtctcaacagccacagttgcagaatcgttgggtagctcctcggaataggggaaccggcttcaaccagaacaatggaacaggcagtgaaaactttggtttaggtgttgtgcctgttagtgcttcaccttctagtgtagaggtgcatccagtgctggaaaaactaaaggccataaacaattataatcccaaagactttgattggaacctgaagaatggacgtgtgtttataattaagagctattctgaggatgatatacatcgttccatcaagtactctatctggtgtagtactgagcatggtaataagcgtttggatgcagcttatcgttccctgaatgggaaaggcccactctatttactcttcagtgtgaatggcagtggacatttttgtggagtggctgaaatgaagtctgttgtagactataatgcttatgctggtgtctggtctcaggataagtggaagggcaaatttgaagttaaatggatctttgtcaaagatgttcccaataaccaattacgacatattcgcttagaaaataatgacaacaaaccagtaaccaattcaagggacactcaagaagtacccctagaaaaagcaaagcaagtgcttaaaataatcgctactttcaagcataccacctcaatctttgatgactttgcacattatgaaaagcgtcaagaggaggaggaagccatgcgaagggtaagaaagaatccagtaatttttgtgtgagaatccttccttataggtggagtgtgtggaatggtattcctttaaacgttttgcagtctatgaattttattctgaaaggaatcaacagtttaagaaacaactccaatcccctccctttagcttttcgatcttaactgttagcttcatgaaaaaaaaaagtttgaagcactattttcaaatgtttgctattgctttgttctgttagaaaggtggtctgagtgtgtgtgtgtgttttacaaaactatagtatataatttataggaccatagcaggtgtaacaaaatagagctaga

SEQ ID NO: 27708 - DNA, 1099 bp, Mus musculus
tatcttgaaataggccttcagttttggagttgtttaagaggtttgtagtgatcatctcactgtgatatatggagagagataattagtatttgaagagctaaatctagaaacgatttatatgtacctatagttaaaatcacttcatagtgattatattttgttataacatttatatttttctttcaggagagaaatagaaacaagcaataaccaccgtgtggagatgtcctattaaaatgacaacactaatgatgtagactctggaaatgcctaataagtcaaagaagatgttattaaagctttttgttttctgcttaaggtgacatctttgaaccctttaacatgaaattgattcttcttgtaatggttttcatcagcgcatctgcccttattctctcaccaaacacacttgagaactgtaacttcatgaagcactttgtgtcctgaagcttttaccagtacctgctgtcttttgtaattatgcatcctagctaaggcacagaagactgaatgaattgcaaggattcattaactcttggaatttgttaagtactaacagttatccattagaagtggttcaatgatgtaagagtctcactgcttcaatcttttcattgtcgtagtttttaaattgtcaatttttagctatttgacagattaaaagcaaaataatcatgccatatttagtctggagttcaagtctgaatgtttatgtgaaaaattattgtagcaaacttttaatatggcaaagcaaccttatgctctattttagccaaacagtacataatctaaaattatatattagaacatttcccttgtcttcaaactatttgatgtaacaaatatgcagcctggtgggcttcaccaattaatgcacatcccctcctctccagttacatgtacactgagaatatgcgttggtttgagggattattttgtttctaccacttaatgaatctcaacattttgagtaaatgtacctcagtctaatcagactttttatgacctttataactacatttaaaacccttaaattctatttctgggtgtttgcgagcctgattgctatcatgaagtaaaaatttattactctaggtat

SEQ ID NO: 27709 - DNA, 1675 bp, Mus musculus
gatttgatggtataaggttatgaaaataatgtcctgccccttatattactgttttgaaaggagaaagctatgtagaatgatatgttaagggtgaaaatagcaatacagtagatttgaatgtctttttgatctgcattagttcatttatgtttacatcgtagttagagatcttttcatttgctcttgtctttgctcacttcaatttgaaagcctcatgacacatatttctttgaaactttgatttatataatttttataaaatattttaggatgtacaaatattgtatttttttattaaaatacagtatttgtaaatgaccatagctacttcacagttacttgttagtcccagtgtagttatatcagtgtttactgaagggaacacaaaaatattaatggtatattacagaatgaaaactttcttaaaggaaaattgcacctattttacatttttgagactaagccatgaaatcttgtaatatgtctcttaactatttataatgaaagttggcatttgggtatagtcagcacagcaatgttctgtatccttaggattgtataagtaggacattttaaagatgactcatgtcattctggagctcctactagagaaaactgtaaaaagggtgaccttgtaggaaggagctgaggcctccctctgagggtctctttttcttggtgctttattagcaactctggatatttttataaaactagatacattagaaactaattcagtcttgtttaatttacattaggttttatgtaagaaatgtcatcaaaatacccaatgagcaggctgattgcagtagactcagacagggccagtgaatctcagctgagagtctattcgtggtgaagagaacatcccagtgcctttaacctgaatttctaatcttatgtgaaatgggtgcagcattcctttggacaaaagcttccacttggtaatttttgtgtttttctcactttaagtattccccaaagcaccaacttctcttccttcttggtcagtcagtatattgtaagattattttccattaaatgacatcattaccggttgtctctaaagtacaaccaacagaatgtttcttaactgcggggaccaaaagggagagactctgagctctacaagagtatatatataataaaatgtttgaataatattaaattaagacattattggtcctgtgatttcttgctcagtgtttttccaatttgtcatttgaatgattcttactaaagttattttatgtgggtattttatttttaatggtattatagtttgtatatttaacagtaagggggaaagtaaccaaaattagtattctttcactatacatattggtacttgaaacttcctttaaaaaaaatcaacaaaaaactcaaacttttagtgcttaattcctcattttaacctgtgatctttctaattgaaaagctgtgttatttttgactaccatgcatgtggggttaagctgatgttgaaacagtttgcagttaaaaaaaaatcttaatcagcttaagtcattcaatcatttcaagtgagttctgcatcctttaaaagtaagtttgtgagattttaagagaattgtgttttcattaaattttgtgtattttttgttatgccatgtaaattccctttttcctatgattaaaggaagggtatgatgaaatg

SEQ ID NO: 27710 - DNA, 1215 bp, Mus musculus
cagtacacttgctttgtgtctgaatgagtggtgagtcatgtgggacgttccaatagctgctgagggaggtttatgttgttgtgtttggattaaatgttctgtgaatctctgttctgtccatttggtttgtgacatcactcagctccaacaattttctgtttagtttttgtatgtatgcactgtttatggcaagagtactgtgtgagggtcaatatgtgatttcagctgtatctattgtttcttttataaacttgaatacccttgtgttgggaacatacatgttaaaaattgtgatattctttcagtggatttttcctttgatgagtatttggtttccttttctatctattctgttagttttggtttgaagtctattttgtaagatattaaaatatttacgagttgcttcagtgtcctggtgcggagcgtcacgtctcgtgcgtgttcattcagccacgatgcctgaggaaacccagacccaagaccaaccaatggaggaggaggaggtcgagacctttgcctttcaggcagaaatgttaatgtccttgatcatcaataccttctactcgaacaaagagatctttctgagggagctcatctccaattcatcggacgctctggataaaatccgttacgagagcctgacagaccccagtaaactggactcggtgaaggagctgcacatcaatctcattcccagcaaacaggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatctttcacagtgaggactgacacaggtgaaccaatgggtcgtggaacaaaggttatcttccatctgaaagaagaccaaactatttggaggaaaggagaataaaggagatcgtgaagaagcattctcacttcattggctatcccattactctctttgtggagaaggaacgagataaggaagtcagtgatgatgaggctgaagaaaaggaagagaaagaggaagagaaagaaaaagaagaaaaggagtctgatgataaacc

SEQ ID NO: 27711 - DNA, 1297 bp, Mus musculus
tacaccctgctgccctccccatgctcctggatccctccattatcctctatctagacaaggtcatagcacataacataggctggtctgaaacttgcattcctccatcctctttaaatttggaaaatactaatacatcccatttgttttcagcagtattttttagacatgataggaaacaataatttaagaatgtaagagtcatgtcagtacctggcttcaaggtacactagaaactcaagtgtttccactttcttctaaaatatgtgacaacctgactttgtccaatatttctaatagaatgttttctcataagcataagaatgtattggtaccaaatactttttttaaatttgtttctgtattgctggggttcacacccaggactttgtacataccaaacaagaattctgctactgagccccagccctaggcctggactctttgagcaggttctcttctgtgtttcaggacacacattgttcttgcccccacttctcaggtgctgggaagatagacaggaaccacagtgccaactgctggctcgttaattctgcagggagtcaagaactcagaacttctttaaggatttgacaaatgcaagatgggattctccttttatgtaagcatatatttttacaggaaaaacacagccatattctacttaaagccttttctgaggagcaggattgtcatttgtgacttagagtcctatataaccattgctcagttggactcttgggtagttaggaaccataaataattcacagaaacaatagctagtttaatatgaactgatccgattattcaaaagcaacatggagaaagaagatcactgtgatatttgtgattggggggggtactttcaataagcacttgcataagacattcaaagtatagctttcttctgatttttaaaataagttagttcaatggatatgttataggggttggagaggtggcttaggctcctcttccagactacctgtgttcagttcccagcacccacataacagctcacaactgttactaacttcagtttcagggatctggcaccctcctctgtcctctaaaggctccaggcacacaatcagtgcatttaacatatgtgcaggcaaagagtcatactcacaaaataagaatagatctttttgcaatcaaggatgcttggtacttggtaacaatgtttttgaaaggcaaaagattacagctactattttttaaaactaacattaagaaataatggacatatcttgaatttaatggcaaatgcctcagagtttattctttcaagtaaaca

SEQ ID NO: 27712 - DNA, 1286 bp, Mus musculus
cattgttaattgcagttagcattgttgatttggtgactgaatagatagccttctttaaaaattcagattcaattccacatagttttctaaaaaagaaaagcttatctgaagaatatttagaatttcgaatgtcgctctcaagaatatctctgcagtgcctctctgtcttatggaaccacaatgaagcattcaatccaagggcagagatatgctgggctgggacaaaagccacattgaggaacctcagcttctgttggaccttgtataaggctgagtaaagtgtcagaactccagcatggcagagctaaagcattgtatgtctggggtctagttgcaatttatcttttactatgtttagctcttttaataatcacttctttgtgtctacctaatgtccttctgactaaaaggtgaactgttttggaatatattaatttaagagaccactactgtccatcaaacaaaaagctaagactgtattcatgtagtttctaaagtctataaaagaggtatactctttttttatatacttacctggcaggggagataccatgatcacgaaggtggttttcccagggtgaggcttatccattgcactccggatgtgctgacccctgtgatttccccaaatgcgggaaactcaactgcataatttgtggtagtgggggactacgttcgcgctctcccctgtttaaaaaaaaaaagaggtatacccacgttgttgtaaccaatgtacctgatacctccactaacattatgccttgatttgtgactatcattgttcagtcattgttaaagcttcataaaactgttaccacattagaacatgtaattggaagaatctgaatctctagtgtgactggccatggagattcatattggttcctgagtaagctatttcttatccagaaacagcttgagatgagagctttatcttgcagtgacatgtctcagtgtagatatctatgcctgaaggagtctttttcaacaagctttgatctccttctctaagatagggtctcatttcagaaagatgacaaaaccaacgctgaccagatagctcttccttggcctcttgttttctctatagtgccatggtggaccactgtgatgactagttccagacatagggactagcagctatgaacaatgtcagatggtttgtgctataagatccttttccacagagtgagttgtgtggactgagaggcctggtttgcagtggttgttatcccaaatgttctagagatctctgtgctgagctgattggagagatggtggctggt

SEQ ID NO: 27713 - DNA, 2257 bp, Mus musculus
actatgtatgctgcattttacatcttattggacattttccgcacaagacagaggctacaggtcaagtttgtttatgaaggtattttggtattgttttcctttgcttaattgcctcacattttgttctgaaaaacatgggtccactgttaaaaccgaatgtatgtgtagctttattctgtttcacaggcgcatgtgattggaaaactcattttctcctccagcctcaggagacttctaaaaagttttgcgtagctcaagttgtgcatgaattaccgaatatattatttttcagcttttcttcatgaacgatatttgacatgtgctttggtacccttctctgaaagttgaaaacctacctacttagtcccttctgtgccttttttattttgccaaccatgttttatggaaaagacattagcaattacattttgcaaatggaattatgttcatttgaacatagaagtacctaaaaagaaaaaaaaaaaacctctacaaaaagctgtacagtcatacttgctgtaattttaataagattactgtaggccagttaaaacacagggatatttgctgtaaagtgcttttggaaggatttgaatgtggccaagcctggctctgttgactcctgctcaccagttagagtggcttttaagaattaagtccactgtgatgtttgagcagcagatggtctcttggccttactctgtggtgacactgtatcctgctagagaaaattaatagtttaaacaactgacaaacttgaaaaggaaattggatgcctagaatgccgcagtgccaccttggttggtctgatgtcagacatcaacacatacccatcccagagatgctgggcttattgcctttttgtggttattaagaaagggctgcagtcagtttgactaaaacgggatccacgttattgcttagaaaggaagcaagccagcagtgatcacttattcttattcttcatatctatccagaaaactgacttcagtgaaggtaagatatatacagacatacacttgtgtttttctttaagactgaagtacacgtatgcgatgctttcttaagattctaacatatttgacaactaatatttctttttagaagtcagctaaatctatttaaaggcaacatcattaaaactaacaggaagaaactgaaatgcatctttaccaggtagagctgctgttttgctacttggagaaagtgaagggaagttggaccctggagggtttccttacatctttgctgtctctctcttagagatcattgaagccatccagtgttgctgaggagaaataaccgtacaatcctatggcccatgagaccattaagtttattaacatttggctttctggaaggagggtgttgaaggcttttagagcattttccccacgtctggtctctgattcaagtgctatgtacaagcagaaagcagacattttcagggcacatctctaagctgtgtaactgcttgctgccagaaccagacgtgttgaagacaaaacaacaaatcacctcctttctagatccattaaagcaaagtttactttctgtttcaacaggtttttattttattttgcattgtcacacatttatttaaaaactgtagcccttttggtagtgatggtccaggtcggttggtatttcagactgaagtttgtgtgtgtctaggtgttcaaggactctcagagatctcaaggcaactataatggcagtttttgaaatatattgtaagataataaaagataacaatgaaaatcaagcagttattgtatttttaaatttttatttatcaacttcccgcccatccatccatccatccatccatcctccatgtctctgtgtgtacatgcctgggggagtcaggagactattaggtcacgggagctggagttacaggcagttgtgagctgtctgatatggttctgggagttgagctcagtgctctgcaagaataattcatgttcttaaccactgagctatttctctagccttgggatattgtagtataaagattgatacgtacgtacgtgtgtgtgtgtgtgtgtgtgagatgctgggtatccatccagtgactcaggattctttttaagcttgtttgaaattatctatttatacatttagagacaaggtcttactatctagtccaagctggcctgaaccttttatgtggcccaccttaaccttgaactctagattctcttgcttacatcctgaatggcaggtatcatcatgccaagctctttggcagttt

SEQ ID NO: 27714 - DNA, 2510 bp, Mus musculus
aaacttagtttgtttggaaatccaaaacttacagagaaacctaagtgaaaaaaagcagagtttaaccctgggtttcactttccaatgttaaattttccctgcagggttttatttttgtctttaggtataatgaagtgaaactcaatctaataataattttcattatgataaagtatagtgtttgtattcagattttaaaagatttactcaaaattagacaggatcattttctcctaggggtgcctggtgagttttcccagtgagatctgacataggcttgtgaggtatatgctgcaccacacagagactgagtagaccacacgaataggaactccttcctgcctgttgtttgcatgaagatacttgctgacttattccatgctttggatttttttttttttcttttccagtttggcccacatatattgaagtctacagggaaaatgaaggctttaattgaaaatgttcccgactcctaatggacaatgaattcagaaagactcctggttcaccagttggcttgcagagctgagtttgtctaggagaaatcaccagtatttagtaaattccttgctgtagtgttcattggtctccttccttctgagcccaactagaggagtaagaagcagtgaaagcagcaggaggtctggcttctgagaggtcagctctggagctctccctaacacacatgtactatgtgcatgttctgttcttaacactaaaatctgtgcacacatttcaccatgaatggcatcagagaggacactgttatcttcctcttcactgagagttcactagtcagtgatggagagctggtatactgttattatagcacactattggagctgggaatgcctcggacaggacttgagtatgttctcactttctgttttctggagctgagtttacataaacagcagaagatgtttactgctgagtctctgtgttgctttctgttagagggaagtgaggaccaggaaggccatttacacctcattaccacccactactgggaagcaaatgaacttctcaagtagtaacaaatcaaactattgaattaaatcatttcttaaataaaagccagaatgtatcatctttctcatcagtttaataagtggccctataaagatggatgatttgttgctaagttaaaaattgtcttagttaaggttaccatcactgtgatgaaacaccatggccagaagcaccttgggggaggaaatggtttatgtcactcacagtgccatatagcagttcttcatcacaagcattgagggcagggactaagcagggcagggccctggagccaggagctgatgcagaggccatggaggctgctgcttactggcttgcttcctatggcctgctcagcctgctttcttatagaacccaggaccaccaacccagggttggcactaccttccccatcaatcactaattaagagaaggccttgcagccagatcttatggaggcattttctcaattgaggttcacttccttttagatgactctagctgtgtcaagctgacaaactagccaccacaatacttctagaaatgtcagcgtaattgaatttataattttaatatactggtcaaaatatcctttataatgaaacattactgaatagatgaataagttccctttaagctatttattattggtcagccaatgaattacattatgcagataaaccttcggtgttattagaaagtagaaaactacctttgttatctagggcttggaaggacttatctaaagtacttagtagtttaccatgatttttgtgtttctgataagactctttaatgtcagaatctcttaccatgagtaaatatttggattatttaaatctagactattggttcttcccagagtttagagatgggaagtgtagataatattgtaagttattgaagataggtgttctaaatcatacaaagactgggctattttttcatagcatatttagtttaaattgtggtatgtttttgctgtatattgtttctaaatattttttatggtttgaaaactgtcttttatgaaattcagaaaatttgtgtgaccacatattttgacctaagagtttatatttatatcagtattgaatttggctagcagtctactatataaaagttaatattttaaaataaagtaagctgttgaattttcttttgacaatactattatctatttgtatatttatctccctctgtctttcctttgtagctaaattctttgtgctgatatgttgctgtaggatagcttgtagtgcacttttttaatgagtttttttttttaatttatttattatatgtaagtacactgtagctgatttcagactcaccagaagagggcgtcagatctcattacggatggttgtaagccaccatgtggttgttgggatttgaactcgggacccttggaagagcagtcagtgctcttaaccactgagccatttcgccagcccgtagtgctctttttaaaaatttattttatgtatatgagt

SEQ ID NO: 27715 - DNA, 1140 bp, Mus musculus
gataccgttcacgttttagatcagacgtatctgctcctacttcctagaagaaagtacaagtgttagtgaacccactcaaatgtttgcccagttttctagaaaagctgaaactttagtaattctaatatatccaaaatattttcttttagtataattaaagtgggttgctaagtctctgaaatccagtgtgtgttttaaacttacagtacatctcaatttatactagcctcatttcaagtggtcacccatgcccacattcggctctcctattagcatgggtacaggataatagtcattacccaaagacagccactggcccctcctaaagtgacagcatatttgaccgtccggggtctgaggaagtctcctgcaagctaacattaccttaaacaagttcacacagtatctgataactgcaaagaaaagtcttggtattttaatttgcaatgaaaaacataactaccaatctttctccctttaggtaaatcttcagaagccaaattaggatcagctggtttcctcagcaagaattctgagcaagggacacaaagtttcctaaagcatccatctccctgtggagatagctgctactatcatatctgtgaactgggttcctcctcccctggatgctagaggttctctgccgctagcggcttctatacattggcttgattggcagctccattgtgttcaagtttaatagcaggaaggtttagctttcctgactcagcttctcaaagggtcaccttagtggtgcttgcaaacccatcacatttgttttctgcagctgtgggaattacctgcctcaacctattttccttgatcagctgggttttctacaagaatttaaggaaccatttaggtcactttttaaaaagcaaattcattaaaaaaaaaaaaaaaagcaaattcagagtagcacaaaattcatggtatttcatgatatattggacacttcaaagaatttttgagtatgtagcagccatttgggaatctgggcccactgctgaaggggcgctggggtaggttagggagtctctgctctagaggtgagaaaaaattttaacaagtcttgtcctaacatggtcatcaacactgtactctaaacatattagtttgtaatgaatctccgtattaaaa

SEQ ID NO: 27716 - DNA, 4931 bp, Mus musculus
cttggttctggatcccatgcacactgaacacaacatgtcaggggctcctctctctcttcagtgctcttccccattgctggagtcgatttaaacttggtacaatgagatcttttcttccttaacacccttttaatattttgtttgctagatggccttgaaatgtgctgatatttgtaacccatgtcggaactgggaattaagcaagcagtggagtgaaaaagtaacggaggaattcttccaccaaggcaggttatagacacatgtggataaactcagacccggccatgtataagagcctcacagtacatgcattatattttaacaactattcatacttcatgtatgtataaccagtaacagacgaaatgtgatttgaaactgagtgaccttgggtattcatgatggcacagaaagtaggctggaaacttctctgcagaaagattgctctgaaactaccccatcacttcaccatgtagagagcaggatcataggagcatgtgaagcatgtctgaaagaactgacagcattagtcttgggaggaacacccagcaaaaactgttgtttggtccaatttagcaagctttccatgtgtcactaagttaacatttaatcctttcatgaggattccgtaatgctcctccagtaaattcatagatagcagtgaaggtattcattatagatttaaccagcagatgtgttgcatcttaacagttctctttcttaaatttacaggagatatagaaaaaaagtaccatttgggtgtgagtccactttgtgatcgtcagactgagtctattgccaacatccagattggtaactatgcacatttagttgcatctggtttaaaaaaaaaaaatcactcgttttgattttcttaagactagactagaaaattattcaaaacaaaagtatcaaattatgttcactgtaatttgtaggacatcttaaccattgtcacagtatgtaccctttgctctgccagcccctcctgtctgcttcaggggcttttcttgatggctcaaatgtcccttccaaaagccaccttcccctgcctgaaggcagtcagtccccactgccaggtttccagagcactacattcacacaagctttacttgcttttggccacgctgtgcctagaggtgggaagcacattggaactgttgagggagctcaccatgtactgggaagcacggggacatgtcctgtgactatacagaagctcgcagagaacccgggaaggactgcctaaggctgagtgtatcattgggctttgaaagcagagaaagatgtcagctctagagtttgggctgaatatattatggggacctgggattgggaagggccttacaatttatgctgaacatcgtgaaggttgttgataaacatcatgatggtcaagtttctaaaagctcaggactagcatagtcataatgcagttgggaggggacacagcagcaacactgacacctttgctgtgcttacaatgaacagcagggactgacgtgactgtgtcagacagagatgtaggaaatgggcacagcttgcatggtactgcgcctgtgggaatcagtgctgactccgtggcaaagccggatagttgtttttctgttgggtggagttaacaaggcaatagaaaggctgttttgattctcaaggagagctactcaagttcaaagactaagtgaactgtaggcaagggagagaaagctacatgagtgggtacatgcagctcccgtaaatgccttgtagcccgaggaaattactctagcctaaagaaagaactttcaagtgatttttgaaaactttgtagtttgtgctggagagatggctcagtggttaagtacttgctgctcttttgaggtttgttagcagcacccacttcagtttgctcctacataactccagcccttagggctatgacctcctcttgtagcctctgcctgaaagcactcaaatatatataaaatacacaaaataaaaatatgtggttttttttaagttatgattttagtcgcgcataacaataaatgcctaaaatctcaccagttttggaggagggaagacctgaagttcaaggtcatccttagggacatgtgagactctctcaaagaagaaaatgggggctgctgagatggcacactgggtaaatgtaccctgccatcaagcctgaccccggggacccacatggtggagagagaaccagtgcccacaagctgtcctctgacccccacgtcttctagacagtctcactttagtagtgaaaatattaaactattttttttattattttaatactatctcttagaaattttgacattgtacattctgagttaaataagtcatgccaggtgtaatattccatccctgaggaagtggccagcagttgtctccctggattgtgttctagtgcccgtagagttgatatggccatcacgtgtgttagcttaagatgtgcttgttcagctgagagaaatagattagaccagagctccactgaatacttcagaaatcccaatttgtaaatcacatgtacacacagaccttttaaaagctaatattttggctgacactggagtggaactgaagaacattaaaactctagatgttttaaagattaattcaagacatattttaacagctttttcctctgtctctcaaggttttatgacttacctagtggagcctttatttacagagtgggccaggttttcagacacacggctgtcacagacgatgcttggacatgtggggctgaataaagccagctggaagggactgcagagacaacagcccagcagcgaggatgccaatgctgcatttgagttgaactcacagttactaactcaggaaaatcggttatcataaccctgaaccagtgggacaactccctcctgcaacattgtggaaatgtgaaatggtcttgagtggaagaactggttctgactgctgaggtttccaaggggatgatgccagcattatctatcaagatgtcttctgttagatcatacgagcgcacgttttaatggtaagacatgaatatacagcaatatgcatcttgcttttgtatgaaaccttaagtctgtaaagctcagcaggagaaccacaaagggttcttaacgaaggaagatgatgttttaggtgtgccatgtgctttcagagtgtgtgtccttcaagccctgaaacttgaactcaacctcagcagcaatcttgatgcaaccagtccagtccaacagcgcatccgtcccttccactacattctctctgagaaaacagaaatgtgaagtgcccagcctctgctgcctctggcaagaatcaatcaaatgtttacaaatcaaatctgaactattggttctaaattgcctcggagcatcgttgtgaaggaaccactgaccgttctcagctgagctggagactgcagctcttcgcagcatttgccttttcttcttcggatgtcaatgtcatcatcgcctcccacctgctgctctgctctgtgcctggagactgagcatttatttaccacagacgccacacgaagcttttcactccagcgtggttggcaatgcagattccttttttaactgttagtttttaacatggggtgggagggaaggaacaccactgtcctagctgtgttctgactctgcagtgaagacactgcatgttgttttcactactgtacacttgacctacacatgcaagcaaaaggtggaatgtttaacataccataatcagctcaggggatttgccaatctgaaataaagtgggctagggaagtgtgtccttcaaatcaagggtactaaagtccctttcgctgcagtgtgtgagaggtatgttgtgtatggctgtatggatgtgtgtttgcgtgcatgtttgtgcatgtatggctgtgcatgttctgtccatccatgtgggaaaggattagaagtgtaagttcttatttattgttctagaatgtgacatagtgagcagccacacttgggggaggggaaggtaggtgaagctgtaagattgctccagatgccttaaactatgcacaaagctaagtgaccaaacttctcattttgatttgaaaagtgcattgttttcttgtcccccctcccccactttgatgaaacattaccctttggcggaccttttgatgtgagtagatgttttctaggataaaatttaaggactaattttagacttaaaacattccacttttgtaagttgttttcagtggtcttatgtagagcaagcacaactgtaacctagtttaagagaaacggtgctttcttttagttaccttctatttcccttgttactgtttaagactgttcattatgtttacagtttgttgcaacagccatcttgggagagaacttgagtgtaaagccatgtgtgaaggcttgggcacactcgtttaaacacgtgcctgttgcttcaccttctgattgacaaataaaaccggtctttgctcattggttaatctttgcactctaccttaccactcagtcctttggaagtgacatgctggattcttaggtgatcagttagctgctgcctctcccgttcagtcctgggtattttgaagtctaagttgtatgcagactttgtcttcctggagtgtatgagcctcactctgcaccgtacaagtgtggcaaggtctggttccgtttggtcattcttgtatagcatttgttggaaattgcctaagaaatcacacccttgaaagggataaaaatagcagttgtgtttgtattcctggccttttacagcagtaagtaataaccacttaattctttctttcagatagcctggtaacaatgtagacagactggcctcaactcagatacctccctgcttctgggtcctactattaaaggtgtatgccaccatccacagtgccaatagagtggccttactgccctcccaggcctaactcatgagaa

SEQ ID NO: 27717 - DNA, 1178 bp, Mus musculus
gtgctctcctccattgtatttctggagagcatgcctttgctgtataccataatgtattagttcattagtggatgggtagccgagttgtcacaagtcttgattgtgatgaacaaaacagttatgaatatttgtgttcaagccatctcttgccaacacaagatattgtggatctttttatttttattttaaccatttgtggatatattactagtagtaatcgcacctggtggtttcaggcagcatttttctgactgttaagtatactgaccctatctcaccttcttttttttgcatttttggttttgttttgttttgttatttaattgaatattttatttatttacatttcacatgttatcccctttcccagtccccccccccaagaatcctactatctcacccccttgctcctgcttctatgagggtgtcccccttcccacccactcctgccttcctgccctcgaattcccctacactggagcatcaagccttcaaaggaccaagggcttttcctcccattgatgaccaacaaagccatcctctgttacatatatggctggagccttgggtcccggcatgtgaactccttggttggtggtttagaccctgggagctctggttggttgatactgttcttgctatggggttgcaaacaccttcatcttcttcatcctttctctactccattggggaccctgtgctcagtccagtggttgactgcaagcatcagcctctgtatatgtcaggcactggcagagcctctctgcagaagctatatcaggctcctttcagtaggcacttcttggcatccacagtagtgtctgcatttggtgactatatgggatggatccccaggtggagcagttgctgatggcctttcatttagtctctgccccacactttgtctctgtatttgcttccgtgagtattttgttcccctttgtatgaaggaccgaagcacccacacttaggtcttccttcttcctgagcttcctgtggtctgtgaattgtatcttgggtattccgagcttctaggctaatattcacttaccagtgagtgcataccatgggtgttcttttttgattgggttacctcactcaggatgatagtttccagttctatccatctgcctaagaatttcatgaagttattgtttttaatagctgggcagtactcc

SEQ ID NO: 27718 - DNA, 1236 bp, Mus musculus
catagatgttgaaaactatcatggccatgggcaaatgataggcacagagaactatagtgacacaaaattgccagtctgttcttggtcccttatgagagacagccctaatctggtttaagggcaatgaatacaaactgttttggatatttccactctcaaatcgtagttcctggactctgggttatttgatggtttgtcccattctctatttcactcacagtgtgctggccacttggcacaaaacactgcttttgctaaacttggctgcaagagctcctcatatgtcttgtgcccaactttcctgttctaggctctcaagccaaacccagaaaagaactgaaaagacactcaggatgtctagagaagaaaggagcagtcatcaaatactacaaaaaagggtcaagtacaagacagataaaaataagcctgtgggatttcatccagagcatcatagaaggaagaggaagtttgtgagagagctgaaaatagaagtcaggttatagtgagttgaaaaggaaatggacatacttacctggcagggaagataccatgatcacgaaggtggttttcccagggcgaggcttatccattgcactccagatgtgctgacccctgcgatttccccaaatgtgggaaactcaactgcatagtttgtggtagtgggggactgctttagagctctcctctgaaagaaagagaagggaatgggcattgaagagtaacctttttgcatgagagaagaatgaagttaaaatgcaaaggaagaaaagaacatttataaacaaggggaaagatgaggaagctgggcctgacggcatgggtctataattacagctatctggaaagctgaggtaggaagaccatgagttcaaggccagcctgggataaatagtgagttcaagactaacttgaataacttactgagaccatacctcaagaagataaaagggcaattcttgggccacagtttggcagtacgccatgcctagagcttaaaacacaagctaggggatccctgaggagatgggagtagcaaatcactacagaaaacgttcgagttgggagtgggggctggtgatgctttagggtctgcaggcgaatagatagaaggaacacaagtgggaagaggacggagacagtggtcttattactcagaagtgtacaggcagaagattgttctttccaagtcagaagtgggggtgtctgttgagggaattggaaagagcaatcaagggg

SEQ ID NO: 27719 - DNA, 1189 bp, Mus musculus
tgaggtcgcaaaaggttgacgagtacggaagaatacaggcccttttgggagagaaagtcctcgaaccgccaagatggttagcgagtacagtagctgagagtggggccccgggcaagaccggtaagtctaaacacataagcatggagaaaacattactgtctccttcgagccggagtcgaaccagcgacctaaggatgtcttctaacggggagttagctacagtcctccgctctaccagctgagctatcgaagggacacaagaaatgttctgccccttgacactgaacacatctcaatcaggagttcggttgacagagggagctgcgcatgcgcactagtcaggactcagacgttaggggcgcgggtcgttctacgcatgcgcacagccatcgttttgcctcccgcattcctgagcggcctagaaaggaccctagcacaaagtcctcgggaggcccaggctctggttctcattcttcgcctcgcctgcctgtgccacctttgcccttctcactataagactgtagagaacgatctcatgctgtcatctcgaaagcccctagagtagcccacgccgacgggccagtggcgcaatggataacgcgtctgactacggatcagaagattgtaggttcgactcctacctggctcgagcttttggcccaaccgtgttgggctagctcagtacttatagcagcctgcattaataaccagcctgtccctgctcctggccccatcacccctcttaaggcacgtggcgcagggccattcattaaaatacatttttgacatggttctgaagcgttcagaaaaatattttatctaagtgggccattacttggcattttaagacagtaaaatgataagtgtttgtctccatattctgataatgtgcccacacagttgtagggctttttggtttttttttgttttttgtttttaatccacccattggcttgggtcttttcaccaagtcaggtgtttgagcaaaaggagctaggtggctgttatcatgccgactagatagcagctggtatctttaaagttgtttagtgtttctcagggttaaaaaagaaaaaaagaaaaaagaacctttatggaagttgagggagcgttgctttcctccacgtaagttcatagacaaaccaaagagccgctatcgtgttcttagttcattttcttattttgcaag

SEQ ID NO: 27720 - DNA, 1160 bp, Mus musculus
gcgcatgcgcagctccctctgtcaaccgaactcctgattgagatgtgttcagtgtcaaggggcagaacatttcttgtgtcccttcgatagctcagctggtagagcggaggactgtagctaactccccgttagaagacatccttaggtcgctggttcgactccggctcgaaggagacagtaatgttttctccatgcttatgtgtttagacttaccggtcttgcccggggccccactctcagctactgtactcgctaaccatcttggcggttcgaggactttctctcccaaaagggcctgtattcttccgtactcgtcaaccttttgcgacctcatagtgagagcgctctccgaccagtcccagagtacgggtgtactaccactaagtcggttcctcacgtatgcggttgcgcgagcccgcgttccacgcacgggggcgacctttttcccggccgcgcggagcagtgacgtggcgttatggagcccttccgtcaaccggcttgccgctcccttcgatagctcagctggtagagcggaggactgtaggcttgtggctgtggacatccttaggtcgctggttcgattccggctcgaaggaaagagcttgctattttcttttaccttttaatcctatctatgaggcatgttcggaacaaatttccatgcctcgcagtgcgctcctcctcctctaggggagcacataaaggccagatgccggtggagggggattagctcaaatggtagagcgctcgcttagcatgcgagaggtagcgggatcgatgcccgcatcctccagttcccctttttttgtctttgcatttctgtagtttttcttttcattgttatatacctcaattgaagccgaaagacagtaggcaaaactcagcgagatgattttcaacctttcaaccttgtattttgtgtggtgtccaaaacttccaggcatgcattaaccggtatgcaacagccgctccccagcaaaacccggaaatagacccagctttaaaccctggctaagctgagggtccggggctgtgtggctccacgggggacgaggcctaagggtgtatatcatggcgctggagtgattttcttcagaagcgtacgggactctagtcttctccaggaagaaattgtggggcatcgcgtagactagggactt

SEQ ID NO: 27721 - DNA, 1160 bp, Mus musculus
aactgctgctgagttctccaacaattagcaatcaagacatgctacagactaaactaataagggcagtcagtgcactgacatgcttacgtgtttaaagtgacagtgctagtgaggacagtctctctctccctctctctcttcctctctctccctctctctcttcctctctctctctctctctctctctctctctctctctctctttctctctctccatgcaaaccccccatggtctttcagtgttgtaaatcagacattatggggcataaatctctgacatgttcatatccttaggttagagttccaattaatgatgattgctttgtagtaaacaaacaaacaaacaaacaaaaaggtagaatttataaagtagaatttaaagtagaattgaatttaagattatctagtacttcagttcaagtattccagggccatattcatgttttctaaaattgtattctctttccttttttggcaaagtgggattttattattttgaaagagaatatgctgtatgttgtgttttcatttgggatgcttcattccataacctttcatctttctcttcatagtctctcatctgtagcccttcattggacgtagcctccattattccgtttttggagccactctcagaagacactgttgccggcctcagtactcatgctctctgccatacacgcttacaagagtatgaacagtgcatagacacgttgctagagagatgcccagaggccgtcattgcgtatgctaatcaggaactgaaggaagatcactgggtatgtgtttcagattgtgcttctagccttgatcagtggagaggaggtttggtactttgcttggcttatctgcagaatgagggctgtttatgttagtctagctttacagggctgtgcgtcgaaggaacgtgtatgtttaatggtagacatttctttttcttaagattcatttattatatataagtatactgtagctgtcttcagacactccagaagagggcgccagatctcattagggatggtggtgagccaccatgtggttgctggaattggaactcaggagcagtcagtgctcttactcactgagccatctctccagctccagtggtagacatttcgagtacttgtagatgctattaaaatacatgaggatgatttatc

SEQ ID NO: 27722 - DNA, 1098 bp, Mus musculus
atccaatacgaaattctaagtgaatacatttctaatcaatattgatattgattgagagaaccacaacaaataacaacagctaggtgtctgtgtgctctcaaagtgtccttatgtctctttaccctgggcttgtagagggagatagaaagagtcaggagcctggatccagttggttctactctttagagaggctcagggaacatgaacgtttccagtgttcaaagcaagatggtggacaaggcatttccgaagagtcctgtttctcatgttcattttaccactgttttgtctgtgtattctgagttggtcacaccacataatcgaggctgaatttcattctgagatgataggggaagcaacagtcaggtcctaatctgagctctgaaagtcacaggttcatactttgagttcctgttaagggcattgggctgctttgtaaaatgtggatgttgactccaacctggccagccttactctttggtcacggtcagtgtttgagattgtgtgggaaggaggtagcctacacacatgcctcagggattcagcaacattgtcccagtctaactcactatcacgtgtcagatactaactagtattgtctttttctctcttctatttctgtttgctgatgaagacctctccaccaccatggtcatgggtgcattgtttcctggctctctctcactttgctcagtgcatatctcttcttccttagccaaagcctgcagtgtttcacggtgcgatgcagtgcagcggtggcacatgaggaagacctatacatggatactacgctaaaggttagcactgccttctcttgacagtagaacagtcagctcaatggagcacatgaatgcttagacacttgtttttaggcctgaattttgcaaagacgaaaggcccaaaaaggccgtattcgttgtgctgggtgattttatgtcaacttgacacaggccaattttatgtcaacttgagtggagggaactccaatggagaaaaatgcctccataagatcaggcaagcagtggagcatcttcttaattagtgattgataggggaatgctggctattggctggtggccctggcttctgtgagaaagc

SEQ ID NO: 27723 - DNA, 1183 bp, Mus musculus
ttaatgacatttaataacactagttatttaataacactagttattaaatgttgccccctccccattttttaaattgacagtgagctagagggtttttttttgttttgtttgtttgtttgtttgtttttgagaggaataaaccgtaattgaaataatgccctctgtgatacggatctctaggcaaaccaatgtggcattttcttaactattgatgtgagaaggcctagcccattgaggatggtggcgctccagagcagggagtcctgggttgtataagaaagcaggctgactgaaaccactgggaagaaggcagtaagcagccctcctctatggcctctgaatcaactccatccctgagttcctgccctaacttccccagtgatggagtgtgatctgagaattgtaaactgaagtaaattgtgatcctccctaagttgcctttggtcaatgttctgtcatagcaatatagacacagctaggacatatatgtctaatgttcagtctggaagatggtagcgctttagtgggtaaattcttaaattttattttttaaggtgtcagtaatgaaacttcacaacttgagtcagaagattttgttatctgtctaaaacccatggaactcattggtgaaaaatgtgaacagtctgggatatctgttaaactggagtccacaggattagaagatgaaaaagtaaaatatttacgtgttcggcatctattgtataggtatgagagttccttttcattcacgagcttttagctttttcatgccagcttaaaaatctctggaaattagatctcttccctgtctcttcttcaacccacagacgttttgctccagatatttcgtcctatgtcttgtctgataacatcaagttacattcccttcagctgctacccattcaccaaagtggtaagtatagctgagcggcagggtagagaggtttgcaaggcctgggctggaagaaagacctgtgtggagacagtaggttgggttttgtttttgttttttctgctgaatcttcctgaggaaaggaaagtcatattggctaggagaagtgaaaccattaggaggatgtgaccagaaaacctcatttcttttttcttttgaaattgtctatagacccagagaaggaaatctgtgagcactattggagtagaggtctgtctagttccagctgag

SEQ ID NO: 27724 - DNA, 2287 bp, Mus musculus
ggtatgtatattactgtttcactgtgtctccatgttttcattctgactttagtgtgcagtattgttagttcacccttagtgcagtttaggaaaaggctaattttcttagtaaaggtttcttaagagcattaaaaaacttcattttgttagctgaacagttcttaactattactttaacttgacttttatttttttctgtttgcagttcattgtgaaggactctgtggaagaaaatatgttgaaaatacagaacacgaagcgagaccttgcagctggagcctttggcactaagaaaacagacgccaatgacatgaaacaagctaaaatcaacgaaatcagaactttaattgacttgtaacttgtggggtgtttctaaggtcagtttgaacagacacttaagtcttacagatgaaaaatacatatttaaggatggcatctagagaatactttatggggggcatattttatgttaatacagtagtgttactgacacatcttctatacctgaatctctttttatgatacttcacacagcagtgagttccattgtaaaccggcctgagacacatgtgcatagagggccctttgctctccaggttggcattcccttgctgagggtattttcctacatttcccatgtttcccacatcttcactgaagtgtggttgaagcttctacttgtaaccacttactcaccaaagccttttggtaatgattcagtgaatctacagtccttgtaaattatgaacaagtatatacagactataagaaagattttactggatgttcaaaaattatacttgcattcataactaaaccttgactaaaacaccaaagttcagagggcaagttaatttttctttgttgagatataacaaatatgtgactttccatatgtgtttagagaaaatttagagaaaaaaaaaagcattgtgtgttcattttagtgaagtggtgcattcattatttaaatgtgatgatagaggcacaaggtgtaaatggtatgtaggggtgaaggaaccagttctacctggtttgtcttgaatgcttatattatgtaatttaaatagatatttttgtaagtgctctctatttatgtaggtgttttggaaatccaactttataaatgtaatacagagactactgctgaacctgagaagtgtgataatcaggatggaaattgggttggataaccttcaaagttcaactcttaaagacattttaatcccgaatctaaaaatgcctttgtgagtttagaatccgaatttaactttggaattttattaattgatctcttcatttttttaaacccttttttgggaagttaatgactatgactcatagttaaaacaaagacgcagtcagggtatataacaatagctttcttttctgttgttgtttttgaatccagagacaagatgactaagaagaagctttatggcttatgatataaactgaagaacaactgagactgtatttatgctctgagagtcttacctgactaagagagatgatagatacccttctaaatcctcacagaatcctccccagcctgttagtcctccgaggggacaggactagccggcaagcatcttctcagctcccttgctcgggcagccaggcgaggcagagtagcattcaggtcaggttttctgtagcggtgaaagtggaataactgggagtggcctgcttgggtgagtagcccataggatttgtaggactagtatcacatacaaatcaagtctcattatgtatggcattggagttctttagttcctatacacagtgaaattaagtgtaaactagttatggcccaaataaacaagaaagaaactcagtttactcattttaattacaaataaactgaggttccaaagtgaaggccatgtgcgtcttgtccagaaaactacagagctatctatgctttaaaacatgagaacaatcaaatttggtgttaataaaaaaagtgaattctaagatatatgaacccctgggatgagggatgctgcgctctgctgttttactacttagaaatgtactgaaaatattatatttcaaattgtgtttccaactggattcttctttaaattaaaaaaatcaataaaaatctaaaaatttaccttctttggtgtcacttagtgactgttttcctttgaactatttaacctttcctttaacagaaaaaaaagcatctcacttctgtaaatgttcgttacacaatttttcattgaatcacgtaaaaagtactgttattataatttactcattcacatttaattttggtaca

SEQ ID NO: 27725 - DNA, 1215 bp, Mus musculus
taagtacagctgcttgttcttaaacaaacaaacaacaacccatataaataaaacccacccctctctgggaaacaaccataattcaaacatggctatttagtaatcagaaggtattgtctcagacaggatttcattttcgggaggcagggcgtgaggggggaggggagcgggactgagagacagttccagagcctccagggaaggcttctactgctaactgctgtattctgtatatactgtgccaccctgtgtggagtctgtgagtgtgctcttgagtagcgtgggctagccaatctgccattcatggtgttataaactcggaattccatatgtaataggatgcaagtctaagcgtttcatgtggacataaatgtatctaaataaaacttcccctagcactgtggctgacctcacccttacttttatactttagtatgaaactgatgagaactttggtagtgagtattttttttatatatatacatatatatgtatatatatatatatatatatatatatatatatatatatatatatctcaagcatctttcaggtctttgtgtgtggctttcttaaagccctgttgtaaaaaaaaaaaaaattactatgtggatggcagtctctcacatcacagatgtggaaagtataattttatatttgtattttcaaataaataagtttgtgaaaggtttccatcctcaaaaaaaaaaaatggaaatttcccttcccttgggatttcttaccttccccaattggtagacaattttaatttctgttcctagtctatatttgtctcagcagattttcacccgactgacagactccacctgtggagctgatcacccgtggaactgcagaactctgtacttgttgaaagctgatgttaaccagcctaatcaatggaattgctttctgtcttttatctgtatcagctaattagatgcttttgacaaatgtcgcattgcccagcctttgactagtatttcagccttcctgggccccattttcgacgtcctaatgtcagcaggaagcagatacagaagagagatacaacatccattctcccacttgacaggctgaaatactaagtcaaaaaggaattccccctgggtacattctgaaaacaattccatatcttttgtcaggttttgtaaaggcttgtgtatccttgcctcatgtgttgaagattgggcaaataatattgctatgtctgga

SEQ ID NO: 27726 - DNA, 1155 bp, Mus musculus
cgggtggtggctgctgagcgggacgcagataaccgctgcccgccccgcggacgtctccccgggcccccgctttctgcacgtccccggcgtcggagctgttcagcatgtctgtggtgccgcccaatcgctcgcagacgggctggccccggggggtcaaccagttcggcaacaagtacatccagcagaccaagcccctcaccctggagcgcaccattaatctgtacccgcttaccaattatacttttggtacaaaggagcccctctatgagaaggacagctctgttgcagccagatttcagcgcatgagggaggaatttgataagattgggatgagaaggactgtagaaggggttctgattgttcatgaacaccgcctgccccacgtgctcctgctgcagctggggacaactttcttcaaattacctggtggggaacttaacccaggagaagatgaagttgaaggactaaaacgcttaatgacagagatacttggtcgtcaagatggagtcctgcaagactgggtcattgatgactgcattgggaactggtggagaccaaattttgaacctcctcagtatccgtatattcctgcacatataacaaaacccaaggaacataagaagttgtttctggttcagcttcaagagaaagccttgtttgcagtccctaaaaattacaagctggtagctgcaccattgtttgagctgtatgacaatgcaccggggtatggacccatcatttctagtcttcctcagctgctgagcaggttcaattttatatacaactgaattcctgtatgcagaagtaaaagaagccgtctctatgagcacagcttacatgtgtagaagagtaactgtagaacaagttttggttttctcttgttccctaaattgccaccaccttcctgtttgaagagtaaaatgaatatgaccgagatagtggtggaaacatgtggcagtgttcattagcttttggttctactcatacttttttttgtacattaaagaaagtgaatttcttatttgtatttttttttaagtttctcattaaactctgaaaagtcttagagctgaggatccttttttccctgctttagactggggaatgttagaacatgatcatggatgagataaggtgagattgtgggccctttgc

SEQ ID NO: 27727 - DNA, 1126 bp, Mus musculus
aaacttaaaaagcttttactggtttagtgtttgggttgctggctgctggagaggattttcagttttctatgaaagaagcttagcttttgtagtttaagattagattttccaacacattccacttgttttctatctcttgcttgggttaaactggactcacttgagtttgcctctgtttaaatacaagctgtaattcatctggagccattaaattcactttactattaactcatataacacacatggctatgaggggggaaaaaaaacccaaccaaatatatcaagattaagccagttaagtgcactttgtattctagtgagggattaaggctagagctaagttggaagaaatgcaggaattatactgttccattgagagaagagcagcgtgttgagaaagcaaagctttggctagggatgctgctgttcagtgggaaagcgtttgcctaggaaggtttgggttcagtccatgtgtcctccaaacagagaagttggtaattatgttcatatatagtatacaagcaccatttatagttgtgactttgagaatttgaacctggtttgtttataggaatgtataaagaaactggagttttgggttatgttttttatatttgtaaagcaaaagtttgatcaaaatgatcattgttctttttaaaagttttatttcactgttatttcaataaaaatatttaaaactgaaaaaaaaaaaaagaaacatacctcaataacaaagacaggcactattttggagaaaaaggatggaaaaaggtcttccaagcaaatggtcccaagaaaccagaaggagttgccatcctaatagtcaataaaatagacttttaaacaaaagttatcaagcataatgaaaaaggacacttcatatacatcaaggggaaaatccaccaagagaaagtatcaattctgaacatctatgccccaaatgcaagagcacccaaattcataaaagaaactttattaaaactcaaaccacacattgaaccccacacaatagtagtgggagattgcaacacccactctcaccaatggacaggtcattgaaacagaaactaaatagagacacattgaaattaagagaggttatgaaccaaatggatttaacagttat

SEQ ID NO: 27728 - DNA, 1213 bp, Mus musculus
ccaacaacgcccttcccacctccttgagttgtggtttcttcctttaaatacccccttactcagctactcggggtgccacagtcctctacccctgcatggcgtatgaccgtgggcccgagagcactcttgaataaaaatcctcttgcaatttgcagcaagtccgtttctcgttggtggttttggggtgtcgcctctcctgagtcagaacgtgggggagtcctcatgttgtgggtctttcatttggtgcattggccaggaaacacgaccacccctcacacccgagaaccgacttggaggtatggggatcccctcttgtgtatgtgccggccggtttctctgttttgagtgtctgttttctgaaacgaacattggaacatgtgcttgttgtgttgggttgtttgtgtcttgtcctatgtttctgaagcatggtgaagtctgagtttggatccatctgagtttattgaatatgtgtcttggtttcagggttacgagatagtgggttcgagtcccacctcgtgccttggttttacacctggcagagtgaggaacaagtgtgcttctctggttttggtcgtctaggtagaagtggacaacggtgtttgtagacgatggggtgatggggttttctgaaatgcgctcgcagtcggtatttgcagctgtccttttgggccacaaggagcggaggactgtggtcggcagacgtgctaggaggaccacaggctgtggccctgggggacgccctgggaggtaaggagagccagggatgcctggccgtctccggatcggtcagagggacagagttctgttgaagtggaagcttccccctccaaaatcgtcaaattcttttgcctgcttgtggaggacaagaaagggtcgaatgtgtctggatctgttggtttctgttttatgtgtttttgtgtatgtgtttagagctatgtgaaaatctagagaaacaaaggtaattctcataggtgctttataccctgactagagatagtttacacctgagatgtgagagaatgggttttgagaaaagcagtactctccgactatctggggataatttggtaaaataaaataaaataaacagtatcaattggtctttggagccctgtacctgtagttaggaatctagtgtggctggagaagccctgctaggagctgattatagggaccagaagcttctcaagttctacaaaaatctctgtgcttg

SEQ ID NO: 27729 - DNA, 1228 bp, Mus musculus
gagattaaaaaggccctactgatggccagcctatgcctgacctaaccaagcctttcactctttatgtggaagagagagcaggggtcaccagaggagtcctttctcagactttgggactttgaaaaaggccagtggcttacctatctaagaagttacaccctgctgccagctggtggttttcttgcctgatggatgatgaccaacgctcctgtgacacatcagaactttttgttgactgaacgagtgaccttcgcttcattccacctgctgtcccactgcgtgagactgcacctactcatcactgcgctgacattctggcagaagaaatgatctgaaggatcagatcagccttggcctgagggcagtagcctcgcggttgaaggtaaacagaaggcgaggacagcagtacggtggtgaacagaaagcaagtgatctagaacagcagcctccctgaagggatgtcggcccagaaagctgaacttgtgactttgacggggcaatatacaaagagggctgttcacatctgcagaaaaagacctaagatgctgtggctaaaaaaatcaggtggcagatctaaccgccaaacaggtggcccaaggagcaatgatcttggcagtcaaggagcctaaagattattatgacatcagagagaccagctttagatacaccgctgagcactatcaagttatggacattatttgacccacctgggggccaagaaattcaaaggtgtggttaggtcctttgactactatgttacaggactctctgacttggcagaagaaatagtcaaaagctgcaaggcctgtgctatgatgaggtagaatttctaaaagaaatcttcccaaggtaatggacctgcctttgttgcccaggtaaatcagggactggccaagatattagagatcagttagaagttacattgtgcatgcaggccccaaagctcaggacaggtagagagaataaatagaaccattaagagacccttaccaaattgacagcggagactggtgctaataattggatagctctcctaccctttgtgctcttcagggatagaaacacccctggacagtttagactgacccccctataaattactctacagggggccccctccactggtaaaaatagcctctgtacatagtgctgacatgctgctttcccagcctttgttctctaggctcaaggtgctccagtgagtgagacagcgagcaaaaaagcagct

SEQ ID NO: 27730 - DNA, 1159 bp, Mus musculus
ccactgaaaacagttttcaagtttttaactaaaaaggaattcttgaagctgagttcagcagcacttgcggtgtgtattacaggtagatgtttttctgccctctagcctagttgtgagtctgcacgccgcgtctaaagcggccaagacagctttcctcaggaatacttgttcaggtcttactactcagcagcactagtgctgtgtgtccgaactgtacgggtgctttgacaagtccttgtaacagtgtgagcagctgcttccctacatttaactgaggaccagaggctcaggtggtgagtggcaagagcagtggctctgaggccagtgtcttctgccattgagtccacaggaagtccatggatgtgggagagtgttgggtttggtcgtggcattactgttcctgtttttctgaacagatttgttctcttatctacagtaactgccgacagtgtcaattgttaactgattttcatcagttaggtctcccctggaaaacctaaaatggtagcctcttgccaactggaccgaggacatgggcttaagcctggctttgagggctcttttcgacctgtttactttcccatgctcctctctggcagctgaactcctgcctgcctctcagatcctggagctctgtccctgttaccactttgattttgccatgccctcctttctcttgggttttttgcctagttttagctccacgtcttgagaagtgtctttgcagtcatgacatgctctctgattccattgcctttaatgcatgtagctgccccttccctctcttgcttctttatggctataggtcatgttgtgcctttgtgtgctgctgtgccttggagaatttgttgaagttcttgattattgtatcacaagctcaaatattttcatgtaaaaatgggttgtttctctaaggcctgtgtttgaatgagcattgacatccctgcctgtgttagaatgagcattgacatccctgccagtgttagaatgagcattgacatccctgccagtgttagaatgagcattgacatctctgcctgtggcattgatgcactataatccttagtcccacttagacttccctggtttaggagtattatagacataggactgttctgtcatctcagtttttatgctgctgggagtgggcaagggagaa

SEQ ID NO: 27731 - DNA, 1107 bp, Mus musculus
atttagttttttttttttttttaatggatcacagagactaagttaacctattgttataggagatagtaatttttttttaaaaaacctgtttgaccaaaaaaaaaaaaaaaaaaaaatcacagctgctgtaagcaaacattttggttacaaatagcactctgtcttgcttttgaattgtgcagcatccatttacaaatgctgagtttgagatgatcatagaggttctggtgctttgtcagattggttacttttacggagcttcataaaaggcaggaggttgctcatagggctggcactattttcaaatcatttagggactttatatctttaaatttagcttttcctatttttttcttgctgttttgtttttaaggcatgttgtctccaagtaatacagaccagcttcagctgccaacgactagggatcacaagtatgtgtcaccgtgccaggcttaatttatcattttctgttgcatgctactcttgtacatatatgagagagaaacaggaatgattgaagtctttactttgaatctctggtgtgtttgttcactttgctgcgtgcagtggagtgagctagttaagagtgcttctgaaatgaatcaggagagagaaatcccaccggggccaggctcttaagctgacttcgcagttgaagaactagcctgtttttgttttcttttttgttgttgtttttccccattctaggtttaggaatcttggcagatgtttctgattctgtaatccctgagtctcccttaaatctctgggtgtctagttttgttttttgaacatgggaccactggtcacccaacattgattataagataaataccttcagatagtatgctacaattaatgaatgttcatgtgtgagagtgagccaacaagcagcattcattccttcgtggtttctgctttggttcccttgcctgacgacagcttaaggatgtaatgtgacctagaagtatagtctcaacatacactttacttgcctaagctgcttttcgtcagtgttatcacagcaggaaactaggtttaggctggtcccagagttggtatgctttcaggattattagtggctgtccagtgttctgtattgtattc

SEQ ID NO: 27732 - DNA, 1092 bp, Mus musculus
acctgctgtgcccctaagtagcgtttagaagtttggatatgaaaaccagaagagaaggaatatgcgttataagagcaaaccacacatgtcccagttttgaatattaatgacagccttgtttccccctttgaatcagcagacacatggattatattctttttcccctcagtagtgcgcagtttgtatgtacagagaacatggacttaacaaaagcttgcggcagtagttggttcttgcttccaagtttgttttggtttagattatggatgcatgaagtaagggagtgaatcattatcttgcttttttttctcaccttttaaacaacaaaaaaattcttaaaaatattttactgcattctttggaagaggtagatgtttggtacatctgatggctcccagagcatataactcaataggtgcatattatggagggaattggaataataggaaactacatgacttccgtcatgtcactctctaagacacatcagcaaagggtgttatgttatctttgttttgggtttctgggttttttgttttagttctttgtgtgtgtgtgtgtgtgtgtgagagagagagagaggggtggggaggagagagagcgcttaaaatagtttctttttggggacatatttctgccaattaaagactagaagggcacaacttttttttttttttaataccataaagaagagtttggtttttttttttctaaataataatcttctgatgttttgtagccataactaaattatggttaaaaatgtgcactattgtgagaaggagcaacatagtttggggcttttattttattatttttattttttattttaccatttgtctgttttactttgtttcttaagagattaaaatatttctggataaggattagcttctcaaagtgtccatcattctgtatagaagcttaaatatgtaatgtaaccagattccagtattaaaaaatctctcatgttagttttctttttacaaagcaaggttacagcagcatataacactgccattacatggctaaatgtttgctaccttagttttgaaaacagtttttaaaggcttgctttgagctatgtttggg

SEQ ID NO: 27733 - DNA, 3416 bp, Mus musculus
cacttaagcattgtagatctaagctgctgttttgtttccactataatcactactatatcatgttttttactcttgtttatatcaagtattttttttttaaagatataggtatccaatcagattctttttttttggtttttttttgagacagggtttctctgtatagttctggctatcctggaactcactttgtagaccaggctgtcctcgaactcagaaatccgcctgcctctgcctcccgagggctgggattaaaggtgtgcgccaccacggccggcttcaatcagactctttatgttcagctaaaagtaaaatatacctacaaaggttcaccagaggctgtgtttgtgaaggtggttgacaggatagtcgatattaatggaagaacccaggagtgtaggttctgaagagaaagaacagttgtcaaatttatatctttaaatttttaattaagaaattgcttagcaaatttataacactatgtgtgtcagtagttattttgaggcctttggctcctgaatcccaccctgtgttctacgaaactgctctaacccagccccgcagctttgctgctctgtttttgctgccttgttctttacaaagcagcgttgattgacgccagtcttggcttcattaaggtagggtggcatttgcttttggtaaagaggatggatacacttacattttaccatacatcgttatatctaccccattttgttagtggggtctatgatactgtaatattaagagttgcatccagagaggcagtcgtctatggtttgtgccaggtgttttcagggttctatcacattgagacatttagaacccattgctctgtggctctgtaggaattctaaaatgctgagtgtctgccacttgagattttgcttttactgcaagagggtcacatctgttggcctctgttgttgtttaaaaaaataataataaaaataaaaaaactgtgcaataatttttaaacgtgctcccaagaatagacacaaactttttgagtatgcctaagctgcatttccttcagcgatgcatttgtcaattgcactgaatctgaacctgaaagtcagaggtgattgttgatagtgcttttgtattttgatatggacattttattcatttgcatacagtcattgacgttcttcccagctgattcaaagacagtcacaaattcctgaaacacagctgccaaaatgacagctgaattttctgataatgtcttgctttctgttgggtgtgtgtttattggtttgttttgttttgttttatttttttttttcctatttctttggctattttacttcagcacactagctgtgatagattgtctgatagaagagaagtgcagagctttgctgtcccaaagcctcgggtctttccctcgcagatgtggctgaagacatctacctttaggctggttctctgtgagcgtaggactgtgtgctttgctgctgctctcactgtccctgtagcctgctgacgtgccatgatgctgctccacagacaccacaccatgtcttcatccaagcagtcagatgatcaccagagaccacacttgagtgtgtcaagtgctgtcatggggctctctactttccttcttgtctttttctgagaattggctctgaaaatccagagtccagtagtctttctatggtgttcatttagatcattgttgtatatgttactgtaaggcagagaataggaggcttaaatgaatatcattgattaaagtagactggagggagcagctgccacccttgaaaggcatgaaggaacctgtgtactccaggcaggagacccttggggacttagatttatccctattttccatgatcaggtaacatcattgagttttcaaatgatttaggcgtggttactggagtaggtcttagagtgtaacagattgttttcctgagttatcctctaggtgagtatgttttaggactaaacaccttttgcagatactgaaagtgcctccttttgtggtatacaaaacaaattatggtgcaaaacgtaatcaatagattgaatcacatgaagggttttttgctttttgacataaaaatgtcaagagacaggccaaagatttgtacttttcacttataaagcactcctttttttccttaagattctttctgtcgatcagatttaatgaaagagtactatttttaaggagctatctgtttatgtagaatgatttcgttaaaagagtaatgtaaactatgaatgaggagcagaggccggctgaggactgggccttttgctatttaaagaaatcacggatgaccaggcttctgcaagcacacctgacaagttttactaaatgcataggaaaaccatctcagacagtgctgtcttgctcttttaaagaccatttacgtttttgtaagtgctttgcacatttccacagaagctggattctcaggagcttagagcggtacttgcacagttgctgcagaaatcctgcctccgtggaccaacatcatggcacagcagcagaagccagcatatgggggctagcagccagcctacagagacccagggggcggttttctgtttgtttttcattccctccttttgtctgaaaccatcagggagggatctgtaatagctctgaagtgtcacaaatttaatatcagtcttttaatacacaatcctagttaaatgtaggagaggaaaataaggggggggggcggtgctcacggtgtttaaatgcattcgtctagaatcctgcgtctttataaagcaggtctgaggtgtccatagtagtctttatttctgcccttctgtgacagtgttgaagcaggatgaataagtatgtaggcttcttcttcttttaaaacctagcaaggtgtttggtgttttcctttggaatttctggatgagtttgaggaaacattctgcatgttttatctggtgtgctttttcatctcattacaaacaggcagacatcattgtgcatctctgccatccttaaatacagaagtgattttctttcctgactttgacattgttgctatatataatgtttttatttgagttttgcaaatcctttgggtctaattctgtgagcctaccttagctttgggtgatgatgtctgcagcctttctttagttccacagttaaccttaaagctgttggagaagtgtaaaccagcccatgacagttttttgtacccgcttaagaactttattgttcagttttcatgatgattgtgtaaggaagactgatgcagatgttcatctctcctggaccatgtcaatgacacttatgatgtattttggttctacatcacagtgatttgtccccaatgaccctttgaccctttccaggcacattgtgtgtgtgtgtgtgtgtgtgtgtgtgtgtgtgtattgttgttgcagttttccctttgcattgtatt

SEQ ID NO: 27734 - DNA, 1188 bp, Mus musculus
gcccacttaggacttctcttgtcccaggtaaggggcatctgccagtccagccaccaggctctgatagaggaagaaagatgtgtatagaggtctagaaaaaagtaagcttaaactataaggaaaagcaaagcttcagcagactcaggagagatagatgacagtgacaaatagattaacagtagagaaaagtgaaaatagagatgaaagagattagagaggtctgagatgagaaagatactataattgggaaatatttagagtaagaaccattaagtaagaggcagagaaggcatattatgaaagagagagagagagagagagagagagagagagagagagagagagagagagagagagatttgactagaatcttggctgcagtggtagaaaaaaaaagacaagatctagacaggaaatctgggcaacagaagaccaatgtgcttaacagaattaagtgagttagagtaccaagcctcagctaaaaaggctcagctgtgtcagactgaagttacttatttgggatacatccttcaagatggaaagcagtggctaaaagaagccagaaaaagactgtaactcagatccccatcccaactacaccaaggcaagtaagagaattcttgggcactgctggcttctgcagattctggataccttggttggtgaccttaactgccccgttgtaccccctaaccaaggaaggagaggtgtttttgtggacaccagatcaccagaaaccctttaaagaaattaaaaaggctctactaatggccagccttggccttgcctggcctaaacaagcctttcactctttacgtagaagagagagcaagggtcgacagaggaatccttactcagactttgggacattgaaaaaggccagtggcttacctagccaagaagtaagaccctgttgccagagggtgattttcttgcctgaaagctattgctgccatatctctacttgtcaaagatgctgataagctcactctgggacagcaaataactgtagtggcacgccatgctcttaaaagcattatccaacagtccccctgaccaatggacacattatcagagcttttgttgactgagtgagtgaccttcccccccccctctgtcttcaatccccgctaccctactgcctgagacttcacctattcatcactgcgctgaccttctggcagaaga

SEQ ID NO: 27735 - DNA, 1540 bp, Mus musculus
tcagactgaagtgacttatttgggatacacccttcaaggtggaaagcagtggctaaaagaagccagaaaaagactgtaacactcagatccccaccccaactacaccaaggcaagtaagagaattcttgggtactgctggcttctacagactctagatacctgggttggcgaccttagctgcccagttgtaccccataaccaaggaaggggaggtgtttgtgtggaccccagatcaccagaaagcctttaaagagattaaaaaggccctactgatggccagcctatgcttgacctaacgaagcctttcactctttatgtgaaagagagagcaggggtcaccagaggagtccttactcagactttgggactttgaaaaaggccagtgacttacctatccaagaagttacaccctgttgccagcgggtggttttcttgcctgaaagctattgctgccataaaactgcttgtcaaggatgctgataagctcactctggaacagcaaataactgtagtggcatcccacactcttgaaagcattaccaatgctcctgtgacacatcagagctttttgctgtctaaatgagtgaccttcgcttcgttccacctgctgtcccactgtgtgagactgcacctactcatcactgcgctgacattctggcagaagaaatgatctgaaggatcagatcagccttggcctgagggtacgagctggtacactgatgacagtagcctcgaggttaaaggtaagcagaaggcggggacagcagtatggtagtgaacagaaagcaagtgatctaggtcagcagcctcccttaagggacgtcgcccaaaaagctgaacttgtgactttaagacaagctctataaataaaaaaaagaaaagtctacactgacaacaggtatgcttttgccactgtgcggggcaatatacaaagagggctgttgacatctgcagaaaaaggcctaagatgctgtgctaaaaaaaaaaatcaggtggcagatctaaccgccaaacaggtggcccaaggaacaatgatctggcagtcaaagagcctaaagattattatgacatcagagagaccagctttagatacaccgctgagcactatcaagctatagacagtatttgacttggcctgggggccaagaaattcaaaggtgtggttaggtcctttgactactatgttacaggactctctgacttggcagaagaaatagtcaaaagcttcaaggcctgtgctatgatgaagtaaaatttctaaaaagaaatcttcccaaggtaatggtaagggtttatttggcttacacatccatactgctgtttatcaccaaggaagttaggactcgaactcaagcaggtcaggaagcaggagctgatgcagaggccatgtacagatgttccttactggcttccttcccctggcttgctcagcctgctctcttctagaacccaagactaccagcccagagatggtcccattcacaaggggcctttcccccttgatcactaattgagaaaatgccttacagctggatctcat

SEQ ID NO: 27736 - DNA, 1107 bp, Mus musculus
ctacatatcaccaaaaattaaaatacttacaaaggattattctaaacaatcaaacagtaggcaaaatactgcaacctgaaactgtgagacaaagatcgtgagcaaatttagggaagaagaaaatacacacattgaagccactggtagaatccactatagccatcacctttcccattgctacctactatacggagcttcatatggagtaaaagaggcattctttctactggtattatgcttgaaaaagaaaatttccccttttccctttctgccaccgccatgccatccagactgaggaagacccggaaactccggggccacgtgagccacggccacggccgcatcggtaagcaccgcaagcacccaggcggccgcgggaatgctggaggcatgcaccaccacaggatcaactttgacaaatatcacccaggttactttgggaaagttggtatgcggcattaccacttgaagaggaaccagagcttctgcccaacagtcaacctggataaactgtggacattggtcagcgagcagacacgggtcaatgcggcaaaaaacaagactggagttgctcccatcattgatgttgttcgatcaggctactacaaagttctgggcaagggaaagctccctaagcaacctgtcatcgtgaaggccaaattcttcagcagaagagctgaggagaagattaagggtgttggaggtgcctgtgttctggtggcttaaaagccacaccggaggttaattaaatgctaacattttccaaaaaaaaaaaaaaaaaaaaaaaaaaaaaaaaaaatttcatttagtacctatttaaatggcatggagaaacatagtaggtaatgtagttcatctttagatctaaaaagtccaacattatatacaatggtaccctcaactgttattcattatttcacctggtgtgaatacaggcagcactttctaccatcattaaaaatttactctaagctgaatggtggctggctcataccaacaattcaaatgtttaagaggcagaaggatggtaattatcccaatatgaggctagaaagaaagttcaacaaagaaatttcaagaacagcctgtctaaaggaattctagaaa

SEQ ID NO: 27737 - DNA, 1212 bp, Mus musculus
cttccccgcccttttatgagggcatagcctcatttgaaaattttaccctgctttcagacgctaggcagcttccccttgagtcagttcagcttaccttgacagaactctctggggtaagaagttgtgtgttgggcccaggcatgcttcaaggcccttgctagagatttgcaataacacgtttagagtaaataaaagtgggttttaaagagacttcgtaaaggtcaaaaaattcatagattaggttttattggaagttaagaaatcatttcctaaaactatataattcattttgtcaatggtgtttttgttggttgcagaaaatagagaacgtttttacagatggctataaaatatttaactaagtgtggactaaaaatggcttcaaaaaagatttaacatggtaaacttttaggctatttgagacatttagtgtatagagattgtgtgttttctcaaaaatttgccctcagattaaataaattagaagttttagatgcctgccaaaaacttagaaaattttggattttaatcttggtttgacaagctacctcttacaagcagaaaaggaaagaaaaaaatagagaaatggattttagaactctcccagggacagagagaaattgggggacgccctgttttattctctctggcccctacaggagaagctctctaccctctttctattgtctggttggtgcaccaatcacgtgtcaattcatgtatgttttctgtttcgttgtctgaatgattgtttcattgtctgaatgactggctgttttatgtttcatgttaaaaagaaaagaaaaaaaaatggttaaaactttacctgctgaatcactctcagtttgcacaacggaggctgagagaggcccctccctttagccaaaatcaagcacagcaggagaggtcctgctgaaaaacttcgaatctacaacctcttagttctaaggcaaataagctgttagttgttctttcctaaaaaattctctgcaattttgtgattattgtatttagcaaatgacaaagtgtgtttttatcttataagtataggtataaaaagtaaaagtctttaattgatctaaatttataagattcgtgaagccacttcatttggtgtttgattgatcttaaaggtataaatatgatctgcatatcttggccatagagaattggcttataagttatttgggtatgattaaaaaggtataacac

SEQ ID NO: 27738 - DNA, 1547 bp, Mus musculus
agagctgtcagctgcctaagaaatcatggcataagcacagcccataaggcaagacagattacaaaagaagactttgccacattcgattatatactatgtatggatgaaagcaatctgagagatctcaatagaaaaagtaatcaagttaaaaactgcaaagctacttgggagctatgatccacagaggaaactcattattgaagatccctattatggcaatgactctgacttcgaggtggtgtgccagcaagctgctgcaaggtcttcctggagaagacttactagctggccctaacccccaccattgagcagctcactcatcagtgctgtgcccaagggtggtagcagtccttagccccataccccacctctcttttcagctgacttactgtatatctttaaaataattgtaggtgggaattaggcatatgttcagaaggataaaagcatttgagtcagacagtttgaggtgtggctaagcattcttagactaactaaacctctgaccttgcggtgattacaaaacagtggaacaagcaaatatggaacaaaaaaacaaaaacaaaaacaaaaacccagtaaagtaagagtgacctagaaggtccagatcagcctctgagctcggcaagcctgggtcgtctggtctaagtggagtgtgtgcatgacccacacccagtgtgctgtttgcttgccgtgtactctctactctaggctctcgttgtgacaatagctccattcacggcagccttccagttaacactggcagtttaagctcagacacactgagggtgttgagggatttgagagaggacacgctggatgtgctgatgggcctgggactccagcaggccgtcctgggctggacagtgacaccctgtctaaaaggggaacaaaaataacaacggatgggagcagcagatggataaagttaccatcttcagtcttacttggtttttgtctactttcctgagctttgttcttgtttgagccactttgctttaaaaaaaaagtaagtgtgcttaaatactggtatgtgtttgtaagtgttctctcatcggcaatttacaaagttataggcaagcatgagtaatttttgtgtattttcagaaaagagacctcaaatttatatgaatgtatgtcagaaaggaacatgaattcaactgggaagttatcaaatacaactgagatacaaatccaaaaaaaaaaaaaaaaaaaaaaaaaaaaaccaaagaccacagactgagagctccaaaacttattgacttgaatttgtgagaataggccacacaacacagttcagtgtatctgaaagactgttgtctgtgagaagctatggtacctggcctcttatcagccacatccattctctatttcctcacatcaccttacagctgaatctttggtttgacatctaaactttgccctttttaggacggcaccaatgatacgatattggattggggatccactcgaatcatacaaaatcacaggttaggccaattagttcccactaatgtggcctcatttccaaaaaagttgcatttgaa

SEQ ID NO: 27739 - DNA, 1161 bp, Mus musculus
ttacatttttttacttcatatgaaaactaactttcagaaagacatgttgtttcttttcaaaagaaatgtgtttcatttgacagttttgccacgaaatatggttccatgatatctcttatgctcaaagactctgcttttaagaatatagtttggatttttgttgtatagaaactaatccttaatatttactaaattagttggctgtgcacagctcatcatggcacccttttcagaaggaacacatttagaaggatcacagactaggctcaaattttgtactaaattacatgaaattagaaaaaaattttctcagtaacacttccctctaattcacccatattcttattttggaaattaatttattaaataagtctttcttttccataatgtcaccatcttttttcatagcaaccactagtcatagttttcggcaagtccaagcaacaagaggaaggtagtgtgaataatgacactgggcaagagagaaaaggctctgaaaacgtttccaaagttgattagtttcactttgcattctaccagcaagtctttctcttctttaatgcttagacattcattcattatttatttatttatttctctctctctctctctctctctctctctctctctctctctctgtgtatgtgtgtgtgtgtgtgtgtgtgtgtatgtgtgtgtgtgtgtgtgtgtgtgtttatgtctctgtgtgaacatatgacatccagagggcagacgattgtcaggaattgctactttacctgatcccaggcataaggctaaggtcttgaggtttaccttgccacagactggactcagtttgtccctcaacctgtgggagaatcagggtcctggtactcaggtgggcaaggagttggcagagtgacaaacagacactaacaccagagagagtgctgaatctgagtgtaatttctcaaaccaagcatcacacttataatacagaagaaaaacaagaaagttatgtgatatatcagccaaggtatatgttaaagatgcataatggctctttacacaaaacagagaaaatgcatacataaaatctgacaggaaccaggcaatgtttacaactgagataagatcagccctatgtaaagtcagctattcacaggagccaggtgaaagggctaatatgcccagttgcaa

SEQ ID NO: 27740 - DNA, 1102 bp, Mus musculus
gggcattcatgctaagtcaccctcatcggtaagatactgcaaagaactaacaacaaccacaggttggtgttggctcctgaacagtaaaccgctgactgaacttcaatctcccacttctgtacgagcctcatgcaattagttgccccttcttgatattgtatttcataattttattatgtatttatttggaatatttattaaatttctttttctgacttatagagaaaaaaaaaagagttgccttagaaggacaacagtgacaaagctactgtgacatgtgggcagagtcaagcagtgctgtgtgaagtaaactacctcaaggtgtgaagttacctcagccatggttttccttttgttccctaaatcccagtttttaatttcctttttctttctttcctcctttcatcctttctttctttctttcttcctttcttcctttctttctccctttcttttttcagcttgctgatattttatataaaaagaaaagaaaagcaagagagaagctgatagtcttgaatattttattttttaatgaaaagaaaaaatgagagaaaaaaaagagttgccttggtcatgacgtctgttcacagcagtaaaaccctaactaagacagtcaccagtccataaacactactgtcctcagacaatagattaattccacatttattccataaacatgcattgacaatatactaaccacaaaagcaacaactaacatggttgccagaattctttttgaagcattatcttctttaattccacaagctgagcattccaggctgactggggcctacgctgattattagtaaatgtctgtgtcaagacagaagttttcaatggagtctagcagggagttgaagcccggggactgtgtagttgcactgctaaaattgattgagcacagggccctgtgagtcacatgcatggctacctgcaatgcagtcagctcatgtgattgtgaaacagagtaacctctcatgaaatcccctgctactctagctatgaagacccattggaagtcataaaaatgaaaatataatctctgatatcttaatgtaagaacatccagaaatgttccaaaatggaaaactacagtcac

SEQ ID NO: 27741 - DNA, 1193 bp, Mus musculus
cccactagcataaagttgagttccttttagtgtactgtttatttttctttaatttcttattgtattgatgttttgcctacatgtatatctgtacaacaacacagtcgtctggtgtacacagaggccaaaagagggcatcagatcccctggaacagatgggtgtgagccaccatgtgggtgctgggaattgaacctggatcctctccaagaccagcaaccactaggtctgtcaaccactgagccgtcttcatttccctctcttatttgggttttgtttcatttgtgctcaatttttttccatttaagaatgtgttgtaccttcagcagttttctctctatacattcttaactctcctttttcttatttattttaaactgacaaaaacagtttttttatattatggtgtacaacgtggtattttggaatatatgttgtagcatatatattacctctgtacctaataacataagcttttgtatataattcatgtatcccctcactggccaattccctatcaatttctgctgcttgtttgtttttgaggcaagtctcatatatcgcagcctagcctcagatttcagatcctccacctctgcctcccatgtgctgggactgcagacatgtgatcacgtgtatttgtctcttgttggtgacattaaaatgtagttggcttagttacaagctgatcatgaagtgtgtgtgtgtgtgtgtgtgtgtgtgtgtgagagagagagagacagagagagagagagagagagagagagacagaccagactggtctgtatagctaggccttttctataactaaagaaaacaattccctcaacctccacacattccctttgtctggagatgagaagtgcccttcaatctgactgcaggtcagtggggcaggcttcttctaggagagagcccattcctagtctctcaccttagagctctgctggctgtttcttggcctgtcactctcactgttgcttatacagaggtcatgttgcctttcctcctagaagaacaggagtgattaagtcagggcattcccacctgggtattcctggaacaccgaatctcaagcgcagtcagtttacaaagtacctttaccacctaacgcacagaatcccgggctttgaggacatgctgtcacatgtgtgatagcagcttaatgattttcacccataaaaacattgtaggg

SEQ ID NO: 27742 - DNA, 2458 bp, Mus musculus
ctactgactctcacagacttaacaccaagccatcagtacctcatagaaaagccagcgacttctcgggaagttaattaacatctgctgaggcctagtcagccatcactgggaggagaggcccttggtattgcgaagatcatatgccccagcactggggaatgccagggcaaggaagccagagtgggtggttggggagcagggcagcgggagggcatagggggctttgaggatagcatttgaaatgtaaatgaaggaaatatctaataaatctgctgaatcagtcagttgtctagcttttgtttgagaatgctaaactagttttagttgtgttttattccgactccattcctctgatcataagttatacatttaaagagtctggaactgttagtgtcttgattgtcatgttaatagtagaaggggagaatggcaggcatggctgtgaactctgctacaagttttgagaagaaaactgtaaattctatttgctttgtcttttatagggtattccatctccctcccttgtcagcctcccttctttctttgaacggagaagtcatacattaagtcgatctacaactcacttgatatgaaacttaagtcctgtgggacctatgcttcaacaagacgctgacttaagtggtactttgaattagcacttggtaaagttgtagagaagattagtaacactaaccaacgccgttttattttcttgaaatacaattttcaagatggtctatgtaaaaaaaatatggattttgatgtaatttatctttatttgaatctcacatctgaagaccagtgacttaagttattcctgataatcagtagctttgtaaccctgatacagtaaacagttggtgggtgcaaaatactattgtgtatttgtatagtatcttgaatttttggaagtacatatttgtgtatctcaatttgtgcaaagactgaacagcaatgcaacacttgctgaataaaaccctctgattaaattctagaggcttgttcagttcgattgtttgatgtacttaactgcgcttttgcagtttattttcttttaaaataagagatctaacacatgaattttaaaggatacaccattattaaccatacaattacgatcgtttggaattttcttttgcaaattgagataagaagagaaagattacaaaacattgtatatgttgcgaagataagatattagtatgtactttataattgtttcagagacttttatttttattttattttcttattctagacactagcaaatcttgatttagttttgactactgtattgaatttatttcaaaggataagaccacgtgaaaactgtgttaagaattgcttctgttctttgtacagttctgaagttgtcttcagttttgctaatcgcctgtgaaaagcatagatataatgtgtggtgaactttttattgtggtcatatcattaaaataagattggaaatttattgtcaaaaattttgtgaatctgccattatcttctactgcaatatttcttttagtcagtaatacagaatgactgggctactatggccaagaatattttatttcttacacgttcagaggagtgttacaggtctccttgttacataattttcaataatctgctttaatagtttaactgactggatttttttctataccatgtatgtaccaattcacacgttagtaaatgaccttgttttgctatattttaaaagcagttatattagcaagaactttgtaaataaatagctttaaaatacaagtatcttttatgtgtcctgtcataatttctttagagaattttttcatagacaaatgtgagtgtttccttagtctctggattgttttgtatttattcatgtatatcagtaatggttttgagtatttgtgtagtattgggatttaagctcacctttatagaagggagtgtaaattgtgtatttcatttaaattttgtgtttatgtctacgtatacactttttcccccaggagaaaacacatagcctttcttgttttattggagatggaggtattgtcctgccaccaaagactgagtgttccaggggaagaaatgacagaaggcttgaacttggaaaacgattgggtgtagcatttgaagcaagtatctgggttttatcactaactgtctgcagtagggcattggtgtgttcccattatcagataaaggcagattgcttaatgtataaatacattaggagagtgtattggcagatttttttcattttaaaagtaattttattggcatatatttattgtacatgtgctggattttgtacttcctattgggaacattcgttcctttatatttgccctgctatttccttttttttttttttccacttttttattagtatttacttcatttacatttctttttctttccagtgtcagacttttatttatttatttttatttatttttcattagatatt

SEQ ID NO: 27743 - DNA, 1219 bp, Mus musculus
agtttccagggtgttacatataccctgatatctagctgctttttccgtagggactcaggatgtcgggccagaacttctaatttagatttcttccagacacaaactgaggaagaaagtcaggtgtgcgtctcttaagggaagtgtgtggttttttttggctttgagggataaatttaaaagaacattcactgttttaaataatgttcagttttagggtaggtagtaagattttgtatggatgtattccctgtttgaattatgtggtctatagtaaactgttcgtttacataattatttttcattatctccaagttactgtttttcagggtagaaattaagtacactgttgtcgatagtggggtagggtggcacgatggtcagatccaggacatatgtgctttaccactgagccacatcctagcccatgtcacacgtctgaggtagcttcatctataaatgttaccatgtgtgggaatgggcatgagtgcttaatggtttgattttagaaacagttggtttttgaactttatttttcaacaggagaatcttatgtatgtggctgatccagaatcctttgaagtaaatacaaaagatatggatagtacattgagtcgagcatctagagcaataaagaagacttcaaaaaaggtgagttctagtgaaattctgaggatatctctaaatgtgcttttcacattaaattaaaggaacgttgccttcaacaccaataacagaatggtctagagctgttgtgaggacctgagtgagttctctctttagaacctacggagctgcggcagagtcgggagcactcctggagtttggtgtcagctagtgtagccgacttggtgaagtccatgctaggagagatcccatctttagcaagaaaaaagtagaaagcacctgcctgatacacatcagggggccctgtactgtacccgcataagtacactcgtgcatgcacgtgtaaacacacaaacacacacataccccagtttacaacaaagctgacctacagtacttggaaatgactcacagattacattttataatggtcagtgacttctttgtcacagtgcttacaaatagcttgctgttgcattctttttttggtttggtttggtttggtttggttctttttgttttttttttttttttgagacaaggtttctctgtgtagccctggctgtcctggaactcactttgtagaactcagaaa

SEQ ID NO: 27744 - DNA, 1138 bp, Mus musculus
ggatgttttgaaggaatatttatctgattcatgtttcacaattaaggcacccgcatgaaagttgggctttgtgacatgagatttatttgtatactgatttcaatgtctatattaaaagaaattttatgaaacaaccattaattttccagacatatcaatgaggataagagaaaaacagaagcacagaagcaaatttttgatgttgtttatgaagtagatggatgcccagtaagtagcttttgtcgatggccattgaattttctgttttagtgaggtttctgtggtttgaatgtaaacagtctcaggctgcagagatgcctctggctatgtgcacttgctgtccactgactcactacctatgactccagctacagaggactggatgccctctgctgggttctagagtgcagtaagctacacagagaaaacatatacacgaagagacaacatgcatataaacagattaacagtcagagtgccacttttgaatggcagcttgtaaaagctgcttgataacatttgactacttctttactgttcacaggctaatctcttatcttctcatcggagcctggtgcaacgagtggaaacggtttcccttggtgagcacccttgcgaccgaggagaacaagtcactctcttcctcttcaatgactgcctcgaggtaaatttgtactcattgaagtttaacactgctgtattttgtgatctccctaattatttaaaataaagctttaatcgaagtacaatatagaaatttgaggtatattcagttatttttcaaaaaaaaaattgctgatttcataatgcggaatacttttggggagaaagtctaatactaactttgatacaaatttccagaatgcaaaccaagtcagaattccttacaagtaaattagatgatgagttctggggaaccttgtttttatgtatatttattcaagatacacaaggtggggttttgttttgttttgtttttaatgaaaatggaagtaggctttagcagctaagatgaaggcaattgaggaactaatttgctaacttagtactgtgactccttgatttctctttcctatgttggtagtgtctcactcactctatagccccaaactggccttgattcctgggcagcccttcc

SEQ ID NO: 27745 - DNA, 1187 bp, Mus musculus
ataaatagctgctttagagatggatctttggagaacagttgtttggctgatctatctgtgtccctgttctctttaggaggtagctatttaccagttggggatgaaaggtgcactcaccttattgttgaagagaatacagtaaaggaccttccattcgaaccttcaaagaaactttttgttgtcaagcaagaggcaagtaactccagaatgaagttacttagctttagtaataaatactatagcttctctgctaaggtcaatttaaaatcttaattaatattgttctctcttttagtggttctggggaagcattcagatggacgctcgtgcaggagagactatgtatttgtatgaaaaggtgtgtttctactcttggttctgtgaaattgcaaaatcgatactgttgtgtccagagcatttatatatgtataacaagaaccatcatagtaaaaattaaacacttttgtgcttttgatttcaggctaatactcctgagctcaagaaatcggtgtctctgctttctctaagtactccaaacagcaaccgcaagagacggagattgaaagagaccctggctcagctctccagggagactgacctctctcctttccctccccggaagcggccctcagctgagcactctctttctattggctcactcctggatatctccaacacacccgagtccagcatccactatggaggtagtaattcacgtttcatggaattagtctttaagatggagtatactgggataactagtagaataaatccctgctacagtgaatgaactgggaaggcttttctcttaatagtcttggtctagttgagtaaacaagacagttcaaaacaaaagctgagcgtagctgggtagtctacccttataattcctagattgggcaagtggagcccagaaggtgggttagagacactctggccattatgagactgggcctcaaaacaaaagcaaaaacaaaacaacagaaaccctgaagagagaaatcttgtaaaaaatatcagttgcacagtaatgcttttgttgggtgattgtttactctatgcttttgtgtgattgtctgtgtgtctgtcttgcaggccactgaacttcagaacaggagttaggaattgtccagggctatagctgaagagtgactgataattgttctgtttttctttttgagacaagg

SEQ ID NO: 27746 - DNA, 1119 bp, Mus musculus
ccaggataatgcccatggccacagcctcgaacccctgatccttgtacctctgcctctcagctcctgagatcagaagcaagggccgagcaccgggatcacatgcgtttttcagtgtgtgttgctattattatcttagtctaaaaacaatctatagtctgcagtgtgtgcaagtggacagcctgaatggccacctttgtcgtaattcattcttctctcttagagatcagctactatgaccagctgtgcacaacaatggctgaggagctgaacgccgtcatcgtttctattgagtgagtagctaccactagtcacaactctcattaagacttttattttttcatatgtgtccatgtctgggtatgtgcatatgagtactggtgcacacagaaaccagaagagtgtgttagatccctggaactggaattgcaggtatttgtaagctgcccaatatgggtggttggtacaaaactctggtcctttgaaagactatcaagccctcttaattgctgcgccatctctccagcctctgatagtcataatgttgttaagaagaaattctaactaacagtctagtaacttagtaataaaaataaaatataccatcaaatgttggaattacagatgtgtctatctacatcattgttttgttttgttttttattttatttattatttatttttgtttttttcgagacagggtttctctgtgtagccctggctatcctggaactcactttgtaggccagactggcctcaaactcagaaatctgcctgtctctgcccccaagtgctgagattaaaagtgtgtgccaccacgcccggcttacatcattgtttttgaactgggcttaatcatacattgatttactttactttaagtattctgcatttgttgtttgcctgcagtgctagggactcaacccagcacctcatatatgctaagcaagtgcctgctactaagctgtattcccaggctttttaaaatgtagtcttgtaagtttgacagaaacactgcactatatgcagcaaacattagacatgtaactattagtaagccttgtggtagactggtctctgctggctctcttagacactgttttcttgagcaactatgaagtaa

SEQ ID NO: 27747 - DNA, 1363 bp, Mus musculus
agggattccagattagatatgagttgagcaccctgcctttcttcctatcaccccgcttctgctgatagtccgtgctacattaagggactgagcagagaacactcagtcaagtcctgatccatttcgtcatgaagagagcaggacctttccattctatgaagggtgcgtgtttctggtttccagcagcaggataacaagtgggaatttactcactgacttctcatttatcataaaagctgcagcacctttatgtacagaacaatgtcacagtgtgtgtgtgtgtgtgtgtgtgagcgagcatgtgctgtctgcatatggaaataactacagcacaggctaccttgctgatgtgtccatgtcactggtctcccttttagctaaaatctgagagtagaataacctgatctttgaggcctcttccaatgttagtcttttctaaggtaatttttagtaggtcataattcagtatatactagcctactcatctctgaagactgactttgctcgtaatttttttttaattggccacatagcattaatgcctccacagggttcctgtgtttcacatttacgatataaattgatacccatcttcagctgaggttgttatggggggctggaatcacgtgttttttaaacctgatattttcattcctaattgagtgacagccatcttttaaggtgttgggcatggaaccccaggccttacctgcttggcaagtgctttacccccgaactacacctgaagctccattccttgtcccttctgcaccatttaaaggtgggaactatattttgactttatctacctctgagaaagaggaaaatgtaattattcacagagtttctcaaaatggcatctttcctcccaaactgggagccaaattctgcagaaatcatggacagtaaatggtgacagatgtctgaaggggtctcaaagatgcaagggaacatggggtcaaaggggccacccaccacatctgatgatatgttagttttgttgttctttggggttttattcttccaggtatgttatgcactacagcctgatcttttcagtctaagacagcatggcttcactttcctgtgttatgagaaggtcacactttggaatactgaaggacaatcctgaagtgctgcagcgcatagtgaatgcctcttggtgttttcacgttcgtctgtgaggactcatagacttacagaatgatgccgaatggaatgttttgtgcatgaccttttaacctttggctattgccaattccccactgcaaaggggaaggcagattttatgaagagttttaggaataaatacattttatagaatggaaacccagtatggtactggggaagtttattcatgctt

SEQ ID NO: 27748 - DNA, 1136 bp, Mus musculus
cgattcccctcttcctgtttttttgtatatttttgctccttggtttttcttgatcatagctactttgtgcttggtctatgttgtctatgatgcagtaagtaccctgtactagcttatactattcccataccaaagtcatggggaaaccaacattattttgttttgggtttatttatactctattctgcatacagtactttaaatgccaatgacagtgcaatctttatttattgtaatgttaaatgtacttattactaatgtgccctcctagcatgttatattttgtgtgttttatactttttgtaattttaggtcagtttagttccttggcaacatctgtagtattagccttctgacatctttcttgtgtttttaaagataagagcatctaactcattaaatgccaaaaaaaaaaaaaatccattaccagtgattgaaaggtttacatgtacccagaaaccatattcatctcctggaagagtgctaagatcaatgcattgtcgcgtgcctatattgatagagttatgcactagagagttctgtattttgttatcgactatggtgattagtgtaattagacgtgtacactgatggtatcaaggtaaatctatttttgccaaagctctggccttcggaagctcatccttccatcgaagtgtgtcttttggcccactgtgacgtcacttctgcattccctgcggcagtcacaggcgggtgaaggcagatgcagtggaatggtttttaaggctattcattcacagggagagtctttttttaaaaaaaaaacaaaacacttcagcactgctgctgtaaagaattccctgaattgttgaattgttacaaaggaaattatacttcaggccaaaaacccctttgatcttgcagagattccgatactcggtaactctcagaatgctgaagcgtgtgacacacgagccgacagcactttattctctcgctcgccattatttgctattcattatagtctcttcagtcaggaagttattcctctacatggcactattctctatcacatatctgtatatgtgctatggatatataactatatatattgccatttcaaaggaacaataaaaccaagtgttctgttgaccttgtctgtgccctttgccata

SEQ ID NO: 27749 - DNA, 1154 bp, Mus musculus
tacacagacatcatattatttctgaggcaaaacatctatacacataaaataaaaataaaatattaaattatcaaaaacatttgtaaataatggcgagatgtgtgctcattaggcacacgcaactcttgcaggtgttagtgaactcaatgtttacggtaggtatttttatttccacttacaactgttgagaagtgaggctcagagaggctaaatgaggtcgttgttcaagggcacactgaggttcgagaccagggggagaacacgctcccagctcctgttctgttaagccaagtgcattgatttttggatttcaaagctagtacaattcttcttaagtgaatcaattcaaataaagatataaaggaaatgtctgtatgttttggtggctgtactaaagatgctgaaggtgatgtggaacatgaacttggaaaccaacactttattggttggcatatagtttcaattctacttaaaaataaattggcgccatgtaaccatccattgctttggtaagaggaacatggtaaaaatcaaactcaggatcttaaaaatgcaaagccctgttgtgctccaccactgagcgttgatgcatgtcacactctgtttgcttttgcttacaggcacatgagacgcctgggtttgtgagtgtagagatgctcaaagagttcagtgacgagatatgttatccttcaacttgcaatgagctctcatctggaaccttcctttatatactgcacccttcctgccctctgctctttccctgctcatgccagtcctttccaccctactgtatcctctcctgtcatggtcacaacaccttggtgtgaaagctgcattgtgcttacctgtaaatgcagtgactaggagacagaatctgggttttgttcccgcagggcagtgttcactgctggcagcacaattcccaacaggagaaagcaaacaaaccacacagtgtctggggcctggaagctgacctcagtgaaagccatccctttgggttgacatttgggggtgggttgctaactccacatgagagctagccagggaaagtaagttcttcttacttcacttgtagggaaattgttggactgtagaatccttggaagaatgtcaacctctttttggtgtatgacaattagtttgtgatgaaatat

SEQ ID NO: 27750 - DNA, 1190 bp, Mus musculus
gaggctgaggtccaagagtttccatttctgcggcttcccctaccctgtcctctcttgcacttcctatgagtcaccatggagatgtcatctcttcccaaccagcacctcactgtggcttcttagtgtcttccttcttacccagagtggattaagtaacccagcttctgtgacttgagcttccaaactaaggatgatccgacttactgtaccaccgcagggagaggaactgtgaaaccctggtcttgcggcttagggtgtttgggtgtgacccttaccactccatgcagagagcccttccaggtcatcgggaacattctcccggcctgcatgtggagctggtgtcagctgtaacggacacaaactcagcaataagaggaacgcaggcctgaaatgttgttcccatgtctcaagaaagcatcagctttgaagttgttctatgttcctggtttataacgtcagaaatttctccttttgaaaataatcagtattggaattctattttacattttcctagacagggtcttattctatgttcagagtatccctgcctcagagccctctggtactgggattatagacgtgaactccactcctggctagaacacacttgaaaagaaaacatacatatatatatatatatatatatatatatatatatatatatatatatatatatataatactttaagaaatggaaatgtgttacattaaaaatgtggcctctttatttgtatccagcactgataatatgcagacagtaaagtaattgctttgtttacatatacattgactatttgtgtttgccactgtttgagtgggacagtcataggttacagaagtgattgaatatatgactcgatagtgtggctcagctctctcatgtgtgtcagaatacaaacaacagtgatccttagtaaaaatataagaccttgttatttttataactcatagattaacactgatgagttttggcctgaagataaatccagatatgcttgaccaaaccctctatatgtattaccattaagtagacctcaccgggcgtggggggactcacctttaattccaggactttcgaggcaatggcaggcagatctcagtgagttccagactagcctggtctatatagtgaattctaggacagcccggactacatagagagaccctatctcaaaatccaaaccaatcca

SEQ ID NO: 27751 - DNA, 1144 bp, Mus musculus
tgtccagaacaattttattctcttttcacaatgacattattttgctaacttgtgttaagtggctcaagaccttgaagtgacagcagcctgtggagggaaacagaagtgaccatagaaccacacagatactgaagctcagagtcccttacagcgagcaactatccttctcccttgttttttcttcctcagccctccctcgctctgtcattctcctccagcagagtgtgggaatggtgtcattggcggacactgtgcgccatgactctgaatgacaccattgagcaggattcacgttggatttcctcatttgtcccctcccccaggccgtggctcagcctgcagaacctactgtttcttccaaagcatttgtcctttcagagtatttgttaggtgaagcactggctgccatctcttttcaacaactccatggcaggtttcagggaactaagattgccccttgcagtgaacggcatcgtaactggggttcacaggctgagggagggagactataatttcaacttcctcaatgtaaactggacattaacaagaaattgttctctgacaaacttaaaacctggcagagagacccctcttcccccttagtgtttcagaagcaaactctgcctgggcccaagtgaagccaaatttggacagggttaaaaccattaggtggtgcactggctggttctgtgtcaacttgacacagctggagttatcacagagaaaggagcttcatttgaggaaatgcctccatgagatccaactgtaaggcattttctcaattagtgatcaagggagaaaggtcccttgtgggtgggaccatctctgggctggtagtcttggttctgtaagagagcaggctgagcaagccaggggaagcaagccagtaaagaacatccctccatggcttctgcatcagctcctgcttcctgacctgcttgagttttagtcctgacttccttggtgatgaacagcagtatggaagtgtaagctgaataaaccctttcctccccaactgcttcttggtcatgatgtttgtgcaggaagagaaaccctgactaagacaggtggtttgacagtgaagttactggagtctgaattgactttgtagtttttacttatctcattgtgttgagtatggaat

SEQ ID NO: 27752 - DNA, 1177 bp, Mus musculus
catttttcaagaaatcatggccagcaaatatatgcttttttttttttttcccatgaaggaaaatatagaatgatggtctggaaagttaaactgtaggacatgttagatcgaaaggaaagcagctttttacggaaaccatttctttggcattcttgagccctggtgcataaataatagatgattatcacatagttttcatacttgggggccatgggaaattactcgcttagcttggaattcatgctttggtaagaagagaaaccctaacttcaatgatttgtagtcgccggctgagccagagtgcccggagggtttgggcttgaggtcccgtttttgtttttttttttttttttgtccagtctgggtctagtctgtcaggaggactgcttagggctgtcacctgctcagaagatgatggctgtcatcctactattttgtcacttttcctcagggccctcagagattgctgaggagcctgtcacagtgggatggtagttacttaaacagtttagtggtttgaagtgtctacatctgccttcctctggactgtgactcctcctgtgtccttgatcatgtgacttcgcttagccctcactccggagcagtttgtgttagcgaggtagtggggctcagagtgaggcggagcaggggggaagcactgtgtgccggaatgggatgggcagggagggtggctctgaagggcaagcattgctctggtggctttattccttctaccatcttgctttctcactgcctcggtaaagagagctcgtttctttttcaagtatatataggtgacccatctgcttcttcatcttctctgtctaagatcaaaggaagtttaaggcggaagccctctcttccaccctttctctctttctgtggatgtctttctttgtaacattagatccagccttgacctgagtcagtgagaccatggggaccccagagctggcctttcatgcccgagttagcacctcagacccctcttccccctccctttctctccttctctccctccctctttcccctccatcagaacaccttgacaaggaacagtgaggacccagaggtaactttggatgtcctttctaataagtgacctaaagggctttcaagatggctcagcagcttagaagtattctaggcacagtcctggcaacctaagtttatcccc

SEQ ID NO: 27753 - DNA, 1196 bp, Mus musculus
caccggcccgcctttactccagccccacaaataattaatgggggagggaggacgctgctgccttttcccgctgcctctccccaccacccttttcaccattagagtatctgaacgcagtcaagaaaccccaagatacgatcgaagagccattttggtgcactgcacaaattggacacattaaaaatatatattcagcattcaggctcctgcacagagaggctcaaaaacggctgtttagattcagcactattaaccctcaaaagctggggcggaaagggtgcgtacccctcccccaccctggctagtggcggagggacccggtcaggaagcgcggcctctccccagtcggagaccacgcctctccccccccccccactcctcccaggaagcggtgatagacagttctgtgtggttctccacccccacctcccagctgagtggaggagttgatatgtctcattataacagccaatgcagccgccatccacgcacaagcaaagaagcatgtcccatttaaatacacccacgcagccccagcgcccttagccgatcagggcgcgcagcccacacgcaccgcggctccgggcttggagatccgcgcaggtcgggctccgggatcccgcggatcgacgctctcggaagatcgggatcggactcttgctggggcccgggtgggcgggggaggctgggccccgggcctctctggcggacagccgcatgaggacgcgagcgaaatagaccggggtggaattgccaaggaagacgcttcggggtggttttggtccatttctcccgcgaagagtcgacatggcgagcgactccccagctcgcagcctggatgaaatcgatctctccgccctgagggtgagcagaacgtgttttttcctttttttccaatggtctagggctgaaagagggaacgttccctgcctttctgttctaattccggggcagccgaggggttctaggctgagcccctacccctacagcaggggctgggctccccttgtgctcctaggctgttcccgaggttccgcaaggaagctggtagagcttgtcagtttcatcttcgatcggtgtaagagcattacatgaaaggctggtgtgtgtgtgtgtgtgtgtgtgtgtgtgtgtgtgtgtgtgtgtgtgtgtacccgggcaaccgtctcgtgccaaggcgcgagacccgactgctc

SEQ ID NO: 27754 - DNA, 1181 bp, Mus musculus
ttctatcatggactcatttttattctgagcgggcagaacctttggtgctgactgatagggacaggaagctgtgacaggcaagataagacctccccctgctgtcttgcttattccaatgaaggacttctctttgtagttcctcaaggccaaatctttgggagctatttttggctccgtttattttgttctctgatcgttggatccatcacaaaatcctgttggtgccatactcctttgaaagcacaactcgggatccaaggcttctagtgttatcaaccagccactggacttttctgtccagaatgatgggcagcagacccttctcctccttccttgatgcccactgtattcccaaccgtgtctgcagtgatcctaagaagcttaagttagatcatgcaattgatacagtcgcacagaatctaccagggattccttttcactcagtaaatgtactattgcccactgagccatctcacaggaccccggtgctgacttccttatcaatgatcactaaagccttgccaggtcagatccaacccattcccctcacttggcagcccactctgcccctattccttggacctccaggatgcttctgccccagtctttcccagaatgcaactttggtttctcacttctgtagagtctttattatctgttatagaaggcctcccagggacactttttgtaaattgtagctccactggacatggcgccttcaacactgtgtattgagctttgagtgttctatcagtaaaatactggttggtataaactctgggaggataagaatgttctgcttgttttgttcattagtttacttttagtggctaggacatgccttagaatttaattggtgggagggaacatagatatggtagccaaggagactggtcttagggtgtcctgagaccctgcttgttaggcaagttctataaggcatatgcttttacacaatggtaacaataataccacaccttaaattgaaattttaacttaaattatgattagacgtttttatactcccagttttattatttttaaaaatcatgtttatttgtctgtctgtaggaatatgtgcacagaaaggcagttgcctgtgggggataagttgttggatactcctgaaactcaagtttcaggcagtcgtgagcctgttagcactgtgaatctcatgctgg

SEQ ID NO: 27755 - DNA, 1138 bp, Mus musculus
tgaactactttagcttacttttgactgactccggaaatttcaagttaaaaaaaaaaatctgctcccaaaggagaaaaacatcaaagtatatatatatatacatatatatatatgtatatatatatgtgtgtgtgtgtgtgtgtgtgtgtaatttcaagctagcttaaactaaatgtatatatgtgaacaagtttgaccaagaaaaagccaaaaaagcactagaaagggtcaaacagggtggcatgtgcctatgcctccccacacctcggaggcagaggcaggagaatcgcaagtttgaggccaaccttgacttcattgtagtccagatcacagaagactacagaaattctttcttaagtaaacagagatggggcagagtaagaggtatggagaaggaaagaaggaagagacagaaaggaggaaggtgttctgtgagggttttcacgtttcagcagtactgtttttgaaaaggtgtttttcactgggtgggtttggtggcacatgtcagccctggcccttggaagatcagtgtaggagttcaagagcccagcctaggatgcatgacaccctgacttgaacccctactccaaatgacaaaattaagcatttttcttcaatatacatctgtcgtcggtctgtctgtccatctgcccatccatatatccatccatccatccatgcatgaataattgatcttctgctctactttgtaaggaaaacagcttggagacattttggttgcctgataagcagcagacctgtgtgtccttaactgtaatttgggacagtagtgtcatttgcctgcacagatcagtgccagcaagagattccataggacctgtgcatactaaagataaagagaaccaggtgagagtggtggctgtgacgtgtcaggagcccacttggtgtttccagagagattaaagaggaggcttgggcctgacaggtaaacttctttggaaatatcagaattaaaaaaaaatatttaacaaatagaaaaactctttattccagatttccctgtgattgacccagtttattagatttttaggcaatatgcaaaatggctgactcctaatggtttaagtgtgtgccatgggcaattaaaaaaaacaagtataagtacaacacaaagact

SEQ ID NO: 27756 - DNA, 1367 bp, Mus musculus
tctcttggtggtcagatgtcccatattatcttcatcatgtttatctgtgctgtgttgatgacgacagacctacagagtagtttcagttgacggagggaagggaactgctgcgtacgtctgagctagtccaccaggcagtggagattcacaggggcagaggcaaagtgctggttaacgctgtagagttgactcaagacctttcaaccagcacacaaagtgacagagctctggttgtatttttgcttttggctatgtccccagcctctgcctcattacaggagtgacctttccagagacgctcactacttccagccataatgcctaagtgatcatgatgttgccctccctgcaattttttttaagtaatttgtttttgacgttagactaaaaataggaattttaaagttgctttggaattctcgactttaaattgatttgttaagtatatgtacacttttctaaagtgtaataggtgtaaccatggaagaaaggttatcttatttgaaaattattttaagtgtgtatatacttttattgttttgtgacttaattcttttactgatgtaaaatacaactaggattctgtggcctggattattttactgcattgtaggtaatgcccctccatttttgtttagacttctggattgtgtgtaaattgtgtctaaaattgtagacatggttgtgggcttgagaggaacaaatggaatcacaatcatggccttggcgtgcagcttagaacagaatccctctcagtcccaccttgactctctgatgccggctctcgggttcctcttctcatgtctggaccctttgttcccagctaggaaaaatgtgtaacaatgtaactcacctaatcagcaacttgaaatagctttacaaatggaagaccccaagattttagttccttaatttgtatgcagttttaaatcttgtcttgttatcaaaaggtatcatctctttttgataacaagataaaccaatccagagatgaagcaagataccctaggagacgtgccgggaagggatgtctaaagcacaagatattgacgttgtagccagttgactttagtgtgacccgttagcttctgcccgtgcaaagcacaattaggaattaggctcaatttttcccaggtatctgctctatgctgctttcgattcctgctgctgggggttccttgcaggactgattgacatgttagccccaggaattccaggaagtgatttctttctgctttgctgtcttctggtcattgtcttgccaataagtagccacactggtgttttgatttcatatttctttaggagttgcatgctcttatccttcctaatttatcaaatttcacatgcatctctacttttcattg

SEQ ID NO: 27757 - DNA, 1689 bp, Mus musculus
caagatttctctactaaaataagcttacacttggaaggtacttaactggaaatgatgacgtttcatgggaattgaaacattggtttaaaccaagctaatgagtaacctttacatagagcacaggctccttcaggtgttggtcaagtctgtgtataacccattataccagatgtatgctgagttggtaatttttttcttgggaattcagtgtctaagctgaataaactgctttaatggcatcataattatgtctagcagaaagacaagaagcctaagaagtccacctggaggtttcatttggaccttactcatccagtagaagatggaatttttgactctggaaattttgtaagtgtcttactgtgattgcatagttgttggcatttaaatgtagtacttgatattaacctaagctgtgctcctagggtaccttccctagtgaccatctagggtttccttccctagttttgcattctttctgtttgaaaataggaacagtttctacgggagaaggttaaagtcaatggaaaaactggaaatcttggcaatgttgttcacattgaacgcctgaagaataaaatcacagttgtttctgagaaacagttctccaaaaggtctgttcttctgtttttacgttgtggtgggatgtctcgtaggcattagtctgcgaaaatggctgttagtctgtttaaaggtgtttgcatatgagtcaggatgactcttgctgtctatttcatttcataaatggggaatattagtatattttgagtcaacagacagcagatttcatggtgtgttgtactagggggttgagaggctgctcttgtcctggttgcttcttaaaaccaaagtcctagtgagtaggagttacaaatgtggcagtgcgtgttttcatgataggattgatcacacatctaataaactcatggttttgtctcaaaggtatttgaaatatcttaccaagaaataccttaagaagaataatctccgtgattggctacgtgtggtcgcatctgacaaggagacttacgaacttcgttatttccagattagtcaagatgaagatggttcagagtctgaggactaattggcctctgcttgtaatacaatgaaagtattctaaagaaatataaaattggactttatgagaaaataaaagtcatttcactctataaaaacatgtatggttcatcagtgtgttggatgcctagagaaaaatttgggttgtggagtgattcaggcctcttccttaatgaacagaaaggctccttgtgggtgaattattcatgcttactgcctgttagagccaacagttgggtaccactaaaaaagggaactcctgagttcttgccttgatgggccattgttccccaataagtgggatttgaagcaaaatccagattgtggagatgagacagaagtcttctaataacctcagtattgtttctacaaagtccttgacatgtttccaacttggtttgtagatttcagtggttggctttgagtgcttttctagtttgcctaaacaaccttagttgacaagacctgtgaattttcttagctttgtgcccaaatccagctttctgcaaagttagatacctgcttatgtatgtattcctttgttgctgggctagttggtgtaagacgataaatgaaaaacatcctgtttgcttaccccaagaactggca

SEQ ID NO: 27758 - DNA, 1164 bp, Mus musculus
aataaatttaaaaaataaaaaaaaattaagaggcctggagagattactcaacattaagagtacttgctgctcttgcagaagacctacattctacccagcaaccaaattaggcagagtaactccaggtcctgtgctatcttctagcctctgtggtcacctgcattcatacacacatatatccacacacagccacacatctgtgcagaagattaaaaacaaaaataaatctttgaaaagtgtaggtgtgtcttaaaactgataacatatcaattaacactgtatagccatatttgtaattttctaacatagtctattgtctaggaagacataagaaaagtgcttggaactgtattacaaatggattctgtctcttaggcacagagagagctagaacgggaaagaaacaatcagaataaatatgtgtatttaatcaatttcaaacagtttgaagtagctccgttttaaatgcctgattgattatcatcattatttccaagctggaataaataactgctgttggctgtggagacagtagtgaagctcggcctgagatcgggggatcggccgcttctctctgttgcagtaaagatgacagggccaaaaatctagacaaaaaatcttctgctattttaagatgctgtggatctaactaactgggtttctgtgccatcattaatcagctgtctgaacagggagaagagaaagaaggaggcggcaggccagttagtgcacctgacttcagcacagaaacaaggagatccggctttgtgaaaagagccacataattaatatgtcctggaagctccccttgcaactttcccacactagaagcaatgacttcatgacatctttgaaactgcttatgtatttccacaaggatagtgtttgctagcatctaaagtgtattttctcatatgaatttacttttaatttctatgttctaacatatctttaagagactataagtgataatattagcatgtcagcacatccacagagagaatacatagaaatttgcattttacagaaaatgtctgtaatgtaaataatgataaaacattggtttaaactgtttaatttatatatctgtggggatgttagggaaaaaatttagcgctttgcatattactaaatgttttcatatctagtgtcttggttaaagtt

SEQ ID NO: 27759 - DNA, 1177 bp, Mus musculus
attgggagtgtgaaatttcattttcctggggacattttcacagagtgcttcaatggccagttcattgctcggtttgtgcatctggtattacctgggctcctccctttcctcacatgttcagtggagggctctgctgctggtggagaagagctggcccctgaggtcctttgctttctcatcagcacgcctctgtcaccactcaggaattgtcctgaggagggacggagagcatgtcctgttttaatttggaaaggaaactgcagtcttccccctcccttccccgaccactggtaagcgtgcatggactcacagactcatggctctatgctcacatactccctggaggtccctggtggggcctgaggtttggctaagcctccctctcctgatgctgggcacacatcgtctgcgttcagccacgtgtaatccttcctgtctgcctgggagttgggcacaaagtactggtgcttgggcccaccctcttctttagtggcaattaacctttactacagagcttcctttgaagtttgctcgtgtttttattacaaaactgcaacaagaaacataatggggggaaatgtctaaatttctgagttacctaatctgttcaattccctagtcgggctcctcttggcagctgttttacacagctatgatctcaaccagtctgcctgagatcccaaatcatgtttctgtctcagcctatttttaagattagggagctgctaagtaccacacacacacacacacacacacacacacacacacacaccacttattgctagcaaatgcacatggatgtgcatattgtgcgcaagtttgtacagccaagttaacatggtttcatggttttagctaaagtcgagctttgtgctttaaacgttagcattaatactgccttagtctctgaacactttctatcaatggactgactcggggagcagagaggaaaacatttccgataccgacaggaaggacaacatggagtgataagcattttgatggccattgaatgctattaatgggtgaagctcaggagcttgaatggcatctgcccagaagattttcagttaaactaagcagaggagccaaaagaaacaactggtgagttatataaatcccacaaaaagagaaagcaactcaggccagccttgcaaataagggccaaagaattatg

SEQ ID NO: 27760 - DNA, 1251 bp, Mus musculus
accaacagtgcagttcacatgaactagcagtgctagctcgatccacttgcaaacaccactcacaaatcagcaactgcagttctattcgaaaaagccacgagacccaagtccacagaagtagcaagaagtcactggaatatcatgagaagttttttgatgcatttttctctatgaagtcataacaaacgatgatcagcaaagaaggcaaggtaaccaataccacagtgtcatcagtgaagaccagtatcaacaaaaccaaacaaagctcagcaaagaatggcaaggcgaaccaataccacagagtcattcacggtctgttttacttataccctttccaaacattacctgtcttctcaagcatccactctagcaaaatatcacatggtcattttccaggctgcttccagaaaaacatctgttctcagcaaaacatccccccatgtgtctgtttcagcaaaaatatcctctcacatttctacttcagcaaagcatcttctctaagacagtttccagtgccgggcagtggtggcacatgcctttaatcccagcactcgggaggtagaggcaggcatatttctgagttcgaggccagcctggtctacagagtgagttccaggacagctaggactacacagagaaaccccgtcttcagacaagaaaaaaaaaaagacagtttccagagaaatatcacatgacacaaccaagtctccaaaaaccccagaaatttccacttcacctatattatatgtgtgcacatacagatgtctatgtgtataattcctagaaaggcactaactttttcatctgtgtgtatgtgtgtgcgctcgcaggaggtccaaatgataccaggtgtcttctattgctctatattttatttactgaggctgtgtctctcactgagcccagagcttgatgattccagcttgtctagttagccttgcctcaggattccttgtctttgctttcaagtgctactacacctgcatgatttatgtaggttctggggatcccaactctggctctcatgcttacatagtaagtgctttatgcagtgagccatcttcccagcactcaggctatggtaactatttttggtggtttacatatacttggcccagggagtggcactattaggaggtgtggccttgttggaggaagtgtgtcattgcgggggtgggcactgagaccctcctcctaaccacgtggaagccagtcttctgctagtggcctttagatgaagatgtataactc

SEQ ID NO: 27761 - DNA, 1100 bp, Mus musculus
ctttcacaggggtcacatatcacacatcctgcatgtcagatatctacattataatccacaacagtagcagaattataggtatgaagtagcaataaaataatttatggttgagggggtcatcaaaacatgaagaacctgtgttaaagggtctcactaggaaatttgagccaggtgtggtggcgcacgcctttaatcccagcacttgggaggcagaggcaggtggatttctgagttcgaggccagcctggtctacaaagtgagttccaggacagccagggctatacagagaaaccctgtctcaacaaaaacaaaacaacaacaacaaaacaaagaaaaaacaacaaaaaaaggaaatttgaaaaccactagcacataataaccaaataggagctggaaagatagctcagtttagaaagtgcttgccatataagcatgagaacctgaatctgatttaagtagcacatataaaaagcaaggagtgatggtgtgcttttaatcacagtgctgtagaggcaggcacaggcagatccctgaggctccccagtaggcggctctgtcagtagctgagttctgggcctagtgagagaccacgcctcaaaaaccagctggacagtgctctagaggaacaataccagaagttgctatctgctttagacacacacacacacacacacacacacacacatctactcatgcatacatatacatatacaagcccacctgtataagcacaaacattggaagtatacacctgtacatgcacatacatacacacacacaaaataatgtgaatatatctttaatttctatcttacaagacaaagatgacattttagagtagaattttcatttgttttagatgaataatcaatctactaccatttaggaagcccaccagaaatgttcaaattgtgataatgcttctgattcatttattgtgagatttttctgccttgttttccctatatgtaggcttagatttttcaaaacctaccttaataagggttcttaaattctttaacctctcttgtagcctacaacccaacagaggtagtggaaaggaaaggttaatagagcaaagggggatgtggacctgttta

SEQ ID NO: 27762 - DNA, 1212 bp, Mus musculus
acaaaacaaaacaaactcatacacataagataattaaaaaaaataaatctttaaaaaaaataactagagacagcaacaaaatgtagcatggagaaatattttaagccacaggagttgcacccacaaatacgtataacacacggaggacactggaggaaactgttctggattcaaatgctgcctctgtttcttgctgctaaatgttagtgctctaggtctccaaggctcagaaaccatttaactgatttctggggttaggtttcgataaggtggtggtctttactccttgttccctgccccactcaaaattgaaattgtctgggggattacatgcaatcatgaggcatactaaaaacaattccttgttaatctaaaatctgagttggctgggtatgtgtttttcctagtctcttgactctaccagctccctccaaaataccttggctccaatgagccatgataaaacaacattccatagggaaaatgtgaaatgatgtgtggtgctgccccctgctgttaggctacggcaacaccatctactttaacagtgtgtcacctgatgctggtctgttgtttgtgtttttttgttgttttgtgttattttgtttaacagaacctccgaacatagacacatagctaagtggagtttggttaccttagctcctataatataaacttatgactacattagttctcactaacaccaaatacattcctccttaactaggtggctttacaacttttgtgtttaaagacacagttctgctatgcagtcctggctgccacagaactcactagagaccaaagctgtctcaaactcttggtaatcctccaggctcatccttccaagtgatggaattacagacatgtcaccatacctggctgctcttaagcctttttatgagggggagtaaaaacatctgtacatttatgacttaaaatttgcactggatttcagtatgctatacttcagtatgctagtctttaaagttgtaaatttcacttaacaaaggccaccattatgttcttttgttatgacagaagcatgggttggtttggggagttacctgcattgcgctggacagagggacaaatgtttttcaaacagcacatctttgaaatgccagacttagctactcagtgtacaatcagtactgaagctgaggagcccagggttggccaggagaggagacccactgactgcctcaggct

SEQ ID NO: 27763 - DNA, 1201 bp, Mus musculus
ccatattaatgtacagaaatgtcatcttagtatatgtaattatttgtcactcacttgatactcagtcatagtagtagattgaatgtagagggataacctccacaacacagctgaggagacatgatgagtaggacaaacaggcagaaacacagttttctctgttgacattccttaaataaactattttcctctttaatgtttttactcttgaaatagaggcctaacattaaatgaagatgagtattagttatgatcagtgtatctagagaggaattatgtgaataagtctcaaaccagtgacctctattagttaaaagttaaaacacgttttggcaacttttttataatctagctattgacctgttctttgtggaattccttgtttggtatgtttattatacttcagtgtgttttttcatagacttacagattataatttcttctataagttgacagttcacatcttcctttgctctctttattcgggttttgatatttttgctttttaaagaagtctgtgtctttgtaattgagaactgtcacttttctccaaggcttttaaagaaacagtttttccatcgggccctaaaagtaatgaaaatgaaatatgataaagacgtaaaaaaagaaaaagataaagggaaatcagaaagtgggaaagaagatgataaaaagagcaagaaagaaagtgttaaagaagaaaaaacaaaaaaggaaaaagaaaaaaagaaagatggtgaaaaggaagattccaaaaaggtaagttttcctaaagttaaattaaaatttaaagtcattataggcacttgagagatggcacagaggctgttgtaccagagacccacattcagtttcttcacccacgtggaaactcatcacctgttaactctggctcccaggacgtcttccagccttcttaaaacactgcgtacacatgctgcagatgtaatgcaggcagagcatccatacacataaatgaaaataaaatgattgtgtacatgtgctctttattgtcctgtgctcataagctttaagagccatgtgagatacctgccatgattatttgtaaacaccgattttacgggctttgttggtgttggaaatggtgagacttctcatgaatatcacagcttttgctgtcttgagtgtttgattctttccacctgtctgtttgtaggaggaaactccaggaactccaaaa

SEQ ID NO: 27764 - DNA, 2225 bp, Mus musculus
gcagctcctaaaatattgtcaggtgctaagctgatctaatcttaagtatttgtctttatggtgcataaaacatgcaaatagagctaaatattgtctaggttcttacaaacaaatattacctgtagctgcttcaaggcttaatttcatttattcaagagaaaccttgctccccacagctcgctgcatcctgtttctcatcatctggctgataactggaggaaggcaccacttttggttcctgccaaacctgactgctgacgtgggcttcattgactccttcaggcccctgtacacacatgagtacaaaggaccaaaagcagacttaaagaaggatgagaaatctgaaaccaaaaagcagcagaagtccgacagtgaggaaaagtcagacagtgagaaaaaggaggatgaggaagggaaaggagctccggcagaccatggaccagaaggctcgggcggagagcggcactcagacacggacagtgacaggcgggaagacgaccgctcgcaacacagtagcgggaacgggaatgattttgaaatgatcacgaaggaggagctggagcagcagacagatggggattgtgatgaggaggatgacgacaaagatggagaggtgcctaaatctgcacatgagaaatcataatctgactagctgggggactaaataagtacagcaggttgggttttctgtgttggccgatcatcatgatgtacagatggcatttgtagcattctttaaatccattttctgaaatgtatttgacattcagttacagtcagccttttgttttgtagaacgttggtactgttattggtacagtttaaagccattaataagttttatccatctgataattttacagtaagtaggcctcattttgatagtcatcagaggtacattgtccacaatgacacttagaataagggcatttttgatagttgtatggctttttactgttagactaatggaaattgctaaagaaactgcagcatttcagattatgcataagtatatagccacttggcagtttctttaggatcaaatgcttaaactcattgttcttgctagttatgctctttttgggtttttaggtttgtttggttttttgttttgttttcataaacttataccagaaaaattccttttttaaggtttttgagttagcagggatcaagagcattttgtggaaacaagccagctagtaacagtgcagcaacccttttaattcagctacagattctccttttccagcttaggaaatcccaactgacctgtgcgttcaatccagagaaaggcggtcatctccagcagaagtgaggagcgctgactggacggcgaggctcttccttcctccccatctccttgtcataacataagatgtattctgtacataatttacaaataaaacattttattttaattgttacttattatttagacatttctcaacactgaaatttgtaaaacaaaaaccatgtaaggtatgtttttagaaagtttcagtaacccacagaacatctgatctttctacagcagcttcagttgtgtgccaacattccatgtattttaatatgagtaaaagttatccttattaagtaagaacagacttaaagtagtagctgtttgtacgccttaatgttcattgatttattttaaatctttacatttagaaatgggggctatgtcatcagacgaggaggcactgctgtgaaagacaatttgctgttctaaaataccaattaaaaataaaggatataaaagaaaacacagcaagccattggactctaattgcttcaaactagtttggccatttactttttacacaccttcgctacaaaccttctttaaaacgcctgcatatacacaagcaatccttggagccacgttttacaccccagtgagcagtgagtgattttcctttagtcacacggtggttttgctttgtagttagtaggtgatggatatataggtcttcatcctcctttaggctgtttctcttcttgtgtttgtccattgtctgtatattgacagcttatgaaatacagcttgacttgtttctttagtcttcctgtgtggatggaacggtaggtgcggtcctcagagcgctgtgcattgattacagtgcctcggtgttcttccttcacatttatttgcagagccctgctgcctcgtgtccacagtaaggaagaggataattacagcttatgagcttgttagtcacagg

SEQ ID NO: 27765 - DNA, 1172 bp, Mus musculus
tggctcacacctttaatcccagccttgggacacagaagcaggcagatctctgtgagtccaaggccagcctggtctacagagcaagttccaggacagtcaggctacacagagaaaccctgcctcgaaagccaccaccaccaccaccaccaccagaaagcagatcctgcttgtgctagcaagtatttaaggagtgagtgaagatggggtcaaagtcacttttaatggtgtgaattccggtgtcactctggggctctgtgaatcaggttgtaattcttgttttaaatgctaactaacatcagttgctactcacattctctataaagatataaaaatatattttaaaaactttatgtatcatagctataggtttttaaagcggggaaatgcccaaataaagtgttaaattacaatatataatagatgctttcaaattaaggtttttgtaagttataataatctaaatagcccactaatctgatctttgtaatttgtctcatgattctggttacttttaaggtgttttttaagtttttgaaatatacctaagttgtaaaatatcctgtgttgtttagatctctgttgcataaatgctgttcttgtgtctgtattcttagaccttaagagttcagctgagaatacagggtgtaatttttgtgtatgattcccacattgatggaattgactgccaataacctcattcagagatgggtcttggtttgtacagtaggggattaaaaatcaaaattcagaaattgttggaaagtgcagggattatgctagaaatgagggttgtacattacagacagccatgcacagggaggcaggggagggaggctgctgacttcaagcctcttgaatttggtgagaatgctttgcgaatggcacttaaaatttgtttcacaaaggcaggttgttgggattatctgttttttaatattttaagcacatttttagaaatcttgcttttggttctgaccattgttctaaagtcaaagttttataatttaaaaaaaaaaaaaaactcaaaacatgattcatcaaggaaaaaagcatcaccaagggggaaagaaaacatgttctaatcttagagaaagcaaatgttagggttataatagctgtgtcttacattggatgttgtattagagacctcctcacaggaaatgatatagttc

SEQ ID NO: 27766 - DNA, 1112 bp, Mus musculus
ttctcagctagagaggctgactaagtgttgtagtttgaagacttggggaatgccagcaacacttgctgctgactggtactttcagcatgtgatggcctcacctcctttcctgcactgagtcccatctacctccaaccccacctccaaccccacctccaataaagtacacagactttcttagttttttacatggggttgggttgcatcctggcttggagagcttcaggctgttgtactagggcgggcctttataacttcaccagttgtatttcaatcaaagtcttatccatctatgcaatcatttcctagtttcttgtgtaccatatgtctgtgtgacttattccttgaaggttatttgagaaggggagtggaaaggggagtaagcgacagataggaagatgatattgcgacctgaatgaagacgtttagcatgatgatggtccttagtagctagatatccttggtgatggatagcgggacaaggtgtgttgttagttgttttgtttgttggtgctagggactgagtcagggcctcacacgccacctgagattgcatactgtattttttttcttgtttgcctagactaacctggaattgtggtcctctgaccttctctcaagtgctagaacttaatatctgtgccaccatgccaaacctagcccctatggttttaacttgtcaagatttggttaaaatcaaattaggtatttctctttatcacctgtccctgctctgaggagtgttgatattaatagtaccactggtacccaagttgagtaatcctggatttttgaagatgataatcagagggagagaatctgtcaaaatgtaggagtttgttatgatcgagtggccagactacagaggcatatccagtcagatatgacagttggctcagttttgcagccagtcataaagggaaggaaggcactgcaggacagttgctgactggtggactccagtaagcccaagcccacttattttcttggcgtaaagcagaatgacccgtgacatgaactgttccaactccaggcttcagtactgatatgtcactccattcagagcgttttgtttcatatcaaagctgggttttgagtttagctgagtacaa

SEQ ID NO: 27767 - DNA, 1141 bp, Mus musculus
cccatgtgctacacaagcgttctaacatggagttacacatccctgtaacttggcatcgtctgatttctctgagttgaaatgtgtcctgactctgacctttcataacagcccttgtttatatacttcctggcctcaaacatccttcctagactccgtagtgacctgagcatctctgcctgtgagagcgtggatctttagcgctctacttgactatgtcttgtcttctttcagattcaccttttcatcttgatagcactaagttgtgctttacattcatttgcctgtaaagggtagacagctatgtattcgatgagtccatccctcagttttccacacttagactttggaaattatcacaccatgtttctctttagcattatttagctatcacagtgcttagattgttatgaatgaatcttacatatgcactataaactttgctaacaaatcctttcatgctgtagttagaaatggtttgtttctttctttctttctttctttctttctttctttctttctttctttctttctttctttctttttttttaatatctatgtcctggtctgtgttgtctctagggccagaactgggtttttgcagagcattgtctggagtcttctcagcctcaaagtaccatcctgccaggattgtgagagccagtggggaacagcgctggcccctaagcctgaagtgactgggtgcttcaggggagagtttctagggagacctgccatcttatttttccttagctagaaccatgccaacagtcattttaaaaagagaaaaggaccaaaccctctatttgtagtctaatgtagttgccaatagttactacagtggacatggttactgttttcttgtatgtatttttagggtgtaaaaataacttgattttctttactatttgtcctcaagagtggatgccttcacttgttggtaattctttctatttatttatttatttatttatttatttatttatttatttatttaaaataacttgattttctttactatttgtccttaagagtagaagccttcacttgttggtaattctatttatttatttatttatttatttatttatttatttatagctcaagctggtgttgaactcatgatagctctcctgtctcagcc

SEQ ID NO: 27768 - DNA, 3256 bp, Mus musculus
atcagataactgctttctcttaagactttcctgcatgaggggccatgctgtctgtagctctgtgctttgcatttctgccttttaaaaaccctcagtctgattctggaccctctcggttataaggttggttgcttgtagggctcttagtcttcttgtgaggctattgtttttcctgattcttctagaacccactttgtgattaagaactcatttttccacagtaatgtcatttagccttatgttttcagttgtatttcagtttgaaagatgaagatatcttgattatgataaatatttgtgtttttctttcaacagtgacattgtgaggaagattgatcagtctgaatttgaaggttttgagtatatcaaccccctcttgatgtctgcagaagagtgtgtctgattctgcttgccgccattcagtgcatggatatccacccgtcagcctgctcacagttagcattttatgttgcccctgcagaagtcgctctcggtatcctgttggagactaggaatcatacagataaatagaactaagaaacagaagctagcttcctgacaatcatgtcgaccctgcttatgcttgctctccagacactcctaatgaggaaggacggtctttgtgtaaaggaaacaacacagcttgtcaaagaaagcctctgctgcgttgtgacactcgacgggatgacatcatcagtctcccacagttgttgtcactttgtgttaagtcattgaaggcttaattgcgcagtggagggccatgcagagtagtgcatctgctagtgttactggttgccgaggtccctcagtttaagatttcctcctataaataaatcttctcattactttgggtaattaataattatgaattgggttctaaattattagctgtgtttcaaaaactggcacagtgatttatttatttgtttttaattttttaaaattatttttacactaaggggttagcttctgagcttgccttttcagtgaaaactagcatgctgatgtgtgttcagaggcaggattcgagagtggcagctgctcacatacaggaaaaagtagacgtctaaagtagctacagaaagaacgattgtagcattttctttcttactgtagagtaaatcctacagttggtgtttaagatttgatgtaaataatgaggaggctctcacttcttagccagcttagaaaagcattccgtttattcaggggaagcggagtgaatatatttttattattatttagtatatgggaaaataaattatcttctgagtagaatgtcttaactacttttggttccttctccagagtacattatctgtactttgacctttcgtggagtctgcggtgaaattcaagaccaatgatgatgaccacggataactatgtaacacacacacacacacacagttccagctcttcctgagctcctatgtcatagctaacatgtgatacagagtgaaatccatttcagggcagggttcctcagttctctacactatttttattaacagtaagtagtatttagcaatctcttatttaaagaagtaccgttttaagcaccattctgctgtttattttaaatatttttatataaaggactttaaaatgatcgtctaaataagctacagttgtcaaatcagtaaatttaactttaggaacgccgcgcagtgctgagcttgtgatgatttaaaacctgtaggcatttgaaaatcacttggagaatgctacgtttcattagaagtgtgagttgtgtcaagtttgtgtcatgcattttcaagtaatgtaagacagagagcagtgagaacccccattgataaagccaacaaggggccatcgaggccacttgccaaaacctgaagacctgatgatgcctgcagcccacgggctggtggccatggcgcgcgcagccctcccctgcaggacataaatgcgagggagcagaccaataagtgcagtgcgtgcgctgacacatttcatgttgaagtgtgtgtttcccctaagacctggaacagctgtcttaatctaaaggcagcattcacgccctaagctgctaggagctcgggggtgtgtatgctgtgacctaagtggtgctctcccttggggcattttagactgagagctgttgaagtgcacagtgtccagcctgcctgggactctttggggctttgtattccattttgagaaactttttcttcaggttattctttttcttgtggccatatttcttattggagtgtgagtctgtgtttttttgtgaaaaacattttaagaaaggataaccagtgaattatcatgcatttgtcaacaaacttagatgagtaaattcaagttgtatgtcttccctaccctcacccacaacaaaacctgtacattttctgccaataacatttaaatgatgaacagttttctgtgataaggttttaaccataattaatggtggtctttgtttttaaatcttttttttttcttattgttgttaactaataagacttactatgtgtgttttatacagaattattacagatgattttaattcagttctagttttcagtccttaagtgccatgcaaactctctgtatgtggtggaagcctccttctctcagagtctccggggagacaggcagagggatgggcgcttggtgtcttagacaccacttatgttgcataagcttgtgatcagatcggtttatcacatgcagctggatgggtgtctagttatctgtgtccctgttgccagtacttatttagaaaattgttttaatttttatcatgtagaacactgccttgttcactataatgtaatctgtatttgtataattttttttacattaaaatctttaaataaaatgtttaatacctatgaggagtggaccattttcaacttaaaaacaaatgttccgggctagagagatggctcagtggttaagagcactgattgctcttccaaaggtcctgagttcaaatcccagcaaccacatggtggctcacaaccatctgtaatgagatatgatgccctcttctggtgtgtctgaagacagctacagtgtacttgaataaataaaccttaaaaaaaaaaaaaaagccgttcgtggtggcgcacgcctttaatcccagcactcgggaggcagaggcaggtggatctctgagttcgaggccagcctgggctacaaagtgagttccaggacagccagggctaaaaagttccagaccaggactgtgagcatttgttccagtcagtaattatttctgtaa

SEQ ID NO: 27769 - DNA, 1190 bp, Mus musculus
gattctgggacgggtcagctgggaggggatggcggtgcacttgacccgagccgccgggacccaggagacctggaccctggtcatcgccgccatcccccggccgtctgcgctcggcggggatgccccgggctggccccagctctaagcgtccggcgacgcgggcttccgggcttggcgcctaacctgcccgcgcccctgtgggtgccacggctcagggtgggtcaagtggggggaggcgcagccctggggcgcctaggtaaccctagagaacttcccgcgggccgggggcgtggggtatttccaccggcggcccccgcagtggggcgatgtggggagggcacttagggtgatcccagtcacagaggtgggggttgggaggactcctacttcctctgccccctctcacctcaccagacgccgggagtcccctgcttccctgtcctttgggttgatgatgagtgggtgtctctgcgtgtgcgcagggctgtgggggcgcccctggtctaggtcatgccttctgcccttttccttggctcgccttggctgaggtgtccctgtagtggcgaaagtcacagtacggtggctaggtggctttcgtccataattctctgggtttgtgttaacataaattgctgggagtttagaagcaaagctttttatttgtcggcttttactgggttttctccagggagggaagtggatgaatactctttttcgccactctgcctccatttgcattctttgtgaggtctgtctgccttgtgctttttgtcccggattagtcttgctcatggatggagatttccaggcgtggagtcttacagcttttggcttccattaggcaaattcgctaaccttttaaagggaaagtttttttttcttcttcattccaaaaagatagtatgtatgaatgtacttgaagtttagttgcatatggtaggtatattaacatgtatcttggggggtggggagaccagaaactacaggttttttttttttttttttctaacgagaaaggattgttttttaaaatttaaatggcatgcatagttgagaaagcctctggtactgaggtttggttattcgtattctaaatttgtgtactcgtccttgtttggagaggcattatttaatgcttctgttacccaccgtctggactgcttcctatttagatgaagtttcttttagat

SEQ ID NO: 27770 - DNA, 1156 bp, Mus musculus
tgtagcattttcaattatatcttaaagtacagctaaaccaaaacagagttgtacaatctattgagtaagaaaattcatctttggaaagtaaacatttctaagtgagtcataagtatttgtatacattccccttttctcttcagattaggaactgagaacaacatgccagttgcagacttaatcgtttaaagcaccagtgtggccatggaaaacctccagtctaagttctccttagttcagggttcaaataaaaagctgaacggcatggaggatgatggcagtcctcctgtgaaaaaaatgatgaccgacattcatgccaatgggaaaaccctgaccaaggtgaagaaggagcacttagatgactatggagatgcatccgtggagccggatggcgagcacgccaagcgaaaccgtgtttctctacctgaaactttaaatttaaaccccagtctgaaacacacgctggcacaattccacttaagcagtcagagctctttgggtggaccagcagcattttctgctcgatattcccaggagagcatgtcaccgactgtattcctgcctcttccctctcctcaggttcttcccggccctcttctcattccttctgatagctccacagagctcactcagactcttttggaaggggagtctatttcttgttttcaagttggaggagaaaagagactctgtttgccccaagtcttaaactctgtcctccgagaattttcactccagcagataaacacagtatgtgatgagctgtacatctattgttcaaggtgtacttcagaccagcttcatatcttaaaggtcttagggatactcccatttaatgctccatcctgtgggctgatcacgttgaccgatgcacaaagactctgtaatgctttactgcggccacgaacttttcctcaaaatggtagcatacttcctgctaaaagctctctggcccagttgaaggaaactggcagtgcctttgaagtggaacatgaatgcttgggcaaatgtcagggtctctttgcgcctcagttttatgttcagcccgacgctccctgtatccagtgcctggagtgctgtggaatgtttgctccccagacgttcgtcatgcattcgcacagatcccctgacaagagaacttgccattggggctttg

SEQ ID NO: 27771 - DNA, 4792 bp, Mus musculus
acaagtactaggtattccaagatatgcaggaaaatggtttgttttgtaaaaagcaaatggcagtttgtttcctaaccatggtaggatgattaaatgggaaaaactcagtgatggaaagctaacatagtcttctaaatcacacagctggcagaactgaggcaaagactagaccatgctgaggccgacaggcaggaactccaagatgaactcagacaggagcgggaggcgagacagaagctggagatgatgataaaggagctgaagctgcagattggcaagtcgtccaagccctccaaggactaagagctgaagaagacacacctgtgtgtggttgacagggctttgtgtttgtcgcttgctttgaaaattgaattctaacatcttatttgcatgaaggtagctaggcattctgttcatttgtatggcagcaaaagtgaagattatatattaatacaaaattttccatttccaaatgaatgaaaatgtatgcttctttgtacttttccagtgggcttggtaataataacctgtgtaatttgagcctgtggtcagtctacctgtatttctaacagttgcatactttccaaagctgcagtctgtggtggagagtacctgtgtccatggtatgcaatatttcaggctcagcttagatacagaggtaatgtttatgatacaaagctattttgtatccttctcattacagactcttgggaagccggttgttaatttgttcaggttgtagagtgggtttcttctgtttcctcctagaggaatttgattgatggaatgatagtaccacctccctaacaaacagtgtgtgtgtgtggaggggaggggcagcctttgctgtgccctgatgctgcacacaagaagcagttgtaatttgtctttctgtttaagagtgactatctctagattgtgtgtgtgagacttcagaaaattaaaatgatttctgaacttttcctgttaacagtggtgtggaagtactcattcatgctcacgaggaaaatggattccactgatgtacgttggttcctatgtaactcataatcttcttgtacagttttatatgtagtcttacaaaggtcttatgaaatttatataatggatttttttcttttaaattataaaatactaaatatcttgaagattattttggacttttgtatgtttaaatgttatcttaaaacttgcacgaatggaccattatgactctttaatcttaaaatcaggaatttacagtcagctaagaatatgtggtaggttaacagtccacaattgaagtatctgctactagcaggaattttagatgacaaatgaattccgtgatttggggaagggcagcctttgcacttttctttgtttttgttttttgcacataaagtctgatgtttttatcaccgaatttcacattagcagatgcttggcttgaaatttgctagggaaaattttcggggaactttgtaattttttggttttgttctgtttggccaccactttgcagggatcctcttgcctctgcccacagtactgggtcgacaggcctgagctctgccaccaccggccctgtgcaggttttagggatgtttctgaaagcagccctggcattatcttctgttgcgtgtgccccgggctgtctcatagcgctacatgcacttgagatctgtgcttaggaacaacttggagtttggctgtcactgtcctccatgcggtaagacatcggagccctgggttatcatacctgcttatggtcatactttgtttcataatacttgtttaaaagatacttttctactttccaaacgggagtttgttttctaaatatattgtgaccttactgtggatttattctactctgctctataatttagtgtggtgacttctgtaaccttgggagaagcacgataggtggcacagggaccatgtatgtcattgtatttagatctggagggaggaagccacgggcacctgtaaagccgccttagcttagtagtcagtccattgtaccccagcttggctgcgtgggaggcacactcaaggactcgcaccatttatttttctgacagactcagaagtgttctgcttgggtgctgcttataagtgtgattcttctagtcttgaaacttgcctcgtgacattgttgagcggtagtcttcactttccagaagatgaaatgatgtgccatcgttttctgtctaaacttccttacaatttttaatcaactgtaaatagcatatctactgctgttgaaagtaactttaatttacattgcatcatatagcttgaaaaccacctttgacattctgtaataccccacaagtgacctctgctaaaatatccagatgaagcttacttcgtgcatgctcattctgtgtgctggttgctctcgtaaggttggctttggtgtgaggtctcgtgtgctatgccaagttcactaggcaagcagattttccttcagagtccatactctgtttagggaggaatgagaccatttattctgagaaactatgtttaggagtggaagaaacacagcgttagctttcatactgagcaaagactgacgttgctatgggtggtctctctctgtggtccagactgagggctttgcaccaagtacttaagtgtggaagctcctgtgccatcaaggaggagtttaaacaaaccacctgccaatcacagctgagactgagcaccgaaagattctaccaacttaggtttggctcgggctttaacagttttgaagtatagtctttagcttgaatctcttgtgttttttgaagataaggatgttttatgcttcttgagctaattttataacatatttaatatataacctgtttatatgtaaaatcttttgtacaggggtgggaaggagtaatgaaaaacctgatttgtacatagtgaagtttatgtgcagaccgaagtcagtgaaccagtaactgaggtgtttgcaggctctccacatccttcagagtccgtgaagcgcccagtctgtgtgtctctggttcctgtctgcagaaaagcaaaatgaaaaggaagcacaagtaataggaactgtgcccgaggtatttccctagcaggagctgcaaagctggtcctgggggtctgcatcccctctggaaggcctgccccacatgccgtgctctgagtgaggagggaaggatgtgtgtttttgtttgttatgcatttactctttagggcaggacgttacaaactgatggtaaattgtgttcatgctatgtacatgtgctcctgaacttggatctacttgttaatggttccatggaagcaatcagcagtgtgtgacatgaactgctgcattatgtatttacttgtggaactgagatatgtaaacagagcttaccttttttttttttttttttttttctagtgtaaaatacttaagcatttccactattggaagaaaaaacatatatggacattttgtattgtatcttgtttaaaaggacagtcttttttaatcttcccacttaaatggcttttaaaatatataatacaatttgaagcttgtttagaaataggattaaatgtcttatatagtgctacagttttggaattagaaagtgatcaactataaaacattttaaaattaagcccagaaaacaaaatagtgtttaaagttagtttagtataaaagaaatttataagatttttttcttcaatataagatacctcacttgagaataaagaaagcacagcacatttaaagtaattctcatgaaaaccccattaaaataattgctaaacctaggacatcttttgagttgttagagtttgggataaatgtagtcaccattagtttctctgctggaaggacttaccttggtaattttaaggcagtgtaatagttcaattattcctcagtttctaacctgtgaaggcagtaagtgaatggtcccttctgcaactactgaaacaaattagctacattgagcataattgataattttgccaatgcatatagttttatgattaaaattgctgtggttggttgcattacatgacacacaaaactgtcctctacctcacgtgaaataaatattttatatggttttactaaaaaaaaaagactcatctatctggttacttagtttacaaattttggattatatttattgaaacatgacatactgtgctcttggcttatacctcaattgtattttgagatgtttgccattttcatgccttgtacataacttgtatagattggatgatattcccaataaaaacttttaatgccaatgaagtttggttcaagtcatcttgatatcaactgctaactttcctgttcccctacgatggacattttcctttcatttatttagcaggtctgtttctatgtgtgcgaatgcctgcatgtgtgtatgtttaccatgtgaatggctggtgcctacagaggatggaagagatggttgtgaggtgccatgtgggtgcccggaactgaaccagcgccttctgcaatagcaggcacgtgcacttaactgctcaactctccctctagccccagtttctctgtactttattacgcacatattacaagaaatatttattaaaaattacaaacttttaccagaattttgtggttgtcccgctacttggacaaaccttagggtaaacagtgagtatctgagggttgagacaggatcagcttggctgggggtttggttcaggtgatgtcattagagatggcctagaccagagggcctgctgtggtgagctcacgtgggtgttgacaatctccaagtgtggatgtgttttatctgttgatgat

SEQ ID NO: 27772 - DNA, 1190 bp, Mus musculus
ggccctggaagcatcatagaatgacacagcagaactagagatatttatctagctactgagtaactgtgttcctgctgaggcattaacagtgctttctgccagatccacaggtggcataatagacctgagggatctaagaaaggactgggccaatcaagcctgtggatatgcactttagacaggcacatgctgaggaatgtagtagaaaggaagaatgggccagaggttgtgtgagagaatcagaaaaacacatctgtaccaaaaagtcagcatccaccaagtattgtagctcacatgcttaatcccaagactcaagaggcagaagcaaatagatctctatctaaagctatcttggtctaatatatcaagtaccgggccagtaaggactacatagtgaaactgaaaaagtaaaacgtaaaaacaaaattctaggcctttaggcccaggcttggggaatgtgacctttgtgactcaatgctccaaggtatgctaatcataaaacagatagcgacattcctccacccacccgcttcctgggttcaaagagtgttcattcaaagaatgtgctattgttaggggctcttagaaaccgtcttgagaaataacctgaacaattaccaggtatcccttgtgacacttgtgactttgtacttccttgtgactcttaactggtatctttggtattttccaacaacgccctccgcacttccttgagttgtggtttcttcctttaaatacccccttatccagctactcggcaccatggtcctctatccctgcgtggtgtatgactgtgggcccaagagcgctcttgaataaaaatcttcttgcagtttgcagcaagaccgtttcttgtgggtgattttggggtgtcgcctctcctgagtcagaacgtgggggagtcctcacattgtgggtctttcaaaaccctgtctcaaataacaattcaatatcttagtgtgtatatttaagctttaatttaagaaaaagctccaggcagttaataagatctactagaatattggcatgtgttgagagacgatggagaacatgtctctttggtgtgtgtgtgtgtgtgtgtgtgtgtgtgtgtgtgtgtgtgtgtgtatgatgtggggtgtgtgtgtgtggtgtgtggtgtgtgtgtgtgatgtgtggtgtgtgtgtgtgtgtggtgcttattttaaggg

SEQ ID NO: 27773 - DNA, 1190 bp, Mus musculus
cacacacacacacatagatacacacacacacacacacatacacacacacacacacacacacacacacacacacacacacattcatctatacagaaagacatatttcccagtcttcaaagaaagcagggagtcagcaagagtggggccctttccttgtctcaggaattgactgaaggccttttccatgtccgagtccaccactttgtttctgcctccttgactcagctgccgccattccttctgcctcacttccctgctgggtagccacctcctagatccccatcctatggagcaatctctgatggccttgagcagcttccttgtccccactcccaggactaaatatggcacaatggtcttgtctgtacacactccactttccttgttaggtagggtgtcagcacctgcagttgcaggtctgtgtctgatgcgccaagtgcacagttggcaataaatggctctgctgctttgacagcctaagagagcaccagaaactatgagggttgccttggtttggcctcatgttctgacactgtgcatgtggcatgttctcaaattttcccttagcttaggctgtcttgcatcttctattttatctgcctgcctgtctgcctgcctgcctgcctgcctgcctgcctgtctgtttgtatgcctatctgtgtgtctgtctgtttattagcctatctatctatctatctatctatctatctatctatctatctatctatctatctatctatccatccatccatccatccatccatccatccatctatctatctatctatctatctatctgagacaaatgctagctttggattatctatgtactataggatgaccttgaacttctgatccttctgtctacctcctgagtgctggagtgacagctgtgtgccaccacagttggcctttgtgcctgcagatgaattcagccaagcactctaccaattcagctacatcccagacctgggcatcttctacacttcttctctaaccatcatgtctcccctctcctctcattgacttactcggaaagtttaggttgttggctgacttatcattcaataaggatcttttgcaaagggcagcatggcctaagaagacgatgagtgcgaacagcagatggtccaggtgtttgcgcgcctcttggcatcaacatctaccaactgtgtgactttgtacaagcc

SEQ ID NO: 27774 - DNA, 3197 bp, Mus musculus
tctcctgtgagctgccgtgtcagtgtagctgagtgaacactagctgtgtaaatagcttctcatgagacatttatatggatagctgtgtggtgtttccttccattatcaatagggactctttgtgaacgccctttctctgtagctaccaaaaaaaaaaagtcctggcttatggtcccatgtgaccttgtgtccgttaaacccagaatatgagtgcctttagcaagtgttagcatttcacagagggtagagaagacaggatttactgccattaaccactgttcattaaatagcttgaaatatcaacggtccttgtgaattctgctctgtgtctgcctccctctctccatttcctagtgcaatctcaatttgcttttgggtgaagtgtgcactctgggtgggagcctggctgctgaggctggcagtagtcatctctgtgcctgtgtttgatgccactgaggactcagagcttgagatgctgatgtggaagcaaacgtcctacagtgaccgcgctccggcttggttcttctgtagagtggagagaattatgtatacaaacagactgtagctctgggtggtgttgtacttcgtctctgcgtggatagagggacctttttaagcaagttggaggcctttgaaaatgacagtttccttccttcgattagctgaaaatattaaatttcctgcggtctctacaaccttctgaacatacgattaaaccaattttcatgtagaaatagtaacatttgcctcagaatttcattatgaagaattttggacatttgtcaaagtggaaaacattttggagcacacctaactctatctcctactgttgacatttccctactcgggtttcctcacgactcccatgagcccatcgctgtgttcttctgtctgcccatcaggacagatggctctatacatttcagacagcgtccctaccatgggtgtcatacactaggatttaatattcacatgttaatgtcttaggaagacagcatgtgtaggtcataacctgaggcagtaagcagtctctgtactctcctgtggatagcagtcttccttgtttctgttcttgagtgtgcttagggtttccaacaagtccgtaccaggttacgtggcccacaaacgttacgttcccgacaggacttgctgtgaactcccaggcgctgtaaccactcgcctcctatgcctgtacatagcaggattaaactctgagacaacagtactgtctactgagggctgggcaagccttaggcagtctacagcctccctccagtcatgtcggagagaactgcggtctgcctccatcctctgcccgcctcctgtggccagcgctgcagagctgaaggggtttgctcaggttggataggttggatggggagaaccaaatcacaatccaacctgagtgcatttaagttgtaatcttaggcttccagtgtaaccgaacacttccttttgtgcccttagaaggactgtgtttattttttaccaactagaattttagttttagacatttcacagttctcttaacacagagatattcctgtgggtatttgttgtttttgtgatgttccatgtagctcaggtgagtcacttctactatgtagccaaggctgaccttgaactcccccgatcctcctgcctccacctcctggtgctgggattacaggcatgtaccaccatgccaagctatataaattgtagttctaattgagtccaaagcaattgctaaaatctcactgcactgttgagcaccaactcatgcagggtctgtctgattgtttttgtctttaaatggcttttatgaccactctggctacgtaagtggtcacgtgaccccccctccccccaccccttcgtgaaaatggtgttctccatcactgacccctctcatgcactctctacctgatgctttttttgttggttttaagaaatgactccataagtcagggtgagcgatactgtcttaggcagggcaaagccctctcgggagcaaaccctcctggacgtggctggtcgttgttctgccttctttcagtatctgatcacccaccaaaggttctgtaagccagtgtgtcactttgtaagtctcacgttgactctgctcacctgtggccccccaccccccacccccagtcaactgtagtgacctggcatgggttttgtgtgttgccttcgaaatgccttattgggtatgccaggctactctgtcaagcatcccagctgtctgctgagacatacatgtcctctctggggtatgtgctcttgatccagaagcaaagctgatcttgctttcagtgtcaagggtgcgttttaattcagttattgtcttaagttagaagtgaagcaggaagccgagagaatgtgaacctttcacgtgatcagtgtggcaaaccgaaaatgtgcttttgctgtttcactagaaagaacgcagctaagaaatgccagtccaaaccggaaagtggggctgtgtcatatcacgctccccacttgtcacttggccgttgagtgtctgagcaggccaccgggcagtgggccagtctatgttctggggctacagagctgactgacgtcacaggattcaaaccaatcaactgtgaattgtgaaattgaaattgctcttttggtttttatttccttcagcctaataaatacagaagtctgaatgttatttaagcttagaccacttacgttggctcatcttggctgtgtattctcatgtatgtactgatttctgataaaggcttgatgacattgtaacgggctttttgtgttcagttcaataaaacagtttctgagtcttgtctcaaaagcgttcggttctgagtcgggaggaagttagcatcagtgattagcacccagctgtcatccccatacttcaggtgggatgtgcgctcccagttcacagcggtatgtggtctactgtgtgctttccaaggcttagaatactgaatttgaggacttgctgtggagttggcctagctacccatccacctccgactcttccttcccagctaacctgggaccggggtgtattctgttttgtgataccttctgatatttatgttctcttcaaattctgagagaatgaacccagaagaatgacaactcctgctcctggaaagaaacacatcagagagcagacgctcactcatctcttgggcattccacctatgaaatggggttatggacatagt

SEQ ID NO: 27775 - DNA, 1033 bp, Mus musculus
cccccgtcccccaggaagcctgtatattatggtgtgttacagtcatggatggacagagtgtagacaaatggagaccttagtccaaaattaaggagatttcagtgtcatcaattatttgtagcattgaagtctgttcttgtggctctctgctgctgcttctttttttgtttgttttttgggtttttttttgtttgtttgttttgtttttttgtttgtttgagacagggtttctctgtatagctttggctgtcctggaactcactttgtagaccaggctggcctccaactcagaaatccgcctgcctctgcttcccaagtgctgggattaaaggcgtgtgccaccaccgcccggtggctctctgcttcatgatgaagccagtcagaacacccagagcccaggcttcaggaagagtctggtttcagtcagatggtctgcatcccacatgccttcagagggcattagcttttgaagttcagctaaatccctgtgtgctttgaccttttagactttacattgagacgagactttgctggtctgagttgatctgtgtcctgccgcttgtaaatgcatgcctattgtcttacgcctgtctgcttgcctcttaccaactgaattctgcattttccacagtttttccacactatttgccttgataaaaagctccccctcatattcctttttagtttgccatgggcttaaagaattagtgaggaggtttgaagccctggaaatggatgaaggaccgtggtggctgagagcctgtgatctgctgaggtgactctcccaccttaccccacagagctgcctacagagctttgtgtagccctcggtctacaaccttgcaatcccaataggagaaaaccattaaacgtacatacatgtacctgattacgtcttcctgtgtagacaggatctaagagttaacagcgggacttggaactgtcccagcctgtgtttccagggagtgtgagcaatggcagcccaagggcagacaagtgacttcctcgtagtgctttctttgcagagaggctc

SEQ ID NO: 27776 - DNA, 1055 bp, Mus musculus
cttttgcggttttaggtttacgcacattagaggaattgacttgagttcttacttccaattatagagaaaacaggtaaacagagattcccgttttctgatgctcctgggaaccattaccaccacagtgtggtgtctacaagatgtgctgttagggtgtgtgcctgggtctcccagcagctcctggttccctgtggcatatccctcctcccgcccccccctccgtaattaacacataggtttccttgaattcatatacgtccagaatactgtgttcttctgaacatgtgacttcatctccagttgtgaaccatacacatgtaattctcgtccgtctctttccctgcttggatcagcttctccactcgctcaccccatcctcatggcctcgcttgctggcagttttggagacccagatttgactgtctaatgagttgaagatggatattcttttagaaaatatattttcagatgattcgaggatgtgtttgagatttcaatttggaattctattttcactgatgattatgtgacctcatgggatagtcattttgtggcttttgacgattgtatcctgacaatgccctgacaggtaatgggcatgcctggaaaatacccctgcctttttctttctttctttctttctttctctctctctctctctttctttctttctttctttctttctttctttctttctttctttctttctctctctctctctctctctctctctctctctctctctctgcccctccctccctccctccctcccttccttcttttaaaagctgatcaagtctcagtgtcatttctaatagcaaaacgccaccattgcatcttctccttggcctccttgaagagactttgaaaacacagatgactttggtgtctaatgattataatgggattcttattttttaaataaaaagccatagtgtatgtctagacagactgatggagtgttatatgtgaacttgtgttcactgtgtgtcctttgtcctttttccttcacatgtgtaagaccagcatgcccgtgctccttagggaagcaagcg

SEQ ID NO: 27777 - DNA, 1144 bp, Mus musculus
cagccatgtgacttttcaacttaattgctcatggatgcagtgctgctaattaatgcccatggccagagggatgacgtttggaactgagccaagcaaaataaaggcaaatctcgaagctgttctcagggcaaagccttatgttagtggggataaccaggcaggggacgtctgctgggctatgagtaaggagagacgccccaaaggagggtttggagagaaaagtggctttggtgtcatttccgtgttgctgagctctcattttaattttcttccctggctgctttaggtttgaagactccatcccttgtcacccacgggattatgcttgtggctttcctgcctgatgattcttttgcagcaggtctggcttcctttacctaatcggccttcaacctctcctcctatgtcagtggctgccaggtccacaaggaccttgcagctcccgccacagaaggcttttgggcaggaagcatccttgcctctggcaggggaagaggatttagctaagagaggggagccagactctgccctggaggagctgtgtaagcccctcttctgcaaactctgcaatgtcaccttgaactccgctcagcaagcccaggcacactatcaggtaagagatggaaaggacagcaggtgtcagcggggtgagcattttgggtgccggtgtcagcaggttaagcattttgggtgccggttggttggatggtgtcagctgggtgagcatttgggtgctggttggttggatggtgtcagcagggtgagcatttgggtgctggttggttggatggtgtcagcggggtgagcatttgggtgctggttggttagatggtgtcagcggggtgagcactttgggtaccatctggtcacaagttatggccagctgtggctggaaactcagacgagctagagaatgagcaccgtgtttcacacagtgggttctgcttgtacttctgaggagaatgtgtaatgtgctacattaattcagtgtaaaattgttctaaagtttgtacagcttgcgtcagttcaatgctacctaccacatgagtcttacactttattttacttaagacttttcctaagtgccctcttacagctgaggcaaatacaggtgacgttttataaagagaataatatggtattg

SEQ ID NO: 27778 - DNA, 1927 bp, Mus musculus
aatctttgagtagatttctatttaaaaatataaagtagggtttttgtttttatggttttttactactgagctatagaacttcgtaacgctttgatatcctgtagggttttacttaagggaaacaattagtaggaggacttagatttcttattagccaagttttattactcagaaaaagttgataaaggtcctatcataatattaatggatatatggacaatgcatataattaaaatgcttgaggccaactccttttttcttttctttttttcttttggtttttcaagacagggtttctctgtgtagccttggctgtcctcttaaaaatggatttatcaaaacatttttttaattcatagaaactttcttttgtgcttttctaaatgtgtgtagttctccgtttgtaaaaaccacttctgccctacattgtttataaacatcctatttttttaggttttgttattggcatgccagtgtgtgaatttgatatggttaaagatccagaagtccaagactttcgaaggaacattctgaatgtttgcaaagaagctgtggacctgcgggatctcaactcgcctcatagcagagcaatgtatgtctaccctccaaatgtcgagtcttccccagaactgccaaagcacatctacaacaagttagataaaggtaaggaggcggtccccgcagcggaccttgtgttgctgtagctgtgctgattgctgcacggttgccttttggtagctggatcatgcgcctaagacaaggaagggctcctgcaccctgagagctgagtgtggagtaatgacttctggatagcagtcactccttcttactgactcaccccttggtaaatgcttatctcactgacactcaagaactgagtttagaattcactgttgcatagaatactaacagaattagagctgattctccttttaaagtttaatgtggcgttaagctcagccatgggtccttgtgatccactcaaaaaggagccttggatgttgtgtctttagacagatctttacctctatttggattaactagatatggtttctggttgtgcttagcggaacagtgaacacttctcgaaacttgtcttcagagaaatgaaatagacacagcgatgcacctaacggtgttttttggttacaggacaaatcatagtggtgatttgggtaatagtctctccaaacaacgacaagcagaagtacactctgaagatcaatcatgactgtgtgccagagcaagtcattgctgaagccatcaggaaaaagactcggagcatgttgttgtcctctgagcagctgaaactctgtgtcttagaatatcagggcaagtatattctgaaagtgtgtggctgtgacgaatacttcctggaaaagtaccctctgagtcagtacaaggtgagtgacggcaccacaccagagctgcatggcacagcgttcggatgatgaatattcattttaggaagtaccacttgtaagcttatttttattagtatacttgaattttgcttaatactgatagtgaatgccagccaagtcttgtaccactgagctatatttatgacatatgtgtattttatgtgttggctcatattcaccccctttgggatgagtgaatttcagccagtcccttgtctatttatgtttatgtttaaataatgcaattattttagagttggaagacatagcagttacactaaccacaaaatactcatttcatgacctacctgctcctacaaaggatgtggggacaacattaaaatagaatcttggtttattacatttactactaaccttcttcctctctttctctggtcactgaataaatccagctgagaagcagtggtagcatacacacaccagttactgtttaataagagagacagtggcctttagttggtgataagtgggaaaatagggag

SEQ ID NO: 27779 - DNA, 1121 bp, Mus musculus
attcctgtgttttgttcacagtggagctgggacatagagtatacatctgttcattttccaaggctttccagtttccgtttggttataacaaatgatgcacttagtcctagtgcatgaggtttctgcctggtgcattcctggccacctgtcctttgtcctgtagtgcgtcacccttgaggtatgacgaataatactgactcagacaccacccgcaccccagctttctgagacagggacttactgtgtagttctggctgacctggaacttgctatgtaggccaggctggcttcagactcatagcgtaacttaacctcatgagtgctgggataaaggcgtaagccactctacccccaacttttggtcatttttatacagttctgaaatgtatctttgttggattgtcacttgccttgtctttagtgttgatgcagtatggagccatgtgtacactcaggataaagcttggtttgtcaattttctataggtggaatgaatggctgaattatgatatatacattcctgatcttcctcgtgctgcgcgcctttgcctttcaatctgctctgttaaaggccgaaagggtgctaaggaggtaaagtatcatgctacataaccagctgtggctccccaatcccccccctccccccctggttggttggttgttgtttcagcctagtcctgccatgtatgtaacccagggttcccttggacacacaattgctctcaagtatggatggtaggcatgtgtcaccatggtggttttttgtttgtttgtttgtttgtttgtttgtttagtaaaatgctaattgactaaagccttgggaaatattagtgaccttttcatttaagagcgtattggagccgggcgtggtagcacacccctttaatcccagcactcgggaggtagaggcaggcggatttctgagttcgaggccagcctggtctacagagtgagttccaggacagccagggccacacagagaaaccctgtctcaaaaaaccaaaaaaaaaaaaaaaaaaagagtgcattgggagagcctgagaagtccgtttctgatgtataagtatgtcatgagttcatgtcaatataatttgttaaccactgagtggctgctggagtga

SEQ ID NO: 27780 - DNA, 1118 bp, Mus musculus
ggtgagataactgaaggctgactcctagaattctgagtcgagtactcctttccatccccctgggagtgttcataagttaggaaagcaaaaatagcaagtctctgcccttattcattcctgggtcagactgtgaattaaattgacagaagccagactagcaggagaaaaaaaaagtgtgtgtgtgtgtgtgtgtgtgtgtgtgtgtgtgtgtgtgtgtgtgtgtgtctgtgtgtgtctgtgtgtgtctgtgtgtatgtgtgtgtgtatgtgtgtatgtgtgtgtctgtgtgtgtgtgtgtctctgtgtgtgtgtgtgtgtgtctgtgtctgtgtgtgtgtgtgtctgtgtgtgtgtgtgtgcttaagaattcacccagaatatgagactccaaagaaagaccaaagctggtccattctccttagctacactggggctgaggaaagctgacattacaggaggggaatggtcagaactacatgagtaaaggtggtcttgacactacactgaagcaatctctccatcagagttgtttgagctggacacagagacatgcaactgtagtcacagcacttgggaaatgaaggcaggaagctacatagcatattgaaggacagcctaggctacgtgagattctgtttcaaagagtatcatctcagagaagtctttaaataggtgacagtcaaaacctgatctcaacctccagttgactgtcagcctggtatcagccttccccaagtgagctaaaatgtgatctccttccgaatcgggagccttggaatccttgcctgccttggcttacttcctgtatgcaagggtggtttgtatagcatccaaaatatctgtgtgctggatcctaggactatggcagagcctgccctctatagcttaaagtttggacaaagacttttcagcagctaattccaaaagtgaaagaaccatgagacagagtgcaatcttctgagaaactagggcatttatgtggagaacgggctacaggaagaggggctcaccagtggcttgtgagaagaacaaatgagaaaacagtgagtgctgttggccccaggattgccttataaccaaatttagacttcattcttcataaaggtaaatattttaa

SEQ ID NO: 27781 - DNA, 1152 bp, Mus musculus
gattggatcttccacaccatcaagcagcatgctttgaactgagatgggagctgggactgcgagctggctcccggcttctccactgcatggcagtgagtggcagcaggcaggcagtggcatgggatggcacagtcaggaacaacattaggacttgagcaagaacataaacaacgtgctctataattgaaacactgtacacgcaagcagggtttgatagcactaaactagtttatttcaaaatccagctttagaataacgagcaatttcatgttatgccttaagtccaaaaaaggtaaactttgaagattgtttgtatctttttttaaaaaaacaaaacaaaacaaaaatccccaaaatacatacaaatgatggagacaaaactagaatgctgttgtttgtctgccagtgttctgtctaacacgtggacacgcccaaggctgtgactgctataggtctgagtaagctaaagcttatattaagttacatgaattggagaagaaggaaaattctgattttcccattgctgttcagacttaacgatttgaagtggggattttgatccctgcttaatgaggaacaacacttggggtgaagggactcgctttttgctttgaacaaacaacactttgatggacttggggtctcacctgcggttttgaaagcagtcacaatacttgcagacagctgcgtttttgttgggtgttgttttttgttgtttttttctctggacagtatttacaaggatctgacttatttcctagggaaattctgggctggcatcaagtatagcagtaagggcagaggagaggccgcagggagcccctgttcctgacctgtacagtgttcactttcagctgattgtttctccttttgcaattgaactgaatacttttttttcatgcatgttttccagaaaatagaagtgagtattaatgttattaaaaagattatttttttttattaaaggctatttatattatagaaactatcattaatatatattctttatttacataatctgtcccatagtcatgcattgttttgcaccccaaattttttatcgttggtaacagcatggttagcttttctctcggtctgtagatgaggctcaggcactattccatttatccaatacccgtgtatgactcctta

SEQ ID NO: 27782 - DNA, 1185 bp, Mus musculus
aaccctgactccgggaggtggggggcaaagtgaggcctgttcactgtctctatgaagagcgttgtaccaaagaagaaagaacattgagaacaccctttgacaagattgtctcgtatttctacactgtgctgccacttgctaattctcattttgtgccacatgttttgcacaagtgtatgaatataaaagtaattctggtgcggctctggtgcttcaggagtttagtaggaaagcaccatagtgtggaaggggctgatgtatgtgcagctctgagcagaaagggagtcatgggttttctatgactgctaaaaccacgtgcaaaagcaaactggaaagacgtctcattttacagctctcagatccgactctatcactgacagaagtcagggcaggaactcaaactaggaacctggaggaggcaggggctgaagcagagaccacagagaagctctgcttactggcttgctccccatggcttgctcagtttgctttgtttgtttatatttcatttttctgagacagggtttctgtgcagccctggctgttctggatctcactttgtagaccaggctgctcttaaacacagatccactgcctctgcctactgggtgctgggattaaaggtgtgaaccaagtcctagcctctcttccccttttgctgaaaaattgtgaacctgaccttatcagttacttcatcagtgtgggatagagagttattccagccgtcccctgcaagtacgtgttgctttcttttagcagacagtcaaaggctgtgctgctctacagcagtgctcatggtacacatcttgattccctaaagtgtcttctgcaagagatgggactgaaaagcacagatcttgtgttgtagagcactgggtcccaaacctagctgatgagcagaatttggggcagggcgccttgaaaaacacaggctcctgatcttcccacagaagacgttctgattgacctgaggttgacccaagggtctatgtgtatgtatgtgtatatatgcaaagctctcaaagtgtgatgcacagtttgatttaggaatatccataaatctgtacatgtgcacacacacacacaatttgtagtgctgtgctaggcagtggttctaacgctgagctccacccccagtgtaaaaggttgttttattagtattgacctccctccctccctccctct

SEQ ID NO: 27783 - DNA, 1173 bp, Mus musculus
catttcttgagttcagttgtttcccacctcctggtgaggctgtcaggagttggctgtgtaaccagtaagatcactgtgctcggtctgaacaggagtccaccttgagttgagagtgtgagatggagggcatcccattttccctcaggaccttaggtaactggcatgtgcccactaagaggccccactactgccctaggacccttcctcatgcctttgccagccacgttctcatttctttttgatgtaacaggtatagaggggcttagtgttctctcagacctgaaaggccaggctaaacagtgtctttggcctgtctcagaagaaggagcggaataggggacagtactgtgttggaggaggggtttaacagtttagcagctaaggacctttatgagtacaaagcaccaccttctaataaaaagtgaggcataattctgctgtttcttcccatcttacagggtacctttcaacagatgtggatttctaaacaggaatatgaagaaggagggaagcagtgtgtagaaagaaaatgcccttgagggctccaccctgcctgcccgtcacctcaacgtctgtagctttagtacactcaggaaaagatgaccatcttttgtagaatgtttatacatgtttgcatatttcaatttccacttaaattttttaaggctttaactggctctataaattaaatgagtttgtgctttccttgaaatgcacttattcttattacaggcattttataattttgtatgaatgtctattttctctaaatattttgctttcagtaagtactctccagctctcctgggggttggttggtggaattactctgtattgacaagtacaagttactgcctatgctttgtaccttaggctacaaaactaaataaaaatcactactgtcctagaagcgtgctggatttgtctgtgtgactggctgctgtcagcgctgcttctaccattacttgatgtggggaagcaatcactgactaccagtgtccacatccctttcctgctaacaattatgtatatggataattcacctgcatggacatctgcaccacactagttagtgcctggtgtctgcataagccagaagagggtgttggtttcctacaaactggagttacagaggttatgagcttttctatctgtgctgggttctctggaaga

SEQ ID NO: 27784 - DNA, 1138 bp, Mus musculus
ttaatttcctttagatttctttattttacatgatttggtgttttccctaaatgtatgaatgtgctccgtgtgtgctcggtactccacatatgtggagaccagaaaagggtgtcagatcccccgggactggaatcaccaatgatgatgagccacttgggtgctgagaatgtatgcagatgcaagagcaatgagggatctaaactgctgagccatctttgcagcaaataacaattcatgctacctttttcgttaaaaaagttaagctttataggttaaattacataagcatagaatatgatgatttttggagtctggtcagtagaatttggttcctctcctccctcgcccttaagctgcggagatgctgccattcaggtgcttatctcaaaagtgggtaacactagcgtgagcccagtgctcagagtgacttaaagcacatctgagttgttgtcatggcagtgcttcagttatctgaaacagtagtcagccaaaacgtgaagaatccttcagaaggtgactgattggaaacaccttttctctcagcatccgatatcaagatggatcgcccggaatttctatgatggccctgaaaagaactacgagaaaaccctggctatcctccagattgaatctgaaaaggctgagttacggtaggagagtgggcgggaagaatagcgcagcttcagaagttggatgtctgtgtgaagcttgagagggctcttctgggagaagggcgactctgttgctgactgggggatgatagctcatactgagaggaatgccctccccctccctcttagtctctgtctctctcccctttttaaatggttatagtgtatgtctctgtgtatgtgtctgcctggatgtaggcccatggaggccaaaagggcatccgatgtcctgaagctagagttgcaggcctgtgagccaccagacatgaatacagcaagtacgcttaactgctgaaccatctctcccgccctggaaagaaattcctaaagaagctactctgcatacagcagcccactccacaacctgcctgtttctttccatcccacatcactagagactgccctgtataacagccagaagccatatgtgcccctgtgtacctgtttctagagagaatgtcattagc

SEQ ID NO: 27785 - DNA, 1232 bp, Mus musculus
ctcctcctggtccctttctgcccccagtagttccccatctgttttgtgtcctgtgtatacctgtatacatcagtatggattccacatagcagaggacatgatgccctccagcttcatgcagttgtctgcatatgactgaatggtgtgccattgtgtaaatgtgccacattttctttattattcatctgttgatggacagctagagtgcttccatatcttgggtattatgcacaagaacatggatactcagctatgtgtctaatgagccaacttagacccctgagcagtgcggctatggagtggtgaaggcctctgtcctatggtggttctgctttgttattttgaagaagctctgctgactgctgtagtggctgcatctgctcacgtgtccgtatcctcacagttactattccctttgttacaggttaaaggagcaggaagttcgaaggctgatgcgtgcccgaggtgatggaccctggtatcaatttccaacccctgaaaaggagttcattgatcattctccaaaggcaactcctgacaactgatgattcatttgtctgtccaagaacagtgtgtccctctagtgggaagaaatgaataaatactctgtatttttgctctgatgtacacaagattctgtggctggttcttcatgaggttcaggtgatgtgttctctgtgggcctttcagcttcatctgttgggatttacagggtagtaatgaaacctggaggtctgggaagttgtgaattcctaaagtgacactgttgataagctgctgatgccgttgtctggcaggtggaaggtgcagcggtcctgtgaatattcaggaactgtagtcatctgtcattgcagatggggcttatttgggactacttggaattttaagttcaaaagaaatactgaaccaaccatataaaattatcaggaccagaataaataaagccttagagtttacctgtagcatcttgctttacttttggggtacgtgccattcgtttttagtgtacagacacaaactcttgagacacagtaactgagctcccgtagagctctgttctggaaacactgaaggtgcctccttcctaagcctggccgcatccttctggctgcgtccttctggctgcgtccttcctggtgctggtgttgaacccgggccttcagtaggctaagtacacactcacctcagagccacagctgcactctctagctgtgtttcacttttagatcctt

SEQ ID NO: 27786 - DNA, 1104 bp, Mus musculus
ctgagcaatagagttacaggcatgcacatgtgcctgacatgttgtatgttcaactgtttaacaaacacaaacaccagtgctcaggttagctagttaactagtcagctaatggtacacagttcaagggcatcctctgctatttatggagtttgaggccagcctggggtcagaaacactgtcttgggggtggagttctttactaaaattctgctccttttatgccgagttttgggcatggttgcactgagttattggagactcttttttcctgccatggggcaatcgctgacacaaatcgacatagatttctgcctttgttttcagatgggtgatctacaatgaccacaaagtttgtgcctcagaaaggccccccaaagacctgggctatatgtacttttaccgcaggataccaagctaaacctcacaggaattggcgagaagaagccatacacctttttaatttgccaaaaaagaaaaagaagaaaaaaagaaaaagaaaaaggaaaaataaaggaaaaaagttgggacagcagatgcggaggactacatgggtacttactgcttcttttaagagcttggtcacgacaccttctggagaagaactgggaatagggggttttgtgactgttcagagagagggtgatggaagaaaagacattggctaccagcctatcaataggcactgtctttccctctcttctgctttgggggggtcactggtaagggcttccctacagtgagaaaaatgcccacttttaaaatttttccatataggacatcaaaacctggactggcatttactggtggcattgtgtcttcatttcccacagtaagttctgacctagctatgtgtaccgggacatctgcagtggatgctatttttaattttaatcacatcaaactttatattacactgtatgagtgtgtgtgagtgtgtgagtgtgtgtatgtgtgtgtgtgacctttgtagtcttctggatatctgatggattggtgttcaaaggctaaatagttgctgttaaatgtatttggaaaaggcaggcaaacatctttaaaaattataactcaggaacaattgttaaaaatgagttccccacttggatt

SEQ ID NO: 27787 - DNA, 1164 bp, Mus musculus
cagaactcaaaactttttagtctataaggccctttgctactgccccccccccaaacaaaaggagcaatccatttatgacaacctcttggaaaagtctcagaatgcctctcagccactcaaacccacacaaatattttgaaatcccaagtccactgttgctagcccagatccccagatacatgctgccaaagctgtctgtcctacaaagggtgtttagaaagtccgtcttcatcatcatagatgccgtggctgctggatctcatcacaggtctttatagtctgtgaggttgccaggagacatggaccgaacagaggatggcattacatataatgtgcttctgcctgttaagtcagtatcccagggaacagaacaaggtctgtgcagtgaagctggtggataggaccacctacccagtgccaccagggtttcctgttgtcctaatctgcttttcattggtggaataaagaccatggccaaaaacaacttggggagaaaagggttaatttaatcttataacttaaggaagggaagtcagggcaggacctcaaggcaagaacctgaaggcgagaaccgaggcagaagcgactgaggagtccttcttactggttcgatccccactgctcgctcagcctgctttccaggaccacccatgctgggctggctcccccaccaaccattaaccaaggagttgctccataggcttacccataggctaattttaatggaaccatttcctcaattgaggtttcctcagatgatcttagctagagtcaaattaaatgaagcaaacaaacaaaacctaatcagcacacctgctctataattagtcatcacccttacagttggtggaaggttctgtagccctccagtgtggtgggatttggtcagcccacactcagattgttccacatacataaaacgcacactagaacgtgaaagcttcaacaagtagtgtgactactgcaaatgatgtgggatacttgattacatgtgctggccatttaacatggaaatctccactgttgtctggtctgagcatagctagtgaataatttagaggtatggctaaggccctcccgttagtgttctgcactgagaggtccaccgtgaaatcccatgggtaagacaggaacctgcagaggctccaaaatcggagcaacatg

SEQ ID NO: 27788 - DNA, 1149 bp, Mus musculus
tcagggtgcttagctaatgaatagagacaaactacaaattgctgggaccacttttctgggactaggttttcaaaataataatagctggaatgtaaaaaaattaggcaatgaaagcagatcattgctttgttaatcagattgaaagccatggtaaaattgactattaagtctcaacattgactgaagagtaaatttctgttcatttgttcacaggaaacaagattatttttggcatgaggttctttttattaactattccctctgtttcacctttagtattttgggagagtgactggagagttcttggtaatattgatggcatttgcaatagtagcgtcagtatatatttgaataagtaaaagaattagtcttgttttctggacacaggtgatttgttgtgccatcttagtagttctctatgaaaagttacatctttctgatttggttaaattgaacattttaaatggctttttaaaaaagcgattatagggctggagagatggctcagcgatttagtgcactgactgctctgccagaggtcctgagttcaattctcagcaaccacatggtggttcacaatcatttgtaatggggtccaatgctctcttctggtgtgtctgaagacaatgacagtgtactcatgtacataaaataaacaaatcttttttaaaaagtgattatatatttataaggacataagttctgatattgtcacaaaagaaacttcctgacacacacagggataactgaaacttcagtgtgttgcaacaggaaatttggagttttcagtacctgtgtagaaccattaaggcattttatttcaagaactgttgtatattagtgcaagcagtggctgataatctgtgcaatcttatccctgttgctttgtgtttagaacagttaggtgctgcataaggcagttattattgataaaagctgctgtgcttggctaaggacaaatttttttgttgttaaaaattagtttcactatgtagtcctccatgctgaccccttaactcatgattcttctatgtcagtttcccaaagtgctgggattacagctgtttactattaaatgctcaaccacacttcttatttttcattttggttttttgagacagggtttctcagtataaccagccctagctt

SEQ ID NO: 27789 - DNA, 1106 bp, Mus musculus
gatcgaggcttttgatcttaaattataggtaaaaaaggaggggatagtcagcctaagctatctcagacagtagaaacttaggcattaatctcactattaaaaattaattgtgctttaatcccagcacttgggaggcagaggcaggcggatttctgagttggaggccagcctggtctacagagtgagttccaggacagccagggctacacagagaaaccctatctcgaaaaaaaaccaaaaaaaaaaaaaaaaaaaaaaaggaaaaaaattaattgtgtaagaataaaacaggagatagtggtggagcactatcccaacagtatttgcttagattgtttgaattgttttagttaccaaaatgaggatgattataagtttggtatttatgatatttaaaatcttctggaagaggtcaagctattaatttaattcattctatatccttaatgatttttttgtaactggaccaaagacatgttattttgggagagaggctctgtatttgtgttgagagtaaaggagaaaaggctctggaccccttccagaatgatatggatcagatatggcaggggacgaccccctgaggatcctgactactgaaaagaaagacagcagcaggacaagtaacttgatctgctggttccccaacatgggggaaaaatgtctctagccaaaactgcagctaaatttagataatacatcttgttatggaatccttaagattcttctagccctccttcatagggcatggctgactgttcaattataaggaactctttcaaagtggtcggtctaagcttgctatttggttttcctcctgctggttcatgtttgtctttagcttgttaatagatagtaagacattgaaatattgctcttttaaactgctctgttatttaacaacagttatacttcttgtctttgtctttttcaagtttatcttgacatacacttgagtacagattttaagggagcatgaatagaaggatttctttgttttgctttacccaagtaccaagtgcagtgtgtgtctggctagtcttgagtgcatgttttggagttgtataagtgttgaaaaatatttactaattggctggtgggttaaa

SEQ ID NO: 27790 - DNA, 1189 bp, Mus musculus
cacagctacttttaaactattgcttgcttgtttgtttgagactggcatgtaatgcatgattaccctgtcaccgtgcccaataacaattttcatactttaaaaaagacttttttctcaagcactgaggtacgtcccagtactttgtttatgctagggaagctatcagcatactgttttgtttttttaactgataactggttccgtcagtgtaagtgagttagtattttctgactgatgtgttcctcttaggacagtaatcttaatgttcttggctttcatacatgtcacctatgccactttcctcttttggtgttagctttgtgtgactagcccacatgtttatgcatttattagttgttgacatggattttcccctctacttcttgattatgttgaatgatggtgaacatcagggttggtgtttttttttgtttgtttgtttgttttgttttatttttaagttttacaaaagaaaaattcctaatttctctcatttccctagtgcacaaaacaacttgcagcagcttttcatgaagaatttgttgtgagagaagatttaatgggcctggcgataggaacgcatggcagtaacatacagcaagctaggaaggttcctggagttactgccattgagttagatgaagacaccggaacgtttagaatctatggagaggtaagttgtctgcttcttgcctttggtcacttaatttggcattttagcagtctgttccatcgtatttttttctgtcattttatttttcagttttgagataaggattcacataacacaatgtttatttctgaaatcttgagaagtagccagtgaggcctccgtcgttaggaggacaggctttgaactaatactgcctggagtagagtcttagaagtcgactgaactttgtttccactgtataatgatgatggtgtttaccttatagttcgtgaagatttatttttgaactatgtttaaagaacaagaaatgaaagtaattaccacaatataaaattgaaataatcttatcagtaggtctttttaaaaaatgtgtctctggacaagcaaagcaactttgttttatgtgcaggatgttgctgtgtagaacaagctagcctcacagaggaaaggtgatctcctcccctgagctcagtgcatgactgcgctgctgtactgtgactgtgtccagcttaaagc

SEQ ID NO: 27791 - DNA, 1145 bp, Mus musculus
acaagagctgcttttgaaaatgttgttgtgctctttaagtcaattattcatatggatgaagtgctaagattttggtagctattctatagaacattatttaactgaactaggctttctcactagtaagaaggggttcagtggtgggtttgtaaaaagaaaatcaagttttgttcagctgaattctacaaagataagccttgttttttttttttttttgttttttgttttttttttttggattttgtagtattaataatgaataaaaatccctgatatttcagaaatacggaaattggatatatttgtagttctggttctttagttatcaatgcaaagaggggaatccatgctatgtacctttgtccactctcctgtcttgtttggcttttgtgatttgaattgcttatgtgctctttagaaagcatgcactagcaggagcgactttacagtgctgaacctgcggtgcttctgttgcttgtcatgtatagcaataccatattgtcctcaagtacttgatgggttaagcagtcttttgaaaaatacatgttcttaatccaaatgaaagaggagaactgaggagtgagaggggatgaggaccacttggtgggtaagttccagagaggacgatagatcactttctgtgtttgaggcattctagtatttgatcattcccacctgtccaaaatcagaacagtatttcttgaacactgatttgaatgacaatggatcaaaaccattcacttcttagaagaagcctttaatcacttctttactttgtcccttcaacattatactcaatgctcaatttatactacaggtctgcttcagtttgtcaatatgctctggaatttaaactgtggaaatgatcatttaaaatattgaaggtctctggtgggactaagtaagacttgaaggtaggtccccgccaaggacccagaagggtgatggatgcttaactcaccactggtgtagttccaagaagcaagtgaacaagattgtgggggaagggcttagggcccatcaacctcatttgttttctgaaaatacattgcgtatttattttagcaggttggaggatgaagctgctgttaagcttcattgtgtaatctgtgcaggttgcttttgacatgctgctgctagggctt

SEQ ID NO: 27792 - DNA, 1167 bp, Mus musculus
ttctttatgaaaaatatattagtgatctttgcacatgcttttatatcattctatattacctctagattatctatagctaatactgtgaaaatgccatgtaaacagtttacatttatttgaggcagagcaatagggaaaaaatagaaccatacatgtttaatatacatcccttcctttgtaattttgatctcatctgaagatgtagagagactatttttgtaaacaattcaaaggaaacattaggaaacttatgaagtaagcataatttttgttttacaaattttcgttctcattaaagttttatttaatcattactactttccagataaattagtgttaagagaatttttttataatttcagacctatattttattgggggtattagtacatgtagttcattcagtagatgaagcattcttaactgatgtcctcttaaatgaatatttcttgcctctgacatgaatatagtgctcaaagatccagacagcaatccatacagcttacttgataatacagaatccgatcagactgcagacactgacgccagcgaatctcaccacagtactaaccgtcgtaggcggtctcgtagacggaggactgatgaagatgctgttctgatggatggactgactgaatctgatacagcctcagttaatgagaatgggctaggtatgtaagcacttagggaagagttgtgagtgtgtgtggttgcattgtattgataatggaggaagcctttcctttttttgtatagaattcacaaatggtttttttttttcctttcttttctttttagtgtttactttaaatgagggatatggctgctatcttgggcactcattttcatatctgtcagactatctgaactgggaggattccttaaggtgccctttcataccattaaatcaacctaaatactcagttgatctgtctacaaacaaaacttaactgttttagtccctccccctttaaaaattatagtacatatttatgggggctgcaaaaacctagcatttattaataaggggctttgagatccagggtaatgttggagagatatcttatatttctgaatgatggtggttgtttcaattacatggcagtttgctttattatgagttattaaagccctcttaatttccagagggcagtgctttatgctgca

SEQ ID NO: 27793 - DNA, 1310 bp, Mus musculus
gaagttcctagtttacagttcttttacattacagttacaatagtgcttgtacaagcttgccaaagatagaatacggatcgccagtcttacatcgcactttcagttcctccatttggaattcagaaaggggagggatcctgaagaaatcatatgttaaacatactttgacacctactgtgttaaaaatatatcatcagatgtgccttgagaatagtatatgtaacattaaaaaaagttgctggctataggaaatgttattttgttttcaaaatatggcagagatggggggaggtgggtggggtggggtccctaacgtaatattctttatgaaagcattagctgcttttgttacatttttaataatatgcaaccacttcttcacccgaggaaaactagaatgaagcagtctaaaatattttgcactgaattgtaatttcttcattagtttagtctggaaactggtctgtttaatgtgttttttaaatgctgtttgtagaggcaattctgcagaccactggaaatacatgttaactcatctgcagggatactgggtgatattggcagtgactgttctacattgaggctttgtttggtttatttattaaagtgtacagtatttaaaaatcaaacatagctttagttgaaacactaagctgattagtcatgtccattcagacataacctgaactactgaaaagatcaatttccagaaggtttattctgtataaactacatgtttagtcttcagtagagtacttttcacattttctttctaccttttttttctttttttttttcttcccccctttttttgattttggttgtttgatgtgcaatatgtttttgtatgcaggtagtaaaataaactttgatcttccatttgctgatttttaactttctacttgttatgccaattgtttcaaagcggtaggagtacttacaggccgagaatagatagcattctttgattgcttttcagaagcatttattttgtttctcagatctagtgttaaaatctaaccatttaatcatttgtaatgaaccctccagaatcttaacacttaaggttttggctagtaaatgatttaggaaatgtataatgtctttgccattagagaaacatctttgtattaaattctaatcaaaggcaatttgtggaagatatgggaggcagaagataagcttttcacttttgcctttagttctttattaaaaactatttttaaattatggtaagcagtttttaataggccgataatgtgctttttgagtgataaatgactttgaaggttttcgtaccagtgattgaa

SEQ ID NO: 27794 - DNA, 1151 bp, Mus musculus
taaaaatgttgagcttgttttataaatgaaggataattcacatatagtttacaaacgggccattagatgtgtgtagcttgtcacgtacattctaattgatattaacatgcacggatacgagattttttttaaaaaagtctagatagtagaactttgaagtgagtgatgtacagtgaaattcttgcactctgtatagaacaggtatagcagattaaatatcaaaacctcactttcaaagtattgaaaacaatttaaataattggctttttaattacttggttctgtgtacatgggttacaaatttaaccatgagttgttgtaacaaagagaattttgtgtctgttgggacttgaagtgttttaccattaagctacatccctagcccacaaagagttttaatttccaggctgggaaacatgacactaagaaagtataattctttttattttcatccataatcagaattccccaagatcttcttgtcataaagattaaactatcttaaagatcaagtacagctgagacacttggataggacttagtaaggattcttttttttgttgttgttgttgtttttttcgagacagggtttttctgtgtagccctggctgtcctggaactcactctgtagaccaggctggcctcgaactcagaaatccacctgcttctgcctcccaggtgctgggattaaaggcgtgcacaaccacgcccagctatttttgttttgttttggtaaggattttttaagagctgagatttcattacctgaaaataacccctcagtgacttaacccaaagaggcactaaagaattgtaaggttttgggcttttgtttttcttacagatggattagtcagttttatttagtgtcagtaaaaagccacctccccagggctaacatgtcgatttaggttggcttctggtgttttggctgccagcctggttaaattttccatgcacatactacacaaaatgtgaaatcagaaaagtgtattctgaaaaggatgtgtgcagctcaaagcactgatgtagacaccatgggattccatataaacctgaactgagtgaagtgggaatgcaaataagtttctaatgtggaattcagcagcatgtcactccagtgggttcttagtgatttactttaggtgctg

SEQ ID NO: 27795 - DNA, 2449 bp, Mus musculus
gcccgcatgtataacatgatggagacggagctgaagccgccgggcccgcagcaagcttcggggggcggcggcggaggaggcaacgccacggcggcggcgaccggcggcaaccagaagaacagcccggaccgcgtcaagaggcccatgaacgccttcatggtatggtcccgggggcagcggcgtaagatggcccaggagaaccccaagatgcacaactcggagatcagcaagcgcctgggcgcggagtggaaacttttgtccgagaccgagaagcggccgttcatcgacgaggccaagcggctgcgcgctctgcacatgaaggagcacccggattataaataccggccgcggcggaaaaccaagacgctcatgaagaaggataagtacacgcttcccggaggcttgctggcccccggcgggaacagcatggcgagcggggttggggtgggcgccggcctgggtgcgggcgtgaaccagcgcatggacagctacgcgcacatgaacggctggagcaacggcagctacagcatgatgcaggagcagctgggctacccgcagcacccgggcctcaacgctcacggcgcggcacagatgcaaccgatgcaccgctacgacgtcagcgccctgcagtacaactccatgaccagctcgcagacctacatgaacggctcgcccacctacagcatgtcctactcgcagcagggcacccccggtatggcgctgggctccatgggctctgtggtcaagtccgaggccagctccagcccccccgtggttacctcttcctcccactccagggcgccctgccaggccggggacctccgggacatgatcagcatgtacctccccggcgccgaggtgccggagcccgctgcgcccagtagactgcacatggcccagcactaccagagcggcccggtgcccggcacggccattaacggcacactgcccctgtcgcacatgtgagggctggactgcgaactggagaaggggagagattttcaaagagatacaagggaattgggaggggtgcaaaaagaggagagtaggaaaaatctgataatgctcaaaaggaaaaaaaatctccgcagcgaaacgacagctgcggaaaaaaaccaccaatcccatccaaattaacgcaaaaaccgtgatgccgactagaaaacttttatgagagatcttgggacttctttttgggggactatttttgtacagagaaaacctgagggcggcggggagggcgggggaatcggaccatgtatagatctggaggaaaaaaactacgcaaaacttttttttaaagttctagtggtacgttaggcgcttcgcagggagttcgcaaaagtctttaccagtaatatttagagctagactccgggcgatgaaaaaaaagttttaatatttgcaagcaacttttgtacagtatttatcgagataaacatggcaatcaaatgtccattgtttataagctgagaatttgccaatatttttcgaggaaagggttcttgctgggttttgattctgcagcttaaatttaggaccgttacaaacaaggaaggagtttattcggatttgaacattttagttttaaaattgtacaaaaggaaaacatgagagcaagtactggcaagaccgttttcgtggtcttgtttaaggcaaacgttctagattgtactaaatttttaacttactgttaaaggcaaaaaaaaaatgtccatgcaggttgatatcgttggtaatttataatagcttttgttcaatcctaccctttcattttgttcacataaaaaatatggaattactgtgtttgaaatattttcttatggtttgtaatatttctgtaaattgtgatattttaaggtttttccccccttttattttccgtagttgtattttaaaagattcggctctgttattggaatcaggctgccgagaatccatgtatatatttgaactaataccatccttataacagctacattttcaacttaagtttttactccattatgcacagtttgagataaataaatttttgaaatatggacactgaaattatgcctgagtctttcatttctttgtggctagcatgcttatacataacttcttggggaactggataactgttcagccaccaagatcttgatgttaccagcaatgtctgttagctttaactgcagaagaaaaaaatggccgaatgattaataacggggaactgaaatgcgttgacatttctagaatagaaactagaagcatatattgtaagttcacccccctccttccctgagcagcgtgaataagcgcgatgtgggcttaagctcgctttagcacttgttgccagaacgagtcaattctgaaaattttcgtgtagcttagcagatgagatactgcgccaaatcagaaccaggttggctgggttggttttcattttcttcacaacacaatggccctt

SEQ ID NO: 27796 - DNA, 2156 bp, Mus musculus
atcctgggactgccatgttagagatggagagccattgttggcttcttacctccatgcccgtaggcatatgggcacatacaatagatacatacatgagtgtcacaaagtaagcctggatgggtggggatggcgcatgcctttagtcccagcactcaaaaggcagaggcaggtggatctttctgagtctgaggccagcctggtctacagagcaagttctaggagagccaaggctgctcaaagaaattctatctcaaggttaaaaaaaaaaaaaaaaggaagccttttacaaaacaatgctgttgatcgtctgtgtctcaatttctcgtccagttgctgagacaaacctcccaataaaaaagcaagttaaaggacaaagggttgattggacacacgtttcccgattacagtcggccatggcagtccagacagcaagaatttgagttgttaggcagcagaggaaggaacccatgccgcccagagcggtagtccagtcccacagcccagggctcactcacagtgaaggtagtaatccctacaggcatgcccaaagcccctctcctagggactctaggttctgtgacaagcaagattctagatctcgacagcaagatgacagttaagacaattcgtcacaattacaaatgcagatttattgttcagagatgcgtctctaaggtctttggaacaacaaaaatgtgaagccaatctgaatatctaatcctgaaaaatgagaaatttcaagaatttattatctgagggtgtaggagctattatttataccgaaaccgggaactctggctctctccctctcctcagactccagggcagcacggggcactttgaagttgcctcccgtctcctgaccagctttgctcagtaacctaaaatattgttttgttttgttttttttttttctttttctcatttcatagaggcttaggctcagtgaggtgtactcagagaaaagtgtacaaaaaaagaagaagaagaagaagaagaagaaggaggaggaggaggaggaggaggaggaggaggaggaggaggaggaaggaagaaggaagaagaagaagaagaagaagaagaagaagaagaagaagaagaagaagaagaagaagaagaagaagaagaagaagaagagaaaaagaaaaaaagaaaaaaaaagatagttgtagttggtacaatcatcaaggcacacacacaaaacccactgtagagtcggtgagttgcaattcagcatgcttcagtgggaatggcacaaagtgtgggtatggctccgatggtagtgtacccttcactcatgtcctagcactacattaactatggtggcatgggtgtgttatcccagcactagggggaagccagcctgggctacatgaagccctatctcaccactattaccaccatcaccaccaccatcaccaccaccacaagcacaacaacagagagagagagagagagagagagagagagagagagagagagagagagaggtattattccattgcctgccttcattttaattaagcattgattgctgggactcttgggagtgcttggacccgtggggttctcatgttactatcaaccaggactcatatgctctatccaaatcaagagtcccttttgcttccagccggcgcacgtagggatatctccaagtttagttatttactaatatgccttttaaaagtcccaggtccttcctctcctcccacacctccacgtttgggtctttcacagagactctgagaacttgatgagaaccgcccttgcagagggaataacctgtaattgcaggttctttctacacagcaatgaggaagaagttggcatgattttgttttccacagagttgacggttttgttttgttagacttctttggtctgaaatgatttgttgattcgctattgtgtgaaccaggctcagtcccattgcacttctgtgactgttggggatgggggaggaaataattggggagtggaaagggtaattggagtgcaggccaagagacgtgaccttgtgcgagttctgtgacccatgtgctacgtgaccctggaccagtcattgcagctgctcagacctcagtttcctctagtgtgacaccaggaggttgagtaaggttagtccttaggtgggtaaggctagcttttaggtg

SEQ ID NO: 27797 - DNA, 1175 bp, Mus musculus
gctggaccgagcagggaggactagccttggccttggaggttttgtctcaagcatagctttataatcatcactagactgcctcatttacagggttgaacttctcactgtgctgccaagttcacacagtaggggtttgcttggtcagaggttctgcatggggctgacggtttcctgtatagagagagaatagaaggagtggagatcagtagagactctgggcatggggatgactaatggaagtttcttatgtgtctgtagtagagaacttccttcttaaggccaaggataggttatttttgcagtgctgggattgaactcatgacctcgtgcatgcaaggcaagtgatcgcccattgagtcacatccccagtccagtcaggattagctctgtgtactatagcaggaacccttttgttgagcttagtattaatcacaagattgcttggctagggcaagatgcaaggccattggcagctgagagcttggggcctttttcatcttttgtttcttttctttgtctttgtttcttggcggggtctcactatgtagttttagctgacctcaaactcatagatatccacctgcctctgtgtcctgagtgctgggattcaagatgggtgccaacattttatttttctacagctgcccacggcctgcccacagttgtagctctggttaggccagtgtctcaccattgggcagcatccctgttatcgtcctgggttcagtggcgattgaagaggcttgccttgcctgcagcagaaagtccacctctttagtctgggtttacacttagaccccagtaaaggctatggacaccttgatgtatgtcaacagctttagacacactcctgaggacaccatttgtatctactgcacagcactgcagtttgaattgctctctgtgagccttgtcttactctacttaggcctctggagacacgatttatgtctcatttacttcccctgaccatttcatagaatgacagacctgggatttgaacccatgtttttccaaagcagcattctttttttttttttttttttgacacagggtttcatgtaggccaggctagcctagaacttcttatatggtcgaggatgaccttgaacttgttccttcgtcttctgtttccctgggattacaaatccatacccagtgctaggactgagccc

SEQ ID NO: 27798 - DNA, 1175 bp, Mus musculus
gaatactcttttttagactgagtgccttaggcttcgagaaaggtcctttgaggggatagaggaaagacacttgaggtgagattcccatagatgctaataagatgtggaggtagagggaccgtgggtaccaagagatccataggaggggtgtgtgatgtaagtgcagaggaacaaggtgaggggctgggaatgcatgtgatgggtttcttctcatgatgtttgctcttaagtgtttgttattcacttgatgttcatgttcttccagaattcatgctgaaatctagtttcattgtggtggggctaagaggtgaggtctaggcatttgctaagggatctggcagctatggatgctttggacaaagttgtaaagcctaaaactaaaaaggctaagagattccttgagaagagagaaccgaaactcactgagaacattaagaataccatgctgattaaaggcggaaatgcaaatgcaaccgtgacacaagtactcagagacgtgtatgcactgaggaaaccatatggagttctatataagaagaaaaatattacaagaccatttgaggattagacatcactggagttcttttcaaagaagtcagactgctctttattcatgtttggctcccataacaagaagaggccaaataacctagtaataggttgtatgtatgactaccatgtgttggacatgattgaattaggtattgagaaatttgtgtctctaaaagatgttaagactagtaagtgccccgagggaacaaaaccaatgttgatatttgctggtgatgattttgatgtaacagaagactacagaagattaaaaaaatcttcttattgatttcttcagtggccccacactattgaacgtccagctggatggattagagtatgttctgcagttcactgcactgaatgggaaggtttacttcctaagctataagctgctgttgaagaaatctgggtgaagaacaccacgaattgagctagaagagatgggaccatcactggacctggttatgaggaggacacatctagcatcagatgacctttataaactgtccatgaaagtgcccaaggctctcaagccaaagaagagaaagaatatctctcaggatacttttggcacaacatttggaaggattcatatgcagaagcaggacttaagcaaactacaa

SEQ ID NO: 27799 - DNA, 1292 bp, Mus musculus
atttaacatttagccataggtttaagtgatgtaagacatctacctgaatccaggtacagattccagcgttcttcagcacatagatggacacaaacacccaggtgacctgtggatgtgactctcagaagatccttctcagcaagctgaacagcagctataagcagaatatgggacattaaacttagaagttccagacaaagcccttcctctcaagtacttggaatagctcaatacttcctgaatggattgctaaaacatcagttttatgttttcttttttaaatatcctgtccttcaagtaataatactgttatgcttgtgataaaactgaattattaaaaatataatacatagaaaatacttcctgattaaaaaaacttattagatttaactgttacagagttagtttgttagattgttttcaagcttttcttaactctatctagcagcccagaagcacttccttcatgcccagcgacaggctgagcccccagtgtccccgtgcatcacgatgctgctctgacttcttaccttaccctcactctaccctcaactcagtagatgagtccaggttgccccatcagacagctgccaccaccttcctcagttgacagtcagggtttgtactgttcagggatgcttcaaaagtcagaaacagaattcaaagagtccttccagttggaaatagtggtatttaacctgaactcggccgcactagcatggactgcagtgcccacatttgttggtgtggagcacataggggagcctcctccctgcagggacgaagcttgagcttgtgggagcacagactgggaactgatgagagccttctgcctaagccagcaccacccagattccaggttccttcagtataaatgtatgtcccttctgtgctaggtagttcatggttcttggtcaggtaagggaaacaggttttaagtagttggtcaacacaaaagtgtgtgtgtgtgtgtgtgtgtgtgtgtgtgtgtgtgtgtgtgtgtgtgtgtgtgtgcgtgcatgtgcgtgtggtttaccttactgggtgtttgctttttttttaagggagagagaaatgaagttgggtgagtagggagaatctttgagaagttgggggagaagaaagaatatgaccgaaatacattatgtgaaaaaaatgacagaaattgtagaatgccggtctcaagctctaccagctgagacttgagcacagttcctgaccgtctaaaagcctgtttaaggctttgatgtattatttcccaaagtacttacttagtcacagaaacccctcct

SEQ ID NO: 27800 - DNA, 1149 bp, Mus musculus
gttcagattgttatttcccagtcttcaagatagttttatactccactgttctcagttgctgggcatttgttcttcaatcataattgtaggaattccaaagatgaattagagttcactgccttcctaagtagttggcataagtcaacttgaccatagcacattatgaagtgcaaaataataaacctttgcagacagaaatgcctgtctattcatttagataccattggttatctaggcttctgattagaacaggggcgtattaaatgcatatattattgtactctaagagtgctgtaattccttattgtagtaaactgtgtatgtttgtatcagtccctttcagttttaaagtccttgttttgatttctcaatggctttgtgagtccggatctgtggacagctaactggctcttgctccgcagcttgctgaagctcattccagtgtcaagtgcttggactccgtgtgctgtttcccaggagagaccccgtgtgcgtctgttggaagaatgctggagcgagtcataggacggtgtagtcccaaccatatcagcaggtatgacgtttatttcactgcgtagcctgggctgcagatttgtcctgtccaagtgaagcagggagcctgctgttgagtcacagcaattactctttgatttgagatgtcactttgaagctttgtggtgtggtcctttcactcaaaggaagagaaggcatctgtgaggagactctctatcttgtgaaggaattactggtttagcctttctaaacttcggtgaataggtgtgtgtgcatggcacttttccttggcatataactgttttcactattatttctcctgtactcctgttttattctctgctaggggtctggtgtttgttattcctttcctactgctttttgtgattacaaggaggggagggagggggtagtagaggcaggccatgaacactagaagagaagggggaagagacgagaggacagagcagggccagggagacaagagcaagagaggagcaagagagtgaggagtgggcaagcagccccttttatagtgaatcaggcatacttacttggctgttgccaggaaactgtggggcagagcttagacaaaatgttaacaatatgacccaaaatatttccataatgtagtag

SEQ ID NO: 27801 - DNA, 1809 bp, Mus musculus
ttggtttggtttggtttggtttgatttggtttggtttggtttgggttttcaattgatcattgattatagtgagcccaactttcctcttattgttccattcaggttgtggaatgcatcggatccattctataccaatgacaggagcatcttgactctctcgccaatggactcatctacttgttaaagggacagtaggactttgtggaacaagttcacttgtcctcaggtttggggtcaccatccagttgtaaaaggccagttactttctgaaatctcttgaggaattgacactttctcagagtccatgggaaacaggcagttatatgaacccttctcctttctctttaatttgaatgtgaatatattaaaatttggagataaagagatagtaacaatctctttgtctggtttgtcccttctgatcatgggactcctggtggcattgcagcctttgctgaggccactgtactttaatatcaaggtagagaaaggggtcattcttggttatgtgtagtttaagatgagggtggtttgggactcttctatttaaatctgcttctgtaaattttgctaaagatttgccttgagaactctattttttttattagattatatttgaagcttttcgtggggaaagttaatgtgaatatcaaggaattttggtccttcagtgacctctgttaattcattagtactttttaagtcacagagcaactaggagagcacgtttctaaccactgtcttttgcggtgtgggtaataagcttatactgaccccacttctttaacgatgctgtaacccagccagtgacgctaatcctacaagtgcaaagggagttttgcatctcatgtccaagtcagaattagggccatttactagacttcaaattggtgtttgctaatatttttgtggccaagtatgtaaacttgtagtgggtaaattcaatacttttgtcatattaatttactgtatctgtcttatcttttgcatgcttcaacctggctaatatatttaaatccaccgcatctctcctccctccccccattattactttcctctctctccaaagactctgttcatagttttataacaatattgtaaagttcaattgtatcaataaaaaaaaaaaacaagtttggacagtatttaaatattgcaaatatatttaattatataaattaaaatataagccataatgtctttctttggcccacttagaattgctcttgacttgctgtaaaccaaccttcagaataaaggacttttgttaagaaccctgttgttgcatgttatctaattgaaggtagactgccacaatacagagaattatgctaagtcccatcgtaaggtatattgttaggtatggttattgaatgaaaatgaaacagagtctaaaatgctaaatttttggcatcaaaagaattttatcagcaataagttaatgtgctatattgactaatcagatacacactagtcttaattccttaaatctcaaactctagtttccaggtaatctatcaccaagactcactattatttgttttatatataaataatgttttaagagttgtgagtgatttttaaagaactactcccacctagttctaatcacaattctgtccacacctaagatcataagaaggagttgtgagctcagtcagcttctcttgagaagatggccgttgctggaagatgacgatgcagctttccactccctcctcctgcatgagtgggacttctggccctcgctgaggctaagtcaagaatcacagagtgagaatgaagactgactgtgtgttacagattgtt

SEQ ID NO: 27802 - DNA, 2343 bp, Mus musculus
gtgtttggttgggggaatttaattttcctggcaaactacatgtactgctggtgtgagtagaatacctgatataagaaatatcaaaataaccaacacatgaaaaaaaaaaaggataatctggggactccctgaaatatgtcttgtgtttcagacgctcagaaaggttctacagaacaggtctgtggttatcttacccatgtttatacagtgtcctgcagtgaacttttatttaaaaaaatattgtaatgagatcagatgttagactccacactcgtgcatcacacaccacataatcggatttcattgtgctctgaaatacttctatgccttctgaataagttaaactatttcatttgttttgaatgttttggattgctatacaatataatattctaaatttaggcatgagggtattaggtttgtttgtttttttttttaattttttgtcatcgcactatggaacacaatgcaattcacttaatttataagaagatagtaagatttagattttgaaaatggttgtgatgagccgtgaagttcaacctttctcccatggcactgctctttgaggcgtggtccagccatgttggctgctgactgttgagatggcttactgctaaatcactgtggttgccaagtctactccagaagcagagattgtcagacaggcgagcactggtgcagataccaatggcttctgttctataaattatttgacttttgactgtttttgtctcacttgcatttgctatttccacatcacagcagaatgcagtcttgattggttttgttttttgtttttccatgacaggactcatgccttgctctcctgctgaaaatgcttgtttctctgataacatactgacatgtgaaaggggtgtattcatacatatttccatgaggaagttaaaatgatgaactaaatgttgggtgactggtcttcaataggaacagattttgcttcatgtatccaggtcctctgcagggtaccaaggaatgttcttcaggatagcggaacaatttatgcagatatggaaatgattaaaactgctttttagtcacatgatttggaaaatgcattgaaagcttaccttacagatatatcattaatccaatcataactttaatttaggaatgcatttctaccaaaagaagcttagagtaaatttctattcacgttacagggattggtcattaaaaggaaaagaatcttgctgttttcagtatttcttgatttcattttttgtaaatataaagaacttcaattatgaaaaaaattaaagatatatgtatatatatctttaaaagttttacagacctatattgtttattccctacatggaacattttgagttttggtattgttttcagattgattgattcagatatgatttgttttcaaatgagactccattagcttctttccctgcctcataaattttttttcataaaaatcttgatatttgtgtgtggcctaatgctttgggttttacagattttatttttaaatgcaagactttttaacaaaatagtgtttgtcatcagtttggtactaaacatttacaattactgtgtaattataaacaaaaatatataaagcttttattatgtagcaaaaagagttaaggttgttcaccatgatggcatcttagaattaaacaagacttgctagggctccaagagaaaattgatttaatgtgtttattctgagggtgactgtctggttctaggaaatgttttgtaatacaaatgcttaccctattgggggcggggcgtcggggagtcttccagaggaagggcacactcactcacacacagccagctattgccggcagaggatcatggggttcagtcttcgtgtgggtcaggtctccaagctgattcttttctttccagacagaaccatagggagagtttactttttgccaaatgtcagaacaggtacacatttttaaatgtaatgctttttaaatagtaaactgtataaaatgagaagtacccacatataaaaatacttgaggtcaaggttctcttgagtgactatcatctgcatatctctgtaagttcaagtgtgtcgtttccaatccctgtcatattacccacagaggcaataaaagcttcagtaaatttgccatgactaaatcttctcccatattatttcagtgttttagtgtttcacataactagactagacttgaagacttttcatggccgagcgctgtaatggcacatctgggggaagagaagctacgccacgtgtttgctccgtaatgtttacaatgtgctcagctgtgttgtttatttaactgcgttagttgtatactgcggcactgtgagtgcacc

SEQ ID NO: 27803 - DNA, 1161 bp, Mus musculus
tgatgacctaattcagtgccctagctttaaatgacaactctattcttacgactcagatttattttttcaacttgagttcttcccctaactccagacttagtctacctttctgctctatatctcctcttagatgtctaataagcatctttaataagcatatatgataacctctcctggatcccacccagttctgcttctcccaacagcccgtttacaatagataatggctactctgtgattcaactttttcaatacattctccagtgacacctttgattcgtcttgttctcattgaatcctatagtaagtaaatctttgtttatcttcaagttacattcatatctgaccacttctaacttcactgctacttcctggattgagcaaacaccagctctcggagcatttctgggccttgactaggacaatggcagtggtacttaagcgtctgagggtagagagtagccgagttatccatgccagtggctgacatatacacttacttggacccgagtctgtcccaggggcaagtgggaggatgaatgggtgaggcttgtgtggcactggcagacttagttacagcccctggcttatataattggcttctgcagtaggattacctgaataacaggttcttttgctttatcagcttaaaagatgctaattgttatttcactcctcacccacacggcgcctcattcagtttttgtcacttttaactagaggatattttccttctagcctccagtatccaccccccccccctgatattttttgttttaggtttttgggttttgttctgttttggaagattgtatttgagttgttgtttttgagactgggtcgtgatgtgtagtcttggctggcatggagcgtgctatgtagaccaggctggcttgaactcacaggagtccactggcctctgccttccaagtgctgggattaaaggtgtgcctcattgtgcctggactcctgaagtctttacccttttaagtatgtctgaataccagttatttgccaggttgcctgttttgcctagtttgcccactgggatcgacatcacttttctcccacacagccctttgacccagactaggtgacaggcaagactgtgaaggtgatggagtaggagtggtctgagcctccatgagtgagcagccttgt

SEQ ID NO: 27804 - DNA, 1172 bp, Mus musculus
tgacaccctcttctggtgtgtctgaagacagcaacagtgtacttacatataataaataaataaaaaaaaaaaacatacacactgtccagtgtacacataaaagtgtacagcgggcgccacactggagaagtctttggcaggtctccctaggatttacacaactaaattgtgtagcatagagcttggctgtctccccccagaaacatatagaattgtgtttactgtcccttctacaacatggttaagatgacattttcatgatgacacccacaagaagcatctttaaccctgcatgtgtattttttccttcagtcatgaaacaaaactagagagcccagatagcaaaaaagaaagaaaaaaactaaaagtatatattgagttggtctgaggatcctgacttctgagtctactgctaaaaagactgcaaatatatagatggtgcatgctgaatccacacttttatacaattaaattacatttggggggtgttgtgtgccacagcattcatgtgagagtcagaggacggcttccagcccattctctctgtcatttcgtgttgttgaactcggttcatccggctttgctgcaagtgccttcacctgctgagttatctctacgatcattggattttagggtctgggactttcctggcctctgccacacagacccctgctgttttctgcccttttttaaatcagaaagttaggcagaccacctactacaattgcaccacagtgcatataatctccctgtgacttgaagacatgaccatatttaaaaatgagaatgtacagaagatgtagggagacatttttatgttgagtgttcaaaacagactccataaagctaaaggccttctggggtaagttcttcagatcatgtcaagtgagatgtggctgtgttagaatcctgatggtgagtgcagaatctgtaagggcagagaagcactgacatcatactctgatgtgatgcattgtcagaagagagaggatgataatgatgggagataagcagcatctagttcagagttgtggaacagccgcctgtaagctatatacggggaatgccgtcttcttccctggaggggaatcagttttatcacactgtctagggtctgtaccagggctctttctttctctgtgttggcctagtcaacctagtcagcctggatc

SEQ ID NO: 27805 - DNA, 1607 bp, Mus musculus
tattgagaataaactgatttggaaatctttgcaagtcaaagttaatctgagataaaaatatgaatgatgtcgtttagaaactaacttgatttgttttattgtacagtggggagtaggaaaagattttataaaactaaaatatttcagggaaaaagaccttcaaattctggcattgattgattattctaagcaaccaaaccaaactgctgacttgttcataaataaccaaaagtagacaaactgttttcaatgtagcagaactcattcggctctcagatgttacagtagtttatggagacattttatttatcaactttaacaaataaggtcttacatgagttgggaagcttgtgcaacagaaaagttttccagaaagtttattcaaagcataatgttaaagacaaacagtgtatcaagaagttcagcttgtaagatacccagagctgttagcactgagtatgtatacacacacacacacacagagatccaccactttagcttagttagcagttctcttcttcttcttccttttcccttggcctttacttggtgccttctggtttgcactggtctgagctctgtgaatgaagtaatataacagctcactgtatcccatctgtcctggattgggtcactgggactctgaaaggtgccccattttatagaaccagcttttaatgtatatttgaaagaggccagaaatttgttaccttattttctttgggttcttctctggctccaaaataatcatttcttcttcttcactatctgatagcactataggggcacctttggaaaagtccaaaaaaggagtttactgcttaagcacatcagaggtcctaacgctcccatctccaggctaagggagctcccaagctctactgcccggaggctgacactctttccgaatcttaccctgttctaagtaagtagctccttgcagctctgaaaatttgtaaaaattgatgttttctataaactctttctttcctttttccccagaggacatgtaggccagaatgctctaattcttgctaccaggactgcccatgaaaaatgtagaaaactgctttgtttgcccatttttctcttgaacagtaattatatatgtgtgtaaataaagcatgcaaattaaccctttacccatttggtgggctgtgtgttgtctcatctttattcacatgttttaggaaagctctaccttcttcactgtcctacttattttaggtccactttcattgctcagggttcttaaaaccacaaacaaaaagcctctatgaaaagagatatacaagtgcaaagatatactagcaccgtaatagtgagaagataagaaaaagcattactgatgattaaaccaactggatgattctctatgcagcatttaatagtcctaattaattaggatctttaatttactcatttatctggttaaaccaacattgttcccctgccaaaacaataccaccaaaaggctgtaagtagcaattcccttctgttaacagtgcatactgctatgagttcagggaatagcactcacatgggggcagctcacaattgcctgcaactccagatttgatgcctgactctagccttcaaggcactca

SEQ ID NO: 27806 - DNA, 1178 bp, Mus musculus
atactcatacatataatgtaaaaataaaggttacatttttttgagtgattatgaaaataatagaaaactcttccatgtgtgcatgattaacgtaatcctcagtgccactccatgagataagttattcttatagagaagggagcagaccaggtttcctcaggaagattaggtcacttgctccgggaagaatgataaattaagctatactctttcagttctttcttgatagttgtacacctgatatgcttgcagcatttattataactcacatacacttagattgaaccctgctcatgtctcactcgataatattataatgttaggtgttcaaagctcattaataagatgtggaaaaatagtttgtcaaatgagatagcaatgataatgtaaggttaaaatatgatttcggacccttatcaaagacagttgtatttgactaaaacactgtttctctttttcctttttatgtagagattgtttatggaagtttttctttccacctgattatcaagttctgaaagtctctgagattgcacagcctggaagaccaagacaaatccttgcatttgaactccgaatgaatattattacagatgctaccattgacttgctgtttaccaaaaacagggtatccattataagattgtagagaatagtattaaaaatctgaaaatgactttgcagattttttgtgggtcctatttctatgtttagcttcatttctgtgggctccccattcctccttaattttaactttttgcttttatagtcctttatttaaagtgttaaataatgattaatattaataacaatggactttaaagttatcttctagtttctctattatattttgttaaattgctttaagtataatttttatataaatttgaatcttgatttgtacagagttttagtagttcatattaatagtgattatatttctttgataatttaaaagtaaatgataagaacataagtacaataaatgtcatgtaactcaatcttgttcttttggtaggaaacaaatgctgtgcatgtaaatgtaggggctggctcatatttagaaattaatattccgatgacagttgacgaaaatggtaagctatcattattttgcctgaaattattagtgacataatttatatattattatagtttgttagtccttccagagtaac

SEQ ID NO: 27807 - DNA, 1112 bp, Mus musculus
atatgaataatgtaaaattactatataaaatctattattacataaaaatatagtattaaacttatcaaatttaacattcattacagttctgcacttgatggaactctcaagctgttgctgataagtgggaccatgtaaaacagtgctagtcctcggcaggcagctgtttcctgtgcagcaatgccaaggccaggctgtaggatagtacccatgatagtccgccttccttcctttaacagaggaggaattagggacttgggctgtttgttacctgctacgttagctggtgtgtgttgctgaaactagagaatatttctttcccctcagagaattttgaccacatcaaagcttaatatctcaaagatctgggtattgaccatagacactgaccttttacagcagttttaaaagtctcaaagacactttctgttcatctcagtgggaaaataagttttaattactctccagattatatgacttcattcccaatgctgttagcattgtcacattttaacctctaacatttgttttgcagttccacatcaatgccagctaccccagaatttggaacatgccacagacatggcaatgtgaattggaagtatataaagccacataccacttcatctttgcacagaagaacttctttacaggtaatttctggtaaatatcgacagttacttgtgtggtgagcttatttatattctgtaggttttacttttacatttaatataggggtgtgctgacatgacatgatatgtgtgctttccttttttcctataatttttccatttattattctcccatatattgtatcccaaactgcagtttccccttcgtcctctcctcccagtccatccctctacctcctctttccctggatccacatctaccccttcaccttttcctcagaaaagaacaggccttcctgagacatcaaccaaatatagtataaaaatctaccataagactaagcatgtattctagcatcaaggctggatgaggtaacccggtaagaggaaaaggctcctaaaagcaggcaaaagagtcaagagacatcccctgcgcacactgttaacaatcccataaaaccaccaagcgacagaaatata

SEQ ID NO: 27808 - DNA, 1098 bp, Mus musculus
tgtatttaacagtttttactttttttagagtagagccttgccatataagaagtaaacatttcatgtgaattcttcctttaatgaaaactactgatttatacttgtttcttatataagacaaggggaggaaggaaagtctgatctggttatgagtaatactttaaagcaggaaagttgaatagttgtaagactttcaggcttaatcttacatgatacagtaacttaaaatactagtagctctgtctccacaccttttacctgcaaagtcatacataactctcttagataaaggcaaagcctagtgaggaagaacatgatcttgatgaagttctatacagatattttagagtataacagtgaaacacatctactttttttcctaacaagtggctccctttatttttataggaggaagacaatctggtgcagttttatataacagttttggaattatgggtaaaaatagtgtcacagaaaggggtggagtgctgacatccaataattcttctgattctcctactggcagtggctacaatactgatgtctctgatgataacctaccgtgtgaccgaaccagtccttcctctgacataaatggaaactcagtgtcagatgagcaagttggtgattttctaatgatactactagtttggaaatagagaactatatactcaatttaaaatcaatttctagagcatatttccttgtcatttcctgttttagagttgtaacattttgttgactatagtatgattacagtatagttcctgaatgggtataagaatatatactaatggtgcacatttctgcccattatactagttagcataatattctgcatatgttatacacatagtaaacattggctaaataaatgaatttatagaatttaagaaaggtagggtgtgattagttaattttagaagtcattttatgcttataggtaatattttatataaattgtaaatgtttttataaatatctgcttattttagatatcattttaaataatactttttttttttttgagtcagggtttctctgtgtagccctggctgtcctggaactcactctgtagaccaggctggcctcgaactc

SEQ ID NO: 27809 - DNA, 1202 bp, Mus musculus
cttcatgccttttatttttattttcaaattagtgctgactagtgccaagctacacattctgagtctaaagaatgcagaatcttcactattgtgataacaaaatgaattttgtactaatgtcttaggatccccatgccaatatcatgagagtttaaaaatacatggagagatggcttagtaattaagagtactagctgctcttgaagaggatctgggttcagttcccagcaccatcatagctactgacaaccatctgtaactccagttccagaggatccagattccccctctggcccccacaggcatggcatacactttgtacacaggcaaactcgggtgaagcacctgtatatataaaataagaataaatgaatctttaaagtttttttcaaagagagacattttaatccaactttctgaaagtatgcaagtagcatttttctgttttatagtatataataatcttattcaccataaactttttttcagggaatacagtagccactgacatgctgtctgaacatcctttgttatctgagccatcatctgtgagtttttataattggatgtcaaatgctgtgggaaatcgtggaagtgtggtacaggaatctcctgttacaaagtcaggacataacagtcttccaacaggtaatacagttatcattttcatattaaccgtcttcagtcgtacatacagttacagcaaaaccttgttcctcaaaggataactagacggtcagctgttaggatgaagttggaccgtttcagcaaaaagctaattaaactttgacttggtgttattataatatcaaatacaagatttaacgaatttaaagcatttaatgtggttggttaaacattcataacacaaaaggaggcaggttaaaaaacattaagtatagttacaacatgatatacctacaatacaggaaaatatcttgaatctgtctagttccctctgagacatcataactattaattatatactctttgtagttacttaaatatttaatcagatctatggggatagaaaagtaagatttctttccttaaggagagaaataaattagggccatttattaattttaaaagatcatgcatgtataaaaatatttggcaagatgttccccaagaaagtggtggctgtatcaagtgtaagtatatcaaccttcctttgcctatttttgaagttttccatgtta

SEQ ID NO: 27810 - DNA, 1148 bp, Mus musculus
gtatgacgggctggttctaattgatctgtggctaattctaagtttctatactattacatgtgatattagatagcaagaaaaaaatgtttgttttattgtttttttttaatagaagccaaatgattttgacttcttagttaatattagaggaaaaactaaaggctatctactagcccatgaacagactagactagtgcaaacatgcaatgtattgaatctcttgcttaatggtacagtgcaccttggaggttattatgtttataaatgcataagaatatgctatgtagttcttcacaaaaggaagtaacagcccttccctttgaacattttaggcaaggccatgtgaaccttcccccactggagttcaagccggcattaatgttggaaaccttcagcatcagtgctgttgtaatggaaaagtcagtgtgcactccgcaaaactccaccagtgccctttcctttcatgatctcaacaagcgctattacaacaccttccattgcaacttcactatttcctgccagtcaataagtcagcatgtggatatggctctggtccgtcttatccatcaattcagtacaatgatagatgacatcaaagcaactcagacagacattaaacttagtagatacacagctggatcagcttcccctacgcctaccttcaaaaccagaaaacatcgggatttccgttcatctgacttcagccgcagttcgagagggagtctcaatggtggcaacagagtaaataatgccaagaacaaacgggccaacaatgagaacaataaaaaggaatcccgaaacaaaaactcactaggaaggtctgaaagaagaacctcaaaagtatctaggaaaggttcaaaagatgtagtggatcatatgacgattcatatggatgattccgattccatcacagtgtcagagcaaagtgagccttctgctgaatgctggcagaatatgtataaattgcttaacttctattcacttatctcagatccaacagggatattggaaaagtcctcagaaacatttggaccagcaggtaacaagcattgttgtgatttacatttttctgtctagaaatgctaaagaagactgttcaccatattaatggtataaattattaaaatgcatagaaattggtagtcacc

SEQ ID NO: 27811 - DNA, 1091 bp, Mus musculus
ctgtacagttaaggacaaggctcctgttttttcatgtattattccaaccaagaccaaattgtgtaataggaattctacaatattgaatggataagtggacctgggttttctttctgttgtcactagacagttgcttgctttctgtttctttcttttctttctttctcttttttttttcatgaaaagtattaactgtatgactttagtatcattataattctagccaaatttttctggtagtaatttttactagaaattattgttaatcatcagaattttacagtagttgggatttactaactgtaataaatcacttacatcattgactttagttttctttctgcctgttcttaatttgcaaaagctgttctgttttggctgaattataaagctgcctatgacaactggaatgaacaacgaatggctttacataaggatattcatatggctacaaaggaagtggtagacatgctccctggtatccagcagacatcagcccaggcctttgggactctcttcctccagctaactgtgaatgatctaggaatttgcctccctataacaaataccgcacaggtacagaaaatcaaaacatacgaggctttattccagaattgaaagctagatattgctactcaaccatttctgtgaacatggattataaccattttaagtagagctgtttataacttgagcaaggaagaactcctaattcttacctttgcaaataagctttagaatcatcttattgctttttttaaagtaagagctcttaggattgatctttgtataaagtggaaacaggaatatttcaaaatgactttattacccccacatgtaacatggtagggaatttcaattttcttacaaagtgtagtatgaatattaaataattatttaaaaacttgcaagttatatatgtacttagatgaaaaaaagatgctatcttcataatttagggccagttttcagaaacgtattggaacttgaacttgtggttaagtaagaaaacgctgtctgcacttgtcagaccaagaagaaattgccctaagaatcatatgcagagatctgtcttattgttacagtcttct

SEQ ID NO: 27812 - DNA, 1143 bp, Mus musculus
ttcaggaaagccacacacataagaactggccatcgtagcccacgaaacaggggccagacaaacacagatattagctcttgcatattaaaaaggaaaaagtacacaggaaaatatatttcatttactcaaaatgaaattttattctttaaaaacctattttgctaatattgaggatttctagacttaaccatttctagactttaattatgaatataaagatttctaaagtttagaagtcatctggtctggagaaatgactcagcagtcaagaacacttgttgctcttgtcgagaacctgggtttaatttccaacacccatgtggtggctcacaaccatctgagccactctagttcagtggatctgaagccctcttctgatgtctgtgggcaccagacaagcgtgtggtgaacataagtataggcaggcaaaacattcatgcacagaaaataaatctttaaaaatgcattctaaattcacctttgcctcatttccctgtgatttttctttagtctaaccacactggagacctggacactggctctgctctagtgctgaccattgaaagtactctcatcactgcatgctcctcagagtctctggttagcaaaggccatttcaagaacttttgtatccgttttgctgatggctttgagacatcatgggatgactggaaaccagaaatccgtggagatctagtaatgaatgcttgtgagtctgatttattttctatataaggcttataattgtaaaaaaaaattaaaatgtctctgttgaaaattgaaggatgttcagatataggaatgctttagaaatgaaataagggttttttgtagttaaaggtagcaaactatatctgtaaaaactcttaacttcaggcttctggtaaggcagaaagacttacacatttgaagcctggtttttcctgtagttgaatgaccaaataaataatccttgttccatgatctgtaagaaagtggtaattgcaagacccaacttagtaagcatagaatagattgtgattctcctggactagaatttcagctttaattatagctgacacaggaataacccaacacacagcccaagtttctaggatttgaaagactcatagtggactcctctaattccactctgatgtatgt

SEQ ID NO: 27813 - DNA, 1365 bp, Mus musculus
tgtttactttgaaacagagttaggtgaaaatacgatgggaagtctcaaatgccacatttatgagttgatttattgatgactagggagagtagtaagtatttttgagtaagaaatcaaatggtgatagcatcaaaggaacacctcatggctgtaaagcataagaaaacagctgacatcacgtgcctggaaagagctcatttctgttctcatttcaacaagatccagctcttctcaagctcagagaatgattttggttttgtaactttgatgtttactgtgactacttagttacttgtaggtggtggatgcagcttataacggtttctgctgtatccatgggaaggttgagctcagagggaacggatagccgccatgctgttatacagaagaggtacatacacactataaacatggaaaccaacactctgtctggtgtttggagcaggtcttgctgtgaatggcagtgggtatctgatatggccatcatatagttcataagtgcttatactcctattcctaggaccttgaaaatgccacttctttatttaaacagaaagtagtagtgccggaacctggacactgaatgtattgtggaaaatgtgtgggattgatgtccacatggaccctaacattggcaaaaggcttaatgctctgggcaacacccttacaacactgacaggagaggaagacatagatgacattgctgacctcaattcagtgaacatagctgacttgtcagatgaagatgaagtcgataccatgtctcctacaatccatactgtaagtgcattcactgctaggaatttcaagactgggttttcctgagatagataactgattaacttgaggttatttcatgtgttgtggttgctgttgtagaggaagggagaaggcggtgatttctaggtctgcagtttacagtactgatgtgtgtttcatcataatgcctttatgaaatgtgccttaacctcagtgtaatatagtaacattgaaagtaaggtaaggtcaatctataaacacagaaagtagatcagtgggttttgagtctggggctggggatgaggtttgagaacagggaagggaagacctgctcttatgagaggagctttcctggctggtactaagagtgtggtagtgactgcttagctctggccatcctaaagctaccgagctgtacattctaaatggatgggtctcatggtctataatcgtatcttaggaaagggttttacaaataagtctttcaaaaagccaagtgtttatactgtgatatatacatttaaaatgtgcttttccaactatactgcttattctgttgtatcaagttatttagtagcaaaagagatagtgactttcagatttcat

SEQ ID NO: 27814 - DNA, 1163 bp, Mus musculus
cctaggtcctctggaaaagtaatcagtgcttttaactgctgagccatttctccagcaagtgtattcttttttaacagtagccctcagagtcaaacaattgcttccactggacagaatgtcggaatctgtgatcttttccaagtgtccagcttggtcatttttatgttttcttttgtgaagaacattgagcatgagatgtgcccttcctgggctgtctgaatgggtagtgcagcaccatcctctgtggccagggtggcacaacaggttttctagagcctgtcctgagtaaatgagacttaatggtgtttgttggcagttccttacagtacctacaccattcctttctttgcttctgtgatttttgactttcaaagaggaaagctgtttgagtattttctatgagcttataaattaagaaaatttctttaaagacttattcatataacactgggaaatagttcactaagcagacttcaatttactataatgagtaattccttgttttctgcagacatacctctcggaagaaagcaacaggctttgctgctgttcatcagctacttactgaacgctggcctacaaccccagtcaatcgaagtcttagtggcacagctactgagagaaatattgactttgagcttgatatacgagttgaaattgacagtggaaaatgtgtccttcaccccactacccttctgcaggagcatgatgacataagtttaagaaggtaagagacagctggaaaagttatatggggttcattagttagaaacactgtccatatatcatgatttatcacaaatgttccccatccaacaccgcaaaatttaaaagtaactagttgaagttacagtattcatttgcataacacagtttgttaaaataaatatatcttttatggcaattagaagcagatagctgatttagaatctggtaaaattgttaattaaaatagatctatagaccaggtattttagctcattggtagattgtgtatatattgtataagcacaggatttaatccccagtagtagtatgtacgtacacacacacatgcatgcacgcatgcacgggcatgcagacacaaagatataagaatcctttggaattctttgaacaaacccaaatttctttctttgtattgattgaaaagattctgtttt

SEQ ID NO: 27815 - DNA, 1152 bp, Mus musculus
tatgtaactatacaactattaacatacaaaagcacagattatacacttacttgatttggtatagaagtaacaatacaactaaacttttaagtcatcaagctacaactcttttgctatgttgacgtttagacaagaaagtattttaccagggagttaataactcctggccctccttcaaatttttattttgacacacactcaccaaattttaatctggcttgaagtaggcagtctcctcattctccttcccagctgcgattacagatgtgaccagcatactcaactattagtcatcgttgaggaaatccacctctgttgactacagtgccctacacttgctaacacaaatgtgatgtctacattctttatcacagtgacaacctcactgttcacagaaatactaagaattgatatttcccttggcttattttaagatatcttttaacaggtgtaattaaatgaaacttggcatggtaatagagctagtggtggttcttaagatctggctttacatatatttattattattattattatagccatttttccacctcggattttatccactcgaccaggacaaaaatgtccacttattatacacgatgatagttcctctgacagagacagagaagatagcatcacttacaccactgtggactggcgagactttatgtgcaacacatggcatctggagcctactcttaggtaagactttggtgtgcacacctcagtatgttcaagggtaccaaagtggttgcttttccaactgatgtgaccaaatgcttgacaagaagctgaaggtgaaagagtattgtggctcacagtttaggagcaaatacactgtccatcttggtgtcacaatatgaggcagctgctcacagtgtatacacaatcagaacaagaaaatgacaggaagtatagccaggctctaacacctcagaacctgcccccgacctacacttggtcgaggaaagcctcacctcctaaagattccacaatccccacactcttcaacactgccgtcagctgggaaccaagtgttcagcgcagcccatgagagacatagtgtatgttcaaaccgcaacacccacttcaccccccacaggcttaaagccaccccataatgagaaatgcatttattcactgtcaaat

SEQ ID NO: 27816 - DNA, 1125 bp, Mus musculus
tctccctccctctcccccctctctccctctcccttttgcaacctccccagccctacctctattctctcgagtaattggctatagccacttttatttaaccaatagctttaaattggtgagtcaggtttacacaacaaaggccactgtatgtgaacactcactcatctgggagcaaccagatcatgggattcagaatttaacatttgcatacataacaccagaccagcccccaagacttatcagcacacataaattatttttaggaattattacaatgaatacaaggctttcagactcaagtattcaaatatatctgctaaagtattttatccagagtatattaagggagtgcagtaatgttcatgaatcatacaccttgatagtgaccctgatttctaattaccatttcagattaatttcttggactggaagaaagattgaccctgtaggtgttgattatattcttcaaaaattgggctttcaccatgccaggactactattcccaaatggcttcagagaggagtgatggacccactggacaaggtgctgtccgttctcatcaaaaaactcggaactgccctgcaggatgagaaggagaagaaaggaaaggacaaagaagaacactagaatagcaattccatctgtgaaacacttgactctgttaatttctattacactgcaatttttttcagcaaaatttaaatggtactttaaaataattctaaattttgtggccattattgaaagtttgtaagttaatctgtttattctagctctaccattctgtatacagtaaagtattgcatgaaaatgtaaattttgtagaaaactaaattaaaagatatacatctgctcattaaagtttatgattgttttatgtgcaatatggttgctgcatttaaagtattacagagtaactgtgaattttttttcttcttggccataactgttagaaaaatatcttgttgataatgtcattgggggtcttttttatgtagacttgtataaagatctatttgtatataatttgagtaattgtgatgattgtataccacaaaaagattgtttgtaactattgtaataaagtcacaataacggcttcagtccatagttgtttcatatct

SEQ ID NO: 27817 - DNA, 1218 bp, Mus musculus
atatcgtagagtgagttaaaaaacacagtatattgaaattaatgggtgtttaaagaagtatggagtttgtgattccatcctgtgtttcttttctgtggaacagtaggcagtggttttctgtctggcttcccccacaccaaagtgtgcacctccacctcatggaagactcaatgaacatggacatgagtcctcttaggcctcagaactacctttttgactgtaaactaaaggctgacaaagactaccactttaaagtggatagtgattcaaatgagcaccagttatcattaagaacggtcagtttaggagcaggggcaaaagattaattacacatcatagaggcagaagcaatgaactatgaaggcagtccaattaaagtaacactggaaactttgtacaaccaacagtttcccttgggggcttcgaaattacaccatctgtggtcttacggttgaagtgtggttcagggcctgtgcacattagtggacagcatctagtagctttagagaaagatgcagagtctgaagatgaagatgaggaggacgtaaaactcttaggcatgtctggaaagcgatctgctcctggaggttgtaacaaggttccacagaaaaaagtaaaacttaatgaagatgatgaggacgatgatgaggacgaagaggatgatgaagaagatgatgatgattttgatgaagaggaaactgaagaaaagatcctagtgaggaaatctgcatgagataccccagccaaaaaatgcatgaaaatcaaaccaaaatggaaaagacttaaaaccgttaatatcaatatcaaagggtcaagagtccttcaaaaaacaggaagaaaaaactcttaaaacaccaaaaggacctagttctatagaagatattaaggcaaaaatgcaagcaagtatagaaaagggtggttctcttcccaaagtggaagccaagttcattaattatctgaagaattgttttcagatggctgacaaatctctggcagtggaggaaatctctttaagaaaagagtttaaacagtttgaaatattctgtcttacttcatttctgtaatagttgatatctggctgtcctttttataatttgaagtgagaactctccctactgtgtttggtaaatgctgtccaggttcagttgccaagaatgtgttgtctaaagttcctgtttagttttcaaggatggaactccaccgttcacttggttttaa

SEQ ID NO: 27818 - DNA, 1159 bp, Mus musculus
aaatacaataaattgatggtggtggtggtggtggaggaggaggaagtcctcaggctgctgtttggcaacaacagagttgtgtcccattttctgccctgctgacagtccatatgtccggaagcatatctgaggcttcagtattacagaacaccttcttccactccagttctcttccttcaccactcactctcttagattagccagcatcagtgactctaccccctagcctttgctaccaaatccagatgctgttgcagttgtgagattggaactgtctttcaggctagactttgctgagtgactccttgttactagcaacatggttccatttcgagtgtaaatacaaagacaggatgactctacacctcagagagcgtaaaacaccaccatgtgccagaaccacccacccagcaggcacagactgataaataaaaattattttgagaagtagaaaaattgcgactctataaacttattaagtcaataagtgttggggccggcctgtggctctcatgtctgggttcgagcctgggaggcagcctggagctgaaagagaagagggaatctaggtgggtcgagaaataatggaaccaagacgtgctagtctgctcaaggttcaaatgtttaatggcagacacgctttataaaggaggggggaggcctattcccaccaattcacccttggcgcccagctgcaggtgaccacgtgcaggatagggtgtagtctccagaatagctaggccaactcccagctggtagcagcgacagtggctgaacaatagagtaatctagggaggcaggctccaccctaggtaatctccttagtggcagcaaagttgaggtctggttcagccagcttcaggctgggtggaggtcacaaataagggacacatgacacatggatgtattacaatcttatcagcaaaaccatgcctgagaatttaagaagtatccctccagaaggaagtgatacaacacccttgtctggacctcggaaagaggaaggcacttggccctgcgatggcagtttccccatagatatgtcatcaaacgactcattgtgtcaaggaacagcaggcagagagctcttgttggctctgtacctcctgttgatgtggcgtcctcaagttgctctccatctgaacccagtacttcagtt

SEQ ID NO: 27819 - DNA, 1129 bp, Mus musculus
gatattgaataatctgctttggttatgtggagcctctcccagctgcataagctctcttccaccttcaatgacctccaaaagagtactattcggtgggatagaaatatgtctcagcatatatacactctggcatataacacatacaataaaacgcaataaatatttttaaagtattgaccagcctatagcttcatttgctgtttctcagaattgtaacatgagcatttattagttccataaactcataaaagtaaatactgtggtactgcttaactagtaagcctgattacctgtgcatgtgcactgcagtttgatttgatcaaacttttatttgtctggacataatgaaataattttgccaagtttcaggtaaaagataaccttaatctgaaattagcaatccattaagtgacctagaatgagcattttagcactgtattgagtgtgagagaacctgaatggacaagacacaaagaacagaggcttccccaaacatgaaggttgtgctcgcaaaggtgttacctatgaggtgaaaagaactgacacataccaagtgtgtgtgtgtgtaagttttaagttttatgctttaccaggaagctgccaccaagcagataaaggaacccctaatttacatgaagacatctggccagccagctacatatgccaccagtctaacagtaacatacatctgataacaatacacaactacatttccccaaagccatacaacaggcagactatatctaagttcacttctgagtctgacatactttttctgccttatcttctactccttgcatataattctttcttccatttgtgttcaacttgactgtaggccacactatactttcatgcatctctgccttctatctgacagaatcatttgtacttaaggaaaccctagagactggcagtaggacttagatcaaatatatgcactgtccctttctttcccagcttctgagtcctgacttctctagtcctgtagcgctcactgtgcacatcacaggatctgtccatatatcaatacagaatttagtttctatattcctttctctctaaactgcaaatattattcactgtacttgggaaatgaaataaatatattaaaacctcatagatgctc

SEQ ID NO: 27820 - DNA, 1171 bp, Mus musculus
tgatatcaccgggggcgggtcccggcgtggaggtggaggtggcggcgacgctgaaatgctgcggagcccgcgcgcgagtgctcagcacgcaggggtttgcggcggccccgcagccagagctctgcgggctaaggagcggctgcgagcggcgtgcatgtgccgggagggccggccccaggctctgcactaggtaagagccttcccctcccgccgaggacctggcaagatcaggtgagaatggtgctttattttattttattttcgaggagctggacgttttcggagctggctctagctctgtgcccggcgctttgcggtcggccctgcagcgagttccgtagccaggcagcgagttacgcgtgtgcgaacgcgggctggcaccgccgcgcacccgcgtgtctgtgcgcattgttggggaccgacccgccgggcgctcgtgccagacctgacttttcccgtccctgcgtgcgggcttgcctcgcgcagacgcgtctctcggacgcgctttggactgcggggcattccgtgggggcaaaacgtgcacggccgtgtgtgtccggggctcgtggctgtccatctcggcgagcaggacagcgtcccgggctggcaagggactcacgtgtttctgtctctgctcgtctgcagccggcgtggcgactgcggggacgcggacctgcggggacccgagagcccgggacgacgccgggccgcgcgcctgacgaccgggacgggacggtgctgtggagcgggcgccgcgcgcacccggcggatgtccccgagccgccctcggccgccgccaaccgcggagaagcgcccctgcccgggggccgccgaggccgcagcgcgggccatgcgcgcccggccgccccgccgcgcttgatgcggcgcgcgctccgcccgctcggcgcccccggccggcgccgcggaggccgaggtgagtgcgggcggcaggtgcgggccggggcgggccgggcggtcctggcggtcctcgcgcagcccgtgccaagcgcgcggcacccgatggcgctggggacccagcgcccgcctgtgctcggagcgcagtgccgcgggacgcggggagagggcgctgcctcctcccgcccgcgagctgttttcattcataactttatccggccggacctgccgcggctcggtgcccctgaggtctcgg

SEQ ID NO: 27821 - DNA, 1150 bp, Mus musculus
agcagaagaggaggaatgggataatgacgaaccccaattaccatctgcagagcaaccaggtgttcctgggcagggtctccgtccctcgaaccgtgcaggagcgagggcatcaggaggtgctggagggcttccccccctcggagacagagctgaacctcaaacaagccctgaagctccagattgagggctctgaccccagcttcaactacaagaaggaaacgcccttgtgagaggtaaggtgcacggcaaagcataaaggaaccaaactgttaactcctcttccttaaaatggcccctgcttggtgctctcaaggcccttcaggctcctctccctatgtattcatggagctcatcccagtggtgtgttcagtgtgagtcctccaaactccagcacctatccaaagcacttgcataacacaggatcgatagatccatatacagacgctcagatcaatgataggatcgctaacaggtagtagaaagtagataactgatagctatgctgatatgtagataactaatagacacagatgacagattggtaatagatgtgtagatacatggatgatgagaagatgataggtaatagagacagtgggtgacagatgatgtacagtagatgatacatatatgcatagatgtgtaatctattctttatctcctctcccttttcccccctcaaagtgttacactgagtgggatatgtttgtatttgatgctgtgttcatgtgcttggtacatggtccaaacctgtggcactctttcagtaaaactgtattggataagtagatgagtagatcaatatatcatttattaatcctaaattaagagttttatcctgtattatcattcccgtctatcaggagatttctgatgaaaaacagggttgttttctacatattccttgtttggttttgaagcactgagcggtacctagtggttagttgctacatgttaattctacgtttcacccagaaacaggtcatggatttaaattagtaatcaagttttattataataaataaaaagtcttgaaaaagtctagtagtgttggcatgtaatatacacaggtgttggaccatggtgaagggtgtggatttattaaatttacttacttacgtatttaggggcaagatatagatagcatata

SEQ ID NO: 27822 - DNA, 1143 bp, Mus musculus
ggtggatggcttgggcagcaccaagatcctgtttcaccacagctttgccgagtggctcttggatgtgaagcactgcacccagaaatacctgtgtaacgctgcagaaggacacaggatgctggccatgagctacacctgccaggcccggaacctgaccccgctggaagcacaagaatttgccttgcacttgattaattcaaacttgcagctggagccagccgaactggctctgtggatgatatggaatggtaccccagtcaaagactccctgtccaccttgatacccaaggagcaagaggtcctgcagctgctgatccgagctggtgctcatgtcaacagcgaagatgatcacacctcctgcattgtccggcaagccctggagagagaggactccattcggactttactggataacggagcctctgtcaatcagtgtgattccaatgggagaactctgctggccaatgccgcatacagtggcagtctggatgttgtgaatttgcttgtctccaggggagccgacttagagatcgaagacgcccatgggcacacgccactcactctagctgctagacaagggcacacaaaggtggttaactgtctaattgggtgtggagccaacatcaatcatacagatcaggacggttggacagccctgaggtctgctgcttggggcggccacaccgaggtggtgtcggccctgctttacgctggcgtaaaggtagactgtgcagatgcagacagccgaactgctctgcgtgcagcagcctggggtggccacgaggacattgtcctgaacctgctacaacatggtgccgaggtcaacaaagcggacaacgaagggaggactgcactcatagctgcagcatatatgggccacagagagatcgtagagcacctgctggaccatggcgcagaggtaaaccacgaggacgtggacggcaggacagccctctccgtggccgcgctctgtgtgcctgcaagcaaagggcacgcgtcagtcgtgagcctcctgattgatcgaggggctgaggtagatcactgtgacaaggatggcatgacccccctgctggtggccgcctacgaaggtcatgtggatgtggtggacctgctgctagaaggaggagcagatgtcgatcacac

SEQ ID NO: 27823 - DNA, 1235 bp, Mus musculus
tttcattatgaaaaaattggtctgtcattatgataaatatctctagaatctttcctactgcaggcttctagactcttccctttacctctgaactagaactgatatccacatcacaggaacattcatgctatctgctgactttttacaggaaaaaaaatttatacccagtatctctaaactcttattagtagcaatgattctataactgtaggcatttctttggccttaatccaagtaagagtcttgtagcaatactgaaataatattcagtctgtgttcaggattatggtttgcttcagtaggcactacattcattgaaaatatggatttaaaatcccatctatttctgtatcattgacttttcttataatcatataaattttatcttattcaactaaaatcaatattctgagacactcctatgcagtagtcccataattctcttgttgaagcataaaacataccacatacacaattctcttgttgaagcatagaaaataccacatttacaatggttaagaatttagggttcatctatggccataccaccctgaacgcgcccaatctcatctgatctaggaagataagcagggttgggcctggttagtacttggatgggaggccgcctgggaataccgggtgctgtaggctaaaaaaaagaaaagaaaaagaatttagggttcattcaaaaagatggctattcctaatgcctaatgtcaatgattgtaggaattatttgatcatggaacagggaaaaatatgaatttgtaagcagaagaacaaagttccactcagtgagttctgtcaacaactgtctaaattatgacagttgtagacactggaagtctcatgcagtaacaatgtatcttcagaaataattaacttcttaattaactgaaaggatgtaggatgctctcaatcttctctgcaaatactagatagttagaagataaaataaattgtagttatagttttataggatatagcatgagacagaaatataactaaaacacatctgtttgtttgtttgtttgtttgtttttgaatcagaggctcatctagtaggcaaggctcacatggaattcactcctggccctgacttattttaaactcaggacaatctgcccaccacaacatcccaagtgccacaattgaaaacatgggctgtcatgcctggcttaaaatctaatattgagaaaatatctgaaaagtaataatattaattttaaaacaga

SEQ ID NO: 27824 - DNA, 1144 bp, Mus musculus
aataaacatcacagcacagatacatttatttatacactcaagaattgcatgtatttcttcatgtagcaagttactaaatgcactgtcagcatcctaagatgtaccattacacataggcttcaaatctcaacccctaagcacctatttactttatattaatggtaaaaagggataatttgaaaagcaagactaaattaactaaaataacttatgataaatattaaaaacaaacaaccacatctcccatccaaaccccacagaagccaacttccatcgtcaagggtgagctggatcccaggaagtgccgtccagcatgctcatagaacttttgattaattgaaaaagtatagaatgttctgcatgaataaaactgaatttagactcattatgtgtaatgttgcttttggaaagaagaaggtctgtgtttcttgaggtgtgaattttaactggtggtattggtcatttggcatggtggagcagcagcagcaacagcagcagcagcagcaactgagaaacttgcaagacttcctgttggtctgcaatcggatgacagaactgtgcttccagtgctgtgtgcccagcctgtgccaccgaactctggatgctgaggaggaggcctgcctgcacagctgtgctgggaaactcatccattctaatcactgcctcttggccgcttacgtgcatctcatgctagccctggtccattgccacttttcggactctgagtcgccctcagttgcaccaggtgttcctgcagaacagatcagagccatcagggtcccagccatccctggccccaggagagaaggtgcttggatgggctcttctatggaccttgggcttatctaaatgtgtgcagagagattgagcttgaaagatgggtgctgttgctcctttccttggagccaataaacccatttttatagtctggttaatttgctgggcaagaaaaaaaatagaatgtaaatatcaaagcgaagaacattggtgtttactcccagtgagggggatggttgcaataaattccattacctttcatgttcctttgcaaaagagcgcagatgcaatattgacaggtcacacttccaggttttctagagctgcaggcaacctgctactgcacaggccacacagatgcccagag

SEQ ID NO: 27825 - DNA, 1172 bp, Mus musculus
gcacatacacacacacacacaaatctctaaaaaggaaaaaaaaataaaccaaacatgatgacacatgtctaatccaaccactgtagcacgagagacagtaagcttaggaccagctccagccagccagggatatatagtgagagcccatcttggaaaaaaagaaacatgaatagagagagaacggcgcttgctctctgcctagggtgaaagcttctaatctatcataggagataatgtttaaatcaagagttgaataagaatagggattttctgcaggttaacaggaagagtagcattgtagactcttagttcctaagtcagccaacatcatcatcaagtatttatgtgaaaccattttatttttctagtttctgggattaaacccagggctccgtgcacgctaggcaagcactctgccgctaagctacattcccagttccaaaccttgtacagtaacaccatcgataccacttaatactcataactgatgctaatttgtagaaaaagaaagcgctaagtgatggagagcattcggagcctacaaattcagtgtcttctctgagccctgtgaaagaacatggtgtgctgtttgaatgctcacctgaaaactggactgatcagaaaaagactccaccagtcatgtcatactgggtagtagggtaagtgtgtggaaagtgcatgaatgagaacatagggtcagaattgggggcgggggaggagcagaggtgtcccaaaacctcagcctgggggtgtcatcaagataaaaatctagagttttgattttgtaattgtgttttccccccaatacctcccttgtgtctcttccagtggagataagagaagatgattgggagagggatttaatcagagatcatcgacgttgtgaaagaaagacatggggccgggagggggaggaaggaaagtaagaggacagccccccattccttactctttcccattgcatcttcttttatcttctcctttctttccgtctccccttttcttcctcacttacacaactccttcaagacccttctgtccgtgtcactctgtccactgtgggccagcctcattgccactgggcagctgttcctgcgatccttctgtggatggtaccccgcttttacatccatcaacactgacatatcttcccgtaaagagcttctctctcc

SEQ ID NO: 27826 - DNA, 1105 bp, Mus musculus
tagtttcttagcaaatcaaaagcctgtgcactgatttaagtattttagtagatacctcactacagaggcagagggagaggatggcagttaaagttaatgtatatttatttgattctctttattgtttatttggattaggatacacatctgcaatcatctgtaaactccccctgctttctttctggttcacatacatttatgtcagctctatcgaatcatattaaaggcactgaagtgggggctggatcaatggctcagaggtcaggaacaagtacctcattggcagagacctgagttcagctcccagcacccacattaggtagctcaaaccccctgtaactccagggactcctttggcttttgccaggtgcccacacacacaattagaaaataaaaatcctttttaaaacactgggggtcggggtggtggtaaggaacaagctaaagctattgtatgtaactttttctataaaatactaatttctgtcttacaaatcagcatcaatctgcactgggtttttccaaaggagaggggttgctttccccgactgtggctaatgtgagcttcagcggtacagaaagctgacaagacagattttctttggctgtgagaatttggtgtgttgaaaagtatagtaaatgctaaatttattattgccatctacccaggtggacatcccagaggctcaatatccccctacattttacagtcctgggtaatgtctctttcaggggttatatatgttggaaggcaagctatctatcttagtcagggtttctattcctgcacaaacatcatggccaagaagcaagttggggaggaaagggtttatttggcttacacttccatactgctgttcatcaccaaggaagtcaagactggaactcaagcaggtcaggaagcaggagctgatgcagaggccatggagggatgttctttactggcttgcctcacctggcttgctcagcctgctttcttatagaaccaagactaccagccctgagatggtcccacccacaaggggcctttcccccttgatcactaattgagaaaatgcctgacagttgtatctcatggaggcatttcctcaactgaagctccttc

SEQ ID NO: 27827 - DNA, 1179 bp, Mus musculus
taacaaactagtactggacttacagtactgccaaatctttgttaagtttcatgatgtgttagtacactgttctattgctgtaaagagacaccatgacaaagacaactcatataaaaggaagtgttgagttgggggcttgcttatagtttcagagttgagtttatttgcatggtgtcaggcaggcaggatggtgccggagaagtagctgagagatacatcctgatctacaggcgtgagagacacagagagagatagacactgggccttatatgctcttttaaaacttcaaggtccacccccagtaatgcacttccttcaaaagaccccacctcctaatccttgtaatcttcctcaaaccagttctgggctctagtgactagacattcaaatatatgagcctatgggaaccattctcattcaaaccactaaacatagccaaattcttagttattttagacagtaaaggggcttctagaatgttaagaatgttgaaaatcaaactgcttcaaaggaaagtaaaaaaaaaaaaaaaaaaaaaaaagaaaaactgtggaagtagccagccttgtacgactgcaaaagcagcctcgctgactggattttttttttttttaaagatttatttatatgagtacactgtggctgtctcagacacaccagaagagggcatcagatcccattacagatggttgtgagccaccatgtggttgctttaagatttatgtatatgagtacactgtggctgtctcagacacaccagaagagggcatcagatcccattacagatggttgtgagccaccatgtggttgctgggaattgaactcaggacctttggataagaaaccagtgttcttaactgctgagccatctctccagttagctaactggattcttaaggatgattctagcaaattataagaataaatagtaaaaagaggcagggacatatttgttaacaatatattgaaatgggagctttcaagtcaaggagccaaacatagtaactaaatcatgaccatctgatgcaagatgcagtcatatccatggtactgaaaataacatgatgcttgcttggagtatgatgctatgtcacccaagtcacaggatgattattaaaagaacacacacaccaaaaaacatacttatcctaaagagatggtgagatataacatgcctta

SEQ ID NO: 27828 - DNA, 1148 bp, Mus musculus
acatctcctctgattgctcacagattaaagccaatcagacagaaaaccaaaaaggctgtggtatgtcagttatttttctaagttactatttgatgttttctttagaataaaattcttgagtgtgatctttttgatttttatactattactggaatttgaggtactctaaacaacatgaaggggagaaattgaacattcatggaaaatagcatagtttctctctgattttaaagaggtagtatttgggttttgtttgtgtgtgttaagacagtttttagtaggcaatccaggactgccttggaagtgtcctttcctctgcctcatgaatgctgtgagcccaggtgtgtacgctagcctggtactccctctagcttcataagaatggcaagttgattctgagaagtttggaactcttaagttaatgatgctttttaatgtatttgattttgtgtctgttttacctgtatatatatatataggtactctattcctgtctggtagctggggaggccagaaaaggaattaaagttccttggcgttgcagtttcagtcagctaaaagccaccatgtggttctgggaactgcctctgtaagagcaataagagagatacctctctagaccctaaattatattttaaaaatagttagatgaaaatattttaaaatactattggctatatactgtattaaatattttatttatacttacagctagtgaattgacatttaatattagccctttgatttagcttcagtttctacatttaatttcatttctagtcaagagtaaactagaaaatacagcctttaaaaaaaaggagaagcaatttaaatttaagcacttctgtgtttagaatttaatgagcatatgtgaagaggaaataatttctttgtgattctgtcttgagcctacttgttctttgtttcccatgtcatccagtcttgcctttgtttggttcccattgtcttcagcggccttgttccccaccctaccttctgcttgctttttgctcattggttagcgtgtcacacttgattgcacactctcacctttatgccttctggctcacaagtgcacccagatacatgtctgctccagactgccaccctgaagcagcacttggatctgctagttctgctatggttaa

SEQ ID NO: 27829 - DNA, 1214 bp, Mus musculus
gctagattgaatgagtaagttgggaaattctggttattaaagcctatattgatggctgagacaagaagaccgtgagtccctacatgctacatattaagaatatgtctgaaagaacagactgaatttacatagattgtgtgtgcgtgttttgtttgtttttatgaggcagggtctcatgtaccctggctagtcttgaattcctgatgctcccgcctctacagcccaggcactgggattataggcatacatattttagaacttctaattaggtctttagcttacaaacactatattctcaccatggcaaatacaattattatttttcacagttatttgctcacataactttgtgtatgtggtgctgggagttgaacttagggcctcaaatatgctaggccaatgttctaccactctattcccagcccctaactaactttaaaagaataattttatgaaagtaactattagaaacccagtatgtaaggaatatgggaatgcatgtataaattgagttttgtcatgtaatttatttttctctctgggtgctgggaattgaaccagggcatcaaacatgccaggcaagcactctaccactgagctatctatccccagcttgtcttacaggcagacacaggttgttagctcatgaacagctttcatggtttattccctaaatcataggtgtgattattcttcaccctggctgagtctctgtcccctaatagttactgacaagctccactttctataggaagataaacacatttatcttctagagtccatccccctagtctgaaatcagcagtttactagagaagtctatttttttctaagtcagggtctcactatgtagctcagactatggtgctacagcagtgtctgatgctggttgctttcagtagggtattctatgtaacatcacaggaattcataactataataaactgtataacaatgtcacttaaattttttagttatagtaatgaaatcgtatatttacatttcatttcaaaatcatagtttctgttccacaggattggcgagcgtgctattctcctgggaggatttgtggttgtatgggtcggcttctttatcttgttaccctggggaaatcagtttcccaaaatacagtgggaaggtatggtgatttcaattctttagcaccagcccctgcattctttacaagtagcaagtgataccttgctctatcttta

SEQ ID NO: 27830 - DNA, 1148 bp, Mus musculus
agaggggcaagtatactgtggagaggtgagctaaaggctatttgcattttcttctgaaggagaatatgggtgtaatctgcccattcctgagaaagtaagtcatagagtgatttgcagtttgtttggcattggcaggttcaagactgaggcatgtttactactcacggtgcttattcagatctgtagcaggagaaagcaggaggactgggaaatgtgcagtttggggaataaaggagtgcaccaagcagagtgcacagagctttttataattaaggaaattagcaccattgtttactgaggcaggacaggtgccctgagagtaaaacctatggaagtctccaactagtgaaaataggaattgatttgaaagaagagaaactaaactgagactgtggctatgtaaacagacttttatgagaactatttcccggttttggaagaccacgtgtgttggaatgctggttagaggctagttaagctgcttacaggtaataggagccagcacagcaccccagtctggcagtagaacttggatgcttcatcagcatgtaaaatgctagttacagagtcatggaggcttacaccattgttagaagctctataaggtcaagttgcaaagtagtcttccaggctgttgggagttccagaattgtggaacacctaccaaggaaatctggaatagagtcatcccatgagagaggctgtatatatatactacacgtgacaaagttggaggggcggagctgttcatggtcactggatcccagatgatagtcccacaagccccagatgctgatcatggtatagtgctttccctcctaggtttagctgttgctttgatccagtcttcccttgctataccccattcctctccgttggaatggaaatgtttactctatatgcctttgtacattggaagtatgtaacttgttttctgaaattatagaaactcacggttaagaccttgcctggcatctcagagcctttgggcttttgagcaatgttgggacaattaaagactgtggtgacttttgaagtcagactgaatttattttgctttatgagcctatgggagtcagagatgaaatgtaatggtttaaaagtgatttgtttgacagtcaggttgacaaggagtgtacttgtgataa

SEQ ID NO: 27831 - DNA, 2396 bp, Mus musculus
actgcagctcgtacccctttcagagaatgtccagtctttgggtgtgatgctcctgctgtgagaaacacctcaccagcgtgaacaagataatctgcctgactgaagatctgaggatgaggcgttggttgtgctgccaggtgaatttgttgccgttggttgtaatgtctggtgggcttcatcatcctaaacaggagacaggaccttcttaacagcaagaaagtcaccgggtcgtttttccccctcccctgccccaccttcccctcctccccttctctctctgccttcctttctttcccccacccctcccatgtctctcttaaaacaaaaaagtatcaaagacaaccagataggtatttgctactcagtgtgcagatctctggaaagcaagggatactgtttcacaggctgtgttttatttgtgttaagggaagagccctgggcagggaagaggggttgcatattcatttaagaagttcaggctactgaaacattcaaacgtgaattcccaaacttttctttccgggctttgtcagagaagggggtaaatgtccttctaagaaagatctggaagttagaggaatatccagcggattgaagtcagcagttcccagcaacgataatttgaaaccagttttatttctttcccttccttccgctaggtcaaatcaatattaattgtgccttatttcacttccataaacttgaattactttttgggaaagcccctctgtgaattgagaagtcactacaagcagcattgagcctgaggctgatgtcattctgtgtgtagaatggaagaggagtactcagtgttaactgccatatgttagaacacaaacatagctagcattgtgatggccaaatgcatcccctgggctcttttcttttccaagaaaaattgaaaaaccaactactcttccccaacagctgcctaattttaggagtctgaccctcactcgtcactggtgtgggtagcagggccgtggtatgaatgtctgtgtgagtgagtctggatgtctgtgagagcaccttgggggaaacttcctgcgatgctgtaaatacgagtaccgttttaataaagcatgtacaataaaccaaataagctcgagtcggactctaaatacagagccgtgagccagtgtgtcatgtactaatactgcatttgattcacgatgagggggaaaccctcttagaaatgaaaatcaggccctgactagccaagctgtccgtgtcccatgctcagtgtaacttccaaggcaggtccacctctgtgggtggttcaggtaagaagggatattacagtggacagtgctctcaggcctcgctgccactcagtgtgctggaagcaccagccttccaaagtaggaactgacatagaaacacagtattgtacccatagccagtaaatcccgttcttgtcagttaaaaaagttctatttcaaagcctgcttagtttgggttttggcttcattatggtggactcttagtcagggacagattgctctcacagagaaaagccccaaggaggtggcattaaagacgtgttcctgacgggtgcagtgcaagcagaagctcgggttcgatgggaagcagagggcgagcggtgctacactcgtagcatgctggaatagcctccagaagtgtgcttgtcaccacatcctgtctgaagaactcaaggagactgaagagtgttgggaagtgcttcctttatatgtaaaacactttctaaaagcaaattgttatatattatctatcctctggtgtagtaaattggtgtatctgaaccattgagcctaataatctgcgattgcgagaagccgcaggtattcatgcagtaaaaaacaatgcattttggtttttaaaaggaagtggttttgtgttttggactttaaataaactgtgttcgtagataatttcttaattccagtcaaatgtctcattgttaggtagtgtggtacccagacctagagggtctgtaaccggcctgactgatgggggcggggggttaggacacgtttcttttcttttttttctttttcttatccttcagtgttagaattcagacacagggcttcacatattgctcaaccatttacatcccagctccaaagtatacattcttcctatccactgagcctaaatctgtttgtggttcctccaatcaaacgtacgattggacatgtttgagaaacactgcatccaccttttgaagttgtgtggtccatgtttgccatacaataaaagttgaacttataatttgtgtccaattctgtacatttttggtttttatatgtgtgtgtgtatatatatatatatatttaattatacttatatgtgtatgtgtgtaggtcagaagtaggtgtcagatcccatgttcctggttttactgcggctgt

SEQ ID NO: 27832 - DNA, 1152 bp, Mus musculus
ccattcctctgccaactcccccagccattccccagacacccagccctgcctccccaaaccctaccttcccagcccagcttctccagcccagtcatcccacacagccaggcttcccgaagcctctctagcccagtcatttctcagcatccccagcccagccatctctgaacccagcttccccagtcctgcctcagaagggcgcttgcaaactcccacagaggacagtgccactccccgccccgccccccctcccccaccccttgctacgacccgtgctactcccgacagttgtctgagaagctgtgccccacccccatccctgttttgttctccttagcctgggtgcctgaactagtgggttggggagaactgtggatggggtgggtgtgagacagacacaagatctgactcttcccattcgcttgggaagtgtctctggaaagtgaagagtaacttaggtgcagagctggagagctgtgcctaagagaattgatcagacccaccccaaaatagccatcattgtctttgatgactattgacttgagtgtcccggagacacacagctcttgtatggggctcaggaaagtttcataagctaggcagactccaatcacactaggaagcccacagacaggactgggacgtggctcaaccggtagagtacatgccacacatgtgcaggcctcgaggatgatctccagcaccacatacgccaggcatggtggtacatgccagtaatcccccactagaatggcagaggcaggaagttcagaagttcaaggtcaaggtcagcctggtctacacagagaggagactttgtcttaaaaatgaaattcccacacacccaagaagccccttgccccttcttggtcatcctgggagaaaacatcttccctccttcattcacatgaggaatcccaattaaatatagtaaacaaaggaaacctcctacattgtaattttcttcccgctcctcttgttttatttgctctctggatttattgctcaagaatggcctccctttagcacccttccctattaaccagcgagataaaagccacggagcgaggtgggaactccttcagttctcattgccagttgtggggcggagcaggctgagtttacagcgggccgcagacatctgttgagccc

SEQ ID NO: 27833 - DNA, 1154 bp, Mus musculus
cccaacttccagtgagaacatctgaccccatcaaatctcaccaggtagtccagactacttcagcaggttattaactccagattacagccctccctaaagaccttagggcatggagagaaaattacccatcgctgagccctagggagcaacaaaagagaccacttgaaagtatactactttgacatagcgttctgacttattgctgcagtaataatggttatcatgattagatttgcactcatttatacttttcatatttatactgatgtaaaatgggccttcttttagcagattaactaatatcaacacagaaacagttacatatttttatttacttattttattttgagggagaggagacactgatccacccgcagtcctccctgttgctcttcctgctcaccgatctctccagatctgttttcctaatcattctaaagccctcccatggattttgtgctttttttttatttttcctaactttctttcttttggcagggtctatgttggctttgaacttgtaatcctcctgttccagcctccccagtatgagattacaggtatgtccatcatatgtgctgtctctgtctctgtctctgtttctctctgtatgcatgtttatatatgtgtggataaattttttttaattctttgacaaattcatacatgaaaataatacattttggtaactattaccctccctacagatatgggcttgtttacaggtgcgggcaaatgtggagggcacaggccaaccctgagtgctagtcttctagtgctttctatcttgttctttgagatagcctgtctcatgctggacctaatgaaggagccctggctgtccagccaacaaaccacagggtttcacctgtcatcacctgctcagccctggggttacaaacatgtgccaccatgcttgactttttaaatgggttatgaagcttgaccaacttcagtatctctctagtcacagtgcttaagactctaggtctacagagatgtataaggttaggtgaacacaatcaccacccaataataggaatctgatctggaataccattacgattaggcccggggatcaggatgtgtaacatattgttttaaaaaacgaaacctgaagcttgacttgagcaagcaagcctgcgcgtcttctg

SEQ ID NO: 27834 - DNA, 1149 bp, Mus musculus
cccaatattggtttatttctctaacctacggggaggatgtctttctgacatgacttgtttgtttggttggttggttggttggttggtttttttttttctttttggtttttcgagacagggtttctctgtatagccctggttgtcctggaactcactttgtagaccaggctggccttgaactcagaaatccgcctgcctctgcctccagagtgctggtattaaaggcgtgcaccaccacgcccggctctgacgtgacttttgctgggatcttggagcagcatgcctcccctggatctggtggttgctcaaagttgctcatcagatctcagttgccaatctgtgccagtcacaacctgggttcttcagcagattcccactgaacagggcgctttagatggaacagacaagggagagtggcctggctctggttaaagattcccagaattacaattttggttagattttccctaaactgcctttgaactaagttcagttctgagaatgcattctagagaccttaaggatgctgggagccctaaaatccatccacctactatagagtctcaagcctggaagtcaatggaacacctagggtgtatcctgcctctggaattctcaagaagctccccatactcaaggcagctttggtgtcacccagaactcacagggaagcaagacaataaagtactgagagtgtggtacccaggactagggatttatctcagtggtacagggtttgtgtatcatgtccaaagctctgagtttgataccagcaagtaggtactatgttgaaagacattaacaaaaaaaaatcatcatagtcacattgagatgcctctttgttttacgttctttggaagactctagaaggaaatctctcaacaatggcttccacaataggcagggatgcttgagaagtgccaggttgcttaacactcaggcttttggactatgtatcaaagtatttgtgtaaaatgtaaccatgagtcattcactaaaagatatctataaacattttcattttcttataaataattactagaggagaaagagagcaactagaagaaaggacggcagcaccctaagtgcttgtacctcatccaaagctcttcataaaggctccatgcaagaagcaggagcatgatttta

SEQ ID NO: 27835 - DNA, 1179 bp, Mus musculus
ggatctggggaggcagctggggctcagcaaagtgctcacaagccgggggacctaagttcgatccccagagcccatataatgaaaagcaggatgtggtggcatcgcacttgttagccaagcaactggggaggcagacaggcagtccctgggggttgctggacagccagccagccctagcctaagtggtgagttccagaccagggagaggccttgtctcaaaaaacagggtgggtactcctgaggacactggaggttgtcttatgttttccacatccgtgagcgtgcactctcgcatacacacacacacacacacgcacacacacactcacaaagggaaaggaaaaatatcagaaaacaaatgagacaactaaaaacttaaaattcacaaagctgagaggtggggggaaaggaagcttttctttctctgtgattcctcccccttctgaaacagtgacaagccagggccatcttgctggcatttcttctctgccctgttcccaccttttctgacacatatttccattcaactaggctacaagtcacccttataggccttgccaaatagtatttcgcaagtttgtgaaagactggtttctcctggactggagtccccaggctgccctgtaggctatagagcattcctctgtccccacacagccatggcaacagtgggcaagttacaactcaactcccaggttggagttaaggactcaggttacttcctcctgtggcccagttggccccgctttcttctgtggcagcaaactaaactgctaacctagccagctgtcaaagctgcccagtcaaaagatgtcccaactcccaatataactccagctccttaggaggcacacctcaagcatgacagactccccagcctctcaggggcgagtcaaggtcatccttggccaccaaaggctcttagtggaggctacatttcagtagtctgcacaaacttgctgagttcagaaagctttcacatacagatgacagttcgtctctttccctcattgctctcactagactcctgctatgttctgtttctcccgagccttctgtgttctctctccttttgatttggagctgatatttcctttctcatggtggcttttatgtattaaaacgattatggaatttaaaaaacatgtacaagtgtcataaaagtgtaaatttcccaat

SEQ ID NO: 27836 - DNA, 1936 bp, Mus musculus
ttctctccatggcctctgcttctgctcctgccctgtttgagttcttgtcctgacttcctttgatggacaaacagtattttggtcttgtaaaccaaataaatcctgtcctcaccaacttgttttttatttatttttatttttgggcgcgcgcgcgcgcggaggggggggggttcatggagttttgtcgcagcagtagtaaccctaagtgagctcagtcttattatctgtctgcgggtgacccactggtctttcaaaaagtgtgggtgtacgcaaaatggagagaggagaacttctggagccgttctgctccacgtcgtcgtgttcaaaagtatccggaagcagtcggtggccagccagccaggccaggcgccagccgggcgggggtaaaggcaggctgggaggggcgtcagagcctgggggtgggcgggtgggtgctgtggcgtgtggaaaggtcggctcctcccaccgtgacgtgatgcccaagaccagactaaagagcctgcccggaagatcacctgctctttgggttctagaaggcagaagacatccttgtccgctcgcctgctacctctgaggaaactcggggctctactcaaagtgctgaggtaggtggtccaccttggagataggtctcggggagaagggggacactggtgagggaagggcagaggcttccaggattagttgaggtaggggggataatatcctggaaccagtgagcgtaaatctcaagccggtccgccctggtctgggctttccttcccgccctttttttgccttcctttcccttggcgcccaccattttgagaccagatctttggtagtccaagctggagggaaaaagcattgacgttgggatggattggagcttcggtggccctgagcactgggattgcaggcgtgagtttacgggactggtctgcgggactggtctgcgccatgcgatggctttggggcctgttaggcaagcaccctaccaagtgggctacacccctgtcccatgcttctctagctctgcttccactccagattcagccatcttggaactaccccaaaagactccgtcaggaaagccataacgcttagcggctcattctgctgaatctagccctggattcttaattctttcaaattatttcattcctccgcttcccacaacctgttaatctctgcggtaacttcgaacctaggacctgaagcccagctcttgatccaatacccttcctctcccgtcctgtgtattttctgtgtatcttggatgtctagaggtctaggttggagtcatgtggggacctttctgcagaagaatggaggcctgtaaagagcctggtttatccatctcacttgtccttagcttagaagtcagtatctttcaaacacgggaaagaatttgaattctggaagttctgggcgtcttccctcaagatggctcaggaaggcaagcacgtgcgtgatggagctcccctgcccccctccctcgctcccccctccctcgctccccctcccctcccccctccctcgctccccctcccctcccccctccctcccccctccctccctcttcctcctccctctctctctccctcactttcccctcccccttcacctcccgcctctctcttaaacacacacacacacacacacacacacacacacacacacacacaccaccccagaaaaaagtgagtgaattgtgtggccgtcataccaagacttgggatccttcgcttcacaaacattcaagtaagtggtggacctagctatcctcaaagcttttatctcctaactcctagttagttcttcttcaggagaaagaaaatctgtattgtttttctcatttgctaaggaagtaggctcataccattgaagtataatgtggaagaaaaggagaaagtggagctctctggtaacggcctaagagagctcttaggggtga

SEQ ID NO: 27837 - DNA, 1151 bp, Mus musculus
aggtgtgtcctctctctgtgcccctggggagcagggatggccctcaaaggctggcagagagtaaagctgtcagcagttggtgcttcaagcacagggatggcagggaagagagccattacaagcggaagagggtcacaggtgtgtgtcagtcgtggacgttatggacgtaagtggtcagagtgtagactgcttgttagatggaccagagttacaggtgagagtcctttctgggaagaatgaatgggtggatcttaggactgtggctgcccattctgtgaatgaagctgtagctcacagggtgtctatctgaagggggcttttgattccgtgtggacgcctggtaattacagggcattcctttactgcatgtgtggctgtgcatgtgtgccttaggagacagggtctctcactgactggtctgggccttactggttaggttagtctggtctaccttccagggagtcctatgggtccttctgcctctacctgctttctgggaaccctgcctttttatgtgggctgtgggtgtggacatcaggtcctcacacgaggttacaagcactttaccaaccaaaccatctctacagtcagtctccttccagtgatcttagaaaatcagttggtaaacaaaaaagcccacaaactttttaattgagtgagtttctctggaggaacatataaaatattgcacttaaagtccaggagcctgaattcctgaatgaatcctgtgggtctgttccaaaaggggaaacttactatccgttgtcaacgattcaggaacagaggtatataaacatcagtgtgtgtgtgtgtgtgtgtgtgtgtgtgtgtgtgtgtggtttgtgtcacattaaaagagtgagaagcaccccagcagcattagatatggagttagtaaactgttgtatttttgaaaggtctatttttaattatgtgtctgggttggtatgagcacgggaatgtcagtaccacagaggctggacagagttacagaacatagtggggggtgcgggggggggcgcgcagtgggttcaggtagctgagctctggtgctgtgcaagagctaccttaccacagcgcttctctctagcccctcgtgctgctctttaaaaagggcagtacattgtgagaggacctcgacaagaggaggg

SEQ ID NO: 27838 - DNA, 1157 bp, Mus musculus
ctgccccatgtgctagcacttcaggagattggccgcttctttagcagttagtttagaagatagtgacctctaccgggtggttctagattctgccttgaggttaattggctaatgaagttttgttttaaaacatgggctcgaaagagagctctccgtagtggcttgtcattccctgaaggatttccaagagcctgtgttcagcagcccttggtgaattgagaggtcttggagaggggagcggttgtgttttgtgcaacagttatgttgagtcgatacaatcactgcaccctctgcttgtgtcggctgaaggagctggagcccacttcagtcctgggcgaggggaaggagtgtcgggtggagtgaagggtttctgtaacagggcactcttactctgttgataccgtgaccttgttatgggcagctccatggtgcccttgcagctgccagtgctctgaaatgaatgcctgtgccactgtccctttctcgtctccccaggtgtttaggaccgacctgatcactgccatgaagttgcatgactcctaccagctgaacccggatgactactacgtgctggctgatccctggagacaggagtgggagaaaggggtccaggtgcctgtgagcccagggaccatcccacagcctgtggccaggtaggcaccctggatagacgcgtgcttctctgctctcctccctgcaggcatagaagctgagagttagcgctgtagtaacatgaggcctcacaagaggcagaaatgtagaaactgttcaggcgctgagggcggtgagtcagagggcagtggcctctgaatttagcacattatcgcagggggtgagccctcttactggagaagagaaggtccaagatgtttttgggaatgaccgactaggcgaagtctgatgttactgtctgtttctctctgcattctatgtcacttcactgagtggcttagtgggagccgtggtggccttggtgcttcgggcagtggctgattgtattttaggagctgacagtgtccgatgaggaatttgagctgtggacaggctctttgcagacgctggtgtttcctcttgatctcctgccgtgtcgctcacctctcccaacatgtcctcgatcttcctttgggacaggctgtgtcgagttggtaccttttttc

SEQ ID NO: 27839 - DNA, 1219 bp, Mus musculus
atcttttcttttaaaataaatttatttatttatttattttgttttttgacacagggcttctctgtatcgccctggctgtcctggaactcactctgtagaccaggctggcctcgaactcagaaatctgcctgcctccgcctcccaagtgcgggattaaaggcatgcaccaccggtggccggcttaagtttatttgttgtagtttgggagcagactctgttggagatgtggtagggtgttgtgctgggaaggagatggctgtggaaggctgcagcatctgcttccattctgggtactttgaagatttctagctgaggtgttgctctcatttggtttcaaattcttagactatatgaacatagggatggtctggcttgggggttggaggaggaagttgcccctgacagtttcttctacaggacagaaagggtaatctggctgtttgttttcttattaaccagggttgtgtctgaagagaagtctctcatgttcatcaggcccaagaagtacatcgcgtcgtccggctctgagcccccagcgttaggctacgtcgatatccggactctggcagacagtgtgtgtcggtatgacctcaatgatatggatgctgcgtggctggaagtaaccaatgaagaatttaaggagatgggtgagactgttacttcattaactcacattggagagagggctggttagtccgcagtgactcatatagagtccctgagaggttggagctcactgtcacagccacctatgtcaccagagtcccagctctttggagaccagattgcttgtgtggctttggcacttgcaatgagacatacagtccacttggagctcctagcgcagtggtggactgcggggcggaagcctgacttgtttctgacttgaattcctgtccccgtctgcttctacccttacttaccatacaggaactgcagcccagggagcaggaggactgggccagtgccctgctcctctttactgctgtgatgccaaagtcccatttttactgcctgcagcctgctgtttctcagacggagcctacaaagtcagcttcaaaccctcttgtttttacctctttaactctttcctggctttctgagtgaggtgtgaccctggctgagagcccagacttggatagtttctctgctgggttggaccttaagacctcagttacccgcatttcatggtgtggaggctgaggtggtctccttatgt

SEQ ID NO: 27840 - DNA, 1242 bp, Mus musculus
tccttgtgtttgccgctcgtggatctaaatttatgcatttcagtttggtgaattcaaagtggggagggataagtcagttaaaaacgttaggatgtttgctgtgaaatctgcttcagggaactgtttaaagtagcaagaaagaaaagttaaaaccaaaacaaaacccaaacagcaaaacccaagcagcataatatgtagtcctgttctctgagtcagatcagtgtcggcaagagtgtgaaggggcgtttaacagggcatgcatttaatatcctaggatgctgcggaagttgttttgagttttgcttctctctgttgtgtcttccataaggaatggaggcgttatctgtggactggcctcagagtcacagagtagcattttctctggtgctcagttacctttatttatgtttatttgggagtttaaacacgccagtgtcttcgctataattctcactgcgcacttactcaggggagatctgcggtgttttcctgcagggatgccggagctggacgagtacaccatggaaagggtcttggaggaattcgaacagcgatgctatgacaatatgaatcatgccatagagacagaagagggcttggggattgaatacgacgaagacgttgtctgcgatgtctgccagtcacctgatggcgaggacggcaacgagatggtgttctgtgacaagtgtaacatctgtgtgcaccaggtgagtggggcagcagagcccagagagagctgggtgccgttctggtgctgagcctctcagccagcctgtactgcctggagtctagggtggttcttcctaatggagccgcatcccacagttgtgctttaggaaagtcttacctgactgtaatcccagggcatggctctctgcctttactccacgaaggcactgcgattcaactgggaacactggaaacaaacccgagcaaagggtgcttaaactctacgttagcttttaactgcggtgactaaaacaacagaagctgtctctggaactggagttttgttcttccttgtctcttcctagctcatggtggattcttgtcagtccttggtggttggcttgcccattagtcttcacgatgtcttccctgtgtgtctgtctagatagggttatcttctcacacagtcctggtcctgttggattaggtgcctgcctgcacagtgtggtctcagtttacatagttgtgtgtcacaactgtttctaaaggtcccgttttcaggtggtggtgcgg

SEQ ID NO: 27841 - DNA, 2573 bp, Mus musculus
tgatgggtacgcccctgatggggaaatgagtgactcagagagcgaggcatcagagaagaaatgtatccatgccagcagcaccatcagcaggaggacagatatcatcaggcgaagcatcttggcctcttgatgaaacagccggtgtggaagcacatggcttgttgccgtgtgctgaggagagctctgataataggggcaagcaaatacccattgtttctgagctacagacatacttccttgcaattcagattgaatttttttccagagtcatttataaatcattgtgagaagtttgtgttatttgcaacttgttgaggaaacagaagagtagactgtaaccataagacactaagattagaacctgaactaaacactataaaaaaaaaaccaacaaatgaagtaactttgcagagggccaggcttgaatagcaccatgtattattgccctctacattctccccaaagcacaaactcttgaatactcactcttacagaatcatagaattctgtgtggtgaacaagtcctatttctagaagccctcatgtaccatttatagcccacaaagcttattttctaggaatggtaaatgctgacggcatttggctcccaggctgtgtggtatgaggagctgaggttctgaagcttcacaacactgggatcttgcacatgtggcatccaggggaagagtttacacaacaggcattgctggaaggctgcagggacagagcagagctgctgcactgagatttggggcccgtgtagcaaggtcccgaagccctgagtgggctgtggacacaggacgggtggaggaaaagttgtccagaaacttctgtgagacagggcagctgaggcccaggtgttactagtccgcttgaccttcctctttcctaactgctggcctttggatccaaatgggatttccctggctactgccagtacttggccatctggcttccaataatacaatggttattcaagttcaagtgatgaacttctggtgactctcactctacagagtcaaccactagtgcatatttgggaaatccaggcttccaccatgagtggattccttaagcaaaaaggaaaacaaaaagcaaaataggttatattttaaaatatagaaaggcaataagttgcatcaaggttatacaggaaagaattcaaagtgtatccttgaataggtttctggagttggagttctaaactctgatttgtaacttggactttcgaattgcaaatggcaataactagtaagttatcagcaataataaatttagcattaaatttgagtataatgttctgtttttgcactcctcatatagtgcatatgtattcagacaagtggatagtgttaaagtcctgttattttctttggaattcaatgtagttgtgaatcaaaattaagagaagggaagtttcattagcaatgagatttagaattaagggcatttggaataagcccagtttcccctaaattacccttagtttattaatatcaatgttcagattcctgactcatttatacatctgtttccatgtggcagggacattctgatatttaatgagcaatgctttgagtttgtagaagctttcaagtcttccagatgattgtcaacaacagaaaaggcttattgaattccatcttgctatgcaagttttatcagatgatcaaatgacagatctgatgcatctcatcgtatgtatgacattttcaaactaagtcttaacttctcaagtacattgtagtagctaattcaggggaggggaaaggatgacccaggttttagattgactattttttgagctatggagctcctttgagactgctgtccagatcagctcgttgctactggtattcgaagattctcaggagtccaagttgtacttttgcttgtagcctaatttaaaaatgagatgttttgcatctgagcaaaaaccttttgctggatacaggaaaaggctggactctgatctagttatcttttgattacagcaacagctctgggtgagaatagaatttatagaggaataatctgtgaagccatagaaagaaaccctaaattaatctagtgagtatatggcctctcaccattttaggaggcaccagattcatttgcactattaggaatgctagttttgtgcaaaaataaatgccttacctgtttccccccacatttaggttgaaaagctttcaaatgttccaagttatgctgaaccaaaaacaaataaaacaaaatgaaaaaaaaaaaaaaaaataataataaaaaatttcccccacaaaaacataacaaaaaaaaaaaaagcccacacgtttaattactgctttgaaatgcaatggtatagagcacggtttctgacagtgtaatgatagctttgtaagttagttcatgtcatgctgggaactctgtatgaggcggccacaggcagcagcagcccacctacctacccacttgcattctattagtattgagcttttttgtttgtttgtttgttcttttgaatcttccttgtgcatcctgaccaagaaatatctttgattatgatcaatgtattatgtcaaaatgtaggctag

SEQ ID NO: 27842 - DNA, 1141 bp, Mus musculus
taccaccattcccaccaatcatacacagacttgcaccacctactctgacaaccagccaggtctactcattcaggtgtatgaaggagaaaggactatgaccaaggacaacaacctgcttggaaagtttgacctcacgggtatccctccagcaacccgtggggttcctcagattgaggttacttttgacatcaatgccaatggtatcctcaatgtttctgctgtatataagagcatgggaaaaggagatcaccatcaccaatgacaagggccgcttgagtaaggaagatattgagtgagtggtccaagaagctgagaagtacaaagctgaggatgagaagcagagagataaggtttcctccaagaactcactggagtcctatgccttcaacatgaaagcaactgtggaagatgagaaacttcaaggcaagatcaatgtgagggcaaacagaagattcttgacaagtgcaatgaaatcatcagctggctggataagaaccagactgcagagaaggaagaatttgagcatcagcagaaagaactggggaaagtctgcaaccctatcattatcaagctgtaccagagtgctggtggcacgcctgggggaatgcctgatggcttccctggtggaggagctcccccatctggtggtgcttcttcaggccccaccattgaagaggtggattaagtcagtccaagaagaggttgtagcattgttccacaggaacccaaaacaaataacatggaatgataaaactacttaaattggcaccaaaaaagcaacaaaaattgtattttttatttatatttatttatttatttatttatttatttatactccatattttatcccccaacccctctaccttccagcttttcctcatcccataccttctccccaacccctgtctccacatggatgtccccatccccctccccacctgacctctaaactcagtggggcctccagtctcttgaaggttaggtgcatcatgtctaaatgaacacagactcagcagtcctctactgtatgtatgttgggggcctcatatcagctggtatatgctgcctgtttggtggtccagtgtttgagaaatctcgggggtccagattaaatgagactgctggtcctcctataggatca

SEQ ID NO: 27843 - DNA, 1149 bp, Mus musculus
tcgatcttcatgtaaacttggccatagatgttggcaaggcccgaggcttcttcaagaagggagatgtggtcattgtgctgaccgggtgacaccctggctctggattcaccaacaccatgcttgtagtgcctgtaccttgatggccctttggagcctctcttctagcccctgtcccttcccctcccctatcctttccattaggccagcaacgcttgtagtgctcactctgggccataatgtggcgctggtgggctgggacaccagggaaaattaatgcctctaaaacatgcaatagagaccagctatttttcatggccctaactgagccaggggtggaggaggaatgcagaattggaaaccctctgactttatcacagaagggcagcagcatctctggactttgcttctgtagaaagttccttcccagccctagcctggagtcaggagacagcaaagagtaggcgctgagggtgtggatcccagggtcccagtgtagatgacgtttggcccctgacctgctttcccaacagctttggcctcctcactccttgtgcactccacttctgtcactgcagacactccactctccaccttgtattctgcagagtctccaggcctgttgctatagtgcccacctgaatgtcagtaaacagaagctgaaggaaaaaaaaaaaaactaaaaacaaaaacaataatagtaagttaaatttagtattaattagtaaaatactaaacatacctacctactttacaatgtttcaaaattatgatcataggtatgcatgtttagagtttaatagcaaatatgtataatgattttttactgaaacattatttgtaattggaaaaataccctagtaatacatcttttttaaaaatttttatttatttccaggatacagaggatgatccacaccaaaaattccagaacttgcccaccatgacctgtcacacttcatcctgctctatcccaaacatcaaaaggaaggctgaaagaatgcaggtaaaccctgataacagacactctctagacacagtaaccaagcattcaggaatgtgcagaaaaaacaaacagcaccagacaggcataccctatagctaataaagtacatgtaaaataaaagggtaactttaaagcatagccatgaa

SEQ ID NO: 27844 - DNA, 1099 bp, Mus musculus
gaaggttatgtactaattcatttttctgtgtaagaaaattcttactaacaaatctaaatttaaataaagtcttctcatgttggagaatatttaaaaattctggcactggtaaactcagaagcagagccaagcaggtactgctcatcataggcgccttctggctcctttgatctctgattgtcagcaccagatccaaggcccatagtcttgaatttggaatctccatacttggagcacttcccttccttaatctattgtccacctctgggaagggacacctaccccacaccactgggaactgtagcaacatacagataggttttgttgtttttgaatctcaaagaaattgctatttaaaaataaaacaaaagttactctggaaatcgccttcagggcacttcaaacctttctttcaactgagaagaaaaaggtttcctaaagtagattttctttttcttgtcttgtttcaatgagatcttacacaaaataaacatggaaagagaaaaaatattaaaagctatgttttacttttgttagcttaaaaaatatcaaacacaactgggctctctctctctctctctctctctctctctctctctctctctctctctctctctctctccttctctctcctctctggtttctcctgtcaatttttctctaaaaatgtttccaaaaaagtgtacataaagttattctgcttctgaacattgaaaagtgaaatacttatattttatgtggtactttgacaattacatagtccatatgatttccttgatagttaaggaaaataaatatatcctaatccatactcagaggtgaagaagattatagtagcataaaattgaatttatttgattttacatagtgtgcttgtggctcagtaagcaggagtctcaccaattagaggatgcaggctttgctcctacaacaaagcatatacacacagtcttgaattattttatcttttgctcttcaacacaattagatgctgtatttggacatctaagttttcttatttttcctatagctttatttgttgtcttccaaacccctcactctttttttcatttttatctttatttctcacaaaaagtat

SEQ ID NO: 27845 - DNA, 1198 bp, Mus musculus
ttttgttaggatctggcagattgagcatagttatgataaataaccactactctttcattgtatggttttaatagcttctttttttttaattgtcaaatttttacctgtgtccattgcattaatatttcaacacttgtaaatttagtgtttcaagaacctaagctattttttctcttgagtatttatatccacagttttctatcacatcaaaaactattttaaaccttaccaatgttctcactttgtttacagtttgtaaagctgtcccaaagacagattttgaacacaactttttcagtatctcattgagatgacattttttattgtgatttgttctaaacactttaaaatgtctgtatatacacatgtagatgtacatgtgtgtggagtataaacatggagacaggtaggcaatccatgttgtcttctattaatgtgtatggctcatattatcaatatttttataaacaaaacttgtttatattttgtgtaaagagtacaataaaagttttagctatgtcttgcctctacaccattaagcagcacatgtttgggttagtactgatataaactgtatcagagctgatatatacactcaaattcattggcttgcagaatctctaccttgatgagtattttcatcatcagaagtaccagaagttgccaggactggagagtacaaaatgaaaacattttctgggagatttaatctgcaaaagtgtccagataattgaacaatgaaaacatctctcttttgtgcacaaataattggttaaatagtttaccatatgcatagatatattgttatatcagcttaataatgcagtatcctaataccttagtagaaattgtatattcctagtatttagcataaaatttgacagttcattctctttaatttttaaatattattcattctaaatttgtgtgtatgtttgtgcacatgtgtgaatttgtgcatgcatctgcatgtgtgtgtgtgtgcatgtgtgtttcaacaattacattgtatcttcctagttaacaagttttcacaaattaaaaatttctgtaactaagtgccttgaataagaaagacaatctttgcttcattaataaatcaaagctaatccaaacagaaatgccttcagccagtatctctactcctcccccacgtatactccctatctgttgtatagatgactatgttttacagatg

SEQ ID NO: 27846 - DNA, 1154 bp, Mus musculus
ttttgcacttctaacagtgaaagcaggttagtctctgacttggtccttttttttggggttgccttgtccatcattgatatgaacattttttgcaatattttactctatcttattttctcctatttgactattggctcttggatgccttcttcttcttcttcttcttcttcttcttcttcttcttcttcttcttcttcttcttcttcttcttcttcttcttctttttttaagagaaaaaatgaggcatgtatctgtgggaaagagaagctgtgcagggagctgggagaagcaggggaagaggaaactgtgattagaatatattagataacacaagaatttattttcaaaaatttaaattgcttaaagtcctatattataataatgttagtcagaagaccaacaaggaccagagaaattccaaaatcccatctgagatgaagacctgatgtctaatgcctgctgagtaagagacagtaaaggtttccaagttggaattgaaatatagattttgcgggctggagagatggctcagcattaaaggctaggctcacaaccaaaaatataagagttcggttcccagcacccatggctgtctctccagccaccaaaagagaggcccattggacttgcaaactttatatgccccagtacaggggagcgccagggccaaaaagtgggagtgagtgggtaggggagtgggtgggagggtatggtggacttttgggatagcattggaaatgtaaatgaggaaaatacctaataaaaagtattttaaaaaaagaaagaaatataggttttgcaaaatccagaagtcaagtctaaatacaggcacttacaagaaatgctaatgaacacagatgtttatatgaaattaaccatacttacacacatatacacagacattatgattttgcaagggaaagatagggaagattttagggtggaatgaaagtcggagttatagagacactatgtcctatatgaagttttttttaaaaaaactttacatagtaaaatcttatcatagtttgtattcactcatcttcagaatagagattcatagatattgtgtttattttaatatcttgctatgtagatacaaaaatacttcgttctttaattttgttagcaattaaagatagattttatcataa

SEQ ID NO: 27847 - DNA, 1145 bp, Mus musculus
cgacatggccaccaacatgaaagccatgactgagcagggcacggagctgtccaaagagttgcataacctgctttcggtggcctacaagaacgtggacggggtgtgtggggggggggtaggtcctcctggagggtcatcttgaacattgagcagaagaccgacacctccgacaagaagttgcagctgatcaaggactattgggagaaagtggagtcggagctgaggtccatctgcaccatgggcctggaattgttggataagtatttaatagccagtgcaactaatcccgagaataaggtcttctatctgaaaataaagggagattatttccaatatcttgctgaagtagcttgtggtgacgatcaaaaagaaacaataaaaaattcccaaggagcctaccaaaaggcttttgatataagcaagaaagagatgcagccttcgcatccaatccacctggtgttggctcttaacttttctgtattttactatgagatcctaataatccagagcttgcctgcacactggctaaaatggcttttgacgaggccatcgcagagcttgatacactgaacgaagactcctacaaagacagcaccctcatcatgcagttgcttagagacaacttaacattaatggacatcgaacagtgcaggagaagaatgtgatgcagcagagggggccgaaaactaaaggcatccagggcaccagcctccttctccttaagaaaacctttttacatctccgttttttattccacttggatttactctagcaaggaagcccattcatgtgtatgggatcaactgtttatagtcttttcacactgcagctttggggaaactccatcccttggtttgtgctgtctctgccttcctggagtgcagttactgctgtagaaaagtatcaatagcttcatttcatagaaacacgagtaacttccagacacgtgtgtagaggagtgacagcgcacttggtatttaagtaatctgaaccagttctgcaagggagagtgttttgtattactgggaagatatgggaaatgtagtgcattacaatttacagtaattgtaataatttcttgatttctacattccttttctgaaccttcttgggggtttcctttcagaagcaacttttccatgaat

SEQ ID NO: 27848 - DNA, 1169 bp, Mus musculus
ctgtgcctaaatgacattagccatgaagtacattttacatcaataggcaatgcaaatatttatatataataatatatatatgggaatagtttataagtcaacataggtcacttgggtgactttacctaatagaactccttcatttactaatacctagtactaaatatttttaaattatatttattggaatgtatagagagtctgagagggaatggatacagtatctggaggcacagttacaatgagaggtaaggttttaacctttgtgaaatcatagaatcattaggtctgatttgataattacactcagaaggttttgcctctcttttgccttacttctactgtataaattcaaccttttaaatatttaaatttcctattataggtcattaagagaaatcaaggaagagtagataaaaagaaatgttattaactttacctaaaatttagaggcatcaagggaatcagtgttagattcttacctggcaggggagataccatgatcacgaaggtggttttcccagggcaaggcttatccattgcactctggatgtgctgacccctgcgatttctccaaatgtgggaaactcgactgcatattttgtggtagtgggggactgtgttctcactctcccctgtgggggaaagagagagagagagatcagtgttaggatttatggatataaacatagcaccagtgttctttctcttcctctctgccccacatatataaaaatataatcatgcaatcttcccctcccctccccctctcccttcccctccctctgtccctctctctctgtccctctctgtgtgtctctctctgtctctctgtctctgtctccctctgtctctctctgtctctgactctctctgtctctctctctctctctttctctgtctctctctctctctctctctcttccttgacaagcacaagcacagattcacacacacatacaacacataaaccacacaatgtcatttaaatttgacatttatagatacctaggaactatgttgctttgccatcaggttctgaaaataaagtgaacacagagagaagggtaaatgtcatagtttcacactacttgatgctgagaaatgtctatatactacattttgctgcaatattttgctgtctagaaggatagaaaattgaatggcca

SEQ ID NO: 27849 - DNA, 1152 bp, Mus musculus
gacttctacctgtttggttgtgttttcctgattttctttaaggacttgtaactccttagcagtgttctcctgtatttctttaagtgagttattaaagtccttcttgatgtcctctaccatcatcatgaggtatgcttttaaatccgggtctagctatccaggtgtgttggggtgcccaggactgggggaggtgggagtgctgcattctgataatggtgagtgctcttggtttctgttagtaagattcttacatttgcctttcaccatctggtaatctctggaggtagttgttatagttgtctctggttagagattgttcctcttttgttagcctctatcagcagacctgggaaactagatctctcctgaatttcagtggtctgagcactctctgcaggcaatctctcctcttgcagggaaggtacacagatatctggcgttgggacctgcctcctggcagaagatgacggccggaaacaggacctgtaccagaagctgtgttgctttggcctgtcacagaagctgttagcttctgtagtccacactctcacctgtgcagactagtttcggagggatctggggaccaagatggctccaccaggtactccagcaaagccctctccggcagggtggacacctctcctctggcagggaaggtgcccggatgtctggagcccaaaacgtggtctgcctcagaagctgtcctctagggaccttgggggtatctgccaactctgcgcccaggtgacctggtgttggtgccgactggaagggatttggaccctggtcaggctgggttttctgcttccctagtgctgtctcaggtccttcgtgattggattggaacagaagttgtgttccactcacctgtggtcctaagatcgagtagagagtcctctaggggacctggggggtgtcgttaggtatatttttatgaaaatagtttctataataccagctatctgcactaagcattataagtgtctaggaaacaatcccttaaataagaaaaacaacagaagtatcctctagctatccataaaatcaagcttgaaccaggaccaaaggaaaccatttcataagtcatctctttcacagagattttattttttttgtcttctaaccactgcacatacctcattaccctaaaaa

SEQ ID NO: 27850 - DNA, 1225 bp, Mus musculus
gtttagggagaattatacaaagaacaaagaagtgggcatctgctgacatgggggccgaagtcaggcgccaggcagtgggcactctggatcttatctctggaacatcgatcctccttgacagccttgggggtcaggctgtgctcaggggtaactcatgtccttggatggcatgggaactcaggaagagatagggaagaggggactataatttagcttttacagcctcaggtgccaggaaaggaatagggaggaaaggggggtgacaaccagctctcagtacaaggccatttggcctgctagggagattgtgaagggctcactttctcacgggatggtctctgacacaggaaggggactgggcaagtgcacacaggcccacacagacacatgcacccacacagacacagagggaacgggctgggatggggactgtgtgcacagcagggcgggtaggacctccacagccccttcccaaacagcctcttatcccttacacccctttcctcctctcttcccccatgttaggaacatagcgtgtttatattttatggccaaactattttgaattttgttgtctggccctcagtgccctgccctctccctttgcaggaccacagctcccgtcctttggcttctggtccttcctgttctccaccctggtttcttaagtagttggttcttctccttagtcttcctgactcaacccgtagtctctgtcccgctccccctctctgtggcagtttcatatttgctaatatgaatttgctcattaaacattttgttgtattttactttaaaaaaaaagaataggaactatggcaaggtcacgaagcccttgcccctgacttctaagattaagctgaccttaggtggggctgcttttgatcccagttgttgacattgaattttatcccagttggttcctgctcatcctttgtaggcattcctctgttttgtgtaaaagtcacttctaagacatgtgctcactttgagacaaattacattcagatccatactcccctgtgtcatgtctgtttgtcacccccttctcgccgactccttgcccacctgtaactggaacccgagctctgccagtggatcgaggacccaagtgaggtttgtctgctgcatataacttctcagcatctcatggtaccttctccaaaattgactatttggtccccaaacaggcctcagcagataaaaaaacattgaaatcattcta

SEQ ID NO: 27851 - DNA, 1177 bp, Mus musculus
tcaggcccctggcaacccagtcttggctgtgcagataaatcaagacaagaattttgcctttttggagttccggtcagtggatgagatgacccaggccatggcctttgatggcatcatcttccagggccagtcattgaagatcgaaggcctcatgactatcagccattgcctggcatgtcagagaacccctctgtttatgtgcctggagttgtatccactgtagtcccagattctgcccaaaagctgttcatcgggggtttgcccaattacctacatgatgaccagttaaaagagctgctgacatcctttgggcctctcaaggccttcaacttggttaaggatagtgccacagggctctccaagggctatgccttcagtgagtatgtggacatcaacgtcacagatcaggccattgcggggctgaatgggatgcagctaggggacaagaagctgcttgtccagagggcgagtgtgggagccaagaatgccacgctgagcaccatcaatcagacacctgtgacccttcaagtgcccggcctaatgagctctcaggtgcagatgggcggtcacccaactgaggtcctgtgcctcatgaacatggtgctgcctgaggagctgctggacgatgaggagtatgaggagattgtagaggacgtacgagacgagtgcagcaagtatgggttggtcaaatccattgaaattccccgccctgtggactgcgtggaggtgcctggctgtggaaagatcttcgtggagttcacctctgtgtttgactgtcagaaagccctgcagggtctaaccggtcgcaagttcgccaacagagtggtggtcacaaaatactgtgaccctgattcttaccaccgtcgggacttctggtagaggtggctgggggagggtgggggcagggctggctggggactttccccctacctgtcccctcctcctttccccccctcttgaagaagacaggcagaggagtgacagccgaatgacagccggcagcaactggaatggcagcaattaaggggggtggggggtggggggctagggcaggaatatcccgtcccgcgggattcagttattcgtgggtgcgagggggaccgcaaacctggaaggaaatgggagtaaaagaaagaagagtccatcaatgtaatccattatataaacaaactcaaag

SEQ ID NO: 27852 - DNA, 2178 bp, Mus musculus
ggaagcgctcaaatgggaagagaggaagtgcctgatcctggaggagatcctggcttaccagccagacatactgtgcctccaggaagtggaccactactttgacaccttccagccactcctcagtagactgggctaccaaggcacgtttttccccaagccctggtcaccatgtctagatgtggaacacaacaacggtccagatggctgtgccttattttttctccaaaaccgattcaagcttatcagcagcaccaatattaggctgacagccatgaccctaaaaaccaatcaggtggccatcgcacagaccctggagtgcaaggagtctgggcgacagttctgcattgctgtcacccacttaaaagcccgcactggctgggagcggttccggtcagctcagggctgtgacctcctccagaacctgcagaacatcacccagggagcaaagatccccctgatcgtctgcggggacttcaacgcagagccaaccgaagaggtctacaaacactttgcgtcctccagcctcaacctcaacagcgcctacaagctgctgagtcccgatggacagtcggagcctccctacacaacctggaagatccggacctcaggcgagtgtcgccacacgctggactatatctggtactccagacatgctctgagtgtcacgtccgccctggatctactcactgaagaacagattgggcccaaccggctcccatccttccattacccctcggaccacctgtccctggtgtgtgacttcagctttaacgaggagccccatgagctcttttaatcacaagcgtcttaaccagggatgttttgggaaactgaactaggataggaagttgcctggaaaaggacacccagtttctgccactactctccatcatttccagcatgcccttgaaaaaacattgttcacaaacctttccagctaaaacccgcattgaaaaggtgtttgcactccagtttgagcttgttgttcatctgtgtaccatcctctaccatttaggggcattagtagcataggctttcttgttttttagttgagggtattataaaaacccagtttgtaagcccttcagaattaaagtaagatgtaggaagttttctagacatcatttcaagttatttatttgtgggatttttaaatgtcagtgggaaaaaaaatgcatggtaatatttatttttttatatcttaatgtaaaataaagtggattatctagcattgtggacattttagaaccatgcaggtacagtcttaattccttaaaaattaaaatgtctctatttgctgatcgaacaggatgtacactaaggaactatttagccctgggggattggtgactttgtgtgtacattcttcacaaataattcctgtttgctatgcctttgacttctctgttgtgttttaaagaaattccgtagcattcagttctttagtttccactgtttagtcactgctaggcacttgtgccttttctgttgtgatgacgttggtagacgtgtgaagattactccaatcacttctcctgggatgtgctttttataagtagctttaggaacagctctggaacagttgctaagaatattagtgagaaaccttgccaagacgacagacatgagcccaacattcagctgagacaagaaagctcacgtcttggaggccagcttgggctatatgtcaagaccctttcttgaaaaagccagatgactggattcaagttttctagaaaaatataagagtcaaaaagataacctggagttctctttcaattgttgaagcctcttccaaacaaaatatccttccagtggtaaaatggtaaatatcttaatgtatgagttctaaatattacttaaggttaataaatggacttacaaagagtgcttttaatatcttgtctctttggtctaaaaggaatctgggagtttgtttggatcttgtaatactatatggtgttacacactatccattagtacactaaattttcatcttgacagttaacagaagtaactacacattctagcttctgggtgtcttggtcccaaggatggagccctccctccaaaatggcttacccctgcattccacccccaggtcaaggtcaagctagtctccccaatgtactagagcacttgagatgtttgtgggcctgatgcactcactcgctcacc

SEQ ID NO: 27853 - DNA, 1250 bp, Mus musculus
taagtaagaacaactgaaccctcaataagaaaagcctgaaagggaccaagcagctcactacactatcacgttacactaagagttggaacactaacacctgtaagaggttacatagttttcagtgggggggttgggatgggtgacgtcattgttacaaagagcatttcttgatgcattttatatgcataccagcaattagcactgtgcttgggcagtgctcacttaactggtgctatgtgaagactctgctaatacaggtatctagaatgtgaactgagtggatccaaaagcttcacacagaggagagcaagatctagtgcgcttttgtttgtttgttttgttttattttttgattttgaatatatatatatatatcatagcttaagctgttttaaaacaaaggccttagactaattttcggtttcctttcttgaaataagctaatggcttgtttgtgtaaagcttttttattaaaagaaaaattttaaaaatcttgtacctagcacagtattgttatagaatttccatgtaacattttctatggtagtttaagtctgtcggtttcttaattgtgaagacattaacagttggctccggccctttactgtaccatacctgcgtcactcgagtcgccctgctgtctgcagacacatcggtatcagttcttctgtcattcgacattcaggcccgcatgaacttgccaggtagctccagtgcctggtgtttgtttcctttctcaccctttttccttttctccctaattttctctttttcttttttagttgacatttaagaggggaagtaccagtgttcagatttgaactataatagtttgtatattcaacatttgaagtatattctattttgttgtactcttgtttcaaagtgtattcaagtaggttttctgaaatatagaagtgaaatttatcttgtggttttggtctctggtgatatttttcacaatgctcacaagccagcccaggctgtcgtttcagtcaggccacagaagtctggtgttttcttaatgactgcctgaagaaatgctactccggtttcgtctttgtcccattatagaaatatttgacaactctctgcacattcccacttcctttataactataaccacataagaaatacaggtcaggaaattggccaatcataatggacctatacatgtgaaacactttcagcactagtggtagcggcgtgcctggcatgtgcaggcccctgggtctggcctggcccctggg

SEQ ID NO: 27854 - DNA, 1229 bp, Mus musculus
taaccactgagccatctgtccagcctgctctgtggcctcaccactgcgaagtatgctgcgtctccactcttgacttgctgttagactgtgatttcttgcatctgctaacccatctgatacacacctttccttcttcccggggtttgttgttcttggctcttttttgtttgttgcagcatctttgttccttagtgtaagacttaaaacgaagtctcttaccttttttagcgagctttcacaagaaagtcaagtatgcatgctttgaatttagctcttaactcacgagccttgattacttcatttgtctcttaagactgtaaaagactatcccagccagcctctccatttctttgtcttatacatccatgtatatatgaaacacatgaaggacactgtgtggactgaatgaccttgtgtgaagccgagtcacagctaaatccagagttgtccaacaaaaccttgattgttctttccctttgcttttgtagggaggtgacacgggccctgactgcccggcagtgattgtggagccagttcccagtgcgaggttagagcagggctatgctgcccaggtgctggtctatgacgacgagacttatatgatgcaggatgtggcggaagaacaggaagttgagacggagaattcagaaacaggtaagacactgcagagagtccttgttacctataactcctatcttttaaccagccatctattttatgtgaaaaggtgttttgcctgcatgtatgtctgcatgggtgctgggaacccaacccaggtcctctggaagagcagccagcgctcttaactgctgagccatctctccagccccataagttgttttgtaagcttcagtattactatttattgttgggggaagcttatactgaagaacctattataaaatgccagttagcataggatggacattggtgtaaaaatctttgtttaaagcgagtttatataagtataggagagtcctatgttataattcttcactatacaacagccttaaaagttgttggtttttgtttttgtttaactacagatattcactagttatttacttataaaatcagtaggttagtatacaagagtgatatttcctaataaaaaaaatgagggtagtattctctttctaactggtttagcccttctttgaatcagcattgctggagcagtaccgttttgttttgttttgttttgttttgttttgttttgttttgttttg

SEQ ID NO: 27855 - DNA, 1336 bp, Mus musculus
caaaggcactgtgccaccactgccctgctgagctcagtactctttaccagtgatctctctctttccagcccagattttaaaaatttgttaaaatattccaggtataatattgcatctctaaaaaagaaggaagttataaaatttttaaaatattacaataatatgtgtatgggcgttttgcctgcatgtatgtctgtgcaccatgtgtgtgcctgaagagggcgctggatcccctggaaatggagttacagacagttgtgagttgccatgtgggtgctgggaactgataatgggtcctatggaagagcggcctgtgctcttaactgatgatcaatctccaaggaagctgtaacataatgtcttccctaacaatacctgtacacgatagcttggtaaaatgttattcaataagttaatgaatttgaatattcagttcttaggtagagttattgactgtcttttgacacaggtagaagcttgtatcctatttaattaaactgttgagtactaattgctttatatctgtcctatatatcttcaacaattcctcattgtccctcttttagaccctctggttaatcacctttagaagactggacttccggatgtctactccatctctattgaactaaaccatgaaaatgaaggctacagtcctggcaatcgtctgtgagccttagttccgttgcttcacagcatttgagacttcctcagggaacgcacgatggcatcggcggtggttgacagcggaggctctgctctggagcttcctagcgatggaggagaaaatcaagaggtcaggcatttaatatatctcatctctgtcttgttagtagagatccgtacatgagtctatcgtgaaatgaatgagggatacgggtactcaagagtggacgtgtaccgtgcataaacttgtagtggtcatggatgtgtttgcatgtaacttagtgatgggcgagaaaggtgctccactgagtgatgtgagatgagtgtgttagagagggctgggaggagcgagggcacgctagcttagggacagcttaggtttctgagagtatccattttcttagactatagagaatgagagatacactcattgtgtgtaaatacccaaactgcagttgtctgaagttagaagcttatgtttgctttccttgtcatttttatttcttagttattctgttatgtctaattcaggattgatctgtcagatttttaatctaatatgtgcagttatttgtatagttagaaaatgaagttttgaaattttctgccagtaggatttttgactcttttgtgtatttggtcattttcttgttaccgaaagaaagcaccg

SEQ ID NO: 27856 - DNA, 1149 bp, Mus musculus
gacagatctcactttctgtagccaggctggactggaactcttggcagtttttctgcctcagcatcccaagaggtgggattacagatgagaactactatgcacttcttgtgacagttctagaatgattttatttttttatgtgtggagaggtcagagggcaacttccaagagttggttctcttccaccatgtgggagttcctgagattaaactcaggtcaacagatttggcagcaaaaagctgggcttaatattgtctgcctttaatcccaacacttgggaggtggaggcaggagatatttgtgagttcgaggccagctggctctgatacggagattcaggaaagtcagatatacagtgagaccctgtcttgaaaaaaacaatataggaatagatttggcagccagtggtttttttttttttttttttttttttttttcccttcctcactgagcatcttaccagccaaagaccagttgctgttatttttcctgtgctggagatctcaccagggctttagcatgtgagcaggccatccatctgagttattcccaagtcttttaagactaagtgatgtgagggtagaactatatagcatagttttctttcagggcttacccatccagtccctttgctcccctttccctcctattctcccttataatgctggaggttgaaccctgtgctaaatacaagcagagatgtgcttccaactctcccattatactgactgggctgtgtgtgtgtgtgtgtgtgtgtgtgtgtgtgtgtgtgagaaaaatcaagagtcccaaaaatacacttaacctgaaacaaaggaaagcctcagactatgcttcacccttaggaatagagacatggtggctcacaaccatccataacaagatctgacaccctcttctggagtgtctgaagacagctacagtgtacttacatataataataaataaataaatattttaaaaaaaaaggaatagagacattgccttgtacagttgtaatatcattaacagattctttttcctaatactcaagttttccaactgttaatgacacccttttattgtttggtttttctcttttgagacaaggttttactttgtagttcagactggctccccagttcttggtattccacctacctcagcctt

SEQ ID NO: 27857 - DNA, 1174 bp, Mus musculus
atataatttaggttcatagaatcaaagttttcaaaatagtgttttgtattttaaaaggataggtatgcagtcatctgtgaatttgcctaattatgccaatagagtgactattcctaagtagtctgaatagtcagatatttgcacttgattgattaattgatttataggcagatttttactatgttgccctggctgacctggaacttttctaagtaggtcagactggcctcaaactcgcaagaggtctgtctgcttctgccttccagatgctgggattaaaggtaaatgccaccatgcctggttagatttttatcttctatttattcactaaggaaaacaaatctaagagtatttcagaaaacagaatctagaggtttttgcttacttgccttgtcagttttaaaaaaatattttaattctgtacataacctgtaaatgtattgttaaacacgaaatgtttgtagtttgtttttgagtttatagttaatttcttattgattactttcttcttttttcctttgttgttaaactatagaaaccctggctatgaaaggattaacgttgaactgtttgggaaaaaaggaagaagcttatgaattggttcgcagaggtttgagaaatgacttaaagagtcatgtgtgtatccttttgaaatgtatttaaagattgaatgggctgtttggatataagaaaacaaatggagtcaagaaatgtaaatccctgttaccatgaggaaatgatttttttcttaaactgaaaatggaactttttttctaatatgactaaatgcattttaacaatatatgttagataaattgtgtctatgatgcaggtcttactttgggagggcggtgttgctatggcctgaatattcatatctctttaaattcatacattgaagccttgtcacagagtgatgatgttaggaagtaaggttttttgagaagtgactggggagtggggatagagccttcaggaagctgtagaaaaaccctcagggagcttgttagcccctttgtcacgggtagatacagataggatgtgccatctatgaaggagacagcatgactcgctagatgatacatacagtagtatgaacagcaagcttcttttatttataagttgcctggtttaagtaaggtattttgtaatagcaaatggtccgagacaagtg

SEQ ID NO: 27858 - DNA, 1116 bp, Mus musculus
gagagttggagcaatgtgtagaattgttaaaaaaatattgttaagtttttgttaaaaatcactttattaaaaattaatactctggtagaataactatagtcttttgtcattttcattaaagtaagtttttaaatttttgtttgactttatattcattgattttatatatatatgtatatatatatacactcacgcatatatatacacatgtatatatgcatgtatataatatatatatatatatatatatatatagttcagtagtgtccatttaacccttaaaagtatttttctgcctctacagctatataatatttgatgttgaagtttttctaaaatagtcacctgcatgtattacagcgtgaataactgtgaagcagagtaatgtgatcttctgttttcttaggaccctgagggctgaacccagggcctcctgttctagtcaatagaggggcatttgctttgtgaacctaagataagtcttgtttttcccacactgtgaaggaaacaagataccagttgcttcagcttcggcctgcacagagagcatcatggattggttatgctattgcttaccatttattagaagactatgaaatggcagcaaaaattttagaagagtttaggaaaacacagcaggtaatgacaaaacagtttattgtgtctgattctaagaatgactgaaagaaagaagtttacatacatacctgaaaatctctgtggttaatatcgatgggcttgctttctgtttcttacgagattgcacacatgctcttttatgtcctgtgctcctgagaactgctctagttgttactactgatggtgctatctatcacggagtatcaagattagactgactctaacttgtagatagtataagatagtgttgtagattgtcttagttctttttctttctaacagtctttcctgattccattgtttggttttgaagcatgcctatcacctagtaatcattcctctgggagtctatatcggaagcaattttaaagcgtttggattttctttctttattattttgctgtgcagtaatgcttttggactgttcctgagtgtggatctgtttgcttttcctaattattagttaaaggtgtactt

SEQ ID NO: 27859 - DNA, 1186 bp, Mus musculus
atccagaggttccaaataaaccaaagagttaaagtggagaagatcagaacagaagcaatgtgcagtaactcagatttttaccatgaagtctccaggtttttgatattctacctaatttagagtagactaaagaaaataatttacttaatatggctaatgagtatttaaaataaggaaaatagatggaaatacttttaaatgattgctgatatatttaattggtaaggttctacataattttcttgtacaaattaccctttcacttgtttgtttgagacagtctccctgtgtagctgtagctctgcttggcttgaaatttgttttgtagaccatgctggcctctaactcatagagttcaccccgtttctgacatatcaaaggtgtgtgccattgcatccagccaggtgtacttttaatttagaaaacttgtaattggcagaaatccatgcaatttataattacatataaacagtttttttccctctttctctcctcccttccccgccccccaaagctaatatgttagaacggctaaaaatatatgaggaagcctggactaaataccccaggggactcgtgccaagaaggctgcccttaaactttttatctggtaagtagaataattgtaaaagaaagtgctgttgtgctttaaagatgagtatgtatttatattgaaggctaatgtgtgcattttgttagcgtttcaacagaatctttctcttataggagagaagtttaaggagtgtttggataggttcctaaggatgaatttcagcaagggctgtccacctgtcttcaataccttgaggtctttatacagagataaagagaaggtaaagccaaccctaataccctctctcagagccgcctggctgctgggctcacgactgctcactactgtttgtgagcctgctgtgagtcctagctcactgaatgcctgtgtacccttttccatttgtagtctgtttgctcttcggtgctttactgacttcagtatttgctttctatccttaacttcatcttataccaacattttttctaatctcttttccttatttttttttaaagatttagttatttattatatgtaagtacactgtagctgtcttcagacaccccagaagagggcgtcagatctcattacagatggttgtgaaccaccatgtggttgctgggatttgaactt

SEQ ID NO: 27860 - DNA, 1579 bp, Mus musculus
gaagcctacagagcaagttgtcataagcttttcccttatgctttggctttcatgcctcctggatacgaagaggatatgaagatcacagtgaacggagatagttctgcagaaacggaagaactggccaatgaaatctgaacatcattaaacaagcaaatggaatgactttggaccatatctagtgtataatatttttgtcacgcacctgctgcattgctcttacttacacagaatgagaggagtaaatgttcttgccttcaaatagtcttacgttttttatcctgctgaaaactatatataaaatatctaacattacaggatataggttcagtttcttaaaaaattaaaagctgctaaaattgaggggtttaaaagaaaaaaaaaatccgtatcctattcctaccttcccttcccatgtttttaactaatttatataaaatctggaggctataacagctaacatagcaggtgtgtggcagaaatattactttaaatttgtcttgtgagattttgctatatctcagacagcataaataaatgctgttttagcactggattctttcactgagcacaaagagttgttggggctttagcatctgcctgattctgttacggggttggtgattgaccataggaagtatgcaatgtgaatcactgtgtacagagccgtctacaacacatgcttgacgttgtagagactgggacacatagctaccaagcggattaagtgaaacctagaaggtgttcagtacgtgtgttgtgtttccaaaattcactgtacatgatcagtttggtgttcttgtaccacagtttttaaccgaaggaaccagttggaacaatctcaatttaactaaaacttgaagaactaaaataacaatgcaaacctttagcattgttttggccaaacttgttaaaactgtaatgcaagaaccaaatgcactgtgatgtggcaccaactaattagcaagcatgaatttttcacctgagagtgaaaaaagaaaactctaccatggcttgaagttacagagcagaactcctgactaccattctatgactgatgaagagactaatagctaaaacctcagcaggccttgttcacgatatgcagaaaagtgctgcagtttagatacctctggaacttttccacagtgtcacaggtttgtaatacttgaagcccttcatttctaagaatatatttctcgctcagttgtttcaggcaagcccaagactttgtaatttttaaagggcccaagatttttttttcaataacagaccagcttctttttcctgcagttacaaatgtaatttctttttttttttgttgtcaaacataaggtaccaaatatgcaataaattgttttgaaaaacagttgtgtgaatatttccactaacctgagttgggcttctgtgaaatgcacaggtggaaacagaggttgcaagccagaggcaatgaaacacactgtagggctagtatagaggggagcttttagagccggctaagtggtggtgtcaggaaagttccagaactaagcagaatgctgctcctttgttcagatttcactgaggctaggatggtggc

SEQ ID NO: 27861 - DNA, 1491 bp, Mus musculus
aaacaagtcaaacctgtacactgagaacgagcctcaggcttaatatttctttatgtttgcaaggtctgagcaattaagttcaatgaattaagtgtatataaaatagaacttttgtagtattttagttatacatagtacatacactaaagggaattttcagaagatcagatccttttatttcatagtacatgatctgcattccacatcccagtctagcaggttagtgatgcaaagatacttccagtctgaacttcagtgcttacacaggccctgtctcaggaacatcttaacagatggcaaaaaaaagtgagcagactttacgaatttttctcctatgagtggcaactaaggttcctgttgtttggaaaaaacactagtggtatgtccgctactaattcagtgttggaggaggcaccagccatatagtaggggtgtgtgtgtgtgtgtgtgtgtgtgcgcgcgcgcgcgcgcgtgtgtatttgtttaaattctactgtatatcaccatgaaatctgtctgtttgtcttgacaatgtttaaatgatgtagattgtcttagaatgaatactcagaagtactcagaactccgattccgatgccacccgagaggagtcagactcctgtcatgtatattgtattccaaccaatttactggaactattgaataaatctttattttctttcaggtttatttgacagtggatacattgtctggtgtcacaggaccttgactgggttcacctaaaacattgtactttactctgagtatatatttatttcaactggatcatttcacatttaccccgttgatattcagttaattatcagtgatactgtgggggaaaacagggttagataaacaagttggaaaaatgcagtgtgatgttgtaatctaaacaagtgccttatgtttattgctaagaactggtgttatcaacccttttactaagaagggtccctcggcctgtattcatgtaggaaagtgaagagccttctgttttcttcatagtcacttactgtcatgtctcattgaaagttacaatctgacgagcttagtttacttagctttaattagataggtgagtcatacattttcaccattttttcctgtatttattatgcacaataaaatgatctctaatagcatgactaaaagtagtgccgatgttgctggaaagctttctgggtcgtacgaggccctgttttttcaccgtgattgtaccgcatgctctactactctcagctgtgaagtgaaagctgtgaatgtatgaagagctcagaaaaccatggagtgttgtgacaaactcacatcctttctaatcaattggtaagactttctgttgccgggcatagcatctgtttggggaaagctaaaagggaaatactgaaaatgctaggcatttgttattttagataattactgtccttggattctgcaggtcgaccttcctgatgggaggagtcttcctatctgcatcgtgctcctggttct

SEQ ID NO: 27862 - DNA, 3088 bp, Mus musculus
tgtgagaagaaatggatttaccttgtttgcatcaagttatggaagggttttaagatacactttcaggaagaagagagggaagttatatctaagcagttgttatggcaactttgcagtatctccagtagtgttgctaattttttcttcttcttgggtacacattaattgtacataacctagtacagtctggcttgtgacacacacagctcattgaattcaaacacaatagccagtgtgcattctaaggcagaatgcaaaattctctttgaaatcagtgtcacgaaggcagacatgctgatatcgataggtacaaatcagatctctagctaaggcttctcgtcacagcggatttcaaagcatttagctgcttccaagagttcacacctgcgcggttaatcccgctagcgtctcagcctcctcaagccatatgtaatcacaattgcagaagtacagagaaaaccccattattttactttagcacattagatctgtaatgtaactgggtcgctctgaatgaatgccgagtttggggaacactcccctcccccaaggtgtccatcaccgagaaggcctgggaacaacagttgctgaagccggtagctgtccacagtgctacctgtggcctgtgtcggtttaggcttaaaagctaaagctttccaagctgcaataaagggctctgggaaaggggagagatgcttgggagtaggtggaaatggagagaggagacaggtagagagcggtttgatattctgtggtcagttgcatcttggtcttcacaactttcaggagtgctttatctggggctgcgacacagcttttccatcaagagccccaggtggagaactcagccctcagttgtgatagccacccctgggctctttcacaagcttcctgacatacctaccgtcaggctctgcacccaggtgacgatgctgcccgggagtgctagtcacatccctgtttgaaagcttaaggagcgagttccctcgggagaaacgtcctctggactttcgaggagcctcctgcaaagaggactgaatagttttcagactgcaagtcagcaggataggatggcttctattctgtagaaagacaccattcagtaaactctgacaggaggctgagtctgtgggttcagattctgagaggagcttttctgtaaatgtgcccaaagagagttggctgctttggggagaacaatggctgaacttcagtgaccagatgagaaggaggacggaggacgagagaacaggttccacctccaatcgcccaggctcacaggatttcacacctggggatggaaccttagcctcagttgctgtaggggctcaacctctatcctaaagggctactctagcaatctcatccaaatgggactcaaaaacaatttgggggggcttaagggccagcaaaaaacgtttagcaggtaaaggtgctgttggcaagccgatggcctgagttaagccttaggacatatatagtaggagagaaacaactcctgaaggctagcctctgaccacacccagcatggcacgcacccgcccctccacacacacacacacacacacacatgtggctgggaaaccgatctacttttcccatcccacagtggaggaagacacactggacttcaaacccagcagcaatgtgtcggtgacccttagacacaggaagcagaccctcagagccgagcctccctgtctcccctcgccctgggttcctggtgcctttcagctccttttcttctgctgtgtgagaagcctgggtgtgtgtgtgcagaatggcagcccagccgattgctccacctctttccttatgtcttaagttcctcttctctcttgctggactctgtgcctttccctgactgtgacccattccagtcactgcccctgcctccgccttctctatccctctccctccctcttcctttccctccctcttccttttactccctcttcctccctcttcttctccctctccctcccctcccccttcccttgctttcccttccccctccctccccttccccctccccttctctcttcctctctccaagttaccaagcataggtaacttgcttagtcataggttgcaactgttaaagaggccagaacctcactgtggagaagagaagcagacagcataggcgctgcatagagaattagctgctgagggaggttggggtttgctccttgcttgaaccaaaacagaaaagcctccgaatgtgccttctactgtagaaggacataggaagcgggcaagtctggtcttctctcaggatcataatcacaaacagccatgattgagattctgtgtggtagagaagaaaaagaactgtgcgctgtcttcctgacagctggcgcttgtgggcttacctgcctgacgtcagcacgggtctcgagaggcctcattcagagctgtctcagtccaaccctgcatgacttgacccatctttagcatctttcctatgctgaactattattgccttgtgttagagttaggagttaggactaggaactaatccatggagcacgtcccccctaactggggcatacgctggaactaacagaagcaaaagaaagaactgaaattaggacacaaaagaatgataaggttacagagtaacaggcggaagacttgagtttcttagtacagattcttattttaatcctctcaatccctgacctctccagcaactaaaaaggaaaccttttttttttttttgtcaaggcctctttgaacctgactgggactagagttcagcctcattcccctttggggttcatcagtcttgaaaaactgtttccttatcaccaaccctcacacacacacacacacccacacaccaacaaggccatgtaatcatttacaacatttaattgtgacaattaaagttgcgttgagcagcaaatacagctcaaagtccaacatctgcctagcagctagaggccctggcttacgtccctagtactgggagtggaagggtcaattgtgaacactgaaataaaaggttgtcttcgtgagacagtatgtgacacttttattaattttacttaattggtttaagaaaaaaaatctaaatttctca

SEQ ID NO: 27863 - DNA, 1053 bp, Mus musculus
tgcctggtttatggttatgctgagacgagccttgggccccatatgtgttagatgaacactttaccagctgagccttccaccccagactgcctagagtgggtgctgaagctggtgggggtgtgccccttctctgagaactcgggagtgacacccagtgcatgtgggtgagccgctcccttggcactgaggtcctcggttgacccaagagtgacctttcccgtcttaatgtttaggtttgtccacccccgtttcgggccgatcaagtgcatccgcaccctgcgagctgtggaggccgaggaagagctgaccgttgcctacggctatgaccacagccccccggggaagagtgggcctgaagcccccgagtggtatcaagtggagctgaaggccttccaggccacccagcagaagtgaaaggcttggcactgggtcccagagacctggagtagaaacttggatctatgcactacatttatctgacaacgggacaaccagggactattcatgccatgacatcacatcctctcaccctgcgttagcaacgactctctctctctctctctctctctctctctctctctctcccccccccctctctctctctctcgcatactaactaggtttgactgtattactcgtaccagatttaaaattagctagccttgccacaacgccctactgagaggtactgtcgaactgtagacagcatgatgttctttgatggtgaaagtctaaatctggaccgtgttcagagataccaaatgatgaggctgaaaaggggaaacggggttcttcagtctcttcttcttctttttatttttttttccatgatgttttctctatggccagtgcaaatggtgttgtcacccttgcatgttgccaaccgcagggcaggaagcaattacatctttatatacacgtagggtcatttgccttttaacctttgatctgtatctcttgcagtagaatggctttgtttttgttgttcctctcctagtgacccgaagcccagtgttttgagtaatttctttagcttcactatactagctatac

SEQ ID NO: 27864 - DNA, 1179 bp, Mus musculus
tctgacctcacatgctcaggagtttgttgttttcatgacagtacttcagtactacacagagcagggcttcactgtgtgtatagcttgtctttcttggacgagcatcgtccctggggagaggaggcagcccttaaaggaagctaggaagtgagctgtggacaaacagtgctgcgtgatccaagaagcaagaagacctgcgctatttaaacgtgttccgtttagagagtcatcacatggaccgaggatgttaagaaaatctctcctccaagggtagtgtgggtgcactttcatgccttctacgagtatatcttcagaaaaatgatttttatgcaatacgaccatattcatgactgccatgttcatgactaatgttaaaaacaaaacaatacggacgttgtacgagtcagaggacccctacatttagaatatagcatcgagttttattctcaggatgtgagctgaattatggcatgttgaaatttttcttttgtaaaatgtgtgtgtgcacgtgcgtgcatgcatgcgtgtgcatgtgtgtgcacatacaagtgcctggagaactttgtatgctctttttgtatcggtttgggaccatcgggtcaggagctgatgtgaggtagtttacacatggtgtttgaccctaaatggcctgatactcttcctgagccctggtggagtatattcatctccttcaacttttctgactacttcataatattttagttataaaaccaagaatgccatctagggtacttagaaggctttccttttgatttaaataacacacaaattcttcttctagaaatatatatatatatatatatatatatacatatacatatacacatatatatacatatatacatatgtgtatatatatatatgtatatgtatatgtatatgtatatgtatatgtatatgtatatgtatatgtatatgtatatgtatatgtatattcccaaatgaaaacacacatttttaaaacatcagtgattaagggcaggggagatggctcagtgggtcagagcttgtgctgagcaagcataaggacccaggttcaaatcctcagaatccatgtacagaactgggggtggcacaagtttgggggtggggccggaggtgaaaagattgctggcactgctagccaccagcttagctccaagtatcctgagagaacat

SEQ ID NO: 27865 - DNA, 1106 bp, Mus musculus
ttttagaaagtgggatgtagttcaatggtaggatggtttcctaacatgcagggttcactccctgacactgtataatcaacagggcgttgtggtccatgccatcagttgtagcatagatagatatacagggaaatgacttgtatacttgtatacttgtatacacaggttaaacattatggagaattattataaaacgttggaattggaggctggaggattgtaagttaaacggcatcccaaagatgtctgtcctgggctacttcgggctacatgagctcttgagacaaaaacaagagcaaacaaaagacaagaaaatgaaagaaaaaaacaaaacctttcaatgtttaaagaagtgttgtctttttcttgtttttggacatggtatctaagtaacatttatcttaaattgatagtgcgagcacacatttgtcaactggtatgcatgcatatgtgttgggggtctagcgggtctcattcttagtttctgggtctcttactgtgacagatttggtcagactcggtttgagatgaactccggggatctgccccctgtaatgcatacaggcttgtgtgtcggtgcctgaaaccagaactcaggctctcaagcatctgaggcaaatgcttcctgactgagccgtcactctggtctcctaattttagtttgattttggctacaatggtcataagtaagacataaagcggtacttaacactggaaaacccaggctcttttaaacagcccagtgtttgtaaacaatgaaacctcatttccatgaccggtgccaccttccgacaccccccccccccccacacacacacacacagaaaactttctgaagcttgggaagtagcacttttttcttttttcttttttctttttttaagtagtggttttgagttgactcttgtttattgttttgatagactacctaaaagaatgttttagggctagtagttggtagtgtgcttgcctagctagcatgcaggatgtcctgggttttattcctctgtgccaagtgaatgctggtgatcctagcctgtgggaagtcgaggcaggagggtaagacgtttaaggtcactcttggccatacatgccctgggctactt

SEQ ID NO: 27866 - DNA, 1199 bp, Mus musculus
gtatagcacagggggaagggttaactagtctgagtaggaggtctctgtcaggctgtaactgcccctctgcgcacacacacacacacacacacacacactcacatacactcacactcacacacactccctagattacaaagcaaaagttgctagtctttgcacacactgataagtattggttcataaagaatcattcttagacttcctaaaaaagctttgccatttctctcttgcctggcccgaatgggtaatggctttgccaatttcccatgggccaattggtcttggagtccttaacaggcagtgcctgtatcattattcgtttgctcagggcttcttcctcagctccttcatctccctttcccattccttatgaatctccacacttagttgaggtcaggttcacctcagtctccacactgaagatggtcaggagtaacatgacagccactgcataccaacaaaacaaaaggaatgccctataggttaaagggagtaaggccccaaagctcactaagtattgctttttgtaatattagcaagagaaatggtctgatggtgagccttttgtgtttttagcaaatgccaaaacagttggactgtgtatttgctgccgttattgagtccaagcagaagatggacccaaatcacttcccagctctggctttacttgaagaagttcttgtcacacacacacattgctaatccatgtgatgtattaaatcatacttaatttgcagggctatagcctactctgaataattgattgaagcccactggaacttcaggtgattagaatagtacccctcaaaacaaagggaatcgttaagtagggggtattaaagagttgtaaccaagctgctgttaaaaagctgtggtctacaaatataagtccagtaagctttttccacgaccagttttacctgtatggatatgattatcagccatctgagaagtgtgactgctgagttattccccagtcccacgtgtcttcagacctgaaatcaggttcttctctggaccctagcggcgattccacaccttctgggaagacagaagcagatgtgttcttcctcatcagcacggcggggggggggtcaaggcatcttctggcacatctgtctaagtgcacatcaggtctcactctcctgttctgtagcagtggggctgtcttctgtacagtctaaatcttttaatgt

SEQ ID NO: 27867 - DNA, 2052 bp, Mus musculus
ttgagaaggctggagcttcccctacccccaacttgattaagtacaattgagttgaaaatgactatatttttattgtgtgtgtttttcccctttaggctacatttaaaagtccttcagattgtctgacagcaggaactgaggagcagtccaaagatgcccttcacccctccttatagttttcaagatttaaaaaaaaaaaaaaaaaaaaaaaaagtcctttctcctttcctcagacttggcaacagcggcagcactttcctgtgcaggatgtttgcccagcgtccgcaggttttgtgctcctgtagataaggactgtgccattgggaatcattacaatgaagtgccaaactcactacaccatgtaattgcagaaaagactttcagatcctggagtgctttcaagttttgtatatatgcagtagatacagaattgtatttgtgtgtgtgttttttaatacctacttggtccaaggaaagtttatactcttttgtaatactgtgatggtctcaagtcttgataaactttgctttgtactacctgtgttctgctacagtgagaagtcatgaactaagatctctgtcctgcacctcggctgaatgactgaacctggtcatttgccacagaacccatgagagccaagtagccagtgatcaatgtgctgaattaatggacttgtcaaactttggggcagaataagattaagtgccagctttgtacaggtctttttctattgtttttgttgttgtttattttgttatttgcaaatttgtacaaacaacttaaaatggttctaatttccagataaatgacttttgatgttattgttaggactcaacatcttttggaatagataccgaagtgtaatgttttcttaaaactagagtctactttgttacattgtctgcttataaatttgtgaaatcagaggtatttgggggctgcattcataattttcattttgtatttctaactggattagtactaattttatatgtgctcagctggtttgtacactttgcgatgatacctgataatgtttctgactaatcgtaaaccattgtaattagtacttgcacactcaacgttcctggccctttgggcaggaaagttatgtatagttacagacactctgttttgtgtgtagatttatgtgtgtattttaaagaaatttcacctgcttttattaccctgtgagttgtgtacagcgcatagcaccaagtcttcagatagatgccacgtgcttacagccttctagggaagcctgccagatgatgccctgtgtcacgctgtcatagttcccatgggaactctgtctgtcgctcaggaaaggggaacttttatctaaggtgatgttctttgtctgactggggttcgcctcctactactctgagctgttggcttttgtcacgatggaggtggctttgtggctctgtcctgaagaatcctgtcacttctcggtccccacctctgttctctttggctctgaacagtgtaaatctaaggaggaagtttacaaataggacttcagtgatttatggagtgctctgtgcgcctaagtacagacagtggcaggattagttaaaaatgaaggcagtaaacttggaaaccagccagctataaatggacatttattttgaaatccttagcttaagaatttgagaagttttttcagccttgagcagcctaatgtgtctcaaacatttacgttttttatacattctatttacctgaaatcctgccagaccaggataattggttttacctctcattccgtccatcggtgtttcccagtctcccacagtttgaggaatagatgtaccccagcacccctctttgcctttatgagaaggcctggtttgcatgagaagaccaaattgcacttccatgagaagaccaaattgtttgtagtgttacttagctctcccctcgtttgttagtgtgtgttaacaagaataaaatgtccctgctttcacccaccgttggccagctttgtcataggcttcccaccataactttcactattttaaacacatattgagccactgctcgtc

SEQ ID NO: 27868 - DNA, 1102 bp, Mus musculus
agcctccgtgtgtaatcattcagtagaggcagctaccgccctggcagtggtctacctgctgaatgccactgaatgactaggaggtgtctctcccttcagaagctgtcaatttcagcagcaacccctgttttccttggtgttaagatcccagtgtgaatcatgggcagttgtctggggcacagtgaactccaggaaaggcttcgtatctgttttgaaaacaaacatcaaacgtgtgagctccgagggtccttttctgggagaatgttcgctttctggtctattattgtacatgattgctctgtgaaaagacttcatctatgcagccttgtttgattcatttcctttggtgtgttctgttgttaagagcaaattgtattatagagctatttggatattttaaatataaagatgtattgtttccataatatagatgtatggagtatatttaggtgatagatgtacaacttggaaagttctgcttggacaaactgagtctaagttaattagcaaataatatatcctgatgagcaggaagccctgaaacctaacaacagtaagcggagaaaatcacttaaaatggaaacagttccccaaaggtgttcaatttgaacttgttcaactgcttaatatatggtcccccccccccccaaaaaaaaaaccttgaagttcttagttttcagctctccaagttactgattttaagtgaagtttctctgtggtttcagctggggagtgattgttcagtagagtgtgcattgtgctttatgcaaaccaaacagcctggccctgtggccggggacagacagacagcccgtcaggatagagtcccgcccttcgccaccacagcggacttgagtaacagtgcagatgccttgctcctgttccattgctatctgagaagtgcctgatgaggatggtaaacttacagacacaagaacaatccttactgtgcgttgtataaagccataaatgtacataaatcatcttaagtggcttggtgtgtgtctttcctagtgttcaaaggttcctgagcgagcatgtttttattcagtcatcaagcacttgagttagaccgtcaaccccagtgttaatggcgtatgac

SEQ ID NO: 27869 - DNA, 1175 bp, Mus musculus
accatagccagtataacagaactttttgttatgtcactccccaaactcaacccccatcttccttgtctccatagatgtcctcatcttaaaaacctactgaaatgactttctcttggcacagagttttctactcttgtcattccatgcaaatagaaccattcaacacagagcctttgatggctggcttccctccatagtatgctatatctcttcagagccttttgtgttttgttaataatgagcttaactcatgctgctgctttctgtagaacttcagcttcaaatagcagtaagtactgattataataatgacacaataaatatcctaggtgaatactatctaaaccagacactctatactatacatactatctcttgcctcaccctcactacaagctacacaggagttataatggcccatatttcccaggttaataaagaggtgccatgctacttgtcaagtgataaagcaaatattccaactcagtgatttgactctaagtcattcttctctgttgcatgacacttgcttagtctgtctcagaagatatacagcatcatcaacctcatcaaacccctgacccttgactgtagctttgtctaacatcaaagaaataacagagaaccagttccttcatggcacccccagcacaactgatatgctcaggctgaggatacagtaaccaagaatcttgtgccctagtgtcaggaaggtctgacttctaagcacagatctgccacctttgactgtatgtgtcatgctattgctttctaattcttgatttctgagcatatgaaatatggaagacacctttaagagttgtcatgagagtgctttttaaaaatgatggctaggacggtacctaagtccaagtaaattttggcagtatctgctattgattattaccatattggacaataatagaatgataccaatcacacagaaatgatccccagggaactctgaactgtcggggagatgagagggcatctctggcagaccttgtgtatatgatggaaggtatggatgcaaatggaaatataaaaaaggcaaatcagggctggagagatgactctgtgctaagagcatttagtgtccttccaagggacccacgtttaagtctcagttcctgcattaggtgactcacaaccacctgcagttccagttgtgggat

SEQ ID NO: 27870 - DNA, 1132 bp, Mus musculus
gacagaatggctaatactggtgtgttggttgctttggatggagaagggaagagcactgtgttcactgagaggaaagaaatgctcctgttctcattgcttagccatggcatatccctcggaaataaaccccacggaagctgcattctgtttatcagacttcaaggctcagagcatgtaacaatgaaaacaccaagagagcgtgaagtgggcgcattctctgtgtccagactcattacagttgtgggagtgagaaagggacattgcaaagatgctaatcactaagcggggcatgggggggggggcttttaaaaggtattggtgcttttagttgttaccttctgactcctatctcctatgctgatggctgagtctctacaaaggggacatggatgcacaaggagaaggtgtgtttataaacaacaaggccggacccagtgagagaagatgaaagaaagatgagtcaagagccagaaggctgccaggttcttgtcatgcaatgctctgtcatgcctcatctgcttcatctctagagcctctgttctcctatgtggagtctttatcctctccctgtgatacctgcctagagtacatatattctgtgtactttctctccaccattgtgtgaggaaaaattgacaatgatttggcagtgagctaaaactagagtcagatcctttttcgttgaagtttaactttggagttagaaggttgacaatgaaggggaatgacagtcatagttagatcccctgaaagttgtgtgtttgaagaataaagtctaatgccacacaaatgagttcaagcaccttggttggtgtctctccaaacctactgcctcagatcttgctgtttcagcacacatagtaactgtatatacattagtaatcatacatagcccaagcccaactgggcagcccatagttctcagagtcctgtgcgctccaaccttgtaggtaatcgctgtggtcatgagggactccagagtgagtaactgtacatgcataagtagtaacgcatagcacaggccaactcggcagcccatagatgcacgtagaggttagaggtgaggttgggaggcagaggcttgaagactgaatttgagaccaggggacctaaatggctctccatctctcag

SEQ ID NO: 27871 - DNA, 1131 bp, Mus musculus
cgccacgcccagtgagctgaggctctgctaaccgcttgtgcctctcccgcaggtccactcagcatcggcactggagagctacccggcccaggcagacggctttcctagctatccctccacgccaggaacaccattttctctgcaaacaggcctatcccaaagcgggtggcaatgaattttaaaggggtttattcttcttgggagcaacatgagatttacccaagaactgcagtgaacaatctgacagatgacattggccaatagtttgaaagagttccttagggacacagggacagagacacaggttgtgttttgaaagtggttatatcggaacccttaatctgacccatgtaaataagatgacaataaattgtatcgagaatagtattttaaacgtacttgggggttagtacctcccttcctgtaagctttgaattatgtgaatgatccacatagactattgaagaggagactgaagtctttatagccgaacacagccttaagtctgcttgtattgcctccacagacagaagtgatagttggacctctggctgcatgtgttactattaacccctgcgggggttgctattcttcagatgcatgttagcatcaattggaacacagtattctatatgtatccacaactcggggcttgaggcaactgttacttttaatttattaccaatagtcatatgtactgctgaatttaactgaatatatttcaggaaagtaaaaatggtgcttactatagtctttagaatgactttcaggtgttttcaactaaaaatgtatacccagaactacttacagatctataagtaaaggaggcttaggataatttagcaaaacatttttcataatctcggcagtatgccgacaggtgagtcccaggctaccgctgttcctcattgtaccctgggagctcttggtgaatgtttacagtcatgggatgtctttccactcacacactcatctgaagtgaatgtgcggcagcaagagagaagacgtgtgctgtctgtgtgtgcagtgtgcgctaggacccgtgctggtgggaggtgacccaccatcatcctgaacagtagctccacactgggggagggggagaggggagaatgtgaaccagaggactac

SEQ ID NO: 27872 - DNA, 1168 bp, Mus musculus
aatatcactgaaaaacagaaatctgggcacttttatttttatcatgatgcttctaagggtgcttgtaagaaagggagccgttgtcaatgagacctgtgtctggctgacctagctttagtgccacctaaaactaacacacacacacacactcacgacctttccctgccattcatccctgcatcaaaggtaaggatgtgtataatatttaatgttctttgtatcaagaacatctgaaagcgggtgacgtgaacatctccaggcctctggttttatccacgtcctaagctttcactgtgcacgcttattctacaaaagaggccgatgaatatcataacaacagggaaataaaaactttgacagtggtctctcgaggtcaaaacattggcaagtacctgggagcgtggtgctactgttctcattgattgtcatcttctccacggaaaactgtatcttctgaaatgtcgtttttaaatcaaaggacatttctgtgcatctagacccatgagttgttttttttttctcgcagtgcctaaaatgcaattcaaagagagagtgtacacttgcaacgagaatgacgggcgtgtagtggccatgatctacaggagcggtgacatccagcacaggtcttctgtgagatgttacacgaggcaggggtctgcgcaggtgatgatggacttcgaggaacgcccaaataccgatgtttccactgtcacattcctccctggtatgtgtgaacttgaaaaggttttagatcttttatcatatttatttattttgtgtgggtgggcctgggggaggggcatgcgcatgcccagagctgacatgcgaagtcagatgataagtcctaggaattggaatttctctcccctcctccatgtgtgtctggaggattacactcaggtcattaaatttatggacacagtgccttaagcccctgacatttctatatgtaattaagggcaccaaatgtgcactgacaaatgtgtactccagaaaatgcagtaaaatcaagtttcctgattttccaacaagcgtccaacatgagtttatgcgcactgtacagcaaggcatatacattgggacacattaagtagacagccttagggtctcttcattaaccttttgatttctaatcatctattttattgttagttcagaactcagagga

SEQ ID NO: 27873 - DNA, 1237 bp, Mus musculus
taaggcccagcttgaacatctgaaacctcaaatcccaccccccagtgacatacttcctccaacaaggccacacctcctaatggtgccacacactatgaacctgtggggcccacttttactcaaaccaccacagcactcaaagttaacaccttgcatccacaaagccatggtttcggtctccagtactccagaggtagaggcaggaggatcagaagttcaaggtcaaaccatagctatccagtgatttcaaagccaaccttattcttttccaggtattgatgattataactgatactacaaatattaacacacattatttaaagtaacaatattttggacaggtatttaaaaataaaattatgttgaagggactgtctttgaaagccatgaagacaagttgaataaagaaagaatacttactctttccggtggaggagtctggagacgacgatcagaaatggcaccacgcaaggggaagaaggaaaagaaggaagagcaggtcatcagcctgggacctcaggtggctgagggagagaatgtgtttggtgtctgccacatctttgcatccttcaatgacacctttgtccatgttaccgatctttctggcaaggaaaccatctgccgagtgactggtgggatgaaggtgaaggctgaccgagatgagtcctctctgtatgcagccatgttggctgcccaggatgtggcccagaggtgcaagaagctgggcatcaccgccctgcacatcaaactccgggccacaggaggaaacaggaccaagacccctggacctggagcccagtcagccctcagagctcttcttgctctgggatgaagattgggcggattgaggatgtcaccccattccctctgatagcactggaagaaaggggggtcgtcgtggtcgccgtctgtgaacaggacttctcattattttctgttaataaattgctttgtgtaagcttaaaaaaaaaaaagaaaaaaaaagaaagaatacttaacaccaaatagaagagtcaatagaagaaatgaatggagcttgggaacttgaggactttgggtagctttccatgggcagcctggaagtctgctttgggctgagagcagatttgggagggcagtacacttattttttccattctatttgcttccctacttcctaccccaaatgttagcctttgtctccattctgacagctgctccattcttttttttttaatccctgaacactattttttta

SEQ ID NO: 27874 - DNA, 1136 bp, Mus musculus
aaatgtttattgtaccttacttatttgctgcactgccataggcagcttagtacttctacaattgctgtaataaattaccctggaaatgtcccaaggttaaaattcaattctggaagaatctgttttcgctgtttatgaagtgtgcttacacatcagaaacaaggtactttaaaaagtaacctggaggtgaccacttgccctgctctccttgctgtcttggcctgactcccatcccttcctggtaccagtggaccaatattcttgcatctctcttcacactttctttgctgttatcatgggtgaattccattcctaaggcctgcccctcatttcatttctaaatgttacccttctccgtggcttacaaccataatttcccaccagatacagatcacaaacatgctgtgttctcaacttgaaaacctctcctgacctcattgtttttctcagctgctgatttagaggtctccttatcacttccaagcttgtctgtgatctcctttttatcatctttctttgctcacctatccagcactccttagctgactctaccggtgtggcatcattagtcactttctgtttgaatttcagtcagttagtatacaggtggaatgttgcatgcctttcatcccagcattggggagagtcggaagttaaaggcatcttcagcttcatgttcatttaataagtaaagtaaatagaaaaatgattacagggaaaacagtttacacatgtgtggttggttgtttggggaatattgaatggatgaagatactgccaatagctggatgtttaactgagttgattaaaagagggttgttctcattaatctcggctagagaaatagctagtggttggccttaggtagcaggttatgtgctgtacagagctttaagggcaggagtgattagaataactaggcgggtgtaggtaggtattggtatagtacgctcccaatggctaacaacagaatggtaaaaggtgcagtgttggcttaatgtaacattgtaaatagtcattgtcaagattgtgattagtagatcccgagcataaatagaagtgctttaaagaaagcgtgcacacaaggaagtagctcctagattaactgttaggattgggtctggttgattaaaggt

SEQ ID NO: 27875 - DNA, 1109 bp, Mus musculus
ttactgagttccagttactctccggccaagcacatggcttacagctgtgatgtaattctgttccactctccctgtaactctgaagggaaggtgccctccttagccgaggagacagctgatgtagtgtactcggggaggcttgctaatcatcagcccaggagccaggactcaagtccttatcctcaccctggtttgctgatgatttaaaaccagaccactgcggtgctcatccgctccggtcctgaccttgtgctcccagacccaggccccaggaatcagtaactgcacccatagtgctcagcttctgcggcaccatcctgttcagtgtgccttcggtcccatgccatccacactggaggtgcaccgggccagcctcatgttttaagagctgtcctcaatgtctcagggatgctaaatcatttctcttctgcctctgttttagcgctcttacttccgtacctttcttatgtacggattccatttcctggtgtggttcctctgtgtcaaaggaatcagggacacacagtgcgggttcaaattactgacccgagaagcagcagcccggaccttctcgtctctgcacattgaacgatggtaggtttctgactggaaggtgtatcgcgttgcctcccgtgggcatccagacaactggacacaggcttgtcatctcccaacaaatatccagatagagccagattgaaacgtttgttatatgttcatctaagcacaggctagagtgtaccctgtctccttaatcttctttcacctcttacactcccttcccggaggtaggtctctctctgcagtgtggccgttaattactgagctcgtgtgtgtgtgtgtgtgtgtgtgtgtgtgtgtgtgtgtgtgtgtactctctctcaatctctctctctctccccacccttcccatcttcaagcctagccttttccattttttttctctcctgtgttcatccttcctatcttccttcagatcctgtccattgaccctgcctatgtccttcattgaccttgcctatgtccttcattgaccctgcctatgtccttcagccccaggcccatccactccagccacagccttttcttaaaagaggtccctacagcta

SEQ ID NO: 27876 - DNA, 1183 bp, Mus musculus
accactgggctcgtggagagagatagactgctccaacttgctcactttagtagcctttggtatgtttcttcccaagacaaagttttattccaagaaacaaagaaagaattggttgaccatgaaccatcttattttctcctctcttcgttttcgtttttgtctttattaaaaagtctgttgtttgagaatgacacatggagggactcatggctcccgccgcaaatgtagcagaggatggccttattggacatcagtgagaggagaggccctaggtcctgagaaggctcgatgccccagtgtaggggaatgtcaggacagggaagggggagtgggtggattagtgagcagggggaggggaataagatagggagttttcagaggggagactagaaaaggggataacatttgaaatgtaaataaagaaaatatctaattaaaaaaaacaacagaaaaaatcagaatctgcatgaatctaagtatgacctaagtatgacttgaggtgagttgacttggggctgctgttgctgctccaagacaggtccaggctatgcatttaagaagaggtcactttctgctttgccttgacctcatcattgaggaagagctgggaagtgctcttctgagagctctcctggattccgtttccacagtgacacctctcaggacatgaaacagggctgagtttacttaccgccagctttatacactcaccactggataaagcgtttgccagggaaaaacttcaatagagaaatgagaactgatgtaaccaaattaaaagcatctccaacgttacacatactcaattgtgtcagggaagaacaatggatcaaatttggggtgctgtcattttacatttaagaagcaatctggaaatggcactcaatttgtaatactagaaagacagctttcaaagcggaagacgtttcactgtaaaactgaaggaagacacagacttttctgctttattttccaccactgtccaaaggccacatgggagactgggagtttcacccacagcttcttggtgttttctctaagctgttctatagacagctgaagcttcctgggaagaaggtgaccttcaggacagttaccctgacaggaaagacctttgttatgacagcatctctagacaattgccagctttgccaccggcatcctggtaccacagtagtgttcc

SEQ ID NO: 27877 - DNA, 1158 bp, Mus musculus
ctgcaatgttcctcttattcgctagctcttctgcctactaggaaaccaaaatggccttgcgatttaaacggaagaaatgcttctttaagtctttatgactgaggctagggaattttttgatagaatgaatttttatgaattctttgagaattttgtacatgcataaatgtgttttgattgtatccccccacactccccaactcctcccaggtccacacctccctcttccaacctcatgttcttttgtgcgtttgttttaaatagtccagtgtgtgctgcccgtatgctcatgggtgtgggaccatccactgcaggttggttcatcctccagggaccatgctcctcaagaaaactgacatcttgttccccagaagccatcaactgtcaatagccccccagctaggccgggggcttgtgagaccctgcccactgcaggctggggtgttgactggtttgatcctgtggaagtggcctcagctgccgtgtgtgtaagggtcctgtcatgcccagaagatgtgagtttatccacgcctcctggacttctgactcttggccattccactccccatcctccatgttccctgggctttatggaggtagactaaggaatgttgaactatgatttgtattctattaaaatttgaattgattgttactggcactaagaaatcacttttccatatctgcttctgtaaggttttcctaaatttctagaaagtaaaacacaaacattgcacttactaagtgtaatatatctccactcagtcattacaatttatactgaaagccagaagtgatgggaggagcctgtccataccacagggaagaatatggaacccttggtggggagccccaacttttgcagaatacaggacagacatttgcccattttcttttaagttacaaatatgtaattaaatactccatggtattttatttctattaattttaaaaggttgatattggtttttatagttttggcctattgtaatcatttctgaacctgtagttgactagcttatgaatttcatttgaaactggttaatgaatgtgctttgagaataaaatggtttttgaattgctgggcctcagatgtattcactggacttatatttcaggaatacagaactaatgtttttttttttttccttatagcct

SEQ ID NO: 27878 - DNA, 1463 bp, Mus musculus
ggacaactcttgggaattgtttcttcctttcttccctgttgaggcttctcccttgtctctgctgcagtgcactccgggccatgagcttgcagccagttctcgcgctgcctcagccagcatctttcgtggattccgtgcggcgtcagcttcggatcaccaggcctctcagccacctgctctgccatctccacagcctcacgacagtagttacttttaagaaacattaatatttgaaaatatgtaggtttggttgcctgaagttagctttattaactttcatgatgcagacatgcatttgtgacgttgtaagaatgggctaaactcaattaatgtgcacttctccctccaacagtctgggtcgtattaacggtccatgtgtggggctcatattctagatcacatgccgggcacagttgttcagttgaggaagaagggacaaagaaagatacttgaaatctgctgcccccgttgtctgataaatgtgctagaaccatccaaaggtacctagaaagattgttgacgacagtgagaaccttgtgttctcaggcatcttcatccatgttgggatttccctggccagtgagctgcaagcagcgcagcctaagtgacccacacacacattaattctaccaaaaagtaattgtgacgttactgtgaaaaccatactacaaagaaggcccatgtgggtgtaagcttctacaaccaggcaggccagcacgcacggctcctgcagcctggtgattggctctgtcattgatttctgttggtatcttttctagattggcatttgaaagagcccccttcttccatcatcatccaaactaagataagcaggctataaggagcggcagccctgccctcttggcgatgtgggtagattgctgtgctttccgctgggtttgcaggcttgtgagtagaatggcagccaggaggggcattgctttccttgctgaacccacacatttctgtccttgccttaacagggtgtttgagcaactgttggaaacaaggggagagaaggatggctgttttatatttcactgaaatgttcttacacaaacattttattgttaaagtgtctaggtttaccctgcaatccattgttttgtttaataaaatgttttctcttttataataatagtgtgcaaggaatctgatttcattaagcttttgagaaacttaataattactttggctttttttctggttataaattctttgaagatgccaaaatgacaaactctgtggatttggggtgcacggtgtgaaggattgtgtccaacaaaggttctatgcctcttactggcataatgagtgtcaatagtcccagctgcagttgcttcgctattggaagagaagttgttgagatgttttggattctgtaagcaatgttccatccttggctggcctcttttactgctggacatgatgcttgaatggggcggggtgtttcccggtcaata

SEQ ID NO: 27879 - DNA, 1099 bp, Mus musculus
acccaaaacctcctgggcgagttaggtaagctggggtatcgggcctctgctaaaaaggctcagttatgccagatagaagtgacctacctaggatatgtcttgagagatggacaacggtggctcacagaagccagaaaacaagctgttatgcagatcccggccccaaccactgctcgccaggtaagagagttcctggggaccgccgggttttgcagactctggattcccggatttgccacactggcagctcccttatatccactaaccaaagagaaagggaaattcacctggaccagagaacatcagctagcctttgaaactctcaaaaaggcactgctgcaggctccggcattggccctgccagatttaaacaaacctttcaccctatacattaatgaaagaaatgaagtggcaaggggagtccttacccaggttttgggaccatggaagggcccggtagcctacttatcaaagaaactagacgctgtggccagtggatggccctcctgcctgcgagcgatagcagccacggctgtgctagtaaaagatgctgacaaactgactatgggccagaatgttactatagtggccccacactctcttgagagcatcatcaggcaaccaccggaccgctagatgaccaacgcccgaatgacgcactaccagagcctattgctgacagagcgagtaagttttgcacccccagccattctcaaccccgcctccttactacctgaggctgacgaggcccctgcacataagtgtgaagaaatactggcagaagagactgaaatccggccagacctcacagaccaaccttggccaggggcgatgacttggttcacggacggaagcagctttgtggtagaaggtaagcggaaggctggggcggcagtagtaaatgaaaaggctgtcatatgggccagcagtctgccggagggtacatcagctcaaaaagcggaactaatcgcattaattcaagccttaaggctggcagaaggaagggctcttaatgtctataccgcttttgccacggctcatgtacacggagcaatataccgacaccgtggactgctgacgtctgccggcaaagatatca

SEQ ID NO: 27880 - DNA, 1218 bp, Mus musculus
agtgctcttaaccagtgagccatccctctagccccaaagggtgtttcttaaacagccagtcacctttccatctagagaactgggagcagaagtataaagctcataggaagttcaggagccaaattgtctctagttgaagcacaatatgcttttaaagattaatcttcacatatgacagacgtagtactgagtatcatgtagtaagtaatatatgagaaaaccagttcaagagataaccagagctagttacaccataactaagaagaccagttactgggttagtacccacagcattctcgtgctgtatgaggaagagctgttggtagaacgttgttacaagtacttgataaaacccaggttcttacctacagcccctatctcaggaaaagaactgcattagcacaccaacatgagaaaatgagactttatggataggatgtgagttccctcacttccagcttggttctcacagtagcttctcttgctggaagagtagagccagcataccaccagtggtaagagaaagaatccacctgggaagcccttacatgcactctcaaggcccaagagtcaggtttttatgagcaaatactcttcacaaactctgaactcaatttttactaaagcatcctccttctgctaattacttctatacacacacacacacacacacacacacacacaagtcttttcactagaaaattattcataatcatcttgtggtcctggttcctggtgagccaggtgcctatatggtaggcacttagtagatggtagattagataaatgctgctttgagcggcagatattactaataggaatttcccaagcaaacagggagagctattatagaacacgatgcattgaaaacatttaatacctgcttattttaaagtttgtgtagatttcattgtctagggcagttttatctttatggagaattaaactgatacacagagactcttttctttcggtaaagagcaaagcatgaagcctgggtcaaaaaacaacagacttggtgtcctctctgtgtacagatttcctaattcaaaagtgtatattagagaaagataatttggatgtaggacatagaaacacatacggagacatttgtagatgacagcaagctgagtgagtaagtcctagaactaggaggtctcctgggctggttgagctggctgcttttctcggcctcaccgtctttctccattttgccat

SEQ ID NO: 27881 - DNA, 1157 bp, Mus musculus
cgagtccactggaagcattgataagcccctgcagtccattggcaccgagaacaccgaggagaacaggcacttctactgtcaactgctgcttactgctgatgaccgtgtgaatccctgcatttgggggtgggggtttgatcctcacgagactctgtaccagaaggcagatgatggacgacccttcccccaagttatcaagtccaagggtggtgttgtgggcattaaggtagataagagtgtggtgcccctggcaggaaccaatggtgagaccactacccaagatctggatgacctgtttgaccgctgtgcccagtataagaaggatggagccaactttgccaagtggcgctgtgtattaaagattggggaacatactcccttagcccttgccatcatggaaaatgccaatgttctgacccgttatgccagcatctgccagcagaatagcattgtacccattgtggagccttaaattctccctgatggggaccatgacttgaagcgccgccagctatgactgagaaggtactggcggctgtctacaaggctctgagcgaccaccatgtctatctggaaggcacatttttgaagcccaacgtggtcacccctggccatgcttgcacccagaaattttccaatgaggagattgccatggcaacggtcacagcacttcgttgcatagtgccccctgcagtccctggggtcactttcctgtctggagggcagagtgaggaagaggcatccatcaacctcaaggctatcaacaagtgtcccctactgaagcaatgggccttgactttctcctagtgccgagccctgtaggcctctgctctaaagacctggggtgggaagaaggagaacctgaagagttcaggagccccagaggagtacatcaagtgagccctggacaacagcccaagtgaccagtctggagacgcagccagtgaatctctcttcagttctaaccatgcctactaatcagagctgatctaaggctgctccatcaacactccaggcccctgcctacctacttgctattgaagaggggccttcagtccctttcctatcactcttgctgccttcgtgtgtgcagtgttgtctgtgaatgctaaatctgccatcccttccagtcactgccaataaataactatttaagg

SEQ ID NO: 27882 - DNA, 2850 bp, Mus musculus
gttgcacagatataaaattttatgggcaaaatactcataaaaaataaaatttagttgagtgtaatgatacatacctttaatcccagcactcaggagacagaggcaggtggatctctgtgagtttaaggccaatggtctacatagtgacttctgggacagtcagaagtacatagtgagaccccgtcttgaacaacaacaaaaatttaaattaaaaaaaaaaaaaagaacttacaaggaggaaataacctggtcacccttcattctattacaggtgaaaattccggtcagacacccatgaccgtcaatccccagcagacccgcttccctgatttcctggactgccttccaggaacaaatgttgacctcgggactttggagtctgaagatctgatccctctcttcaatgatgtagagtctgctctgaacaaaagcgagccctttctaacctggctgtaatcactactgttgtaacgtgatgcagctgtgagctgacgcgagtcttgggccttgcggaccaagtgatgaggcagagcgggcctgcagctgcaccacgttctgcctttgtactcacactccttgtccgtgtggccacttaatcattgcctggtgttgattcgcaggaacttgcgttacacagaaataaatactctcttttcattttctgcaagcctgcatttctgtggcagataaagcaggatgggttgtgcagaatgactttagagaatgtctgcagccctatggctgggttttattacagttagcttaaattcatatatcaactgattctaagccatacaaagctgacctcaggcagtgaattctgataggcagcttggtccaggaagtgatttacagtttcaaaagctgtattgataacagtagtaacaaatgctttaaaacttatttaacttgagcttcaaaaaaaaaaaatcattgtatagatagtaattttctcctgtagggaatacagtgtagtttggaatccatgctggctctgatggcttctctcattctgtgtttacaagggcacagagtaccaatgttgccaccgttcatcattttcctgcttagcagctccattctgtgagcaggagagtaacttcaacatctgtcacaattcttgcatgacagatcgtgtgaaagagaccagtttggtcacaatatgaatgattacagaacaaaattgttttgtttttttttaattgcagcttggtttttttttcaaaatgcagcttagaatttgatgtttgttatatatatatatatatatatatatatatatatatatatatatataaactctgtaattttgtagctattacagagggtagccaaatgtttttgataaatcagtggcaactatatttttatcttttggacctgattctgaaaacatcaggccaactaggtcgcagcctgatgaaccatgaattttgtgtgctgttttgtattctgaggcattattaattctgctttcaagatttcaagtgtttaaaataatcctgtctatgaaactgtttgaagaatgaagccgatctctgattaacacatacagaaaggccctcgtcaggacatgagctgtagatttgtacgtctgaattcagtaaaattgtttcctaagtatactatcctaatccttttgctaaattggtaagaaaaaaagtccaaggtatgtactcaatgcctcttatgtaaccaacatattatttgtttcgttagcttttaaggaccgagagcttcatgttcctctggcaggcaggccgcctgcacttggcaatgacgtccttagctgtttagtattttgaactgacattatttataatctatgaatttaatctctttttttaatttttattttgaaagacatcaagaagctggaaggaagcttttagttgccgtgagggtgaaggcttctcggttgaggatcttcagtaagatcccttttgatccattgaaatagaaacgcacagagtacatttgatcttggtgggaagaggcaagttgaaaggtcagaggcaaagtagcagagccagggaaggtggcggaaaggccaggtgatgtgaaattaagtagacatgtcagaacccctcaaagacaaggcaagcaagacgtgtgagaagtgccccaaagtgctccgctgcctttatgccaaaagacaccgctgttagagagaagagggtcagggtgcactttactgggaagggcagaggaggaaggagtggggctgtgacattgtccatgtattggcagacgagaacatggactgctgttgctttcagcactcttaaagtgatctctctttttctgaaggaaccccaatttatgtccacgttaattccttgctctctctctgagcacttcaagagagacaagtaggaattttttgttgatactaggttgaaagggagcactctttcgtttcctcttttgttagcaaaagttgcaaaaaagagttgtacattctttctgaggaaaaccaaaaacaagccaaaaacacaagggacctaacaaaacttgacagtgttactatatttaaaaatatttttatagatgcattgcaggttattaagtgtaaaaaacaaaagatactcctttttttaaaaaaaaattagttaagtcatctatgatttatgttaccaagttttagaagcaattttctaataagcttgtggcattatgaaatactagaataattttcttagtaaattagtttaaaactttttaattaatatagtatttttctagagtgaaatatggcccttgactgtttactaatagataaagccagatattataattgttgttgttgtttttaagaacataaaatatggtttgttacagaacactaaa

SEQ ID NO: 27883 - DNA, 1227 bp, Mus musculus
ttatttctgtccttgagtctgtgtatatgttgtagtacactgattggttgatttatgtatgttgaaacttccttgcatttctgcagtgaaaccaacttgaaaatggtgtatgatttccctccctctctctctctctgtgtgtgtgtgtgtgtgtgtgttgtagtgtatgttcttgagcatgctcttgcacatataacaagtgttggccagaggttgatattgagagtcttcgtttgttgctttattatgattattgagacagggcctctcatagccagtgagatccagcacctccctgcttctcaaacctgcttacagacccttgctgacacaggagtcttcacgtgagtgctggggctcctacctcaaatcatctgctcgtatattgagaattttgctgacttgctatctccccaccccccttaatgttttagtttaatacttttttaacattttatatattttcatgtatatggatgcttcacctgcatgtatatctgtgtactgtgtgagcagtattcatggagacccgagagtgcttcagatcctctgggagtagagttacagttgtgagcgaagacataggtgctgagactcacacttgggttttctgaagaggacagcaaggtactcttaaccactgagctctctctccaaagtgattttaaatttgtgttgttattctcagtattgttactgtatggcaatattacattggggaggccagaaggctctgttgataatgtgccttccatgaaagcaggtctatccaagttccagtatccagcacctgcatgaaaatcggtgttgcataacatgactgtcacctaggtgagggaaagacaatagatctctgaagctgatgttcagccagcgttgctgaaccagtggtatctgaaagcgatcatgctgtcttgaaaaataaaggtggagagcaactaaggaaagatacttgacatcagcacgcatgtgtgcatacatacatatatacacatgtccatacatgtacacccacatctatatgagcactcccacaagatactaaatagaaaattagaaacaacagccaccctcctatgtatgcattaaatggaactatgtgtatatcatatttagcatagtaccaggcttttttttttaaagatttatttattaaaggtggtgtacacctttaatcccagcagtcgggaggcagaggaaggcagatctcaaagttcaaggccatcc

SEQ ID NO: 27884 - DNA, 1168 bp, Mus musculus
tatattaatagtcaatgccatatctctgagctcgcaattgcttaaattgttcatccctcagatactattaattctcaaatttacaattgcttatgcatatttctagttaataaataaattatgcacatgtgactcttaataactttgcaagccttctagttacaactgctccttaagaaaattgattaaaagtgcaattagtcactgcccctttacagccatgtatttaaaatattttgtcaactagttattaattcaaaagtttaggtattataaaattttaaaactttaacttcttaaaagacaaaaaagagagaaattgtatccccgtacatactattagtgcattcccatgcacactattaaagtcttacctttattttcaaaatctaatattttaatgtcaaagagtttaataaatgctttatagtatcttaaagggatctacttattggcttatagattaatcctaaaacaactaccttattagaaaagggaaaaacaggttttctccacaaaacgctgcagaagcatattggtaaattcgtgtgacaagctggtaggtaagttgactcatgtcctgattaaattgactaaaaaactaaattaaattcatgttttagatccatccttacttgtcatttttccagtttagactagcttctagctttttaactttatggcaatagtacatcagagactgtatattcagacttagtaaaattagtcatttaatagagtcataatgatttttctcctttcttcagtgtgaccagccattctaactcaatcttagactggtcctaatattcagtccaatgttagagattcctatattctaaattacctagcaagttaattcagagcacatcccccacatcccctagatccctaacctcagaaagattgctggccttacagctagtggaaaaagctattaaagagcaattggtcacttaatacattggtaaaatagaaggaccccctgactaacgaatagaagggtccagatccagttctaatttggggtagggcctcagtttgtgttttttcacgagatgaagatagcgcgcagtggctgccagataaattaatttgttagatgaacacagattctaaatcttctaaagtatcaccttgaggactaaaattcctcttttgcttaaaa

SEQ ID NO: 27885 - DNA, 1435 bp, Mus musculus
atagacagatgtcccatgctcatggatttgtaggattaacatagcaaaagtggtcatcttaccaaaagcaatctacagattcagtgcaattcccatcaaaatccaacgtaattctttacagaccttgagaacaatactcaatttcatatgaaaacacaataaacccagcatatgtaaaacaatccagtacaataaaagaacttctggaggtatcaccatccctgatctcaagctgtactacagagcaataaaaataaaaacctcatggtattgttgtaaaagcacacatgttgattaatggaatcgaactaaagacccagaactaaatccacacatgtatggacacctgatttttttaaaaaagaagccaaaattatagagtggggaaaaaaagcatcttcaacaaatggtgctggcctaactggatttctacatgtagaagaatgtaattagctctccctttctccggcggccgggaagatggcggacattcagactgagcgtgcttaccaaaagcagcctatgatctttcaaaacaataagcgggttctgctgggagaaaccggcaaggaaaaactccctcggtactacaagaacatcggtctaggcttcaagacgcccaaagaggccatcgagggtacctacagagacaagaaatgccccttcaatggtaatgtctccatccgaggtccgatcctgtctggtgtcgtgacgaagatgaagatgcagaggacctttgtcatccgcggggactatctccattacatccgaaagtacaatcgctttgagaagcgtcacaagaacatgtcagtgcacctgtccccctgtttcagggatgtatagatcggagacattgtcacagttggagagtgcaggcccctgagcaagactgtgtgattcaatgtgctcaaggtcactaaggctgctggcaccaagaagcagtttcagaagttctaaggggactctggccaatgccctagaacaaataaagttattttccaacgtacaaaaaaaaaaaaaaaaaaaaaaaagaagaagaagaagaaataaatgggatatagtcttgaacgaattgacacagaagaaaatttcctggaaaacaaaacaaaacaaaacaacaacaaaaaacaccagtagctcaggcactaagatcaacaattaataaatgggacctcatataactgaaaagcttctgtaaggcaaagggcacacaccatcaaaaggacaatgggagcctacagaatgggaaagatcttcaccaagcctacattcaacagggggctgatatccaaaatatttaaaaactcaagaaactaggccccccaaaatccaaatagtgcaatttaaaaatgggtacagatctaaacagagaattctcaacttaggaatctattatggctgaaaagtacttagagaaatgttcaacatccatagt

SEQ ID NO: 27886 - DNA, 1099 bp, Mus musculus
acctggaagcagaggtcctgaaggatcactgttcactggcttgctcctaatggcttactcagccaggacaatcagcttaggggtggccccacccacaatgggctgagccctctcatatcaatcatttgttaattaaatgccccacaggcttgcctgtgggccaatcttataaagacattttctcaattgtggttctctcttctcagataactctaacttgtatgaagttaacaataaaccagccaggacagtctgtaattcaagatgcttaaaatacttaattaattttagactatttacaagcctcataatacatcttgacaatagctaaaatgatttggaacatggtaggcaagcatacataggacttgtagaactttaaattcaaactccagaccattaaatcagtgtggctgggaatgtctgtaatgaattccagtcttgttcttataaatagcatttttattctaaagtgttaatttttattttattggaacttcctgatttgcattttcggcttgtttcttcttgcctggcaaggtatttctgagcaatcgaacacgttaaatcacaggagattgtttgttttgtcatatggggaaaaatgtatccacgtcataggcatgaaaaaaagaaaaaccagaatagatgaagtataagcttctactgaaagatattaaaccgctctattggttaaagtgagttatggagcagtctggcctatacacccagcactgttagatagtatgtctgtgggggtgtggttgtgacataccagcagatcagtgtctcatgtaagtggtaccattattgtagcgcagagggtttgtggcccaaactggaaaattattttcgagatggtcttttgctaaaagagatgatcaaataggttggtcaaagcctgatgctgctgctttttttttttaaaccaatgctattatcatttaaatattttattcaaagctacaaaaatgcatttaaaataattgatcatcttctattctgctgaaaagtgatacttgtattctagcaatcctagtaagttttggagggtatttacaatatttgggaggaatccctgatactgcttatatctgtt

SEQ ID NO: 27887 - DNA, 1170 bp, Mus musculus
gaagccttcacctcagttttagcttaatttcctatgtaatatctatgaccaaagtgtatggccacgtcagcaatgaggtcatattaacaatgtatccatgataggcaaccaacagcagtggaaatagcctggattactttggagacctcaaggatacccagctaatgactcagaggacagtagctcatactggctctgggatttgtacataatccatcatatggcttctgagagtggcttgttttcactgtggagagtacctccattcaaactttaaaagcattttaatgtttttatgcatgtatatattgtttgttgaatttacttgcctttgtaacgccttcactcctttctcatgcctctccccctgcattgctccttagacccctttatttcaagtcttatgtatatgtgtatattcatgattttgtatatctatataagatctaggaaccagaagtgacatgtatttgtctgtgattagcttactttatttgatataattatgtgtagctacataattttctgaaaatgctgtaacttttattggctaaaaaaggtggtgtgtgtgtatgttacatttttcttatccatttctcagttgttagctacctacattggttttatacttcagctactataaatattgctgcatttaacattgacgtatgtgtttctctatgacatgtatgacatgtcaacttaaagtcttgagtaagttctcaggacgactatagatggatcgtgtggaagataagtgttaggctctcctggaaacctccatattaatttccataatggctagatagtttacattcccactagcagtgtgtaagacctgccagtgtttgtgattattggtttttttaatgactgacattatgattgtggtaagatggagtcccaatatagttttgacttgaatttctctgatggtttgtgaagttgaacattttaaaatggtattagccatttgtatttactgccttgagaactgtcttttcatttttttaacctatttattgattgggttgtttgatttcttgtatagtttttgaacttttaataatctaggtataaattctctgtcatatgtacagctagggaagatgtttcaatcattgtgtaggctaggctattttttttccccacagaagtagctgtttactg

SEQ ID NO: 27888 - DNA, 2206 bp, Mus musculus
gaattgttgtactgaagatgtatattttgcttcaacagcttatcattgcaagtgtgtagatccctggctaactaaaaccaaaaagacctgtccagtctgcaaacaaaaggttgttccttcccaaggtgactcggactctgacacagacagcagtcaggaagaaaaccaagtgtcagagcacacccctttacttccaccctcagcttctgccaggacccagtcatttgggtctctgtcagaatcccactcacatcacaacatgacagagtcttcagactacgaggacgacgacaatgaagagaccgacagcagtgacgcagacaacgaaattaccgaccacagtgttgtggtccagctgcagccgaacggtgagcaggattacaacatagcaaatactgtgtgactttccggtggttggttgacttcccttataatgtttatttgcgcatatgatttgattttttgctccttttagaagtttctgtagaaataacttattttttagttttctagtgtaatcaagttcctgaaacaggctatttgatctctgatacttatctccaatagtatacagccacttcactaacaaagtaacagattggtgctgtaactcaggcatcaaattagctctctggggatgacaaaatgtagccaggacactttaaaaatcctcagtatagcttgaaatgaagacctagatcacagtctgcaaatgtcttacacatgaagtctgctatggtcatctagcatgagctaaaacaactctcactttcataaaagttgcctagtgtggttgggttggtacaagtctcttctgatagtccctctatgttatgattaatgagtggcaacaggcagtttaggatttttcttcataataccacagagaaacttatgtcttcttcctttctattcccaagtagtttttcctcataggaaaggtctagtgtagacttcaaatactttaaggttttcaaaaccactatagtgttatgagtttgattccacgggaatgtctctggaccttactttccatatttcagtatccttttgtgttgtgattttaaaaaatgttgcataaaaataccaaatttcagcaactgttaatattgagatcacatacctcttcataaagagcatcttatgctaattagccctgctgaaccatgtgcagaggaaattgttcaagtattggatttgaaaataagtgcttttgtttaatagacctaatgtattgaggcaatgtattatgaaaagcaaaattatataactctgtaactatgtagaaaatatacttaaatataatcagaatgctaagactttttatatggccttgtatgatgagagcttcaatgttaataaatgttttccactttaaaagccaccaagtattgttctggtgaactcttacattaaccttatatgcagggtgctataaaggagaatgatggagtcatacaccaccttaagatgtgatacaaggttacttactaattacttacaagcagtcaggtttatccaccaaagttagcactgtagccaaaatcatctcctaaatagtgtgaattagggaatttggttgtaaattgtgacacattctttacagtagatgcatttagtgacttagtgacgtggaaaattgaataaaatcatgtagtagaataagtatatcacttatatgagcatttcattatctttttaaaatgctgtattttaagagaaatataacactaggaaaagaaattttaattttgaattgtttcttttaaaaatttatactcagattgtttctttgttgagttttttgtttgtttgcttgtttggtttgtcagttggtttggttcggtttattgagccaaggtttctctatgtagccctggctgtcctggaagtcattctgaagaccaggctggcctcaaactcaagaaatcctcctgtgtctgcctcctgagtgctgggattaaagacctgcactaccactgccagctctttcttttcttctctttttaaagatgatttaccatagtaataaagcaacatggtactgacacaaaaatatacacagatgaacagaccaaactgaggacccggatataaagctatgaaattatagccacctgatttttaacaaagatgttacaaatacacattggagaaagggcagcatcttcaacacatgggctgagaaaactgggtgtccacatac

SEQ ID NO: 27889 - DNA, 1721 bp, Mus musculus
gttggtggggaaaggtgtctttctttctgccccttccccttaaataattgtgttcatttttgttttgtttccttgtgtactccagcattggttatagtcatgggaaaggaaggtgtccacgcaggcacaattaacaagaaaacatatgaactcgctttatacctgaagaggtctgtaaccaacctttatctggcatcataattgcagcacaataatgatttgcatgatatcttgaaactgggggaagggggcatgccaagttgggcatcacttcgtcttagcagttagtggattactgattactaaaataggttaatagtaagcaaggtgccggtgtacagtctctaactcgatcagtgtcttttcagcactttggagcatttccttggctcatctagtcttccttttgtagcgcatggttgggaggaaaaagtgcatgcctctgtacgtcacacctttctcacccctccctaccaacacgaggtgtttggtctgcttccattctcttctgtgtagtgcctggtttatttaactaattaatacctcctctgttgatgagctattgagagttgcagtgttttactttttaatacagtgactgcacttgggacagactatttgtagtgtctataggacatgaagcgtgcagcttggagagcaaaggcacttcctcccacgaccttactgcagtaaccataccgatcaaattcccagggacattctgtcattgcagtagctcagacctgtcttttcttgcacaccagctgtgctcttgagaaaatgtaaaggctgccattatggatattaggtatcccaacataaccatctggagtgtgtccagtttatttttcataggaccaatttttatttgcagcttaggtttttatatgaagttgcattattgtggacttggctgtcttgtgatgtatttttttcatatgtatcctgtgccatactattgttaaaatgaactgttgctattgtgagatggatttcctttcgaatggcactaccttagggacattctagtattgcttctattgtttgggcattgtggataatgtacagatttaaaaacaaatcttgttgctgatttgtccatttctttccctgcactttgttacatctgggatacagtctaactcatctgacttaatatgcatttaaaaaaatgccataactattaaacaccttgtttacagacagatgaaataaatttattccaaccaaatactccattggactcctgtttttattataaatttttggctttgttgttattgttgatcttggagggtagaggggaggtatttgctgtgtagtccttgttggcctttaactcaaagtactcctgcctaagccttcagaggcagctttagctgacaagggactctgagggaaagaccaaactcatctgcaagcacatgaaaggccctacaaatttcttttcactaagctttggcctactaaatgtggcttttgtgtcttcattttatgatcatcctcagacttaatgtgaagaaaagtaacctgctagggaataaatatatcacgttggcctctcgatgagaactcagtctcataagcacgaggccccactggcaagaagagtttctggcaagaagactccattatggagggttcttctggactgaagtgtcagtgactgtagatttgtagtctgtgttggcagcctgatgtcagccaggcagtctcataaa

SEQ ID NO: 27890 - DNA, 1100 bp, Mus musculus
tgtcagccggccggagtggccccagctgctctaggaggcgtggtgcagccaggctccgggcttactggggttgggcagccccagcccgtgcagcctccgcagcagatgggtggcagtggtcagctgccagccgtgcctggtggtcctcacaccgtggtgcccggagttccaaacgtgcctgcagcggtacccgttccaagcgtgcctagtgtgcccaccacttctgttactatgccaaatgtacccgcgcctctgggccagtctcagcagctgagcagccatacgccagtcagccggagcagcagcgtcatccagcaagttggttcacccttagctcaaggcacacacagtgcaccaacaagtctaccacagtctgacctaagccagtttcagactcagacccagcctttagtcgggcaagttgacgatactagaagaaaatcagaacccctacctcaagcaccactttctctcattgctgaaagtaagcctgttgtgaagcctccagttgcagatgccctgacaaaccctcttcagttaacacctatgaacagtctggccacctctgtattcagcatagctattcctgttgatggtgatgaagacaggtatgtacatttttttaaattttgaatatctgatagagttgcttgccccaaatatcttaagatgcagtttggggagtttgtttccacttagggtctttatttttaaaacttaaatttggtaaaaatcaattcaaagttttgaagtaaggagacaaaagtcacgggatttttgttgttgttgttttgtttttgttttctttttaagcaattaaatggatagtgattcaacatgattgatgtatttcagcttaatagtttgaagatgagagctggtattgcccccccccccttcagtaagaaagagggtccctttctaaggtagtaaattactttttaatgtttatggtagagttttgcctgagttggtaagactgaaaaccagaaagccttttcctgggggcagggaagtgatggaatagaagcagtctccatcagtgaatttggaagactggagagaatgataaaatgtgaagtctagctttgactatccct

SEQ ID NO: 27891 - DNA, 1638 bp, Mus musculus
gtaaatgcaattagcttaaattttggaatcttatggttttctatagctatgccctttttactcttgaattggaaagcacactccattatagggacatgtaactgtcctataataaggtgcttttaaatggtcacctacacggcttagttttaccacaatcattgtcacctaaaactttttaaaagcttctagggcatattgtaagtaaagatgcttacagctgcatctgtttctaatgataatgtttctgttacacagccttgaattttgcatgagtaagtatagtcacctagggtcccattcgagcctggattgaacattttctaacttaatcaaagtgattgcagttccactaaaagctatcatggtgaaatgaaattagagatggtttgctgatgtcatactgatcagaattatcaaagggtttactgtgtagatacggagaaagacaagaactaaatgccttgtcgaaacatgtggagtcccgtgtgccatatgatatcttagcatgttaattgcacttttaataccaaaaaggcacatcaactaaagttttgattgaaatgcccttagggttctaggtctatcgatctaaatgagcatttggaatgaaatgaatttactgatgaggatcagtctagtcttcctttgtatgacttcgtaggttgtgattgatcattttctttttactaatagtaagggtgagagtaatgaggcaggtttgacattttctggtactattgaaaactacaattagtcctatttatgcacttagccagaacttggtgcagacaccaagcaatatctgtttatgaatggagagaagcctgcttatgtttgctttgttatttgcctcaggagatctcttttgaaatacgctgttttcaaaggaacagaagggaaacttgcccctgttctgagagcagtgtaaacctcacagggctttggatcccctcggacccccttggacacagaggagaaggaagggaaggagtgggtcgggatgcacaggaatctttcctgtatcggaccaggaaagaaagctggctgtgggtctgtagggtcatgactgttgtctgcctcttttcaccctgtaagtgaatccctgaacttggttccctctgaagccagtcttggttaactaattctattttactataactttaaaagtgaaagatattctctaaatttatagcaggtgccttatttcctttgaatcaaatcattccataccagaatttcccttggtttactatagataattggctttaagatattcttgtttttaaacatacaatgttttaattattttgttaaattgctgtagccatcaatcatttcacatttgtaaaattacattccctttgtatcatgtaatttacctattcagtgcattttatattcaggttggattatgcatatttgggtcaatgaaagttgtgtctgtttgatttatggtttaaaaataaagttccctggatatttgatgctgttgtaaaagaaaatgattttgcagagtttttatttgaatacttttcatagtttatagaaaattattttaaaggaatgcctgtacttagcctagcagtggttgcaaatgcctttaatcccagcacttgggagatagaggcaggcaga

SEQ ID NO: 27892 - DNA, 1225 bp, Mus musculus
actaatctgtagacctggctagcctggacttagatgtataaaccaggctagcctggaactcagtgatctccctacctctacctcctaaacgcggatattaaaggcacgtgttaactaacacacctgccctaaagtgttttattgtatagaatttctgtttcaataattgttaaccatggctagtcttaacttctaacatctattcaattatcatttctctactaagctaaaaccaaacaaatatttcaatatgtatcactgaaagttagggtgggccatacttaaccatacaatgtaatacttaatttaatacttagccatacaattgtcataaataatatgattattattcagacttctaacactgcaaaagttctattaagttttaaaactcaagatctgaaattgtcatatattgcaatttgatatctctcaaatttcttttagtctctaggttccttcttaatctcttttttaccccttatagtagattgtttcttttttctttttttgggggggggggtctatgtttatttgttggtttgcttgtcttttgagacagcatttctctcggtagccctggctattctagaactggcattgtttgccaggctggtcttgaacttggagatctgcctgtttctgcctcttgagcactggattaaagatttataccccacctggccagcagttgattatttcaaacactcatttttgttttatatttttctgtagtttgaagtttgtttttatttcttatcatagaatttaacatgttaccagtcttgtataaattgctaattgaatatggagtttttgttatataataagatattttaggattatctcacatatttcctgacatttgtctagagtcagctaatattctaagccagctgaatcccttttaatggaaaacaatatttgcagactatagtcttgactctaaggcttcattgcactatagaaatcatggtaactagactttcccgtctctttttttttttttcttttttcctttcctttcctttcctttcctttcctttcctttcctttccttttccttttccttttcctttccctttccctttccctttccctttccctttccctttctttctttctttctttctttctttctttctttctttctttcttaatttctttctttctttctttctttctttctttctttctttctttctttctttcttttcggaggctg

SEQ ID NO: 27893 - DNA, 1219 bp, Mus musculus
ggcttttttactggagtgctctgcctcattacatgaaactacaataaagagtttgtagttatcctagccttttataatgagttcagagcttgataagttttgttaatttattatccatgtctaattcatttcttctcattttagacacaattgcaaataaattacatttgcaaaaagttaatgactttaatttatcacctggaacccaaccttataaggtaattcttgcttttatttatttttatttatatagcacatgtgttttttctgtttttaaaaagaatgtcaaaaaaaaaaaaaaaagaatgtctaaaaacatccatctcagtttatgtgcttctaagaattaagcactgatttctacatgtgtatcttaggtggcagtttatgtcccaggaagtaaaggtgccccctcatttgttcgactgtatcagtatcccaactttgccggacctcaggcagcactggccaataaaagcttctttaaagctgataaggttacaatgctgtggaataaaaaaggtatgatgagtaatttttcacttttgttattggatattaatttaaggttcatatatgtgtaaataaaggaatatagatgactttaactttatttttaatctcattgaatactgtttttctgttacagctactgctgtgctggtaatagccagtacagaggttgacaagacaggagcctcctactatggagaacaaacactgcactacattgcaacaaatggagaaagtgctgtggtacaattacgtgagtaccccttaacagttttcctgtggttaaaaacagtaaaatgataaaaagaatgtttcaatgtcgggcgtggtggcgcacgcctttaatcccagcacttgagaggcagagacaggtggatttctgagttcgaggccagcctggtctacaaagtgaattccaggacagccagggctacacagagaaaccctgtctcgaaaaaccaaaaaaaaaaaaaaaaaaaagtaatacagtcaaaattcttaatccagtgaataaactcaaataccataatgttgatgataaacttcctctgcattgagcagcttaatgtcatcctcaagtacgcctgactttgacagactccagtcagtgtggtttagtaggagaagaatctgtgagtgatatgttgtaatggctctctgagcagtaactaccacagcaagtagatgtgctgagtttagtaacagc

SEQ ID NO: 27894 - DNA, 2185 bp, Mus musculus
tgtgtgtgtgtgtgtgtgtgtgtgtgtgtgtgtgtgtgtgagagagagagggggggggtggggtggggtgggggaagattatcaagaacagcaaaaccaactactttaaaaatcctattgtgtagttcaaatgtcttgccgtgaccaatctaatgaattaattaatgggccctttatactaaactaatttaaactgagcagatgttaagttaaatgaaagtttactgctcagtgcctctcttagcattatttttaacaaccatctgcctaagttttttgtttttgacttacagataatctcataaagaacatactttagattcacacataagtaatgagctaatttactgtttttagaacggttgaaactcacctcactaaagaaaaattcagcgaaacctctttacaaagtgtattatgtaaacagagatcatttgtctagtaattgaattatcttaacatcatatatcagaattttattgtatttgaaagacaaaattaaaaatatttttaatgttttcatattgttccagagttctaaagagaaatttagagttgataaagacaataagaatgatttctcagaaatagagcataattttgaatagcagttacatagcagctgtggcaacagaaagggattaagtggaagagccaaatgtaatcctggacttgtgagtggaagttatgagctgagggaaggaactgcaatgggagacttgatgttgatgccacctgactcttagatgttgagagcagcttgactactggacacacactgagtgcattcaggcaatgcctcttacagcctaaagtggaatctactgtgatcttcagatagcaggaagatagtctagtgatggaatgttacccttttgactagtatcatagcactgctagcctaggttcttttggtaatagacattgtaatttaaacggaaagttccatatatatgtatatattgactagatcttaaaaccttgctaatatggttgcctaccacttcagactccacatcttgcaaagtttaacatcggaggggcctttcttcaagtaataggcattccatttgtgatgcagttagctttatggcacatagacattcataatttgagccatggatgttcatgtgtacttgacaggtcaaactatgaaggacaatgtcaaatctaactttctccatgtatgccttaggttgaatttgtttccaagttaatagcttttactggcttagacattcacactcatctctgttttattttatgcttagtcatatttaaatccagaatttaatagtctactagacagataaatgagatgcatgaatataaaaatatataagggaaaggagatggtaaactatttataactttattatattactaacatttcaaagtttattagttgcttataaattgtatagttacaaaatgtctgtgctccattaatcagaagatcgcaacgtatcagcaggctggctaattttactggtgttttcaacacagttgctattgtggaaggttttttgcattaattaaaaagttggtaaaacctggcttttacctcagcgtgtcagatgtagagaacacgtgctctcagtgtgtgagtggcagtggctgtgcactcgcattcgtgacagctgctcagcctgaacagctgtgcaatgcggtgagctccagtcatggttcattcttacttcagagctttagtagtttggaagtttgactgactggcacattctatcattgtcataacttaaataattcagttaaaattttttaaaacatgatttgatatttagggcttttcttttttaaaaaatgagaagcaagtaaagaattgtaaagatttgggacttctttgtggcattgtgaaataaataagccaatgtgaaaggaaccctgctttgtgaaaatgattctgtcctagtgtactttatgtagcagatgtgttgaggggattctgcactgtaaaggctgtcatccagtgaatggtgtttgctttctcgggcatcttaagccaaccagtttgtttaacacctatttctgactctaaatcttacctgttttagaacttaaagttgttttcctaagctttataatttgcaggtacagtactgagccattgacagtgttgtgatttattcttgtctggaacataaaggaataacatacgttgtcccat

SEQ ID NO: 27895 - DNA, 1188 bp, Mus musculus
gccaatccatcgtggtaggctccgcttaatatctggggctaaagacactttcagaaagtttctggaaattgttgcttttgtgaaatgctgcagttagaaagcttcatacaagaaaagtgtccacggatgaattgtagaatgatggcaaattctttctgacccctcccttccaattttgggataaaacatttagaggagtatcatgaaattaatttttcctgtttgttcataaggcaaatgactttccttatctgagaatgtgacaagacttcatttttatcaataagaaagcacagctgagaacctatttaccatgtgctaagcataattttgatttttgtttcttaatgaaaattgggttaaatttccttccctcctttcaaactgcatgcactctttgaaaatctatcaaacatacttttttatagcagcacctaacttccggccctttccttacttcctcctctgtaagtgtgcttcgcaatgctctggtgtgcgattgtcatatgttatttctttttaggtccccatcctcagtaaaaaagaggacgtctttgcatatttagctaagtattctgtgccaatggttcgagcaacgtggctgatcaagatgacttgtgcctattactctgctatttctgaagctaaaattaagaaacgccaggctcccgatcccaatttgggtaagtgagccagtgggcaatgttttatatttcactactggttcttcaaataattgtcacctgcaccctctgagaactcagcatcccagcccccacccccaccccccctccccaccccatgcagctgacaggcagcaagccctgttgatatctccaccatcgtctcttgtctagacagaagcaacctctggctggctttcctgcatgcttttgctgcagctgagcaggcctccagtccacgtaactgttccttacctcctatgcccctgcccctgagctcactgcctctttttctggtcagtgccactgcctttgcgtgtgtaatgacagttgatgccagttaatcttgctacttcaacacagttttctgcttgtagctggagtgatcctgttaattgtgctcagaatccttttatgactagctgccgagctcacctgctgcctgctctggccagcaccaacagcctgcatgttgttttttactttaagccttaccggaagcagg

SEQ ID NO: 27896 - DNA, 1168 bp, Mus musculus
tgtgggaatgacgttccactgtggcagtctatgcattgagtttctaaagaatagccttatggataatttactttcctactgtctgacagtataatgggttttttcacgaatcttgctatttatcaaagcattgtttgtacatcttaaagcatttgtctatggcttaatcttactgagtattgctaagcgtgtatttttggaggaaatgtaaccctttgaggataacatttttaaattcacttacatggccagtcctcccatgtggttttcattttcccattttctcaaggggtgggggtgatggtggcagatttttcttttttatgatttcatttcgtggacattcataacatttctgcctgtctttttcatcagctattttgtgagccttttgtttgaagctctggtatatgaggcactgtggcttgatgttgcttcctttatttatgatgttcaacatttgttttacatgacatagattttttctcccatgcctggagaatcctgtgagaacatcaacccttccttgagcagaagactgtcagtcaatggtgagaaactgctaaagagagaaaaaccaagagaattaattttcccatcaaattacgacctcctccgacacctgcagtatgcaacccactttcctatacctctggtaagacacgtttccatcagtgtgtaccatgatgattttataaggccatcagtgattggctgtcagattatccactcgctgtgcttattataagctcattagtgaatggttgtctgattatccttgcactcctctgtttacacataatgacatgtgaaaacgacgtttgctgcatttgaaggctataatcaggattgtacaggcagtatacagctacagtgtgaaaagttacggtgtgatattagtgactaataggtttaatagagtttcttatcttaatatcctttcatcagaaggatttgagtcactaagtaatgtctaaatgttttctctactttaatttgaaagtcatttgctgattagtttttacttgccctgttttgactgtcggtacttttgacatttaacaaatgagtaagagtttgggggcacagggaaggtaggatggttgtttatgaatcacaagttcttctggcagtgaagcagttgggtgagaaccccagtgcccacgaa

SEQ ID NO: 27897 - DNA, 1149 bp, Mus musculus
gttcaaatcccagcaaccacatggtggctcataatcacccgtaatgagatctgacaccccctcttctggtgtgtctgaagtcagctacagtgtacttatgtataataataaataaatcttttaaaaaaagaatacttgctgctttaaaacaaacaaacaaaaacagcaaagccacaatgagctcatacacaggtgctggaaatgctgcccagtggtcggccctggctcaagctattttagacctaagagttaatattgacctttaatttgatgggtcctatataaagcttatggctatggaatgtcttaagattaacaaacctcataacatacagaacataacaagatatgtggtcagcatgactctggtctgagtcaagttatttttctgtgtccgttacaacagcaatatgaaatagctggtgggcatagaataaaatggctacagctatgctggggggcaggggcaggcttccgcattaacctcaggaagaatgacttttccatacagataacaatctgctattcagaggaaccctgggctgaagagatgatccttaagcggacatatttgcataattgtggggaatcagaacactgaaaatctcctctcagtggagttataagaaatagggcctttctcatgtataggtataaaaatcactaaagcaatagtctcctactctgtaaagaaatggtgagctgctgcctcctcatgtctggagtgtgtgacaggaaataagcatctaaacaggagcccaacttcaagagaaaccatagtgaatgctaatggcaacagaacgtaatcacatgcctgccttggttacattctgcctatgagtcttcttgccgcttggaccttctataccatgctcagtttttctggttttgttttactgctctttatttccatttgaaaactcttctaggacgaaactaccatttaaaatcctttcacatcttaaagcctttttctttaactttctttaccagaaatgaataatgtatgtatgtatgtatgtatgtatgtatgtatgtatgtatgtatgcatgtgttggggtgctggatgtggggaaataaaggggtgggagagacccatgttctaccagagcttggggagactgcctcaggaatccacagaaccatct

SEQ ID NO: 27898 - DNA, 1135 bp, Mus musculus
taaaaagcaagggagtagatactcatgacttgggtaaaccagtagggttgttgttgttttgttttgttttgtttttgtggagtttattagcaacttagatgtttttggtcctgtgaaattcagaataaaaatgcaaaaggcttcggtcctataaacaaaaattcaaaatgaaatgcagaagtttaatcttctggctcccttctcaaggctctgtcattttgtgccaggctgcatggagcagatgcatggtttcagtctgtctcacagtcctgaaggttctgggtctctgcgaattgacagaggccacgggtggggcctcgcaagaatgaccatctgactttgtcagacactacaaaggagtagcagaagtaactgtcaggctggacacccatactgtcagtctaacaagaggaaatctaaaaagagcaaaaattctctggggcaaaggtaattggaaccctgatgtctgcctgggattgtccctggtcttactgtagctgcagaatgctgatctcaggccaaacgacacgttctcagaagctgtttctctgtgaaggctgcagcaggcacattcctacttgtaccctccagcacttctcttttagtgtctcttaattatctgaagtaacaggctgaagagatagctcagtggtttatagctcttgccaacacccagactctagtcccagcatccacatggtagctcacaaccatcaataaattccagttccagggtatccacctctttcttctgatgtcagagggcaccagtacacagaaggtgcacatacatgcatgcaagcaaaacatttgtacgtataacataaaataaatacatccgtaaaattaaataatatttccaacctctctccacttgtatgcatgagtacagggtttactgctgccctctgctttaggaaggctcagagttgtgtgttgacgagcagcagaagctcagaggtcactgacttttgcatgaatttgtttacatagctctaggcaagttaagcacttaactgtcaaatgacgaatgtggtcagaacctgcagagttttcaaatgtgttcttttgtaaattgtcaagttgtaagtaagacaaattatgtagacatctttggccacaaggctgtaataat

SEQ ID NO: 27899 - DNA, 1207 bp, Mus musculus
tgaagctgtagtaataatagctacagtgttctctgtttggattcattttaaagttttgattcacatggttttaactagctaaggttcccccactcccctttgctttattttttctggaaaactgaacatttatctgagagtaaagcacacctgtgtgggtgtccacaggagccttgccctgtactggcaatgcagcaacagatgagcagagagtggttcaaaagatgccagccccctctttgggacacacatgccctgtccttgtgggatgctaattgtgcccagtctgcaccatcctttagtggtgcgtagggacttccgacctttctccagtttatcagcacaactccggtctgattttggatagcactatttccatgttggtttgctaactgacctgtttctgagtatttaacaaattgttcccatggatttttttttttttttttttttttgctctccagttgtactctggattaacacaataccacaccatctctctgtaccattatgccgaggttcctccatgtgcttaagccaactttgaatgcttccacccagcactggacctggagcattttctctggtctttcttagatttctctctcttttttttttggtctcaccattttcccctcccgcccaactctgtcttaccgaatcaaaagtaaaagttcctcaaactgtctcgtatctcctaagcaactatcaaactgttcttctagcatcctttgcagatgcattagaaaatagttcctgtgtgctgtcttcacttcccttctaccttgtaatctattttcctgtgtgacttcatggaaactgcacaaatccagccccactacccattgctcagcctactcgttatttttaaaagatatataaaggcagcatttgttttttaattgtgaaagtgcacacaaatgttctgtcttgacctgttttcttttctgaaataaccctgttgtgagtttcaggctcacctggacttcctgtaggagctcagcagcctcagagcttgtagtccttgtgtctttgtacttgtggatggagttaggtgtgtgccccacacctggcctttgggttttaaatagtgtctctcagagcagagtctgaacacctcaccttaccccagcctctccagtgctgggattacaggttcaaaccaccacactcagtctcttgaccacttctcagggatggttcagtg

SEQ ID NO: 27900 - DNA, 1136 bp, Mus musculus
ggtggaccaaactactgatttgaaagctgtggcaggtctcgcgggagtggacacattagctcttcactcgaccgtggcggtggggtgaacattttttttttttttgcatcactttaatttgaaatgttgatcattttcataagcactttataaacttcgttcgcatttatgaaggacttggcttcgcttttgttgtggtccaaaggtgctgaaacggattgttgcttagtacttccgcttcttcagggcttctgcaagagccacctggaggactgtgggagtctctcagaagcagctgcactcaaatttgttcccagtggcaaaatctttatccagattcttcatgaaggtacaacctataaccacgggaggccagaagaaccacggtggaatcggtccattttacttactgccagttttggtttaaaaaaaaaaataactgtccagtttaggttcttcagaacctcatgccaacttgagaaaaataaaataaaatctcacagctggccttagattccacagtgctcagacttgacatggtttccagagggttctggtagtcatcaaaggtatacttgctgttaattttgtatggtaagtatttacaattttgaatttaattattaatgttggtgtcagtcttggttgtgtattgcttctactgtatttataaaccggtgcaaaaagcacaagtaaagtaaattatacatcaaaatttattataaagaaatagtaactattttaactttgttcaagtatgtggtaatttgctcctattagagtgaaaaaatacagtaaattattatcagtttgtgtaacttaagagtattccgtataatatttttttagaattagatgcatacaattttgaatgtgaaaattgcagggcattttaagacatgtagggatctttccctgtcctttgttgggttcactttctttttgccatatgatttcacatgtaatgtagtcaagcatactgtgaatagattgtctatgaagagcagaccctgtagaactacttttttaaaatgtagctagtacgacttcagatgatttctttcgcagattgttattataaataatttatatcttcctaggtgagttacccattgcagagtttgactcattcaaat

SEQ ID NO: 27901 - DNA, 1436 bp, Mus musculus
gatgaggaaaaacctagagctctttgccctgcgcgttacaaggaaagcaactggaattttaaatttagttattatatttactgccacttaattctgcattctgagaggtttttttttttctttcatagcaaatgcatgtggttggcattaaaattgtcctaaggaaaaagctctattgcagaaccttgtcatttgctgggtgggttgcagataggaaattaaagaccagaccttgaaatctaatggaattgggtatacttaccatttctggctataagaaccccttaacatctgtgttatattgtaagctgaatctttagagggtggcatttcttgttttatgtaccctttttcatctaaaagtagagggagactactctacggtgggtatcatttgacctctggcagccatagagtaccaatgttaactggagtcagctcatgtctgaggtaggggccaaaagaaagtaggcattacggaaagtaggcatcaagttccagatgaatggcatgtgctaacaaagctcttggtcttagtgatctgggctaactgaatgacttttgcttttttaatttacaaggctcctttataaatagatgaaataaatttataagtagatgaaatttggacagaagccagagaaattattctagaaaaatcccagtctttagaataaaagaggtgaatcatatgatactcccacatatatttgggttaaattaaacatgtaatgttagtacggtgaaatatgaaaataaaacccaccatttaaatacagtgaaacttgattatatagaagcagttgtctagactcgtggaggaattctgccttagaaagtctgtcttcagaatggctctgaaccatgggtgcctgagcaaggctttaaagttataaggaagtgtcactgtacctgtagagcatttcaggatgacaggtgtggacaaatgtgaaacccgctttgcacttcccaatgtgtgagcattaggctgccctgtacatgtagaaaagctagcctgcatttgttttgtcttgtttggtttcatttttaacgcaggtattaaaacaatgggaactttcagtgtgaacaaatggtaaactattaatcataatcagaacagttctgcgcttgttttctgtaggttttatcaaaatgtttgtaaaccagtgacaaaatatttgtgcattgagattaacacgggctgcaaacctaatctttcacgttgtctccattcattctgtgtgcgatgtttgtaacattggtggaaaacagacacaaggcagctggcaactgttagcggaagaaaggtctttttactgaaaattcaggtgcattcgccatttgttaatttgtagcggatcattttctcttaatgttttttattatttgttggcaaaatcaaagtgccttaagttaagagtttgctttgaaatcca

SEQ ID NO: 27902 - DNA, 1584 bp, Mus musculus
aatctaaaaaatcctttgaaaatttttttttacaaaaaatctgcgtctcccccactggagacttttatttttttcttcctcttttataaaataacccggtgaagcagcccggtgagatcgacccgcctggacccagcacctctagcctcgctcccccgggttccacggccgttgaatacgcatcgattctggttgaattttgtccctctgagctcgcctctgctcccccagacgtgactgaggtgatgttctacgagaagttcagcctgggcccatcctctccatccgggtctgcagggacgtgatcacccgtgtctccttgggctacatgtatgtgaacttcccccagcaggtggacgcggaacgtgcttaagacaccatgaattttgatgttataaagggcaagccagtatgcatctcgtggagtaggcaacatattcattaaaaatttggacaaatccatcgacaataaagcactatatgatacgttttctgcgtttggtaacatcctttcatgtaaagtggtttgtgatgaaaatggctccaagggctacggatttgttcattttgaaacacaggaagcagctgaaagagctattgaaaaaatgaatgggatgcttctaaatgaccgtaaagtgtgtgttggacgatttacatctcagaaggaacgagaagcagaacttggagccagggcaaaggagttcaccaatgtttacatcaagaacttcggagaagacatggatgatgagcgccttaaggaactctttggcaagtttgggcctgccttaagtgtgaaagtaatgacagatgaaagggaaaatacaaaggatttggatttgtaagctttgaaaggcatgaagatgcgcagaaagctgttgatgagatgaatggaaaggaaatcaatggaaaacagatttatgttggtcgagctcagaaaaaaagtggaacggcagatggaacttaagcacaaatttgagcagatgaagcaagataggatcaccagatatcagggtgtgaacctttatgtgaaaaatcttgatgacggtgttgatgatgaacatctccggaaggagttctctccgtttggtacaatcaccagtgcaaaagtaatgatggagggtgggtacagcaaagggtttggttttgtatgtttttcatcccccgaagaagccactaaagcagttacagagatgaatggtagaattgtggacacaaagcctctgtatgtagctttagctcaacgcaaagaagaacgccaggctcacctcactaaccagtatatgcagagcatggcaagtgtacgagctgtgcccaaccccgtgatcaacccctaccaaccagcacctccttcaggttacttcatggcagctatcccacagactcagaaccatgctacatactatcctcctagccaaattgctcaactaagatcaagtcctcgctggactgctcagggtgccagacctcatccattccagaatatgtctggtgctatccgtccagctactcctagaccaccatttaatacaatgagaccagcttcctcacaggttccacgagtcatgtcaacacagcgtgttgcta

SEQ ID NO: 27903 - DNA, 1095 bp, Mus musculus
ttgggcactcagctcctctacaagtttgagagaccacagtatgctgaaatcctcgccgaccacccagatgcgcccatgtcccaggtgtacggagcgccacatttgctgagattatttgtgagaattggagcgatgttggcctacacgcctctagatgagaaaagccttgctttattactgaactatctacatgattttctcaagtacctggcgaagaattctgcaaccttgttcagtgccagtgattatgaagtggctcctcctgagtaccatcggaaagccttctgaggggtgtgctcgccctctctccctcgtgcttggatctctgtaaacagtttggttcttagtccttcttttgtacaaatgatgtactttgaagaccgttagtgtataacagagttgtttgtttcctctttgattttaaacagagaaaataaaaggagtaactgctccttttttcttccttttttcatttcaaagtttctaccagtgtatcagtgacggacaacagagagacatgctgtagagtgtttgcctagttgacaaagctgcttttgagtgctggtggttctgttcctttgacactacacacttttataatatgtgttaatgctctatgacaaatgctctgattcctagtgccaaaggttcacttcagtgtatataactgaacactcatccatctgtgctctttttttttttttaatggtgcttaaagagcccatcctttgcaagtcatccatgtcattccttaggcatcttatctttgctcaactgttaaagaatggtggcttgttttcatgggttttgtatttgtgtctaatgcacgttttaacatgatagacgcaatgcatcatgtagctgcagttttatggaaaagtcaatcttgtaggagttgtttttcagatcttcaataaattttttctttaaatttcaaaaaaaaaaaaaaaaaaaaactcgctaaccggatccaagaacacattaaagcaatcatccatcctgaccaagtaggttttattccagggatgcagaaatggtttaacatacgaaaatccatcaatgtaatccattatataaacaaactcaaagacaaaa

SEQ ID NO: 27904 - DNA, 1115 bp, Mus musculus
ctcataggtgtgtcgagagtaccagcgtggcaattgcaacagaggagaaaatgactgtcggtttgctcatcctgctgacagcacaatgattgataccaatgacaacacagtcactgtctgcatggattacatcaaggggagatgctctcgggaaaagtgcaaatacttccatcctcccgcacacctgcaagccaagatcaaggctgcccaataccaggtcaaccaggctgcagcagcacaggctgcagctactgcagctgccatggtgagtggagacagcagtgccctcctgtcagcaatcagaaaagatagtgaacaatttctctactgccagctattcatctattaacctcttcctcccgttttgctgaagatatgtttgttcaggtatcccacacaatacataaagaagctaccattcacagacgcaaggataactcctcaaatgttgctcatcctcttagcctaacccctaagactgtctcattctggatgtagggtttctgaaattcctgcttcataaggaaccacttgtcgcctttctgattgaacgacactgccatttccagtctctgatttctgtatgccatccagctggcccttgttctccttgagtgtgttcttccccacatcaaggctcttctttacatttatcttgcctttaataacatcatctgaaactatttaggagaatagcttcaacaaaattgtttttaaattagctgcaatgatccttttgaatgatccgctgtcgagatcgtgtgaaggcctactgtggcagaaacatgattattacagtgccaaatattgactaagccactatacagggaagagaagagcactagcactcaaggagtgtttaaaaaatgaataaataagtaaggatcatttagggtagatgctaagtggtttatcttaagatcaacttcaatgagacctagtagatgagtttaaggaggccatttcttcttggcttagctgttttaacgctgtcctttttaatataaatatataacttattctttaaatattcatacaaaaatcattgtcatggcacagtaaaatgatcatgagagaggtcttttctgtgtttgtttatggatacttgagcaaaa

SEQ ID NO: 27905 - DNA, 1320 bp, Mus musculus
acttgctgttctttctttctctctttctttctttctttctttctttctttctttctttctttcttctcattaaacttgttttaatggtctcaaaattctatgacagatttttggtcaagttgtttccattaaaaagtactgattttgaaaactaacaacttaaaacagccacacacacacacacacacacacacacacacacacacacacacacacacaaatggtccacaaaacattctttccttctgaaggttttacgatgcattgttatcattaaccagtcttttactattaaatttaaatggccaattgagacaaacagttctgagacccttcttccaccactgattaacactggggtggcaggtgttaggggtaatattcatttagccttctgagctttctgggcagacttggtgactgccagttccagcagccttcaatgtaaagaacgtgtcggtcaaagacgttagatgaggcaatgttgctggtgacagcaaaaatgacctaccaatggaagcagctgattatcatgaaccatccaggccaaatcagtgctggctatgctcctgttctggattgtcatacagcccacatagcatgcaagtttgctgagcttaaagaaaagattgatcgtcattctggtaagaagctggaagatggccccaaattcctgaagtctggtgatgctgccattgttgatataggccctgggaagcccatgtgtgttgagagattctctgactattctccacttggtcattttgctgttcatgacatgaggcagacagttgctgtgggtgtcatcaaagctattctttttaatatttcccacaacacacttctttcaagaccacacctccttatagtgtcactccttgtggttctatggtggccatatttattcaaaacatgatagtggaagttgttggtggtggaagtggaaagttctcataagagaaagaacatgctacagaagaaagagcatttgccaggatcttgaaaaattagtattccccagattcatatccttccttgacaccccagtttagatacgttttttcacatctgtaaaccttagttttcataaatgtaaaatggttgaaatcaggtgtccaacctgctgttaagttaataacaaggtatattagatactgtgaaactgtgttgaagagtcataagggatgaaaagccatggagctcatggtccatttgagggagtcctgcctggacaagcagaagaacttctcacatcctgacacagagaggcaggtctcatgatatagtcactgctgttgacatcagtgtcatgcttctgtc

SEQ ID NO: 27906 - DNA, 1212 bp, Mus musculus
ttttctgctagatcttgaagctttacattttgtttgtttgtttgtttgtttttcttaaggcaacacagtacaatcttttttgaggtgattttttgttttgttttgtttttttgttttgtaacactaccaagaaattgagcattgctattggttttaatctgttttcttcaggcagttggtaactttaatgccaacatgttaagtgataactatgtcatttggctgctaaattctgtcattttttaaatgaaggtgaatttatgttacatatcaaaatttgtacatttgagtaacgttgttttagcgcttttgcaagaaaaagtttatttttataacatttgtgattttcatgtagaagattgaaacagatatctgtggttaacagtgctattgagtggtatggaacagtgttacttggcattttgagccttctcaggtttgtctcatcagtggtagcttaacaacctctggattgattgtgtataattgtctttgtattcaaaagaggttcatgtcctgtaaaagcacagtattgtttggctggagggagctgcagaatcgcccatgtttctgtgactttgctcgtgtgtgtgtgtgtgtgtgtgtgtgtgtgtgtgttccaggcatggcagccaaccttgtatctgctatttaaaataacagcagagcttcataattgtggtcattagagttgttcttatcataattaaaactgagattcaataaaactatgaaacatggtgatggtgtctgtattattagactgttcttgctcaaatatttcctcacttttgttttgatttgttttgtttttgttttttgagacagggtttctctgtatagccctggctgtcctggaactcactttgtagaccaggctggcctggaactcagaaatatgcctgcctctgcctcccgagtgctgggattaaaggcgtgtgccaccacgcccggcatttcctcacattttaacatacgctgcaaggctctttgttttaatttgggtagtttcttaaaatgacaactacactatattttatgataaagggagaatcctcatgcaagataatccctaacactgttcttatttgatgtttagtcgcaaataaggacatattctattctattctattctattctattctattctattctattctattctattctattctattctattctctctttcacacacacacacacacacac

SEQ ID NO: 27907 - DNA, 1428 bp, Mus musculus
gaaaaaaggcccttccaaggaccttggatccaaggaagtgagagaatggggaagggacgcccagggagagaagagagaggtggggggggaagaggcccccaaaaagaagagtctttatccaggaagatttagatgaggagcggagcaaggcagcaccagccctgagctcccgcgggcgcccacctctgggggctcggcagtcctacaccagcctgctctggtcccccagcctcgtggccacaccgcgccaccgcagctgcagaacccccctccccaccccctcccctcctctgccctgttactgctcggccagaccaccacagccaccaccaccgccaactccggggagctcgagagacctggaggcgagcagtggggcgcgcggcatcgtctcaatgtatcggggagtcgcctcggcgccccagcccggctgagcagcctcgggcatgttgctactggccagagagcatgagccaggaggcgctgcgagccccagagccaccgaccagcgagtgagcgagccagcaagttagccccggagcaagctcagggagcagacaccatgctgggctcgggccttcccggagttgggttgcttgggaatgcagcccaaagtgggtggtaaactccatctaaggctaaataccggcacgagaccaatagtcaataagtacctgaagggaaagttgaaaagaactttgaagagagagttcaagagggcatgaaaccgttaagaggtaaacgggtggaatctgcgcagtccgccccgaggattcaacccagcggtgcatgtccggccatgctggtggttcaggtggatctttccctctccccgttcctcccgacccctccaccagagcgtcgttcccccctccctccccgcgtccagtgctccagcagcaggcgcagggggtggtgtggtgggagcgcgcgggtggggccgggggtggggccagcaggggaccgtcccccggctggcaaccagccgccgctgggcgcacttccaccttccaccatggctatttcagagctctcctagggacagaaggaaaacgggagacgtcctgcttcctctctggctcctatggagatattcttagctctggttaggatatcagggtccctttgagacaccaagttatattccctgtctatctattatctgtttttggtgcaccaaattgtccatatgtctgtcaattcatgtttgtttttgaatgattgttgttctgtgtttcatgttgaaaaatataattggttaaaactttatctgctggctctccatcctttaacttgtttaaaaagcagtctcaatttacacagcagaaagtgatataagcactgtggctgagattcagttacagctgaaaaagccctgctgagggccgattgcaaatggagctcttaaagggacaggcagccttttgc

SEQ ID NO: 27908 - DNA, 2671 bp, Mus musculus
gagaatccgtcttccctgatgagcatatctgcttccttcaaccttagggactaagaaaggaactggatagccttctacaagagaagattgaaagccctcatcctgtagactgggacgacactaagtcaagagactgtgcagtactgtcagctattctagacttgatcaaaactcaagaaaaggctactccaaggaacttgccaccacggtcacaggacggatattatagctgacagctttctgtgatggcctaaaacctatcctggtgtccataatttccaatttttttcttttttttagtttttggcaaaatgccaagccctgggttatgacttgcttttgtgtgtaagttagaaactttcattgggtagtaaagagttaatgtgcatgactaaacagtgccatctagctactataaagacattggaaaaagtaatatgctttctgaccttatcctctgttgtagatatgtccacactttgggagaattcccaaagttgtaacattgagaaattcctttatgctattatgcaaaattaattttctgttcataatgactgtccagagacaataaaaatagaaagttgggccaaaaagcagtatgaagtaagaatttgaatacaaccacattttttaaaaatgaaattctattattagtaaatttgttgtaataaagtccgatatttaataaaatgtacaatgtataaatctcagctaacttcttggtttggtttctagagttctacctatcactgggctcactcgattgcttttatttgtttgcttttattttttaactttttaaaaggttcaatacctacggtcctgttctgtgtagcataatgtagcaacagagcatgtgtctggatgtgatgatgaaggtcctgtctcagctcatcaccttttccttatttgaaagacaggtaaagattgtgaggattaaatatggtaacatgtaaaggaccacagtgtctgatgcatatggtcttcacacagtgcttgttactatttgtccataaaatattttttaacctttagtaatcaattttaccattttattttttgtactaaggaccttggagatggttaggccaagggcctcacatactagatgactgctatattactgagccacatccccagccctgtaaaacaccatttttatgcttctttatgctcttagtggaggtgacaaacaaggctgttttcaggcttgttagctattgttttcttcctagttttggactcccttctttttttcctgttgtagtccctacctctagcttgaaggtgttgcttttgttctatccatgagccagtgattattctgagataatcaagtttggtcttctttccctagtaagttgtgagatgaccaggacatatgcatagcactgccatggatttgctgccgatgctggttcaggtactgctgccatgtctgagtatgtgtcacgtggcattgtgtacaaagatttggatgcactgtgtcccttgtttatttttttggattgtctcaccaaaattatgcttctccctaatcatagtggtggtgttatggtattgtagcatattagttttgcccctaaagtcaaggtgtgtttacaagcaagtatttagcctccacagcaaatgcaaaaatgttgttagaattgttttttacagagaagcagtacacaaaaataagtgatgtcttgccagcatctgctgctgtctgacatagctaagcaagatagagggtggcttgcgggtgctctgaaggttcggctgcttgttcacagattacgactcctatctgaaaaatgcactccaagacccagaatgacttgttctgagtgctcttaaaaaatagctcattaagaagaaaaagctgtctcacatcactctgcacagcacaaaggacaaactggaaaaaaccactgtaacagaaacttatgagatctaccgctgtttcaagagcattaggtacatgcacatggtaccttcctaattaattgacctggaaaaagagctgtaataattttaagtcaattaattgcaaagtgtatttttctgcatttgtaaaacaaagtctactctaaaattattatttggtatctgcacccaggctaagtaaatggtggcatatttccttccattttcaacactgatcttatatttattcttcagtaactataattatgttttatatctatatatttgtaataatcctatatgttaaacagcatctttattctgattttttaagaaccatcttcattggagaatatgggaaagtgtatccaggaaagtaaatcatgttatcactgttagtttttaatagtcttccatacttttttaaggcttgaaggtagtgtgtatagttagccagtttaagagtataacttcagtgtatttggtctactgtgtgaaattgtgtagccaacaccgcagtcttcatgtagaacattcccatcaccctaagatgttctcttgttgcttttacaggtaaaatgccctcccctgcctgcttctaccctctggtgcccagggagcagcttttcgtcaatacttttgtcttttgtaggttttctgggaatggattcacacagtccatgtgtccagcctttttcatttaatataagcatggagatggctcgtgcttactgtacatattagtaatttttattgt

SEQ ID NO: 27909 - DNA, 1159 bp, Mus musculus
agaatgagtacggactaaccttgtttcattatatagattttagatgcaaatactttcagtgttccccattaaatataaggttagctataggcatgttttacatatgtgtgtgtgtatgtgtgtgtgtgtgtgtgtttgtataagtatttttgaattatattctgtctattcctagtttgtctagaaattttatcatgaactttgtcaagtgcttgttctggatctatcaagatgattgatttctgtccttgagattgattacatattacaatccatttattgatttatgtatgttgaactacatttgcatttttttgggatttgtgatggaacctattataggttgtaatgtatcatcttctttctttgctcttgaattcctttacaagtgttttattgacaatttttgtgtctttatctctttagttaacaagacaatattggcctgaccagatggatttgtttatactttttattcctgttttgtggaataaaattgacaaatactagtatttcatcttccttgagtgaatgatgggagcatgtgggaaggagaacaggaaaagatgcagatggtgaagaagggcagatgtagataaaggtacgtggactgtggactgggttataaagttcattttcccctagttttaactaactttttttttccttccatgttctgtggtggatatagaaatgtaattgatagtcatgaatcttcatggcttcagaatgcttatgctaattccatgggagttcattgagatataaggagtttaggtaggggcaggtgcttgtttgagtggctagactaatctagccacatagtggtttgattttgttgttgttgttttgcaagtttattacaacaaagttatttttataaaaattgtttgatagagctcagtagtgactccatctggccctaggttttttctttgtagggaaacttttaattgctgcttcaatctcttctctcactatgggcctatttaaattatttatatcttctggatttaatttaggcaagtgatatgtgtttagaaatttattcgtttgtctaggtttttttcatactattttctaatgaccatctgggtttcattggaatctgttgttacttatgttttgcatcttttctccctttacattcttaacttct

SEQ ID NO: 27910 - DNA, 1165 bp, Mus musculus
aaaaaatgctatttcagtaaattgccattgcctaagccaatccccttattgatactaaagtttatatatacacagttttcctaaagtacctgaacttcacttaagccattaaaaggagaaatgtgttttctcatgtatacgctttcctttctgttcttttattgaacatttcttcacgtttatgtttgcatggtaggtacaatgttgcgttttctctcccaaagcttctctggaggttattaacatgtaatagctataagttctattgggacaagcctctgaaaagataccttgcttgctgaagctcattttttaaagtaaacaatccagtcagattacattttacagtcgcttagggacaactactctgtgaagagaagcaatgagtactgcaggatcttcagccagacataaagactagtgtcttgcagactgcatgttcttactgttcaggggccctgactcctgctcacatgctatttgccttttctattttataggccctttatgggactacatcagaaactgcaacatggagacggtgtgctaactacgtcaatgggaatatggagaatgctgtggggaggctttatgtggaagcggcttttgctggagagagcaagcacgtggtaatgtttcagcacagcacagcagcatctaaataacaccctagcagttcatgtggttgataagcagttacagtcgttcacatttttgcttaatttttattaattaagcaaagaatctgtgaatcataatgtaccattgttctcaacagatttcaccttgggcttcttaaaaagtctagttatgtttctgcctttcccacagaagtctagctgtgtttctgccttcatgatgtttaattgaaagcacgtgtctattttccagaaacagtgactttaatgtacactgtcatgtattagacttataaagttgtctatttcccaactgaccatttcattaagtaccaaaaatgtaagccacagtttatttgaaatgtgagaaaggtatactattttctaattgctactgaaattaaggcaatgcagtgtaatggcatagtaaaacaacttattgaaatgctacttcttgcttaattgaaccaatggtgacattgagagctaatatggtattcttctaaaaggacagcaagaactaggac

SEQ ID NO: 27911 - DNA, 2749 bp, Mus musculus
tataacaactttgataaatgtattagatgcaccttacagataaaaacaaaagacaaagcaaaaaaacatgcaaagtcttcaaacaggctccaaagtctgtgctctgaactcctgcttggttaataccttcctatttaagcacagagtgaatgagaaggatctaactcatcataccaagtttctatttttgtttctgaattccctcatttgagctgcttagagaacttctgcactggagctggggagatggctaagaaattataggccaggctcacaataaaaaggacaagaagacttctatggtttccagtgtgatatggacactgagagtccaatgctgacagtaactctttctgtttgtttcaaaggatcattgggactttgcagaactctgccgagtttgcagatgcctttcattgccgcaagaattcatacatgaatccagaaaggaaatgtcgggtttggtgatcttcacaagatactgaacatccacggcaagatttgccaaagccacggaaacaggaactcttccctcagagaaactgggccccggaagtttcttcagcttcctggggggcaattcacagagacgagcatgagctaacataaatgaaattagattattaaatctgctgtgaatgaaaggggagggagcctacgatctagcaaatcaatcacttcactgtgtaaataatgattactttccaacggtagtactaccgttcacttctgtttctcacacagactgcagctttcatgttgtctgtagagaacagtgttaacacttaaagcagactatgacttctgatcaaaaggaggacgatgctcagtacagcagggcaccaaagcacagatttgcccctcagcactcacttttgtttgcaacattcatgctccttccaaactctcccaaagaactcccatacagactgtggccttcaggctcgtgcagttttgaactcattttaccatacataagttattcattcatcccacatcaatttagtttgaacactcttagagcttaaactagagtatctgaaacggttcccctatttcacccactttagtgatgttgagattcttgaacccccctgcagatctttgagcaatttcttgctcttgctgcccctcagactcagtcttttaaaggatttgtagtaatgtataaagaataattctatatttaattattaactacatttatgactgaataaaccattgctataggtaatcattgaatattgaagttatatggccaagatagttttgaagatctgtaacatgatatacagacgaaaatttgagactctttaaatctgtaaatcatattgatgaaaagctttaagtacaaactctgggggtgagcattaccattggacgggtgtcttgagatacataatagttgtggtttacaaacagcattttcaagattaagtctgtccctagtggctaagaaagggtctaactgtatctgtgttgctccatgaatgcttagccttcaggtttgtcatcagatgaaaatattttgataataaattgacgttgtgagccccttactaggcctgtgtgcacgccatgccacctagctttagaaagcctatgtctgaatcgagatgggcagcctccactgtacctgcttcttgaattctacagctcatggactctaattggatttcctgaggcactcatatgccttccttgtccttctgcttactttagtgattttcactattcagtataaattttacaaagattcatttctacagtccttatttttatcaaaaggtgaaaatgaaaacatttctatccaaactcttagttttcatgccttgtgagaaaagcccacttgcttgtaaaagtgttacagtacaatatgtaaaattgtatagaacaaaaactacagttcagcgaactgatattctctgaacacagcaccctagctaaaatctataagaaatggaacactgtagctttctgccatcatcatataactgctaggcatacattatccagatctccagcattatgcactagctctgccccattttgtctttcagtcatgcattacttcctatcttacttctctctgccttacatttgtaaaatttagctgtatgattggtttatatgtgaatctatcattgttgaataaggttctgttgtgtgactatactacaaatattccatcttattattgatggacttttaaggactccatgaactcctgtctattctggttttggattgttacaaatgatataactatgcattatgaactgtgcttatatattcacctttacttgaattatcattggaatcactttcccaaacctatccaaaactatcataaattttaaagacacggtttcagactgtgtggttacaaacatccttatctttttcccttttaaaacaaacactattgtcatgaataatacttatatgactgtttctttgaaatcaatttaaacatacttgagtactatgaatggtggtagtagaagatttcagttaaacagctatctctgggttattttcatttatgtcctgtcatagcagccaaagagacagaagtgaagagtcaatggccactagcatctccactggtagttcattaaaggatcaagcttccaaacctatgtaacagcaactctggtgcctagattcctgctgtatatacagcatacagcatattctttgagctaagggattttaacataaaagttaaaatggtaattttttccct

SEQ ID NO: 27912 - DNA, 1161 bp, Mus musculus
tgactacagggaagaagctccaagtcaacttgtttctccactaaaactgcagcagagccaggagatggtggaacacattcagaggggcttgaggaatggctactgtaaagagactctcctcccttctgaaatattcaacaatattccaggtgtcaaaaatcacagtatttctcatctaacctatcagggtgctggctttgtgtataaccatttctcaagttcagatgcaaaaacgaaccaaatctgtgagccccagcagcctagggctccagatatgcatgcccctacacctacaccatcaacacatgctcctttggctgctttgaaactgccaagcccatgcaaatccaaaagtctgggggacttaacatcagaggacattgcctgcaattttgaaagcaaatatcaatgtattagtaggagctttgtgacaaacggcattagggacaagagcgtgactatgaagacaaagtcattagagcctttagacgccctgactgaacagctccggaagctggtgtcctttgaccaagaagacagctgtcaagtgctctactcaaagcaggatgtcaatcagtgtcccagggcattagtcagaaagttgtcgtctagaagtcagagcagagtgcgcaacattgctagccgtgccaaggagaagcaggaagctggcaagcaaaaagctatggcccagagcaccagaggaggagtggtccttagaagtaaaccgcccgctcctgctctggccgtgaaccgtcactccacgggctcatacattgcaagctacctgaggaacatgaaagctggtggcctagagggtcgaggcatcccagagggagcgtgcacggcccttcgctatggctacatggaccagttttgttcagataattcagttctgcagactgagccaagcagcgaagataaacccgaaatttattttcttttgaggctttgaattatataaagttgcattttcattgtttacatgatactctagaagatgttagatttttttccattgtcaggaaatatgatactgggctttgaaatgatttccaaatgtatttttaaacttgtattttggtctccctttgcctcatgcatttgtatatagattctgtggcctttcccaggaatccatgatctttcccccaaggtgttgta

SEQ ID NO: 27913 - DNA, 1188 bp, Mus musculus
gccagcgttctatcttaacagtgacacatcccaggaccatgagcgctgagttattacaccagtctcctggttgcagtcttgctccattccatccgattctccactcagtcagggtggaatcgcaacaatggttatctcattgtgggccatcataggccacctccttctgtggcatgtagagtccttgaaagaggtccagactatcacactttctccctctcccatttagagctctgctctaccctaccttactcagatagcttcaataatgagtcatctctagaatcccaggcttcaaagaggctggaagtaggagctgaggcagtccagctctgaaccctgtgctctccctcatctgcctcattcctcttttctgaagatgccttttgctttttctggcttagaactggctatccacagctccctggtttatatgtcttccttacaactgctcatcagagacaaagactaattttacagggcctacactttcattggatagttaatgtgatgagcaagagtaagatttgccccctgcagttagttcaagcctcacggatgacctggtgtagtgggcactgattgtgagaacagcctataggttttcaaggtggggtaaaaaaaaaaaaaccacagtaccttagtatttttttttgttgctataacaaagtacctgaagcaaggtataacaataagatattaaagctaggtacttagaataactcttgatttggctactagtggggactttttggcagatgtcataacagaggatggagtgtattcaaaagagatcacatggtaagacacctagagaaagggagagacctggcttgctcttttataaataacccatagtgatagggatggagtacccattattctctctcattcatgctgattccagttaccaggtcatcttttcatagctcttagtggttctgtcatttcaacactttcatcacaagaagagctggactgaatacaaattgatccttgggcagcttactagcatcatagcaaaccagaaaacataggatgcccctatagatatccatccttggctcgtttcccctgtgctgctgctgtcctcaccaaaggtccttcatgttgcctaggtactgtggtcccaggtgtcttcaataggcttgtactcacatcttcagtgacaaagatactttgtttatc

SEQ ID NO: 27914 - DNA, 1141 bp, Mus musculus
aaaacaaaaaacaaaacaaaacaaaaaaacattgttaaaatcagaatcaatttgaataagttatgatcaatgtaatatacttttagaaagtagtgacacactgtaaaaagttacccagtagaaagatgtatatatgcagaactaatgttttgccttgttcttctgcctccctgtaccctagtgccagggattgaactcagggcctcaggtactctggtctagcagcacatcattactgagctacattaccagccctatagtgctaatgtctgaagaggaagtttaagtatcgactgttatattagttgtctaggacagccatatttgacatttgtttttcagttttatcaactttataataaaggaatttaaaaaaacattctttctgagatcactctttttctccagtcatctttctagccactgctgagttaggaccactgatccaagaggtaagaccaccatttctcgtaataaatacagttatttccatccggtagttagataagaggatttcccttaaaacagagatgaggacggcagcacagatgtcagaaaggaacgatctttaggacatcgcggagcccctgaactcgccaattctcaaactaccctgccttctaactcctcattgcatgagagagtattctgccttgatagtaaatttggagttgggcatggtagcatgcacctgtaatcccagcacttggtaagtagggactggaagataaggagttcaaggccacccttggttcatacagaattcaagaccagtttgagctaattaatatgagacactatctaaaaatcagaaatatcaaaagcaaaaccacccccaaaccactttaatgtatatattaaaatcttcctgacaatgtaagcctctttcacaaggccaacagtatttgctaactgttgggacttgatctaataatggagtccttcaaggggaattcagaatgcttgtgcgaaatctccaagaaaacaagacaagagtcttgtgacctaagtttctccaaaagcaaaattgtttttgaaatgtgctttcgtgcccttcccaggcatagcagataggagtgagcttactccagagtattcattacagctggatattgttacttgtttatatgcctctttggaa

SEQ ID NO: 27915 - DNA, 1148 bp, Mus musculus
acatagacagtgatatatgattataatcctagcacttgggagtttgaggcaggagaattgtgaatatgaggccagtctgtattacagaaaagcgtgagccacgtactaagaccttgtccaaaaataaggaaataagacttcaatttatcttaccatttacaataaatgaagtattgaaatattttctcaaaatgtacttgattaatctctttaattacaaaatagaaacattaattattgaatgtttccatattttaaaaaaaatcacagaatatgggccctgaatatagctcagttggtgtaatgctcacctagcacacacagagctctgggatgcacacctacaatcaagctttgtgatgcatgcctataatcccatcacttgagaggtggaaggagagattcagaagttcacggttatccttaggtacatcgtttgaagctagcttaggccatctgagaccctgtctctataaagcaagcaataagaaaaaaaaaagttatagaatgtttgttataattttgtttttatagctttgcaaaaaacttggaggctcgtgtgttacagctctggatggttactatgtggaatccattatctgtgttctcattggatttggttggtggttctttcttggtccaaaatttaaaaagttacaggatgaaggaccatcctcatggaagtgcaaaaggaacaactgatgccaacattactggacattctagaaggtaactgtagcttagtgttaccaagaaagcaatgataatcagtgtgtaggagtgtaaaataccgttttaggaaatttttaatttaaaatgccaaatagttgaaaagtacagatgtatttgtatgtttgattatattttcctttgccttatcaatgtattgaaagtttacttaaggctaggaaacaacccttttggttttattacttgatttctgttaatttactgaccaaagcatattttaagctgcagtggaatagtcatgggtggtcaccatgctgccaagtattgttagtgcctgtcattgagtcgtatttaacatgttggtacaatgtatcaagtggagcaaagcttaatatgcaggtactcactaactagattaaccttattggaagttaattctcactttgaattgtaaattt

SEQ ID NO: 27916 - DNA, 1210 bp, Mus musculus
ccttttcctcccttcccctcccttcccctccctcccttccttccttccttccttccttccttccttccttccttccttccttccttccttccgagtcagggtctttatgtagtccagggtggccttgaacttggtatgtaacttgaggataaggttgagctcatgattttcctgcctccctcaagtgctccttctcctcttactgctcctcctctcaccttcacacaggttttccttctctgtatacctctgctgcacactcagcttttcaatgcgtggtctaggcaattcttctcacccttctcacactcttcatcataatcccaggggtatctgatatagaactgtcttccaagtgtgttgagtgtcaggaacaactacagtattgagatctgtaaagagagaggacttttttttcaacctttatttatacatgtgtgtgtgtatgtgtgtgtatatatatatatatatatatatacatatatatatatatatatatatacatatatatattgtattaaataattaaaaattagtagtcaacattgtttactgactcctcttccaatcaatccacagggctattatcatatctggaggacctaattctgtgtatgcagaggatgctccctggtttgatccagcaatatttaccattggcaagcctattctaggaatttgctatggcatgcaggtatatctgtgaattgagtttgagagttgacttaatgttttcttcttgtgatttaaatactatttgtctctaagataatttgggcaacatactactgtatattactattttgtcatggaactgaccttgtaaggaaacctgttcataagtaactagatcacttagcaaattactatttatttgtttgtttgtctttccgttggtccatccatccatgcatctattcatccatccatccatccatccatccattcatccatccatttacttatttgagacagggactcacatgtaccactggctagcctagaacatgtaagttaggctagacttgaactcagagatagtcctgccactgcctccctaattggtgggattaaaggtgtgctcctttatgtgccacgactgtacacttttaaacagtgagaattcctgctgtctctcctacctactttcatttgttgttctcaatcatggtcattttaactatttattagacaagaacaatattgaaca

SEQ ID NO: 27917 - DNA, 1225 bp, Mus musculus
tctatgtaaatttttacagtgtcccattgctatacagtttttaccttctgaattttcctaatctactatacagcaaatttgtatttctaaacaaaatgattgttgtagttaggatttctatttctgtgatgaaacaccatgatcaaagaaacttagggagggaaggatttatttagctaacttattcttagtcaggacatgaactcaagcagggctggaacctataggcaggagctaactaatgtacaggccatgaaggagtgctgcctactggctgactcttcatggcttactcagcctgtttccttatccaactcagagccaccagcccagggagacaccgctcataatgggcagggtcatctccagtcaatcacaaattaagaaagtatcctacaaatttccctacagcctaaatcttagggaggcattttctcagttgaggctccctcctttctgattattctacttgtatcaagttgttataaaactaagacagttcattgacctatcaattatggttctccttgagatattagtgtgtaaattttactttttttaatgtttaggggcctgcagaaggaagaaattgttttacttacacatggagacagtgtagacaaagttgctgatggattcaaggttgtagcacgttctgggaacattgtggcaggtaaaaattcagatttcattaaaacttttttcatagtgatcatgattctatatgagatattcttaaattttcatttaaaatctttactttgctttatttgttttttaaaaacatttattgtgcctgtgggtcagaggactgctacagtgttctttccttcacctatttggatctcattaggttcaggtttggtaccgagtgcctttacccattgaattgtgttgtgggtatgtttttatttttttcatagctgttgtaaatgtggtaacttaatgtagtaacattactaaccaaggaaattattcagagtttacataggctttaaaatatttaacttaaaaaataaaattcacacgaataaattaaaacatatgaatgtatgtgtatctgtatatatgtgctcaagaaggtgagaaggttacgggttctctgaagctgagctgcaggcagttttgagctgtctgatgtatattctggtgatcaggggagaaaaagtaaagtttagctcaggatggtagaagtgctagtcatatctttggattgtaataatgc

SEQ ID NO: 27918 - DNA, 1100 bp, Mus musculus
cacggaaaagaattagcaaaacattaaatatgacaacaagtcctgaggagaaaagaaaaattattggtgatactttcgttaaggtacctttcttttaatgtggataatgtatactgtcttatgtctgttttagtgtgtttttattattatcatatcacatgccaaactttgctaattctgttttacttttgaatatgcactgtatgtgtgtgtgtgtgtgtgtcctgtggacaggtagacactgttttggtttaataggtatgcatgttgctaagctgctgttctagcatttagggatggtcctttccgttggcactgcacttctgttgggtttaccagtggccatattttaggtaatgtcgaagggaatgctcacatacatgttttaatcacatgcaatgtacaatgttttcagaaatttatttttgtgagtttgatggatctactttcctggttggtactttagaaagaatcaaatttaattgaaactttgttgaaagattgatttctcagaaaattgttctgctctcgtggtaacagattgccaatgaagtaattggagaaatgagtctgaagcccgaggaggtttttctcgcccaaggcactttacggcctgatctaatcgaaagtgcgtcccttgttgccagtggtaaagccgaactcatcaaaacccaccacaacgacacagaacttatcaggaagttaagggaagaggtaaaggcttgtgagaacttggccctaaagtatgtccatgcaacatgtactgttcttccatccttttttgtttcttctcagtactttgaaggttgagtaaccattaccacaaactaattgtagaacatttatattatcctcaaaaggaatgcagtgcatcttgtactcattagcagctcttcattctgactgcttcccacatctcctgtcaaccctagacaaccactagccactctttttctttttttttttccaatttacttttgaagacatgatatctgtttgtattcctggctgactggctggcctggaacttgctttgtagataggctggcctcaaactctcagatttgcctgcctctgcctcccacatgctgggattaaag

SEQ ID NO: 27919 - DNA, 1137 bp, Mus musculus
gtttaccaccacacccagttcatttggactcattagcatgaacattattttttctaattgccttctttgtgtccagtgagaaatagttgagagctgatgggtctcttcattttcttttcttttcctttttttttttttaattttgtgtgtgtgtgtttgattgtgtctttgtgtatgtttgtgcatcatgtgtgtgcctgttgccagtggaggttagaaagagggtattggatccgtagatgattgtatgcatgctgagaattgatgctgcatcctctggaagaaaggagccagggctcttaaacagtgagtcatctctccagcaccagaatttgtttttctttataagacttgtaaggattatacttaaaatgtgtttcaacaaagattatgaatgccactgaatagtaatctaattccttctaagcctcacaggagaaaatatcttaaatgatagtctacttttttcattggtcccttattttcttatagggaaaagtaatagaacctctgaaagattttcataaagatgaagtcaggattttaggcagagagcttgacctgccagaagaattggtttccaggcatccttttccaggtaaaaacacacctgggttttgttggttggtgacggtcatgtggattcagtttagaccattctgaatcgtttctcttcttagggactatgtgacatgacaaagggagagggtgacagggaacacattctttgaagtgcctactgtatttataccgttatgtgactcattctcttttttgtttgtatttagatactatataattcctgggagtttagcatatagtattgcttccagatgaggaagtggagcataaagatattttaattacatttgtacagaattcttaattatagatctaggatttttataccatgagtactgtgtgtattccatggaaaaaagagaattaaatcttcatttctcctcttctgtttttaaacatagggtctcttgaaaaatagttctcttaaaaaataataagattcctctcactcccacctccaggttgctttggatgctctgagttcatgcattcgaggtcagcctggtctacagagtgattccaggacagccagagctacacaaagaaagccggggg

SEQ ID NO: 27920 - DNA, 1599 bp, Mus musculus
gctattaaggatgtgttgtcctggaaagatatttaatctcattgcctcgtcttatgaaggcccaacatcaaccagactctgcataggtcctctgtctccttgaaacaggatttatgtggctcatcctcaagttcatcatgtatttttctacaccacaagtactgtcttcagtgttatgctactggtaattgaacccagaaccacatgtgtatgcctggaaaacactaccaattgagcctcatgcctagttgcattcctggttataagcaagaaaaggcatggcaagagacagtggaaaagctggatagcacttaaaaaatgaacaaacaaccccccccccaaaaaaaacgaaaaacaataaacacaaacattcatctgtggccaccagctgaagaacataccatcaagatttggtcatctcagattctttaaaaaaaaaaaagctcatttgcagtgtttgcagactttcactttactttgcatttttggaagagctattagaatatatttctgttttgacaacagataagtattcataactgctaactattggcagagcaggagctggattcaggttttctgattctctgttgaggttctgtgtacaactcatcaagaatatactttcacagtattgcctcaactggggttctggggggcccattgtctttcagaagtaccagcatcctccctcccagtgttctgaccttgctttcccactgctcccctgtgtgatcctccccagtccccattcttctagactctgcagagtgatgttagaaggcaagccctcgttattattacctcagtgaaggatattcctttaattagcccaagtctagctttaagtaccggttagacgtttttgacttgagaattccttcttgattgaagtagctgtaccagatggcagagggaaactatcttttacttgaggcttttctttcactgcagtaatggcttttgctacatctgcatatgtgtttttgttgagattggggaccatttgtggtaattgaatctaggtccagttgtagtatgtttgtgagtatttaacagccaaatgagtccccagaatatcaagatgccagctttcaacagtaggcacgctgtatgtagaagagtcacagcccatggaaatgttcacgtttgccaactttggttgctgctgtctgaggaatttaaaaaacaaaaaactcaaatctgactaaattggggtgtgtggggcacgtgtgcagagtttttaagtttctcagaaggaaaaattactattaagggatataactggtctattgttagagtcaactaggtgaggaatgtaaactggagagtcttgctgggatcctcattaactaagttcagaccctaggtacagacttttggatctcattgcatctatgttccacagaagttagacataccagcctgtgtagggaatctgaaaggtaaccgacattgttacccatgttgagatctgtatacccccatggactgatttaccctctttcttcctatttctttttttttttttctcttagaagaaatctacccctgtgttatagccacctgcagttctgtgattgctcaggtcataggcta

SEQ ID NO: 27921 - DNA, 2540 bp, Mus musculus
attgaaagggaaactcagagtaccagggcattttattaaaaggcaaggagtcttgcaatgtgctgtaatcacgaggagaaaataacttgtttcctacatctgtcagaggtcatggtaacctggactgagctgttattatttataataggaggaagaagttaataactggttctctgtgttccaagcacaatattacaacttttcgaactgtaaatcttagagtgaatcctcttcctaaggaattaaacagaagcctcattttctttttaacaaggcttcaaatttgtaatttataataactcaaagttaattgtaaattacagggcctctccaatttgagggagggaaacttgcagaatctttttttttttttttttaaaagaaaggcagccaaggtagttacctaaaaatagtacccaggcctatgagtgttggcctgtgaggccaaagcacacactgttcagctgtatggctttggccctgggtggccgggaggtcagcttgaccctgccatgttggtttgatgtgcgaagtcactgggatcattgtgtctatgaccaggctttcgcaccacaggcagaatattaagtgagagagtatttctactgtgattattgacacatgagagaccaaaagaatttttgtgaacgtaaccctggaattctttgggctctccaaagaatttacagtggtttaaaatggttgtcagcatttttccatgaggactttaataaacttagccccgtttgctcaaggttccttttaattgtgaagtgctgatcacatacatttttgggggggtctagcaaagagtagcctcatgttgtgtggtcataacccccacccccccatgtcttttccccactcattatgtacagattctgattttgtatgcaatgacttcacagtttgcaaagtgcagcactatgatcactgatttcatattcctatttgccgttcaccacacccaagaactttctgtaaagggaaatattactaatatctagtttctgcttgtaaacttaagaggaacatatgactctatttttaactttaaagatatttacaaggagtagagctgtttctgtgctggtagatgtttctgtggtctgtgctacttagggaactcaagaggagtgcacttgtatagtcatgttactccttactgtctgcctggagaatcattttatctccaagtgttcagttcttttcagtgatacattgttacctgagtgtcatttccaggtaatgtggaatgaatggggaaatgagaagggattcaaagcaaagtacatttcagtaacacatatgaggtaggctgttttgttgttttattttaatcagtatttggctggtaaaatgataatttgataaaccatcatgttaccaaagctaaaccaaactccttctaagtgactgctgtgaacttgccactaggtggcggtgcctgtgtagctggggagaaagtcaccacctttatctttatctgacagtatggtcagaagctcaagaaatcgggatgtcagcctcaaatttttaattttaagtagtaaccaaaagtttgttgggagagtgattatgcagttttcttctgtcttgactgtttcctgcgactgtctttgtttttaactctgaacatgttctctaactctgtgctaccacatttctgtgtgtgaagtcatgcagccagtgtatcagccctttgtacttagaagtgtggcccctcctctctagcctcttctccaccattgaacattgcacataggattacgaagtgttcagtaagacagtgaaatctgtggcaggcagagtttgtaccataaaaagaccccatacatcacaccagtaaaataggacattcagagtgctcacattctttcctttctcatatgtgtgataggtagactcttagtgttaagaatttttatttcacgatttactcatttataacttaatagaagtcttggattaaatatacaacttgtactgtttgatatattgttttaatttggaaaggataatttgaagttaactgaaatgatggaagtggaatttatactctgcattttaaaaaaagtcttgttattaataagtatgattaaactttgtttttaaaaatgtgttttgtttttctgtaattctttatgtgaaccataagagtatttattacacactttatattagacctctttcctacacgtgtaagtgccctgttgaagtctctggccagatgtctgagacagtgacaggcgtagcacagttacaggaaggaacagtccgtccctgccctagtgtgctgctgtgtgcctgctgggccttcctaccaggcattatgttaggaaggatttgtatgaatgtacacgtgtgcatgtatgaagaataccagcatatcgtttatttcccacctattttgaagtcttagggtagttaataggagattgggcgggtctttcattttatttaattttaattttatattattgtgcgggtagatactcggacacatgcacaatagctgaggtagagaaaattggggtagc

SEQ ID NO: 27922 - DNA, 1228 bp, Mus musculus
gtacgatacaggtgtggggtaccttaacgctgaaagtcaagaaatttcaattcataattttgctaacaggtgcagaatcttgtatttttatagcttttgtgtgggaagcaatttgtagtggagttggtggcaattttatcttactgacaagtacctgatagatcaagctttttgggtacataaaataatctcaaaatggcagatctaaatttcacctttttacctcctgtcaagatgttcaaaatcacccccatcttaaaccctgagaagaccttatagacaaaatttttttccacatttttgccacagataaggtggaacaattaccctgactttattactattacattgtttctgcaaatctgtaaggaaagctgcagagtactttttcctctattaaatgcaaataaaatattttacagtattatattttactgtattaatacatatatgtatacatatatagctatctttgagatatatcttaccaccatatatatgtcctaccacataatatatatcttaccattggtaagccccacactgttccatgcaaggtgacaggccactgtggctctgtgctggtgcgtctcatccctgccccagaggcactggcattgtctctgctcctgtgcccaagaagctcctgatgatggccggtatagatgactgctacacttcagccagaggctgcactgccaccctggcaactttgctaaggccacctttgatgccatctccaagacttacagctacctgacccccgacctctggaaagagactgtcttcaccaagtctccttatcaggaattcactgatcatcttgtgaaaacccacaccagagtctctgttcagaggacccaggctccagctgtggctaccacataagggtttttatacaagaaaaataaaagaattaagtctgctaatatatatatatatatatatatatatatatatatatatatatattaccacagtaaaatatctcaatatatcttaaagatatatatgtatcttaccacaataaagatatatatttatatcataaaacttactagttacctattttggggggggcggggttcgagacagggtttctctgtgtagccctggctgtcctagaactcactctgtaaaccaggctggccttgaactcagaaatcgcctgcctctgcctcccaagtgctgggattaaaggcatgtgccaccactgcccggcttagtt

SEQ ID NO: 27923 - DNA, 1153 bp, Mus musculus
gcttccatagtctgtcaacatttgtctcgtaattgttaaacatagataataaatatgctaatatattgcaaaatagtgctagtctctactcttccctcatctttcttcatcctctaccgaaaataaatcactttactggagtaagctttataaaaggcaacgctgggccatgctgatctgctcaaaggatcaagccctaacctcttaacccagcatacaaagctcttccttatctggctccagccaatctctcgagaccagtcttatctctaatcacctcccacatacactctgacctcccacatgaactgcatgtgcttcttgcattgtatcctcatgctctgcttagttaactttacacatattaagtcacctcgtggtggtctagtaactaagttcacatgtcacattctgaagcaatccttgttacctctcctgatacctttatcagcaatggcaggccttatttggtattttcttaaagatctcactatgtatctggttggttgtcattattttcttcattattacatctagtttattttgtgtatcatggggtgaagggcatatgctatggcacaataatggaggtcagaggacaacatgtcagaatcagttctctcattttaccatgtggatcctgggaatgtcaggcttggcaccaagtgttttttaccccagagctatttcaacagcctctcaaataaaaattgtccaagacaattaaattgtatactgagttcccagatgtataatgtataaacagaaaactatctgagcaagaaatgtagtaatttttgttttactcaacacatatttctgtattggttttgattgttctttttacctctgttaatctttctagttgtggggtcttttcacttttttttattttttagtattcgaaatatatacatgtatgatatgtgaggcatacttgtgctcttatgtgggtactggtacatacattggtgagatatttctggaaatgctgcttaattaattagtatgtgaagtttttgtgagataaaataaccattgttaaaaactatgagaatggggtcctttcccagaattccaagttagttttctatctggatttttgaacaagtatgtgtgatggtatgttcattagtaaaacatgtaacggggt

SEQ ID NO: 27924 - DNA, 1193 bp, Mus musculus
attcaggaaatctgcatagagacgcttagactttataccaggaaaaaggtaatctcagttactcggttggtgctgatgccattttggagattgtaactgttataaaaggaatactaactaatgtcactttcatccatcagcctaactatgaattgctggaaaaggaagtagaaaaaagaaaagtagccttacaggaagccaagttaaaagcaaagggattgaatcttgatggaactccagccctttcaactcttggtggattttctccagcctctaaaccatgtgagatacattcagaattaaataaaatgtaggcactggaagtgtatcctccttagaaagttttggcattggtcagttgcctagaaaccattaagaaattgttagtattgtgtgtgttgggtttttttgttttgttgttgcttggtttggttttgcgacaaatcagcttaaggattagaagtatagtgtatgttgtataggaaacttctcctcagctaaatcctgtttttaatatgtccttttccattaaaagcatcaccaagagaagtgaaagctgaagagaaatcaccagtctccattaatgtgaagacagtcaaaaaagaacctgaggatagacagcaggcgtcaaaaagcccttacaatgggtaagtatgtatacctcaagggcttgagcactcagtgttacacctttgtaacaggtggtacacctccggaaacaatataacaaatattgcctgcatttttttttaagtgtaagaaaagacagcaagagaagcagaaccagcagaagtgctagtagatcaaggtcaagaaccaggtcccgttccagatcacacagcccaagaagacagtaagtaaggggtcctgggtggtgcaggccttggactcttaaaattaacatgttgtttttttttttttttttcctccagaattaggaataagtatttcatgtttttgtatgttgtgttttgttttgagcaagttttagtatatagcattaatttgctaggaattacttggacttttagcatagaggaaaaaactttggggacaaacttcaaatgtatgtgtgggtcccagggactttgggcttggtagcaggcatctttacctgatgagccatttcattgactctagttgtgtgccttaatagcatttttgtttattctggtcatatatcccgaccctgt

SEQ ID NO: 27925 - DNA, 1176 bp, Mus musculus
cctgcatggacggggtaggcgagagccgctcctccgggatcagcgagtggtcgatggtgagcgacacctccgaatacaggcggtcgccgatcaggatccctccggtcgtggtcgtcgtcgtggtggtcgtgccggagctggagccgcccgcgctcggggcggcggacgaggcggaggcggcagcggcggcggcggcggcagcggtcgaggtcgggtgaggcccggacgccatagttccagcgagctccacgcacgcccgacgcagccggaacccaaagcgagactaaccagcgtcctcggcgcgacggatcttcccgtgaccgccggcttccaggccgccgcacgcagcgtgcgcttccgccctgacgtcaccacgccgacacgccctaccccaccccactccactccccgcgcgcgccaacgagttcctccgcgcttcggtcggtgacaccgggcggaggggtccggatgggcagggcggggcagggtgctggcggctcaggggtggtaatggctttagtcaccggataacccggactctggcctggtgagtcggccccgatacccctgcacggtctgcgcgttggtgacagtccggcggtcggcgacaccggagtgtaacaaagtgactctgaaccgggcagcttcccagtttgagcgcctggggtttccggaaagctccgagcgcgcgtgggtgtcggggtgtagcctagaaaggcatgcctagccctgacctcacttcgccgggtttacagtaatctggaaaatccctagttccaaaaataggtttatggcgaggacagtacacgggcgatttcattgcgctggggagtctcgtcttaaagagatggtttttgtcagagtggagagaaagtaactatccctgtgtcaatgaagagaaaaacacagctctcatcttacatggagtttggaataacctaaatctgtgttccgggaccatggtcaatcaaaatggctccaggataacccatcatttattccctttaagatgagagctgtggtttttttgtttttttcgagacagtttctctgtatagttctggctgtcctgaaactcactttgtagaccaggctggccctgaactcagaaatccgcctgtctttgtctcccgagtgctgggattaaaggcgtgcgccaccaccgcctggctgaga

SEQ ID NO: 27926 - DNA, 1174 bp, Mus musculus
tgaagtactagggagggaataaagacaggaaatttgtttggtgagagctaacttgggcttgagttaaaaagaaagaaacgaaacaatgtgttctgccggactctgagagaaaactaatagggaaagggaaagttgtagattaatttgaattttttcatacatgtaactagaacatctctgtaaaatgtcctctagtgacttgaaactgaaatgtcctaaagcatacacttgcttgcctatgtatgatccagctcctctaactagctgctgcctcctttttgttaacgtcactggaccttgtgtgtattttctgcctcttccacaagaggaaggccgactgtaatgggctatacagcctccctccttagtacccagtgacatcatcattgccaacatagctctgtactgcttccctagagtacttattaacttaaaaggtttcttctttttctatataggattaccaaactaataacaatgaccaggcggtggttgaaatctgtatcacaaggattaccacagccatcagagagacagaatccattgaaaagcatgccagagccctggtggggctgtgggattcctgcttggaacacaacctgagacctgcagggaaagacgaagatactccacatgcaaaaatcgcctctgatatcatgagttgcatcttacaggtatgtcagtgtgaaacagcaggcaagtgggtactgagttggcagcttgtgcgaacacatgatgtctctgaaccgagaggcaatttttttgtgcccgttagatactgtaaaaagacaccacacaccaccgggagctaagccagcaggttgctaactaatcaactgagaaaatcctactgagtcccagctgtaggagagccatactgtaaagaattcaaaataataccacagcaagcttgagagcacgcttgaggaggccaaaagaagatggcagatgtcctctatcactttccacttcttcgtgagacagtctctcacagtatggagatgagcactgcaggcacatttagctgtgctcagctttttatgtagatgctaggggtttgaactcaggccctcttgcttgcactacaagggctcctgtctactgagccatctccccagcctgattaactcgttttttttaaagtctatttcactatgtactgtgaatacccatc

SEQ ID NO: 27927 - DNA, 1107 bp, Mus musculus
ttccccatccccactaatctataatcctctagagcaaagcacgtcttattcacatagattatatccttcttctcaccccaccccccacctcctcacaataccttacacattaatatttcctaaataaatatttgataaatgcatgcaaagatggtatacccttaaggactttaacaatttctaggagagatgccaagatttcccataaaagctacaagacccaacaaggcatagctgagatattaagtactgcggaagttgagctttgcctcgtgcctgacatagatttactcatgtatcaaaagcatacagagcatgcgggtttgggggtttgtttggttggttttttttttcacactattctttactgttattaaggtttcaccaatgtctttcagttacagagcacttcacttatgtaattccacacttgtgcatggattgggctctgcaaactcccctgaaatctctcagacactgggccaccaaccaggcagcatacaagagctggtccaaggccccagacacatatacagcagaggactgcctggtctggcctcaatgggagaagatgcacctaaccctggagaaacttgagtccccagggagtggggaggcctggggggggacatcatcttggagataggggagatgagaaatgggattagaaactgtgggagggcagacgggaggggggagcaacgactgtactgtaaaaaatataaaagtagtataaaagaaagagagagagagagagagagagagagagagagagagagagaaagtctagcggtggtagcgcatgcctttgatcccagcacttgggaggcagaggcaggcggatttctgagttcgaggccagcctggtctacaaagtgagttccaggacacccagggctatacagagaaaccctgtctcgaaagaagaagaagaagaagaagaagaagaagaagaagaagaagaagaagaagaagaagaagaagaagaagaaaggaaggaaggaaggaaggaaggaaggaaggaaggaaggaaggaaggaaggaaggaaggaaggaaggaaggaaaagaaaatgctaaactgaacaaagaaatagaagaacttaaag

SEQ ID NO: 27928 - DNA, 1180 bp, Mus musculus
ttaacttaggtactcttgtatatttttcagaatttttgctggacatttgggtatatagtatttattagtacttgatactttattcttgatataatatatggttaatacttgctagttgattctacaccttcctttcttgggtcttcctttcttttccttcgtttagctgcatatcacctacagtagcctcagtaacatatgttgaagcacaattgaaaagcataacctatcaatgtgggatggggaaaagctgttggtagctaatttatatacttttattgtagaatacaaggcatcttaggaaggtttgtagattatctttcaatcacattagaaatcaattggtgagttcttttttaaagaattattctgtgaggattttcaagaaccttatctcgtgtgtgtgtgtgtgtgtgtgtgtgtgtgtgtgtgtgtgtttgtgtgtgtgtgtgtgtgtgtgttttgtcctagggattgaacccagggtcttgttcatgtcaagtaaacattctaccactaagctaatcctgcacgtgtcagtttgagggaaagacttactatccactaagttagttatgctgtttgcttgcattgccgattttgtttctttgtacccatttcttcatttctctaactgccaacttttaccaggtctgacattgtcctgttattctcttattaaaatatgtcaaggcatttgtttcttgtttgagataatatataaaaagaacaagtgatagtgatttatagctattctggcataatttgttgtagagtgcttttttttccccctttttcactcatgatataaaatatcacttctattaggatgtctgtggcttgtgtcttaggtcctgggcatcctgaaatgcagaaattatttgttattaaccttgtttcatcagtttctaacatgatgctgtctagctaataattgatttctgaaaaacttaatactattttcagtggattaattgaatgatgaatttctcaatgaatttccagcactcattttaaagcatgttctgtatgggaatttgaaatttttagaaaaaaatctaaaattattactattatcaattattaattatcttaactgcagtttcctctttccactcctctcagtccctccctctcctcccccaaatccacttttccttcattcctcttcagaaaagag

SEQ ID NO: 27929 - DNA, 1146 bp, Mus musculus
gcaacccgtcaccttcctggtagatactggggcccaacactccgtgctgacccaaaatcctggacccctaagtgacaagtctgcctgggtccaaggggctactggaggaaagcggtatcgctggaccacggatcgcaaagtgcatctagctaccggtaaggtcacccactccttcctccatgtaccagactgcccctatcctctgctaggaagagatttgctgactaaactaaaagcccaaatccactttgagggatcaggagctcaggttgtgggaccaatgggacagcctctgcaagtgctgaccctaaacatagaagatgagtatcggctacatgagacctcaaaagagccggatgtttctctagggtccacatggctttctgattttccccaggcctgggcggaaaccgggggcatgggactggcagttcgccaagctcctctgatcatacctctgaaggcaacctctacccccgtgtccataaaatacggaccgagttcagttcggaccggtggtagccttaaacccggccacgttgctccccttgccgggaaaagagaccccccacgactgcctcgagatcctggctgagacacacggcaccagaccggacctcacggaccagcccctcccaaatgccgaccacacctggtatacagatggaagcagcttcctgcaggaggggcaacgtaaggctggagcagcggtgaccaccgagaccgaggtaatctgggccaaggcgttgccagccgggacatccgcccagcgagctgaactaatagcactcacccaggccctaaagatggcagaaggtaagaagctaaatgtttatactgatagccgctatgcctttgctaccgcccatgtccatggagaaatatataggagacgtgggttgctcacctcagaaggcaaggagatcaagaacaagggcgaaatcttggccttactgaaagctctctttctgcccaaaagactcagtataattcactgcccaggacatcagaaaggcaatagtgctgaagctaaaggcaaccgaatggcggaccaggcagcccgggaagcagccatggggactgacacaaaggcctcctcacttctcatagagacctcaaccccgtacactccagacttcttccatt

SEQ ID NO: 27930 - DNA, 1108 bp, Mus musculus
tctagatgttgccaagttggcaatattactaccatgacataagtgtgaagacctgagagtgtttgtacagtgatgtacaactgtattgcagcactgaggaagttgagacaggagaattccttaggctcctttgttggccagtttagccaaagtggcaagttcctcgttcactgtcttaaataaaaataattgaggatgatacctgacattaacatttgcccctccatgtgcacaggtatgcatatgtacgtgcacataaatgagcatgtgtacacatatggccatacagacagacactaacatggatggacacagaatgttattgaatgtttgatgtgaaagtgtgagattaagcattcttttctgtatttgattatgtatatttcttttctttgtaaattatccattcaagttattcattcatttgtttttctttgtaccagtttgaattttaagtgtagtttgaatttcaagtccttttggcatatgcattgcaccttattgctagtttatgccttatattttaattttgttgttgttgtttgagacattatttctctgtgtagctctggatgtcctgcctctggatagcctgcctctgccctcccacttgctgggtgctgggattaaaggcatgtgctataccacccagatgtattcattttcttaatgatcttttctgcagaataaaattctattttatacatgataaatatctatgaaatatctatttcatagatattttttcatgatgtgtaagagttcattgactcttcctataatactaagatctttttcttcttaaaaaaatatttattgtttacattctaaatttaaaaatagttttctgcccaagtattagagcagttaatatgaattacattatttaaatttttaatttcaatgtcaaatctttcatttttattatgtaatttacctgttttgtgtgcatatcttatgaactttgtattctataacatttgtagttttgcctatttgagtgtttggatttttttttttttgataaaattcttgaggatttttttgttgttatcgactatacaactattcgcatatagggtattttatttatttattgttgtattac

SEQ ID NO: 27931 - DNA, 1189 bp, Mus musculus
tcttggatgaattggaattattaataatatttcaaatatttgatgatttgttcagttctgctcttccagctgcactatggactactctttatgaaaggcaccaaacctggacatagtggtagatccctataaacagggctaggtggctgtggcaggaagatgtcagttcaaagtaagcttggactctttagcaagttctatagtaaccttggctgcagcaatgagactcagccttaaagaaccaaaccaaagtaagacataacagcagccactgtgacacttgtttttagttctttggcatctgcctgaaatccttgcccttactttaattaattaatttcataattttcattgcatcagatcaaattttatatttcattaaagacttcttgacagttaacaacagattacagcagtttctctggaagtgttaaaaactttgccttcatagcatcacagcaggtatttcatttgattgacttttatgattatataacctttttctcccaatcattattattcaatctgtctctcctttatatatcatgttcttcatacctcgcttagattctaccttatagaaagtatttgctgaatatctatcatctgtctctgcaaaaacgattccattcttttgcagtttctcaacattttctgcttctcaagagttttgtctcattataaatactaactataatttccgtaaagtgtataaataaatatacaatatcggcaaataactatgaaacataagcttaggttgcaccatgcagaccaagagataggactttgtgagcttgctggaagcccctcccctctgctgtagctacttgcattcctatactattgcatttgtcattgttttgtttatattttactgaatcgaaattgctcagttagataactaagcttttgattcttaaaaaatatatttctttaaggatctggtgagatggctcagcaggtaagagcacttactgctcttccgaaagttctgagttcaaatcccagcaaccacatggtagcttacaaccacccataatgagatctgacactctcttttggtgagtctgaagacagctacactgtacttatgaataataataaataaatctttttttaacctatgttttttaattagatattttcctcatttacattttcaatgctatcccaaaagtcccccata

SEQ ID NO: 27932 - DNA, 1579 bp, Mus musculus
gtattgggatacctcgggctaaatgttcattaaataaaggaatcgtttttgcttagagatcgatttgtatcacgcgttcttttgaaacctgtaacctgacttcagtctttacctgtggaaatcatatgcccaatattttagtcatcactgtgcattgctgtgacagaagacctggcctaacttcagggaaaaggtgtattttatttcatcttatagtttgagcaatgtcaggccatggtcagctggctccactgcgtggaggcctgtagcaggcagaaacactgcaagaggccacgtcccaggaaagccactcactaatgcctgtcgggaagcaaagagacaggcaggggctaaggccatggtacttcagggacatactccagccacctgcttctagtctgtcccctacctcctggtagctcactcagctctaagtgcatggtgcagtccattgataaagtcctcatgctccggtaaccgtctcgggacaccaccagcacacggccaggctttaaacatttgagccttttggagacagttcatagccagaccttaatgcccatgctagactatgtgcctgacccagtgtcatgatggaaaaagaatttctgagaaataagagctcttgcagcactcctgctaggcagtgtctgccccctcctgaggaagccgctgtgtcgtgtgtagaatgacattctctaatagacaagcgtggacatctctgaagtccataccaaacatgccagagggaagagctatgggccttgctgtacaaaatgggatttcaacccctggcacaaacacttttttccccatttttctctgcttgcttttacactgactctctgaagactggagctgagggcacagccatgggaaggccctgggacatgaggtcatttagattccatcttttttacactttagagctactgaagttctcttctctgttaaggatgaaaagtggcaggaccttacactcagttgcaagtactataaaaacgtttatgttaaaatgtttgttttcatgtagatgttttcttgatctaagcaaaggctattttccttggctctacaaataaacatgccgagaatgaaggaggcccatgtggttgttaatgtgaacacggctatgcagtagggatttcggaagggattaatctcaaatattctgctttttaattctttatattatttgtaaactgtgtgttcccatgctattaggaagtgtatatctaggaatggatatacgctatcaatgggtcatagggagtcttccacacttcttccatctatactgcaataaaaatactgtgatctactttctagtattccttccccctaggtttctcaataacaggtacaccaaatacagatgcttgaattgtaacaaatttgcatcttaaagataaactttttgtggaaaataaaaaaagtcaagctttgtttggttttcatttgttttaagtaagcaaataaacttggtcctaaagaacactgtgactgcttcctcccttcgttttgtcgtgtcattaattttgttttcttctggttctttctgaaaaccacaatatgccta

SEQ ID NO: 27933 - DNA, 1164 bp, Mus musculus
tagtggagaaaagaatactgtaatatatcacatctttttagttaggacattcttattacgtgactgggagggtggctggtgggaagaaatacactaaagttttgcgtcttttaaaacatcccaggggtcttgttctgacgttcctcatgactgtacatcttaccatccttcatcgcttcccaagcccggctgctcaggaaggcggtcatcgggtgtctagcatggacttggcagtatctagcaagtttatttaggtaggtctaggaagcgggtggaaacgtacagaggacacagatgcagtggcagtaggcacatctttggaagggtttgtcttaaagccgggggtaccagagtgttcagtgagtaaacgacgtgtggtggatgagtgccaagtgctcagagacagtgtgtgtaagtgctgttgatactgtcctgtcaaacaccacttcaaaagaccttatgaatagatcatttagatatcccccttttaaatgaaagccagttttgaagtgtgtaactaatttatattatctagtacagtttcgaaaataaaaatcatttctttgtcagccaaaaaaatcttgagctgtaagaaaaaaaaaatagggacactcgctaggtaggtgaggccctttagcctagccggcttcagcagaggcaaggctgcatgtcaggcaggatgtgggcggctggagcccgagcagcccacactgcctttgttttttcctcggggcgaatttcttgcgttttcccgtcgttttgggcaaagggcttaagagttactcttaaaagtttatggagtcgtttggaggccatgagcttttgttggccaaggctagctagcggcagatggagaaactataacagcttccagattgtttagaatgctgtcttccctagacctcttctctccacaggaaagggtgagattaaccccgtgtatttcccaatcccttaaactaatatgcacaaaatctggctgcataggtcctctgctttaccgtgaaagcaaacagttctgggatgagtcccatataggggagctcatagcaatgctattcagaggcagagcagggtcccgcggccgggatggggtgggggcagtagggggagccgatcgcagggcttctcctcgcagactcacctccttgctggcctgctgga

SEQ ID NO: 27934 - DNA, 1140 bp, Mus musculus
tcttcaaataggctttcctgtctgggataggcttttgcatcttttaaacataaaattgtcaatagaaagctaattgtaaggcattaagttgatatatccctgtattttcctcatttttcaataaattgtgctaaaatacttttttatgtttgtttttaggttcccctaaataatatgtttggttattccactgagcttaggtcttgcacagaggtaagcagctttaaagcgagttaaacttcacttcagtgcagttcagaagctactgtgcacattacctccaccctgacctgcatgagcaaacacatctctctctctcctgcagggaaaaggagagtacacgatggagtactgcaggtaccagccgtgttcaccatccacacaggaagagctcatcaataagtatttggaagctacaggtcagcttcccgtaaaaaaagggaaagccaagaactgactctcctcactcaggatatactgactatttgactaccacacttggggatgatggagtctgcttgaatgaattctgacggcagaaacaaatttaggagcccctgctggcccacgttcaggagcttctgtatgtacgccaaggataactgtgtatttaaactgtattgactatttttattgtttagtaaaagaccttaaataaaattatattattactgatgtatatataatattatataagggaagaagagaataattttcagcttaaaatatatataaatttacttcactgctttttttttttttggacataagggctgtgtgtatatagcccctgttggcctcaaaactcacagtcctctcatcaagaggtaggattctgggcacacaacacccgacaccgtgcacatgtatgtacgtctgtggtttagtgtgtgaatgtacatgccagaggttgtcttttgtagttgtcctctaatttaattatttaggtaaagtctctcactaagcctgaagcttgtgttgctgagcagaacatccagggattccccctgcctctgtttccccagactgggattacaggtgtggtccaggcccagctgttttcacatggttcctgggggcttgaactcaggtcctcatgcatgcctgcctaccagtggtttactgacagagactcctctc

SEQ ID NO: 27935 - DNA, 1100 bp, Mus musculus
taaattatagcccatgagatgcagttacagacaggaccactctgttccctgaggacctctcagtaggaggttgattcctttcccaggcctccagaggcaaaaggggcatctgctcctgtggctgctgtacagacagctctctcttcattcaggaaggcattttgtacttcacttgccttggagcagatggtctagcagcagaaacagtctaggataaaacccaaaatctgctgggcgtggtgatgcacacctttaatcccagcactctcgagttagagtcaggtggatcttggtgagtttgaagcaagcttggtctacaaagtgaactccaggccagccagggccacgtagtctctgtgtgttctctgattgaaagtctttcaaagccccagtagtgtgtgatttcagatgctaatattaatagtgcagttagtctgtgtgtgaagactttgacagtggtgtgttcctgtatctggaaactgcagcatgcagtctattcagaacctcgggctggccgtcatcgctatccttgctggcatgatcctggactcgaagggatacttgctgctggaggtgttcttcattgcctgtgtttcttgtgagtgtgccccgtggcagcgttgggtttcttacaacagattcaagtgttgatgtttttacagttgggctttgtcatactgctgaaactaaactagacagtgtgcctcagcaggtaagggtgggaagccaggctctgccttggtcgctgaagtagctctcggcttctaggaagctaagggtaaagttctgattttgttcatttgtaaaggcacatggttttctcagatagaaatccctgcagaactacttcttagaaatgacaaactggccaggtgctgccaattctggggataagaagagaggaagaagggtcagggcgggtgctggttgggggtgtcttggctcccactcctatagggctattctgccactcctgggctaagaagcagtggtttcctagggggaaaaaacgctgtggcactccagggctcccagaagcaaagatgaacagtgtgttttagattccgattaagaggggtttggtctgtgcttgcgtttga

SEQ ID NO: 27936 - DNA, 2440 bp, Mus musculus
ttaataagttttgagacttgagtaggatgaagtttaacagcctgtgttttttaaagtaggtggtactctcctttttcatgttacaaagttggaaatgaaaggctaaagagctggctcagtggttagatgtgtatactgggcttacagagggccaggggtggcgtctctcgggaatgactagaggagcagctagcagctctagggaacccagggcctcttccgtgggcacctgcactcatgcacaccgccctccaataaaaatgatttgtatatttctgaataaaattttacatcacaagaagcttaatgactaaaatgtttagaaataacagaaaacagaaattctatcatgtattttacaacgttacactttcattctgaagactgcacggagctgcctgtctttctcgctgccttctggtgatttcctgtgttatgttttgcaggtaaagccgtgagaagggatagcattcgcggctgactggaaaccttcaggaagacttccttttttaaaacgtcatgtagaaaaatgatagaacggaaaatatatttatatttgaaatatgcctacttaaagtgattcatgcagactatcttagcctttcataaccatgtgttgtggaaggtttgtttctggtcgtgaacagtgaacagtttacggaatctggaacattcaggcaaagacctctgtaaggatctgcatcttctgctgggacgatttctaataagggcgtcctgcggatgaagcctttcctttgtattatagcaggaaaaagccacaaaacaggagggtctgtggtagaaggctgttacatacataataaagaatgacattttaaccgcactcactgtgtcctagagaacaatatgtaattgctccatatttccctctaggagattatgtgtgaatgtcgttagtgatggctgctgagcagcaagcctttggaagttttttttttttccttaaagacaataaaagtgtccttcagtttatgatggctacctatatacatggatccataaaaccaatgcaaaaggtagacttgatgcctgccttatatttttacaacattgcaataacaacttcaagtttcctgtggaagataatttccagaaatcaaatctgcaataaagaaaatgtcctagatccaatctcattgaatagttttataggtgtaaggtacgtggggtacatagccttgtatgcttcaagctttggcaccaagggctggagagatgactcggtggttaagaacatttactgctctttaagaggaccccaggtcagttttcagcatccacatggggccactcatagtcacctaactccagctcccagggatccagtgccctgctgaatcttaagcagtacagaaacagtttgaaaatgcattccttttctttttggtttatagtttgttatgcattcttcacttgtgagcttcgaggctttgactacatgtgactctcatagcacatgtcaagtatatgaactggcccctctgcactggtcctgtcttcccactgtgtccacatgaggtgtggggagccttgacatgcttatgaatgggctgggtgcctgctcggctcacagggttgtccatctcgatttccttctcttgagtgtattctctagtgcacactctaacctggttccatctgacttaaacaaaaaccgtagtttccagctcagaatcatcctaacatagaaacttctctaggccactcaggctgtatacaattaatgatacctatgaactttaaagcctcatcctgtgcctttttagctcactttgatttgtcaggaatttgtggcattgtgggcttggggtgtatttgatcgtccttagattgtcagctccatgagagcagggacattgcctggtttgttagtgactctatcctagtgcctagcataatgaatgtacaaaactttttctttctcctttttgtataatgtataaaataaaaagtaattggaacaacctatttggaggataaatgactgctgcagactaaccccttctgggtctcctatctcaagaacttccttaggcacagtttgcaaaacacaagaaacatcaaacaagtttccctgggtctctcctgctgtgcttcatttttggctaacgtgcagggcctctctcagcctcccctgtgcaaactgagggtgaatcagcaggtaaagttttaaccatttttttttccttttcttttcaacatgaaacatagaacagtcagtcattcagacaatgaaacaatcattcagacacgaaacaaaaacatacatgaactgacacgtggacagattggttcaccaaacatacacaatacaaagaaggtagagaactcgatgtaatcaaaactaaggatttctcctgtaggggccagagaggaagcaggacatctaccgatttctctcggtccctgggagagctcc

SEQ ID NO: 27937 - DNA, 1995 bp, Mus musculus
catgttttaaaaaatctcaatcctaagcagggagtgaattcatgaatgtttgacttatcatgatttataatgcacatctaatacatatttgaaatttaaaacaagagtttttcaaggggttgggtatgtgtcccagttattaggatgcttgcctaccatgcacagtgccctaggtttgatcccatatgaacataacatggttgcacatgccagaaagcccagcactcaagaggtaaagacaggaccatcagaagttcaaagtcgggtgaggatctgtggggatgcccagaagagcgaacaagagaagggacagacctagagttattaagaatgggcctttgcattgtataccatttgggctattagcggtgctcctgggcaggagcctccaagtaccccatcccctcctgtcaccatgacttccatcataacttctaaggggggaggggaaggggggagattttatatatatatatatgtatatatatatatatatatatatatatatatatatacatatatatatatatatcaagttttaaattattgatagtttgtctggattaccaaaatcactctttagcccttcctgtggctattatgccgacctgtctcccctgcctcttcccgcttccctcaagccaactatacagcccaccagaaggctctggcagtgcccatgggccccagaagcaccagctccttgatcacctggggtttgccatcacggtgtctctgctgttccacatgcccttctgccacctctggggtaaggaaaccaaaggatctcagtgggggtgggagcttcagcctctcccctcccccctcgccccaccccagagaccctgctcacaccagaagagactattgaaagatgattcattttattttttctctgacctttccatccttgggaaaacagaaaaacaaaacaaaacaaacaaacaaacaaaaacaaaaacaaaaacaaaaaaagaaagaaagaagaaagaaaaaaaagacaaaattgaccgcttaaaaaaaaaaaaaaagacaaaaagacaaaaaaccagagcccacctaatccatagaaagtaatgtctttctccctccttggaatttttcttctgttctgtttttggaaataatattttttttaaagttgccttattgtggagcgggaacctgaactaatgcccaaatgcctgttttccttgagcctctggaagagctccacctgcctgggatgtccctggacttggactgactagaactttcctcaagactgagttgcatgtacggggcctcctacctggaggcaagagttgggacagttctatcagagctgtgcccaggacacccttgctgttgcattgtctgaagccaatgtcctgtgtctgcacactgttgccactgtccttgttgtgcttgctgtcgcctctccaggcccactctgctctgctccaccccgccccgccccgcccagccctgggaaaccccatggccaagtttgcttcagactgttgtaaacataattggtcttgcctggttaaaaaaataaataaataaaaaagttcaaagtcatctatgtctacattgcaagtttgaggccagcctaggactcataaatctatgtcatagatggatagacagacagacagacagacagacagacagacagacagatagattaaatactaagctactacctggtcataaaagctacatgtaaattagtattatcaaattcagaaaagatgataaaataggcaacctcctcaagtagtagctgtttcattagccttcactaatggaagtgtgaggcttcatttactaatgttagtgttagacaatgtaaaataaagtttgttctttctaaagacaagcatcatgaggcagccgctgtggtgtgtgtgtgtgtgtgtgtgtgtgtgtgtgtgtgtgtgtgtactgttacaagagcacaagagcatatacgcatatacattggcaggaaaatcagcaatgaggaagttg

SEQ ID NO: 27938 - DNA, 1433 bp, Mus musculus
cccctgggctatgagggtgaaaagtgcgcgcccgaggctgcgcacccctttgctaatttgcgggttagttaaccggaggaagtcaacttgtgcggggagggttggaggcagctcaggctgctgttggctcccgccccaaggcctcttagggcgatcgcacctcacggctggccggcgccgcgcgcggggaggtccgggtgggcagcgggcggccggaacagtgggctctacccggccactcactctttctgcctcccccctccccaggattaccgagaggatgggatggatctaggcagtgacgccggcagcagcagcagcagccgcgccagctcacaatccaactccaccaaagtgaccccttgctccgagtgcaaatcctcatcgtcgccggggggtagcttggacttggtgtctgctctggaagactatgaagagcccttcccggtctaccagaagaaggtgattgatgagtgggctccggaggaggacggggaggaggaggaagaggaggacgatcgagggtatcgggatgacggctgtccggcccgggagccgggggacgtgagcgccaggatcggcagcagcggcagcgggagcaggagcgccgccaccaccatgccgtccccgatgcctaacggcaacctccatccgcacgaccctcaagacctcaggcacaatggcaacgtggtggtagctggccggccgaacgcctctcgggttccccggcgacccatccagaagacccagcctccagggagccggcgcggaggccgaaaccgggcatctgggggcctctgccttcagccaccggacggcgggacgcgggtcccggaagaaccccctgcgcccccaatggactgggaggcattggaaaagcatctggccgggctgcagttccgggagcaggaggtgcgaaaccagggtcaggcgaggaccaactccacctctgtaagttggcccgggtgcgtgcccacgcgcgcacacccgcgtacacacctcgcgcgcagcccacacgccccttctccgcgctctcgccgggggtggccccattcatcctttcccgagggtgggggctgggccggagagcctgcctcctgctcccctggggtacgcttgctctgtctgggagctgtctgggtttacaggatgggcggagagaagggaggggcagccagagggcagcagaaagtcgggctagaggaacccgcgactcattttgatggaattacttatggagactaggttgtgagtcacttgcctgaaaataaatctagggagatttcctgaccgaagtcagtgcctgcgggggctttttcacactataatagttgtggctttgtccatcctcgtgggtcttccagcgtctcccctcacatctccccctgagccaggcagtgcctgtgcacatgaactcagtcgcctgcccacac

SEQ ID NO: 27939 - DNA, 1433 bp, Mus musculus; identical to SEQ ID NO: 27938

SEQ ID NO: 27940 - DNA, 1220 bp, Mus musculus
gattacgcagtcaggaacctaatgctggaaacctacggtgtgggatacaagtatcatttctatcagagaacacactatgggagaatgataaagttttttctttctgtgattagaaattatgaggactaaatgtatttattctatggttcaacagtttatcctacaatatctcatacggtagtcagtcttttttgtctttctatgctaatactaatcttactcttaagagtgcagatgcaggtctcttccaggaagaactaggacttcaaggagacaggtggttcagtggaaaggctgtttgccatcaatcctgatgacctgaatttgatctcctggaaggaaagaagacatggacccacacaatacatacaacatacacatcatacacacatgtacccacacataataatagtgatgaaaggagaatatacatacatacatacatacatacatacatacaacatacacatcatacacacgtgtacccacacataataatagtgatgaaaggagaatatacatacatacatacatacatacatacatatatacatattctgttatatagccttggttgtcctagaactcactatatggaccaagttgacctcaaacttggcgatcctcctgcctctggctccagagtgttggcattaaaggtgtgtagagacatacccagctagaaaaagaggtctttattttaagatgtagaaggaaaatgttcaggttgtaaacacaccagcttgccagaattgaagccttggcttagtcgtagggttctgctcaaggtcctgagttcaatacctcccattagttgtagggtccttgtctaatcgtgtttgaggccctggattcatttgtgttcaaggcactggataataataatgaagaaattaaatagatttaaggaatacccaatgtgagaaacttttgtaaatataatatttttattctttgaaaaattcatagtgttttgatcatattcacaaacaccccaattttgtgctcactctattgagtgtaatttgggctgcccatatcctcctgagtgtagggccatcactggagcatggtcgacttgccagggtctcactcttaaagaaaactggccctccctccctcagaagtccttagctgcctgggtcctcagttagggatggggctgatgctagaacattggctggcttcatcacgtgtactgtggtagtcctgtggaggag

SEQ ID NO: 27941 - DNA, 1220 bp, Mus musculus; identical to SEQ ID NO: 27940

SEQ ID NO: 27942 - DNA, 1153 bp, Mus musculus
ggcttcagagaaactcgatttaggcttaagtaggaggaatgaagaaaattaaccgaggtatgcttttattccgttttaatagtatattatagataaaattaccatcctggaggatacataatagccccatcaagatcactttcagtgtgttgaaaacaatcttcaaagcagggagacaaccttgcttttggtttttatagctcctgcaccctggaaacttgcaatgtagaagtcataaatccgattctctcgttaggaaaccccattcattacattatgtattgtgaaaggtactaaactatacaacattttaaggctaaatttttgatttcactctttcagaagagcaatacactgataagaatctaccctgaaagctacttctggatataaagcctggcagaaactacatgatgcggccaccacatccacacacttgaaacagcagggccgcggctgggtacaaagcttaagaggggcctgctgaatgctgagtgttctcgcacttgtaagaaattaagcccaggcacactcaacacattcctggatgcgacttcctgttggcttatttatacaatctgaacgattcccgaggagagctttattgtccacagaaattgagtggaggtgtcttcagggttggctcttttccaagaggctcctcttagagccaaattatccattgcactttcttagagagtttactaaaaatatatgagagtttactaattgctgaacatatgttactggggggaaaacgaaaagaagaggataaattcctacttttaacactggttactttaaatctgtggcgcttcctcccaaccctatattaatctccaaagagaaagaaacaactatgtctgtctgtctgtctgtgtctgtatgtgtctgtttgtgtgtatgtggtgtgtgtgtgtgtgtgtttgtgtgtgtgtgtatgtgtgtgtgtggagagagagagagagagagagggagagagagagagagagagagattttaaagccttggtttaagtctaggcaggcaacaacagttgatgttgtatcttggagtccaaagctgagaggcagtcttttttttctgggacctgtgttgcctccttttcagttgaatgggtgagactggcctaccatatggaaaaggatgttct

SEQ ID NO: 27943 - DNA, 1153 bp, Mus musculus; identical to SEQ ID NO: 27942

SEQ ID NO: 27944 - DNA, 1147 bp, Mus musculus
ttaagttgacaaaaaaaaaaaaaaaaaaaaagcaaaacaaaacaactccaggttctcatagcaagcttggagctaaaataaaataacatgtgttttaattattccctgccataaatggtgaaaggagattcacgaaactaagtgtgacatatgtcatatctataaatggcagtttagtttccaaaccccttgctcttgcctctggatatatgttgtcttcgttagggctactattgctttgatgaaaccccaggaccaagaagaattcagggtgggggggaggtatgcagtctctgagggaaaccaaggctgaaacttaaaccaagcaggagcctagaggcaggagctcatgcagagaacatggaggggttcttactggtttactcctctcgcttgctcagaaccaccagcccaggggtggcgccaccatgaatgtgctggtccctcccttctcagtcactaattaagaaaatgccctgtagacctaagttcagccggatcttatggagggatctttccagtgagggtgcgtcatcccttatcattatagcttgtgtcgtgttgatgttaaactgcccagcacacatgctgattatgaatcatttccataaatgctgcttggatgtgagggtaaaacctctggaagtgttgacgtctcaatagagagataaatctaagtcccatagggtacacagaagctagggtcagtgtaagagagccccaaacccagcccctaagttctgtggactgagtaatgaagggctggagcactaccctggccatgcagacaatggggccgcatggccctagccatgactctctgcccaccccttttacgagtgttgtctgtcagctgccaggaatgttggtagccgacagttctcagctgagaccctttggggttaaacagagctgttttgtcttagataatgcctctttctccagataaggccatatctaatgattgattaatgctgggaaacaaaggctctgcctttccctagggttggaacaacttagaagggccagccaacctccagcccccctactgctcgagtgagacccttatttacaggtgcactggagtcagggtataccttggcttactgcttcattcttctcggctgttgacttggagctcgctctt

SEQ ID NO: 27945 - DNA, 1148 bp, Mus musculus
ttctcattgggctttgaactacaggctcagccctttctcacatgtttcagaagtcaaaaataatcatgactgcttgctactgggatgtttttccctctgtggtatcttgttccgatgaccaagaggtgtgtgttgatcaggcaaatgtcatttgatgcctgacctcagaagactatctcagaccgtggctctgggttccataattaaacatggtcctgttataccttttaccactcttctatccgtgctcagaacagtcattctaagtaggccctttttgaggtttcttgtgaccgatgggctcattgagatcaagtgggtagtggtactgctgccaggcccccacctatgtggagagaggaccctgttgctagtgccccaccccagctgcatggcaactagagtgaagcttgaagctgctctcccttccttcacagagcaagcagagttcttcctattcggatagagacacaactgaggaggagtctgaatccctggatgacatggacttcctcacaaggcaaaagaagctacaagctgaagccaaaatggctctggccatggccaaaccaatggccaaaatgcaagtagaagtggaaaaacagaacaggaaaaagtctcccgtcgctgatcttgtaagcagcggaggctggcatgcaagcgggcgtttggggctgaagatgggttctttcccagagttatgcaaacttgggtttctctgaggcagtttgtcagaagcaccggcaattgagaaagaacaaagtccgtttctttttccggtctccctgttacactgagaaacacaggggcagcatttcgtagaattaaatgctcgagggccagtgattcagatctcctgtgttcctgctcttgcacaagtaaaggttgctatagttctctcccacctctttaaggagatggtggaatgtaatgaattagtgccctggacttagcagtcacggttagctctgccactggcctgctgcagggatccgacaagaggctcgcatgccagttttcacatgtgccctgtggataacagcacccggttgggagtatggttgtcgaagacacagtgagaaggcatccagggcaccttacctggcactggtatagagtagtaagcagcagctgatagtgttcatgtt

SEQ ID NO: 27946 - DNA, 1148 bp, Mus musculus; identical to SEQ ID NO: 27945

SEQ ID NO: 27947 - DNA, 1326 bp, Mus musculus
gtttgtttgttcctttatttctgtttttttcagtataaataggtattcttataataaagccttgagttatttacaatgtatgttattctgattgtatgtattctatttgatatataaattgtaaagtatcttccatactttatgaaacaaaaatacaggagaaagggtttggggaaaatggtacaatgtagatgtatatcgaagtttatagttcacataacaaacgctgggaacagctatggtatccatcagctacaattagataaaaccacgtggtattcaccggcagtgattagtctctcatagaagggttgagctgtggcacatgccgcaacgtggatgagcctaggagaacttccactacgtgaagtaggttagacatggcacagacgtcagtcctgcggggctcacacaaggcactcggattaagtaagttcttctggtcagaaaagaggcaagagggacaggccctggaggagggaattcattgtgtaacgctggccattgctgcttggggtgagagccctagaaatggagagtggtgatggttgtatagcatcgtgggtgttgtgaactccgttgtcctctttaaaaggattaaaatgataaattttctttccagttgtttttttttttaaaccatattgaaaaagtagtcaaactgcttttgttgttgttgttactctattgacaaagttggtaaactgcattttcttcattcttccctgacttcagaatatttgggcctcagacttagagtctaaattttcaaaactctcctcactggatgaccctgtttgtctggctttaatataatgcatccccaagtccccaaaagctttttaacagtgacacagacatccctctaaagtgcccttgaccctgctcttagaattggtgcattacagagctcatgcacactaattgggaaaaacatcacccctttccctccactgtaatttctcatgtaggttttgttcatagaaatgccccatagttcccaatatgtaccttttcttttatgaaatgttggactgttcaattcttagtctagagtttggatacacagatatgttcaattcatgaaatctaagcaattgacttatatgttatacatgctttctactttgttaaatttcagtgtaatgtttcaaaagaaaaaaatggttaaattttatgtttagtatgtttaccacaataaaaaggttaaaaaaaaataatgaagtctgtttgtgttctttggtagctaacaattcaactcaatcttgacactgcctactagagtcagcaatggactccacaggccacagatcgcagctggactgc

SEQ ID NO: 27948 - DNA, 1125 bp, Mus musculus
aattagagcccttactttaactgtcgacacactctgaggctgagacttgaattttcgctgtagttcagccaaccttacaatgagagtttctgtttgattttctgcaacttgagctctattgctacaagagagaagattctcctcaaggacacacttagcaacttttagatcgtttacttgtgtctggagccttttgattttatcacacaactccttcctttcattcatcattttttccacagatactaagagcagccagccagtaaaatcatttttcgattttttccccatcttgtagaaagctttgtgcactgaatcacctaattcattaagaaaatcaagggcattagggggagggcgggggagggcgggagagggcgtcctccagcggctccagggctggggtgcggggcgcggaggggcatccgggttggggaagggcccctcccctgagacggcggccggccgccgcgaatggctctcctgctggccgcttgcggaggtttggattcaggattcatccccagtgtccaagactttgataagaaacttaccgaggctgacgcgtacctgcagatcttgatagaacaattaaagctttttgatgacaagcttcaaaattgtaaagatgatgaacagagaaagaaagttgaaactctcaaagacacaacaaatagcatggtagaatcaattaaacactgcattgtgttgctacagattgctaaaagtactattaatcctgtagatgcaatataccagcctagtcccttggaacctgtgatcagcacaatgccttcccagactgccttacctccagaacccgctcagttgtgtaagtcagagcagcgtccatcttccttacctgttggacctgtgttagctaccttgggacatcatcagactccaacaccaaatagtacaggcagtgggaactcaccacctagcagcagtctgactcctcccagccatgtcaacttgtctccaaatacaatctgcaatagcaatctgtagcaacacaatgcagggttctctagagtcacagaacttatggatagtctctagataataaaggaatttattgatgacttacagtcggcagctcaattccataattttaaagagccc

SEQ ID NO: 27949 - DNA, 1148 bp, Mus musculus
tatgcaactttgactaagttaagagaattgtttagcttatacattcttttaggtcttatatccacattatatatttcatgaaataaatcagttcttatatcaatcctgtgcccagtacaaattcacattgcatattcataaacactaaagggtagattacaatagaaattgtagggcatgggatatagctcagtggtagaatgcttgcttagcacacattagtgtccgttggttctcctatagagagggaagaatagttggcataagaagggaaccttgtaggtcattccccttttatacttctttaaaccaagtgtacttattagtcttccattaagagtaaaaatagcattcaaagtcttggggacatgtaccactgtacaaggggtctggtcagtcttcggctacagaaacccaatgcggtagggaagaatggtcaaatctgaatagtaatgaaatgatctatttagttgtttactccttttcattattagggagacttaggagctattgatgaaaaatatgacattgctatttcatcctgttgccatgcattggactacattgttgttgattctattgatacagcccaagaatgtgtaaacttccttaaaaagcataatattgggattgcaactttcataggtttggataaggtaagtattcataataaacttcctataatttaactttgaggtgccatatatttttcccttaaaatttctaatttttcttcaccactattggcccctttttttttttttttttttttttttttttttttaatttaggttgtgtgtacatgttttgggaggttaaagggtaaagtttgtaatgccttgactaaaaacttccagttgttatggtgttgtccagtggatggatgattgttagtatgtttctgtttgagggtggggacaggaggttcaaggcaggatttccttgtatagattggctgtcctggactttgctctgcagaccagggtggcctggaactcctccccattgccctgagagtataggtgtgtgctgccaccacctggctctatgtttctgacttctatcactaagctgtttcttcatagaacctttatggagatgttgtgtaattgtattttaaagtagaactcaattattttcactatatc

SEQ ID NO: 27950 - DNA, 1166 bp, Mus musculus
gctaagcattgattgctagatggaaagtcagggtggcataaacagcacatcaacttcacatcttacaacagatgcagagaaatacgataaacttcccatgcttggctacaagtgctgtcagaaatgagacattacctgaaagaagactaaaatcaaattagaaaatgacaacttttgggttgaatattaataccttaccctgtttttattggcttgctagttaatgttttattctgattaataagtctttttctttaactgttacatgttatagtggctaacttggcagttctttgtatatgtagatataagatttttaaacaaatgacaagatccttgaggtccacaagcctattttgatgatttgaagctttccaatgcacagatggagaggatttataagttgttttaaaaatctaggccaggattgtttaaacctttttttggggtcaaggctattcataggtttaggagcagtcatcccaagtagcactgcttgctgcttgtggataaactgtctagtacacttgagtttaattcatccttgatatcagtgaggtctcaaaaacccatcagaaagtgtctggactgctggctctagcaccacaaagcaaatcaagtacatattttgattttgtattttagccttgtttttatatgaaaactatacgaaacgtacattgggacaattatgtttatgtgattcatctaatagattatgatgtaaaaactatattcatcttaaaatgttttcaccctgtagcttgagtactgggattataagtatgagttgatgctgtacctgtttagttttaaaagaggtcattaagtcagaacctttaattttgctcacttgacatggactaccatgatgcatgtggtagaacttttggttcacagccattgaaatcccctacacaatgttttccagaaaccccttatgaatgctcttgaatggagactttatttcaaataaaagctgtgtttcttaaggtcagaacaatgctgacaagttttatcactaaagtccacttatcagacgcaaaatctaggcatggtaacaaaatgaggtcattttgaagatgcaatgaaggtgaggggaaattatgtaaatattagcaagcgaagaatattggaacatttttcaaggggttactagcttcttt

SEQ ID NO: 27951 - DNA, 2286 bp, Mus musculus
atttcattggtttttttccctcttttccttcagattgatgaagatcctagccttgttccagagtcagttcaaggtggaacatttggtttcaattcatcgaccaatgtaccaacagaggggttccagttttaggaagatgttgtggaggttaggtacaatgcagcaccgagaaacatatatatatatacacatatatataaaaagggttgatccatcaagcttggctcatgggatctgctgctgcattaaatcgggagagaaaatgtgaagatttcatttggaaccacagaaaatgcccaaatgaggtcaaggtggcgagtgggtgcgagtgagaatgagtggcaatgtaaggaaaacttgacacgaatgcttatttaggttgagaggaaagggctacaggtcacaggtcttcggtgcctgagacggagcattgacttactctatcaattgagaagtgaaatgccatcatcatcaagccttgtaagcataaaagcgatgcccatataagtcaaggaaatgagcccaggcctcgctgtgaagcagtgtgtgaatggacagtgttgaatgggtgtctggctccgtgctagagagccaggttcatctttcaaatctagggctcttcgcgcatgaagcagactcctagtcctggggtgactgtgtaacgagagtatggttgtggtgctgtatgtggacgcatgcaagcttgatttgccttcagggggctgataacagacctagtagatcatcaaagtgagatcgatcacaagtgttaatgtacactggacatgaaaacaaagaccggtttagcagcagacattggtttactctgcagcctgtgttttctattctccctctaccttatcccccacccccaccccaccccaccccttttttatttagttttatttactttacctagtatggcttttttagttgcttctcaagtcagaaaacttcaggaaggtttccctgtgcatttgcaccagatgagtgtttgatgctatgaaaagctttccatatcatcaaaactaatttgtgtagatttttgcatgaaaaaaatcataaatttccctcacaatagactgtgttgcagtacacaagttgccataatagtataaaatgtgcttttaaagccattcttttcattttcagagataacataaagatctttgcatgaagtaaatctacagcatagttcatttttagattttgttgagtcctgtaaagaagaaaagtttcagttgtgatagaataccgtgctgtgtttaaatgttaacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgtttaattgttttagaatctttttatcttagatgtaggcagccatgaacaatctattttgagccactttagggagaaaaactttgtatttttaaaacttgcataaaaattatgcaagtggtttttataaattggaataatacctcagttttgaggttatgcacactaaattaaatatgtcataaattaatttgtacaaaaagaactctttataaggtggctcattgtaggaaatcctgtgccttcccctttgagcacaagtgttgcatgaacaacagtttgctataagaaacataccaggttagccaccattagcatctatatctactttgtgtttaaaaatcaactggtaattctgaaacactgtagaatggataaaaattattttgtgatcataactctttgttgaactagagtatttttgcagcattccttgtcatcaaaaacatggttaaactttaaaactagaagcagcagaaaactagcttgtaaaatttattcaagtagagtacaggctaggctgtcttggggaaataaacattaaaacttaaagcaatgttttacaaggggcgtgtgtgtggtgtgtggatttctttttctatttaatgtttttaagagtatacctcaatggctccttttagcttcttatctgtcttaagcctttttcctagaaccatcatgagacatgtcataagccctgtaatttcattctgggggtattagtatttcagttcacagaacttgttcagttgacaccatctacaaatgcagtctccctgttgacactaaccaaggctttgaccttccttcactttctccagtcaagaggattaagagacagcttgagttatatttt

SEQ ID NO: 27952 - DNA, 1207 bp, Mus musculus
ctgacactggttgataagagttcttaatatcaaacatctcgttgcatctcgtgtttcagactgctgcactgcgagctgtgggcaacattgtcactggaactgatgagcaaacacaagtagttttaaactgtgatgctctctcacacttcccagcactcctcactcatcccaaagagaaaattaataaagtgagtatttttaaaatattaataaaatggtactctttgtttgtggaattaggttccatgaatgtcttaaatagcattgactttttagtataagatgttacaggcttcaagagaagatatgttagtctttataatatgctcatggggttctgaattcaaacctagagcctttggcatactaagcatatgttctaccactgaactataccatcaccaataaactgtagttttgactctcttggaaatgatgaaatagagatatttgggtgttgaatgttgctgtgagtggaaaattttaatacatgtagtaattctcctagtttaatgtttcattgatagttactagtgtaagtgtgtgcatgtatgtctgtgtgtgtgtgtgtgtgtgtgtgtgtggtggctatgaaagggggcactgaatggtgatgctgatattggagtgcatctgaggctgttgtagaaataacatgggttgttgataacaacgttgccgatgattaaaacccaaaaacagctcacctaagtagcccagcaccctaaactctctaacaggattattaaacatcctgtgatctgatccaaagagtctagtatatgctagtgttcactatactaattagtatattggtgaatttaaatttggtaaattccaataatgttctccatagggtgtgaaatagttgttgttgttgttgttgttgttgttgattactaacagaggttttagtaatgcttgtgaccactatcattctagcaacaatgtagcatcttcctgggttaaaggcagttttcaacgatcattaaagtagaccaatcaagcaagccaacaactggggccacatttagctcttgagagaactagtacaatgactattataaataaggacactgaaagaatccacttgcatttttgacatctccattattatggctaattgagatttatctactaggataggattgttaaggtagagggagtagaataaagcacattatttgacaaaaggatgctacatttc

SEQ ID NO: 27953 - DNA, 1135 bp, Mus musculus
tccccctaaaatgtaaattctatgagacaaggaagtttatcattatattcctaatggcttcttaaatgctgactgaggtttaatgaacatttatggaaaaataaaagtactcttaaaaaagctgagtgtgtgtgtgtgtatgtgtgtgggtgcatgcacacatgaagatgccagtagtgagctttttgacatgggtgttgggaattgaactcaagtcctctaaagagcggtacattttttataaccactgagccatttctccgggccctgtagaatgctttttaaacagtgcttaaacaaaataattcagtaatttacctcttaatgaagatttgtctattaaagttggatataaaatcacaaagaaagatgaataatattttaaaagtggatattaaggtgggaaatagcaggtaagtttagcttgtttgaagaaatatatactacaagtagaccttgggtagaaaagttgtggtgtgttataaaaaatattgaactagatccaggatatctgagacttgatattcttaagaaaattattctgagccgggcatggtggtgcacgcctttaatcccagcgctcgggaggcagaggcaggcgaatttctggtctacagagtgagttccaggacagccagggctacacagagaaaccctgtctccaaaaaaaccaaaagaaaggaaggaaggaaggaaggaaactattcttttcctgtctctctaaagtgaaataattgaaagtaaatgatttttattctttcttgtgttatttaattaaaattttttattaagaggaactagagagatggcttggtggttaagagtactaactgctcttccagagaggacccaggttcagttctcagcacccacatggtggcttcacaaccatctgtaactccagttccaaggagtcaggcacccttttctgacctctataggtgccacacataaaattggtgtgcagacaaacctgcaagcaaaaacctcatacatataaaataataattaaaactatttttcatttaaaagtaatgaaaagaagcatttagaaaggaaaatttactctgacgaagtcccaagacatgggacagcccattttgaacaattccaaggaaatgaccagcttttgctc

SEQ ID NO: 27954 - DNA, 1203 bp, Mus musculus
ccggctcttctttctttttttaattaattaattgacttattcacattacatcccaatatgaagtgttctgctttttttctgggctccttttgctgttttggagggggtgaaaaaaaaaagtctgactgtgtgtgctgtacttttcaccccagtgcagctgcctgtcctcatggtcacctgcttgtcaccagttccctgcagaagctttttctttaaggagagagcaaggacagttcccacctgcgggatgacagcaagaggcggcggcggctgggggttacacagagccttccctaccttctagaaactgctcggtccgttgctaggtttaaacagttgttttgaggaagacacctcttgagagaatgcgtgtgggttttactttcaggatttgctttcccaacggtaagaaatgcaacctgagatttagcacaaaaaagcaagagaaaaaggaaatggcttgccggggttgagacttgagctttgcgctcagtggccagcgtttgaggatcttgacccacactgagtagaaccccatccccttgcctttgcagaccaggtttgtgccttcaactcacacctgagcatgcatgggggcgtttagacaaaacaacttagtccgtggctgcatcactagaatgactctccctctctcccccagtaatctttacttaactgcctgtaacttctcagggaggggtgaggctttgtgaacccttccccattcctgagcgattccccacaccagctcttgtgaaggcaagttcacataactgccaagttcgtgatcgcaacagttgtctagtcaagatttaagacagtggacccttttccccctaagtgtcggggctcacttcttcatcctctcatcttcctctacccacctcccttacattccttcggcttttgggaatggtgcagatgtctcctgtagggctaagcaccgaataatcatttaatctcatctcccattatgggtctctgcatttactaccacttattacaaaaagaaatttctcaattcaaagctgaggacatcactaatcttaaaggtaagaacataaatattagaaaatgatttgacaacatagccattcagcaaaccccactttgtccctactgcaggtccctagccacagtcttttgatccaagtttatggtgccaggcatgatgtccctctgggacagtccactcaagtccaa

SEQ ID NO: 27955 - DNA, 2410 bp, Mus musculus
caacgtggtcatcccagacccagacatcttgacctttgacctggacaagctgcagccggagttcatgatcttggcctcagatggcctgtgggatgctttcagcaatgaagaagcggttcgattcatcaaggagcgcttggatgagccccactttggggccaaaagcatcgtcctgcagtccttttacagaggctgccctgacaacatcactgtcatggtggtgaagttcaggaatagtagcaaaacagaagagcactgaaccctgccagatctcagctgccccaaactagaggactctcaacatactgttctcttcatgtagtaaaaggtgtgggtataattaggatcatgcgtcccaacacagaacccccttccctgatggccttgaatccctttggagtactgagcagagggttcccttgctgacaccgcagaggctgctaagtttgtgtccccccagcccttctatcagtgtttgaaacacatacataggtagccacagatcccacatatgaggcaaaggaaaggcaggccatatgttttccttcttaataatgtacttttcatgatctcttctgtggtccttcagggacctgacttggcgtcctctctgaacctgggcagggcaagctggtgatgccaacacttcaccatgacaatgaggtggccatgccctctgccttgaagcagtttcctcagaaatgctctccccttctgagtcttggtcttcagtactccagcatcctggaaggagacatgcaacactttgtaatttgttgcctgctcttagagacttgagagttgggaagccagtgcagcttcctgcacgccagacctccccgcttccgctcgcttccttcattagttcagtagagtcgggatgcagttagccagcccttacgcctctcatggagtgcagcctcgccatttgttcacaccttacgatgcatcgagggctgccgctgacctcaccgtgagacgtgagtttttgtctcccctcaccaagactccccagagaggggaggaagcaggacggaaagcacatcgcagtacagtatgcccttccatcttcaaggaggaattaggctgggatggttctccatgaccttttgaaaattgctgtctgcactggagaggaaggcaggagtcctggggtcaccagtcacactcaccaactgctggtttctgcacagcccttcccaagcccaccctacctagtagctttcatgcctttcaaacagaggtgggagaaacagcaacctagaatcacccacgggtgctgttcccagctaccaccacaagttggtatcggggcgcaaactactgggacgtgcttcctggcaagagaaagacctttcatggtcaattgcaaatctctgtccatacccaggcaaataggaactgtctgctgtgacctggagggaaagagcagactggctcctggggacctgtgtgcactggttgggagttcaagcaggaaccctcagagataagcagcagagttatttggggcctagattactgctcttcccttactaacaccaaagttgtgggggtttttttcccagtctctgtactttgtaagttaatttataggacatattagattgtcctgtttgctgattgaaccagccccaaagagccacgattttcattgcagacctacaccagagccggccttgttttgttctctcagagaggctgtgtgtcggcatgacttctcaagccctgctcattagctctccctaccccggccctctccttcagctgcagagcttgtaggaagccgagtctggagaatgaaagacttggactctgaggactgcaaactgtctggattcctctgggaacttgctttcctttggctgcatcaagaattaataatggcttcccaggaaatctgcttacttttgtatcttgtgttttcaacattggaattagggtcttttctgcttctcagaatgttttagtacaaaacacattctatcatgttagacagaagcattgattgtggagagacgtgcactgatgggtgtgtattatgggttaggtgggtggggaacagagaagtcaggtgtgggtttaaccagtgatgggatgagcttgttggcttaggatgctcttaccagagagtacccaaaacccatcttctaactaaaggtccagactcaacagcctatacagtcaacttcccttctgtatttgcttaacacaaaagtatataacaagaggaaaaaaataaataaatttgagacacaaatgtttgggtgaagaaaaaaagaaaactgccaagttagttggttggtactccttgagcaagcagggtttcttaaccagcattgctgaacccccctagttccagagccttctaactgaggtttatagatatagatattatagatcgatcttg

SEQ ID NO: 27956 - DNA, 1106 bp, Mus musculus
cgtccaaaatagcctttgtttgttacaccagcactcctgattcagctctttatgctggtcagatagggtgggggtgggcggtatgaactatgaaccctgaacagcctctggttacatcattctcatttaggactttgggctagttgggtgcatcttgcaggaatagaggaatctagcggtcctcaacacggtcctcaacacaagagaacacgtatgctaaaaatgttttttcaggtacatggttttcttgtcagagaagttgggggaaccatacttcacagtgcgaaataaattcatgaccaagctaaatgtcaaataggagaggagaaaacgcatacagagccctaacagagtgtctgtgagcttcatgttttccaaatgaactcgatcacagacatgtctgagtgaccctcctgacatttcagtgggctcttcattaccaccttggaatgacggtttgtaaatcagaagcactgagctctcgcctgcaaggctggcttacagtagaagcagtattggaatgttatgatttaatatgactgacagtctcccattgacagcagaaggccagcaggcatattgaaaggtctccctccttttctgtaagaagcaagggctttgtcatgctgggctattcttggctgggctaccacagccttcagttgtttctctgctttccaaattaaaccaaaatgtttgttttttctcatcattgacacacaccaaaaaaagaatgcatgcttgattttaatttgtttttgacattttaactatttttaatgtataatagaaatgtcacctgttaatattaacacacacttattatctttcctctcttcacaccagactctgtgaaataatttgcaatctagaattcatacatcctgaaattcatatcctatgttagcccttctttcatacacacacacacatatacacacacgcacgcgcacggttaagtctggcaacttataaggcttggccatatttccctagacgttatcctctgccttgtcagtttgtttgtctgtggcttttttttaggggagggggaagagatgggcagctgtaacaagtagcccagatagatctatgggtgaaacaca

SEQ ID NO: 27957 - DNA, 1195 bp, Mus musculus
gggacagtgggtatgcgtggcctcgacagtggtctggtggaagccaggtttcctgtcctccaaagagagaggacaagaaggaaaggtcaccttgtactatgtggttgggttttgttttgtttcttttctatttttggtcctaagagactataaatcgtaatgccccaagagcaaacccgggactgggagtgtttatcatccatctcctgaccatgtgaacagcaaatttgtcatttggaaagctagcctatttcagtagtacaattacttaacttcaaatgcaagcaaacactaaatgtcagatttttttaacaacaaaaaatggtctcttagcattacacattccaagttctaaacatatgattcatgttttgtactttgaacaagaatagcaaaatctattttctgtatgagggggggaaaactaaatatcagccatgggattttttttaaaccaaagaagcagtggcttttaacttctgccagccccatcttcttccctacactattgagccccgctgggttacactcatcggcttactcatcggaacagcacctcacaggaatacggagtcagcgtttacagaagaaccctcactagtttctgatacgatcaaggccaggggcggggcataatacagaaaggaggaagaggaagggaaagaaggaagggaccactgtcatagctgagtagtagtttctgtgaatggtagcatagctcagaggttctgagcttgtcctgagccatcactggacatgctggctttgtgtaagttcttcttaaatccacttgacatcacgacattctttcccttggcagcgggtccttcctacgtaaaacatcagaacaggttgtttatcagaagataccaagatccataatgtatcagccaggtttaaaaactcttgacatgtttaatgatgaactcacaggtcaaccaggctttctgacgtcagtccccaaaacccatctgtagatcagaaccttgccgaaacctctgtgcactaggcgctacttagggcgtttcatttctactgtccatacttgtctctacgagacatgagaaagtgcaaggctgcgagagggggttgggtagagctcggagcaggtacatgacatgtcatttggtccctttgatgtgctgggtagagttggcgttgtagagaccgctgtgttcatgcaatcactaattct

SEQ ID NO: 27958 - DNA, 1194 bp, Mus musculus
gctgaaactcatggagctccctagacaggagtcaaggcctgaacttagtgattgctttcacagaatttaacttgggtcgtttaaaggtgacagaggagtcaaacataatgcaaacgaagagttttgctaaccaaatcaaagggtcagacagtctggatggctcaggctgtagattagaatttcttaagatttccctaaaagaaaaactaactagtccacagccagaatacagtgtggagttgtatttattagacagtatagttacataatggttcagtgtgtatcttaagtggttattatgtaaagatatatatatatatttcttgtaaaaagctttacagagttatattgaaaacattcatttgtattgttttcatttgcaaggtactcaatgatatggtacgtaagagttatcaaatcaagtattatttaatgtcatttcaattttctaaatgtttaaaggttatgtatggtctcagtattatatgatgaattgcctttcacatttgagctttgttttattcaccactgatcagtttaattaatgtggcgttaatgtgacatcaaaggttattactgactgtccgtaatctgttgaactctgttgcactgtaaacatagagaattaaagcaagaaaattcaagctttgtatagttttttaaaaatgtagtcagtgtttctcgatgtcacttcatctgtctcattatcctccaaagaatttgggaataataagaacttcaggcagatcatttcctaaaggcacagaaggctgagacggtcttagtgtttactatcacagtgtgtaagctagaaaggggaagtggaagacccaggttgtattgttaaccctcccagtgtgtgttttctactgagtaatcaatttgtcaataaaggatttttaaaaagcagaaaggccaccatggagttgggagtctgaggcagagcctgactgaagtctgtgctttcacaatgctggtgcttccttgtggaagttcccaaaaagaggaaagaggattccccgtcccccattccagggattatgcagcttcctcggagagttgagtaagaacacgtaactccttcctattaattatctggcaataagtgttcaaaccttcctcagaaaatacagcctcaggagcggcagtcagctcctgcgatagctgatttctaactccacatggaaactgcag

SEQ ID NO: 27959 - DNA, 1190 bp, Mus musculus
tgatttaatttcttgactactggactttgctgtagctcactcagtcatactagttgggttttattcttgagtactgcatttgccttggctagtcttgctatcactagatagtatctggtacagttataatctgcctgttcacacttttcagtgtattacttaacagatttttctgtgtaccttcagaccagtatcaaactgtctacttaatgtatgtcatagatgccaggaagggctctttgtccattaaatctgttgtttatttatgtcaaaaaaattgtaatatctagctgtttaagcttgctacttgggtattgtactagtgtgtgttctcgtcctctttctaatatataagtattaaattaatcctatagaattatcttttaagtagctcttgctttgcttatttctggttcctcttagttcgggttcctactttgattattataaagcctccattctttttctctctgtttctttgttttaaagttttcattctagccttactgcattatgttcagtgtatcaagaatagcaagctgtttttagctcctgatctagaagtattaaaattatgtagtcagtatatgaacatttcccaaaataatgtccatccccctacacacagacaccctgaaactcattctgtaaattttttttaatggtcattgatgttttatctgcgtgtatgtctgtgtgaaagtttcagatcctctggaactagagttacagacagatgtgagctgccatgtaggtgttgggaattgaacccaggtcctctgaaagaacagccagggcttgtaaccactgagccatccctcccctaaatgtccattctttaaaggaaaaaataaagaagccacagagtaatgtagaaagatattaacttgagtggaagcttatgtttgtgaggttgcttttgggtaataaaggcaccaattcattttcttacgaaaaagtaaatttctgtctgaagaggaatactttttttttttctttaaataaatttcccccctctgaaagctacttttaattcttgctcaatataatagcacagtcattgggttgccctttcatttgctgccattgttgccatggttttatagtgatggattgcaatgatgttaatcacatgttccttcaaagatcttatgagtctatttaatttttttcctttttttaaaaaattc

SEQ ID NO: 27960 - DNA, 1122 bp, Mus musculus
taggtgtgtgccagcatgcctggctttgtgtggtggtgagaatcaaactcaaggcttcaagcactagggacaagcactgtacaatcaaaccacattcctacctccacattattaagagaatatgttcacaaccacattttcatgaggtaaacttaaaaagataatctaatctttggatttcatgtgtccctttcttaaaacagtgtaaccactgaaggacatggctcaggggtagagagcttgatcagcatgcataaggtcccatatttaatccttggttgtgcaccctcttccccaaatgtagtatacttagttttataattttaactttgacttattgatgtccttaatgcattcatagaaaacatttaagttactaatttttaaaattagaatattcactattgaacaactaggagtgaaggagtgcaattgccttcttttccaggtgatgaatggtgctatcctgcagcaagtgtttgtggtggattatgttgttcagtcccaaatgtgtggagactgccatagagtggaagctaaggatttctggaaggctgtgatccaagtcaggcaaaaggtattgaaaaaagatgatgagtgaatcctgagtcttgaatttcatcactgtccattttcttttctttttttctttttttaaaatacattttattcattgattgattgatttttttttttctttttgggttattttctttatttacatttcaaatgttatcccctttctcagtttccactgaagaacccccccccatttcattcccccttcccctgcttcaatgagggtgcccctcccaccctggctggggcatgcagccttcacaggacctcaaccccattgatgcccaacaacaccatcctctgctacatatgtggctggagccatgggttcctccatgtgtactttttggttggtgggttagtccctgggggctctgggggctctggttggctgatattgttgttcttcctatgggcttggaaaccccttcagctccttcagtccattttctaactcctccattggggaccccatgttcagtccaatagttggctgcaagcatctgcctctgcatttgttagactctggcagaacctctcagg

SEQ ID NO: 27961 - DNA, 1815 bp, Mus musculus
ttttctttttgtattgagaaaaggcctttttgtttctttttttattaaaaataaaagtcacgttttccctttattttgttggaggagaaccaagtggacaatctcttgacttcaaatcattactacatatgaaatcatccatagatatttgtacatcatagagatccttttgagttaatcagattataactatgagaactacatttggtctatggataggctgctgcttcctattttttttgtctcagaagtgttttgaggtttgttcagactagtatctaggtggggaacacacattaaattatatgaatattgtaattcttaatcttttcttcagagataatgcctttctgtcttgttatgacaccaacttttttttttttttttttttttttggtttctcgagacagggtttctttgtgcagccctggctgtcctggaattcactctttgaccttgaccaggctggcctcaaactcagaaatccacctgtctctgcctcccgagtgctgggattacaggcgtgcgccaccactgcccagcctgacaccaacttcttaacctgaaagttcacatattttgtagagtatgctatcttctagatctctactactgttagtttataaagccatttgacttcatttacagtattttctctaaattaaaaagggcatctgcattttggtaaactaaaatattttatgagagcgtttaagagatgagtatttttaattttatttggggagaggggagctgtgcatgtgcaccagttcatgaaaacgtcagagggcaacttgaggatcaagctcagatcatcagactttgtagtaatctttatccactgagctgtctctccagcccacttcagtgtgtgcctgtgtcagagttttggtgaaattcataggtttttctgaactctaggtttttgtttttgttttttaagttttgggtctgttttcttgctttaggattcttttgccttctagttaattttttgctcagtctgagttagccagtctctgtgaagacatttttctgtgaaaatgctatgtgtgtatgttacatgtgtgtgggttagtagttcagggggcaatgttaatgtctttttcaagttttggattgtttttatggtttcctttggagtaattttctgcattcctgatttgttaatttgttagttttgattgttttagaattctggaaagttgaaagctgttttaaatgaatattaaatgagaaaaagtcaatattatatttaatttttccatgatatgatttctttcttttctgttaagcacacccttggggaagtctggatccagaagacatctgaaatgaatacagataaacagtatttttgccgaactcacttgggacatcttttaaatcctggagacctggtgctggggtttgttttattttgttgtattttaacttggcagatagcattgtaggttttcttcaggagccaatgaatatttaaaatactaaatttgttaatttcaaaaaatttaagagtgcttaagatcctttcagttttttttttaaagatttatttattttatgtatatgagtacattgtagtatatgagtacagatggttgtgagccatcatgtggttgctgggaattgaatttcaggacttactgcttgatccatgcttgatccagtcctgttctctccagccttgcttgttccggtccaaagatttacttattatatgtaagtacactgtagctgttttcagacacaccagaagagggcgtcagatatcattatgcatggttgtgagccaccatgtggcctctggaattt

SEQ ID NO: 27962 - DNA, 1213 bp, Mus musculus
ctggtgccttcttagcagtggcatacccagctagcacccatgtgttatatgtgttcaaggatagctacatggcccccacaatgcattgtgttacagtatctagaagttggacaactctgtcagagattagtattttcattctaaaaacaagaaattctttaatagtaattaatacaccattcagaaataacactgattcaaaactttcacccaatcactagaatactgaggtcttgacatttgactctgcaaagtcctttacagaaaacttgaatgtaagattctgtgttactttggcatctcatatgtgtttgatctggaccagctctttctttaagaaagagtatgttttctttagttgacaattttaaagaattcaagacaggtatcttacagagtgacctctgtttggctttgttgtcttttcctgtgactaggttatatccttttggcagtgccactcaagtgatgccagacatggcacattatcataggatgcatgtgcttccatgagtccagatgatgccaggcatggttcattataggatatgtttgctgccatgagtccagatgctcccaaactttgcattcttttctggcttcctgttctgagaacaagctcttccatggagaattgtttgttcattttatttatatatattatattattgtagacttttaagttatcccacaaaatctagtatggtttaattgtgtagaatcattattattacttgctcttaaaaaattttttttttaaattttatgtatgtgagtacactgttgctgtcttcagatacacctgaagagggtatcagaccccattacagatggttgagctaccatgtggatgctgggaattgaactcaggacttctggaagagtagtcagtgttcttaccttctgagccatctctccaaccctatttcttgctcttttaaaagttcattttcaacatatagccagattcactctttgatatatctgaagttttaatgtgtgcagattttgtaatcataatcaaagttctggtcagctctaacacacaaaatcctcattctttgttattaaatgtttcctctattcccttagcaatatctaatctggtttctgaacttagtttgcttctcctaaagtaaatgagtgacatcacacagtatgtgggtcccccctcccctttcggtttctttcatttagcctagttacttgatgt

SEQ ID NO: 27963 - DNA, 1172 bp, Mus musculus
atgaggccgctcctgggctgtccgggcgcagtacgtgtggtgtcctggtgtgtaccttccatgctgtgcctggacgccgatgcccaggctgcacgaccacgtctggaactatccaagccgcgaggcacaggattaccatcgccttcctagctacgctgatcactcagtttcttgtgtataatggtgtctaccagtacatgtcccctgatttcctctatatccattcttggctcccctgtatatttttctcaggaggtgtcacagtgggaaacataggacgacagttagctatgggtgttccggaaaagcctcacagtgactgagcttcagcacatgggtcagagtggaagcaggatgtggagacactggtcctgggtgtgatgaagatgatctttttctcaatgttccatttagactgggctgacgataaatgactcctaaagacgtgttcacttagtctagactagcaaatggaggcaaggactacttacctaaaagtcttaccttgctcccccaccctcacacctgtcttctttggaacattccatcccaggctgtatgtgagagtcgggtaaggggggcagtttcccgagtattagagttcactcatcattcaaagcaaatgccatatttcaaagccttgaatcaaaatgaattaccaactagcagttttgtgtcagtgcccaaaggagggaggttgatggtgcttaacagagatgaagtgtgtgtagtaagaatatttatccagaattaaaataaaggattgtgtaaagaggggttgagagcagcagtgagttggaggaagatcatctcccggtaggacctatagtgcagccatatctccaggtcacgctcaggctggcgctcacgtgtgggtttcatcagtgtgggaacgatgctttttactgccaggaggtttgtagacgacaatctcactgaaagccgagggcagcacaaagtcaggtttctgcactgggatgctggacttctcacctcaatttaagagaagttttatccgagctctggaccatctaagagtgagtcgctgtctgctgtttcagtcataatgagccgaaattgtgtctctgtcactccagggtggagaggactcttccacagccctgtggagcttgcaatctgtgattgcttcgtaacaggttgagtgtgcacgt

SEQ ID NO: 27964 - DNA, 1164 bp, Mus musculus
tatgaaaaccaatctgagccttgtattctcgtaaatatttattttgtaatttttgttaccgcacgagctgttccggagaagggttctcgggtcatttcagaggtgcgtggaggcacactcagcaatactgtgtcagccgtgacatccctcagtcataccctccactgcacactagtcctctgacatactccagctttgtaagttcagtgatttttacttacacatttaccatttttgtattccaaaatgtgtttgttttaagttatatggaactgacctcctgatgcagtccttggtccccaggcggggcagaagctctgtgcctgtggacacctgggtttgggttaaccctcgaagggctcctcatagggggttgcttttttttttttttttttttttggagggaaatgtttgaagtaaacctttgttttctgaaactaccttggctaaaagaaaatgggttgtgctagactttgggatggtccttaaagttccctggaaataaaaacaaatgattggtattttgaagacattcttcagctaagacttgagtgtcttgcacaagccacagtgactggaagaaaaataagtgatcttggtgatgcacttgattgtatacaatgaggttttttttttttttttctcttaaactggaaataaatgttagaaataatgtagccaaaaaaagtgaatctgaaggatgcttttgccaatagttatagcagttacaacaaaccaaagtgactgagtttgtacaaatggtaactagtaccaagcacactcactttcctgatctgaacacccagcgaggttcatgtccgtgctaagtttgcagcattgtgttcttttgcattcttttttttttttttttactttttattaaaggttcaaccccccccaaaagaaatgtaaatgaagaaaatatctaattaaaaaaaaggggcaatgttgtggctggcaagtaccactaagcttgatgacctgagttcaattatctagaacccacggggtggaaggagaggtcttctgacttccatatacacagtcagtctctctgtgtgtctgtttgtatctctatctctgtgtctctgtctctgccccccccccccatgcatgcatatgaatgaacagacagagtaaataaataaatgtaaattctgaatg

SEQ ID NO: 27965 - DNA, 1216 bp, Mus musculus
atggctgagccatctcttcaccccaaaatatagtttttctaatgtgatgattcaaaaatgtcatttctaggccctaaaggagagactggtgacactggcagcccaggacacccaggaaccactggacctcaaggtcccaaaggccagaaaggagagaaaggtaaccatttctcatccaactcaggaagactctgcatcattttaagaaaagcagtttgctagaaaagaaagctagattattgaaagtggactttttaaagtgtaaacactcgataaatcatctcatgtattaatctgacataaactattaactttatacatggctaactgaaaaacttttaagtatatgagaatatcatgcatacacagagtaacacacactctctctatatatgtatatattgtatatatatatatgttatatatatattggaaatagagggagaggcttttttagttattcttttttgatatagtctttttctttattaattattatctttaaaataaatttatttatttatttatttatttattttacactccatactttattccccccatccaccctcctactgctccacgttccatacctccttcccacccccctgtctccccttggatatctaccccccgccatgtttcttgacctctaaactccctggggccccccggtctcttgagggttaggtgcatcatctctgaatgaacacagacaaggcagtcctctgctgaatgtgtgttggaggcctcatatcagctgcctgtttggtggtccagtgtttgagagatctcaggggcccagattcattgagactgctggtcctcctacaggattgccctctcctcagcttgttccatcttttacctagttcaaaaacaggggtcagctgcttctgtctgttggttgggtgccaatatctgcagatgatatctctttcagctgtttgttgggtcttctggagtgtggttatgctaggtccctttttgtgagcattccatagcctcagtaacagtgtcaggccttgggacctccccttgagctggatcccactttgggcctgtcactggaccttcttttcctcaggttcctctccatttccatccctgtaattctatcagacaggaacattttttttttttagttattcttttaaaaagttattcagacaatatgctttgattatgtttttccctctcccaactcctctcagat

SEQ ID NO: 27966 - DNA, 1195 bp, Mus musculus
gtgtgggatgtagaacagttgaagaataggagaggagggccaggaaatggaatatggattgtaaaaaaatgaattacaaatgaaattaaattttaaaaccccaacacatactatacatgagtttcagctctttacagaagggaagtagatacacagaaacatctacatgcacatacacacatagagcaagagagtgagagagctagagagagcaggaaagagagagcaagagctaaagagacatgggagatgtaaaaacaaatacttaccaagaatctcgattctttctagaagggaaacaaatgcagatgatgccttagcaaaacaaaactctcacacttcagagaaggacattggagttccaggaaactggcactaggatttgtgaatagaaaagcagaagagggcgtttttgtagttcttgattttaatcttgatgtcttcagccatcctgattcctaaagactgtcctggaggagcattacttcaatgtgacccttagcaaaggcaccccctttgacagctacttccccaaccagaaccagactaagaacggttggcagaactacctggacttccaccgctgtgagaaggcaatgacagccaagaggggcaatgtgtccctgtgtgcatgggaccggcatgtgtacaagtccccctgcccgtatcatggatttttaaaaattcatttttaagtatgaatgttttgcctgtaatacttacatgcatcaactggatgcctggtcctgaaaggtcaaaagaatgcaatggatcccatgggaatggagttatcactggttatgggccaccattttggtgctgaaatcaaacctgggtcctctacacaaacaggaagtgttcctaaacactgaaccatcttttcagttcctttggtctcagcctgggatgattgcatagcagaagacacatttcctgggaagatctgacctggctctgcccacttctcctctgttctttgtctttctccctgataggaaagggggaccttggtatatgatggtctctaccctgggaccctgaatcatgatgcaactactaataaaaactcactggaaaagttaaaaaaaaaataaaagaaagaaaaatagaaccactaatgatacagagctgcataaatccatcgaagagtcacagggaatcataggtaggctattaagttgtagttccataattt

SEQ ID NO: 27967 - DNA, 2531 bp, Mus musculus
gaacacacatggcatgtactcactgataagtggatattagcccaaaagctcagaataaccacaataaaattcacagactatatgaagattatcaagaaggaagaccaaaatgtggatgcttcaatcctgcttagaatggtgaacaaaataatcatgggcagtagagggagggacctgagaggaagaaataagagggaaggaaaaagggaagtaggaccaagtatggaaagagacagaagtccagagggtcaggagaatgaatagaagtaagtagcagtgaggaaggggaaccagcagaaagtcccagatgccagagaagtgagaggtttccaggaccaaatgtgcgtgacatcagccaaaatacttaacagagggtagatagaacctgaaaaaccacctccaatatatagacatggaccccagctgaaggatggggccacccacccatctcaaaatttttagcccagaatttttaaccctgaattgttcctgtctacaggaaacacagagacaaaaaatggagcagactgaaggaaaggccatccagagactgtcccaccttgtgattcttcccatctgcagacaccaaaccctgacactattgctgataccaagacgtactcccagacaggagcctagtatggctgtcctcggagaggctctgccagcatctgactaagatagatgcaggtactcacagctaaccattggactgaacccagcgaccccaatggatgagttagggaaggactgaaggagccgaaggggcttacaatcctataggaagaacaacaatatcaactaaactaaacggaacctccagagctcacgggacaaaaccacaatcaaagagtacacatggagggacccatggctccatctgcatatgcagcagaaagttgtcttatctagcttcaatgggaggggagactcttggtcttatgaaggcttgttgccctagcataggggaatgctagaggggtgaggtgggagtgggtgggtaggttggggaacacactcatagaggcagggggtgggatgaggtagtttgcagagggaagactggggactagggacaacatttgaaatgtaaataaataaagtaaccaattaattaaaaggcgggggctattagacattcttatatcatctaaaggccacctggagctctgggttatgtaaatccaaagagcaggtgctctagtcaagaaaacaggaactctttgttcagggaacagcttcaaaagaatggtgatttatagaggtagaggatatatgttaatagaggacacttggcatcttcctctggctactacacatgccccgggcacatgcagcagcacgtacccactcacagacatattcacatacatgtaaagaagtaactaagtagatcctttaaaactaaaacaaagagttgagttacagttgagtctgtcaactcatttactgaaagtcttctaagaaaagcaccattctcatatagataataaagcctcatttctctaccccaggtggtctccattcttttttttttttttttttttttagctcctggattctatgatgttcttttagaagtatgtagctgcctcttgtggaagatagacatgcatgttctgacagctcaaagaaaaaattatttatggagaattgttgccaaacagcctgctgtggctcttagagcatttctgtgtatctgttgagccaggcagctgccctgtcatgcagactgaatgtttaagtgcattgtggttggctttggtggtttgtatgaaaatagcctttgtaggctcatttggtgtggccaagctggaggaagtgtgtcactactggggggtgggctttgaggtttcaaatgctcaagccaagccaagccaagtgtccctctttcttcctgctgcctgtcaatccaaatgtagaagtcttagctacctctccagcatcatgtctgccttcatgctgccatgcttcctaccatggtaagaatggactaaacctctgaaatgtgaagccagcccaaataaaatgttttcctttttaactgttctcatggtcatggtgtttcttcacaataatgaaaccctaactaagacaatggccttgaaagaactaatccttttctcatgggaaaggcccatattcactatccagtgcaatgtagataatatttctggactgagtacaaaacaagaaacttttccagggtctgtctgtctctttaccccctctgtctctctctctgtccctctctgtgtctctgtctctgtctctctctgtcgctgtctctctcagtgtctgtcttagtgtgtgtgggtattttgcctgcaagtctatgcatcacgtgtcagtagagcctagaagaaagtgttagattccgcaggaactggagtccctgatagttcggacccattgtatagttgatttagaaataggatctgggttccctgcaagagtgcccaaggctcttaagtgctgagccatctctttattcccaagggttctgatcttatgcactcaataagtctaac

SEQ ID NO: 27968 - DNA, 1188 bp, Mus musculus
cctggacttccccaaaataagcttttgtaccattgcctttcactgtctggactttgtttttcaagcaggtcagtcaatgccctttagcctgactgcaaaaggcatgcatccccgcctccaagcaggtggcagttactaatcttcactcaagtaacattctagtacatattgtggcttttggtctgatttggaattaaggttagctacgagggccagacagtctagacagacacccagatcttggaatcatattaatctagacagaggtacctgccaagaggttgtggtttattgatagtataccacagagccacataaagaattggaggcaaaggttaaggccttagaagtagtagtcttaacaatacggcagggcatagcatatattaaggctagaaaggcagaaattccagatattagcaatagtcacttggacacttggaacattgatgaattggccaatgatttaaagataacctaagtgcattgaatcccctggattgggttcaatatattatcatacttgctattattattggcactattttattagtaaatcgttgtgtttccactcatctttagagcactcctaagatctatagctatgatgaggtgggacattctggaacttcagcaaaaatataagaatgggagaatgctatgcacactccagtgaagtttgcttggcaggtcgagaggcctgggagcactcatgaggcaaagagtttcatggatgctcacctcctggaactttggcattctcataaccagtacattcttaccctatccccacgttagtctggtgtatggatgcacgtgctctcctttagtattatcttattaaaagtgccttttaagattgaattctgatatagttaagccttccccagtgttccaacttcctagaaagaacttggaattcagtaggaattcagtaaggaagttacctattcagtaactaattagcattacaaaagacggagcctgcagctcagggatggtctgcagaatgtttactaggacagtaagtacagtctaaaccaaataaggatttactataaataaagttagggaatcccactgagacaggtttcttcactaggcccaaggaaatcaggctgaactatagagcataaataaattttatgcctcagtccagcctttcttttttatattaataacagggag

SEQ ID NO: 27969 - DNA, 1120 bp, Mus musculus
taggggtccgagggacacttatgaacccattcttactccatgctagaatttggactgctttgtacataacagggaaccccagctgctgtgacttcatgagggcaatttgacaggctcagaaagcattgcttcatcccaggctattctagcatctggcttttatgatctgttctccaccttttcattatacactgtgtgggaaggatatgatcaaggtatttcatttgtggcttttcatctcacatagacttattttctgtacttgactaattgtcagttttttcattagtcattggttagtgcataagaaacttctctgatgagatctgagggacagactagtctaatttacaaggaattgatgttatatccttttagcatgaaaatagtagtagataaatttatcaacatgttttaggtatattttgaagttttaaatgtcttgcattcattatttatttcgtgtgtgtgtgtgtgtgtgtgtgtgtgtgtgtttacatcaagggaactaagttttcttggattacagaagagtttctagcttctgtgaaaaggattctgatcctattgtggtctgaccccaccccgtaggctcctagcccctgaatagctgtagccattttgttacatgcctgccacctttttcatattgttgctgtaacaccaggcagaaccttctgtgcctacacatgagctcattgtggctttgtggttgacactgaaaaatgctactaataagtgaaaagttattattataatacttgtgttcgtttatctcaatgttataaaattcacctgttcacctcatatctgccacctatcttaccttactcagcctaagggttagctgaaaatactttgtctagtatcccacaatgtatttccttccttccttgccttttaaactgagtttccctataagcctgctctgtaaacagactggtaccataattaggtcattcattcttatggtcctcctctgctcagtctagagtgtgcattcaataccatccctgcctaactgagatcacttttcatgtggtgtgtggggcaagtactagaccacaatagatcccaggttcattgtgttaaaccccagttaatcagtcttttctgactg

SEQ ID NO: 27970 - DNA, 1120 bp, Mus musculus
gtggctcagatgattatcactggaagaaggcaggcattgacttattttggaaaggagccagatatcattgtccagccttacagcgtgagtcaggacacttggctgaaacagcatagtacagattggttgcttgcacaattagggtttgaaggaactatagatagccactacccccaagataggttgataaaattcttaaatgtacatgatatgatatttcctaagatgactttcttacagcctttaaataatgctctattgatttttactgatggctcctctaaagggcgagctggatatcttattagtaatcaacaggttattgtagagactcctggtctctcggctcagctcgccgaattaacagcagtactgaaggtttttcagtctgtacatgaggcttttaatatttttactgacagtttatatgttgctcagtcagtacccttattggaaacctgtggtatgtttaacttcaatacgctgtcaggatctttattttcagaattacaaaacatcattctcgcccggaaaaatccgttttatattggccacatacagtctcactctggtcttcctggacctctggcagagggtaatgatcgcattgacagagctctaataggagaagccttagtttcagatcgggttgctttggcccaatgtgatcatgaaaggtttcatctctctagccataccctaaggctccgacataagatcacaaaggagcaagcgagaatgattgtaaaacaatgtcctaaatgtattactttatctccagtgccgcatctaggagttaatcctagaggccttatgcctaatcatatttggcaaatggatataacccattatgcagaatttggaaaactaaaatatatacatgtttgcattgatacttgttcaggatttctttttgcttctctgcatacaggagaagcttcaaaaaacgtaattggtcattgcctacaagcatttaatgccatgggattgcctaaacttattaagacagacaatgggccatcttattccagtaaaaactttatttcattctgtaaagaattcggtattaaacataaaactggaattccttacaaccccatgggacaaggaatagttgaac

SEQ ID NO: 27971 - DNA, 1237 bp, Mus musculus
gccaccgtaaggcgctgggcgagcccggagcttgggggctcttcctcccaggcggcgctgagcgtacgaggaagaggcagctacggcggcggcggcggctgtggcagcagcgcataaaggggccgccgccgggtgatgcggtgaccgctgcggcaggcccagaagctgagtggggcctcggccctcagctcgtctgatccgcgctcccgggagctcccggtcttctccggtcgactcgcgaccgctcgggcggcctcaggccccctcgccccttccccgtccctcccccgtccccgttcccgccccgggggccgtcgccaccgtttcccaccatggctctgaagagaatccacaaggaattgaatgacctggctcgagatcccccagcacagtgttcagcaggtcctgttggagatgatatgtttcattggcaggctacaataatggggccaaatgacagcccctatcagggtggagtatttttcttgacaattcatttcccaacagattaccccttcaaaccgcctaaggttgcatttacaacaagaatttatcacccaaatattaacagtaatggcagcatttgtcttgatattctacggtcacagtggtctccagcactaactatttcaaaagtacttttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagctaggggaactctgagagagagaaagtacttttgatttccatttgactgctttctatgagcccacgcctcatcttcccctgtgcacatgtttacctgacacagcagtgctgcgtgttgtacatacttggaacaacaaactagaaatactgtacttctgtaccaacattgcctcctagcagagaagtgtgtgtgtgagaagccagttctccgggcataacctaggtgtgagactaaaagctttccttattgacttaactttggataatggcaagatgtgaggggtagtaggtacacagtgtgtgcttggatgggaggaaaagctccagtgacccataggagattgtccttaagtggagtccatccaatctcaaacagtcataaaaagcaaggtgaagaacgtgaagctgtttctatattcatttcat

SEQ ID NO: 27972 - DNA, 1130 bp, Mus musculus
gagtggggtcaggcaccctcactccttaaaaccgaagtttctacagctcaactaactactgttttcattctatatgaatcagcccccttcaaaaataattcctaacaattcatgtactaaatagtttccataataaatgtttacatttgcatgatcgttgtattaacagatttactgttttaaaaactcaccacattcgggctggagagatggctcagaggttaagagcactgactgctcttccaacagtcctgagttcaaatcccagcagccataaccatctataatgagatctgatgccctcttcttgtgcttctgaagacagctacagtgtacttacatatgataataaataaaataaatctttaagccagagggagtggggctgaccagagtgtgcagaggtcctgaattcaaattcccagcaaccacatgatggctcacaaccatcagtacagctacagtatactcatatacataaaataaataaataaatttattaattaaaaaaaaaactcaccacattcgttcgacccgcagagaaagaacacagttgtgaacagtgtagctgggtttaatgaaacctatataaaatacccccattaagaaaagcaagtttcgtttcgtaaattgtcactatggtctcccagtatccttgcacatgcttttatatgcaattgtgttttctggcttctgtgagagaacggactttgaatgctctgtgagatgaaaagtagaatttactggtaggagcagaacatatggcaaagatatttatgtctttgtattatgtataatttcttttaaactcttattctggactcccccggaacagtttactagagtggggcatggtgcctttcaagcagagagtctttacccaagtctggcagttctgataggtcagcctataagtgctccagagagttgcaggcttgtttttcatcttccaggtccctgagtcagggcagtgcaaacgccacagtgctggatgttgctcagacaggcgggcataaaaagcgggtacgccgtagttccttcctcaatgccaaaaagctgtatgaagatgcccagatggctcggaaagtgaagcaatacctgtccaacctggagctggagatggatgagga

SEQ ID NO: 27973 - DNA, 1178 bp, Mus musculus
tattctacttttttaacattgtaactagaatttaaaagttttcacttcctcacacagcagaaggggtttgttttgttttgtttttctctgttgaatgttactaagtgtagatggctaagagatgaggtaaatagaacacaggtcagggcttctcacttctaggccacatagtttatctgtgctcatataaacctgtactataggattcttctaatctttggttcactttatttcacaattcgtacctgacataattgtgtcaacgtgtaagaaagtgtggctgataaacttccaagttgtcagtactgagtcttgaggtatgagtgttgtaggcatgaagccagaccctgaagctgtcacgccagtacagagaagcttccgtgcccgaggatgtgtgattttcttacttcatctctcaggtttcccgattaggttagtttccttcttgagagaagtgacacctatttccagagaaaggcagcagtaagtggcaaaccttgctgttatagggcaagacaccaccgatatgaggctactgaagtttgaaggattgttggcatatagatgtaaagggacatgggctaggagacagatgtggagtttgatggtttaggccttgagtcagtcacttctgtattgtgataaatgtatgtgacaattaagtttaccgttacgtatacacttcattgttattaccttcagaaccttttcatcttccaaactcagactaatcaataactaatcacccccccccacacacacacacccatgaacaatcctagcaaacacctagcctggctgtctctgaaacctgactagcttagaaacccagaatttagtggcttacagcatttgtttgttcataactggcttattccacttagcccactgtcttctagattgactctgctgtagtgtgcactccctttgaaggcctctgccttcatgtcctgttggatgtggtagataccactcaatttgtgcatttatgtgttgattttggttgaattacttgtttttcgtgccattggcttttgaattatatctgtttcagaacactgtttgaaatttcggcagaatgctgtctgaagaataaaatacggtcttgccagtgtctattcccactcaataaaactttgatgcatccattcagcgcacttgtgggcgagcatgctgtg

SEQ ID NO: 27974 - DNA, 3914 bp, Mus musculus
caggatcgaatccaatgacctgcctctgctgacggccatcgccagcactcactctccgtacgtggcacagatcctcttatagccgactacaggacagctctcattggaaaatgagacaggatggagggtgctctcagtgacggcagaggcgtgagaacacggagcaggcacccctcgttgttcctgtggctgctgcctagtggctcttacattgggaagcttgtgtctactccatgcagtgggagtttgtgattgttcaggaacagtcgacattgtctcccaggaatcaaaagaaagtaacctttctggcaggagggaagtgtaagcaacactgtcaaactagacagacgtgcccatgctgttgggtagaatactgagggctgactctgagtagtgggtaaccaatgtctagaacattccagaaggaaagtgtttcctgttcaagcgtgagagagcatgaagagttgctctaagaacgggttgtggcttctaggtcagagctcttctacgaacattgacctgaagaaagccatgttgtgccactgtcagcctggagctccagcagctactgttggacataggatgtggaagagggttgcctattgagaagagagtgctccagaaacccacggttgtcacttctcagagcttcctgtagactcagcacagccacctgcaggtctgcgagggactcagtgtagcaccctgtcctgccgggtattttggaggacgtagtctggcactgggaactcatctctggctttagtatctttagccttctccagaaagaccttttaccaaagttgtttccatgagctcaggcgatcttctgtggctgagctcgcccagcgcaagcctctttcttcctagccggctgtgcagatgtctgtttgtgctgtatggggccgctgccagctggggagtggacttgctctgataaggatagcaggcagcccgaacatttatgtgatccacaagcgatctaggtttttatatgatcagttctgcactttttaatccctctcatattctttaaaaaaaaatctttctagaaattaacttgaccatttgtaaaacttaccaaagtgacgaactgtaaaaacccaactgatcattgaacctacagaaccttagtttactgaccataagacagtccatgttcaaatactttaaaaacaaaacttctgctgtttaaaagacaggagccagtcaagtaaagtcaaaccctgtgggctcctcagtccttcccaccagtccctggtgcctgagaatgtgggacagcaaatcctgatccatgtgacatgtctgtctcctcattacaaatacaagttagtggagaccatgtgccccttacgctactggggacgaatgcctacatcatctcttagaagtgggccggagtgtggacgctctggaccccctccctccctttcctctcttcctccccctctcgccctgagcatctctcattttttgtgatatgtaaaaataggtggttcttccaggcccttaagatctttaatttgcatttttgtgtttcacaaagttgaagtgtcctattcttttacatctctttccactttctatcacctggcatttgtttgctgttttccatttcctggctccatggtaccattgtttgccagggagccccacatgtggcccgctgagctgtcaatgcagatttcctagacaccggtgccagcttagagctcgcccttctttctcctggcttctctcgtttacacatggactcggcctcaccagctcctgaggattgggagaaaatagctcagtacagaatcagtttggtcctcgtgcagatgtagtgacatgttgacagctagactcggggaattgagctgtcaccaggttaattctcagcttcatgaagaaagacttagcccagcacttcaaagcctgaaaaaaattaaacctgcctcttaatctagtgttccaaatttcagaagaaaagtgggaaaccctgggctcacgtgggttatctcagcgccccaccatcacttgcaagaaagatgcgctgctcttctcctggctcccccggtgcgggcgatgacgatgacgtgtcctttgtcttaaattcatcctcttctcagaggcggggaaaacagtaaacaaagcatctcatggacctgtgctgacgcggatgctgtcattctgtcatagccgaagagtccgaaaaggtgtcccacctaggcataactcaaggggaaaaatctttttttaatgtttaaagaaatctacctcagttgacaggattccacctgccctagggtttcttcagctcttcagtcttacctgttaggtgtcactgggcagcgctctgcttgtctgaccaagcaggctggcgaggcacagccgagcagaagtgtctcagtgtcctgtaatgacctcttctagcatgttgcagttttatatttgttaagttgataagtgatatgaatgtataggcaattgtgtatgttttcaaaaaggacaatgaaaatttaaaatgtagcttccacacttgtgcataattccaaagtatcttattttatcagtgttaaatagcttttgtacagcttcagcccattttccagacgtgtgctgttttatacgggaagtaactcatgatctcactcacggagctgtgtttacacatcgcaaatttttaacttaatgtgtttttcagaattaacttttttggagggaggaaattccccacttgctaaatgatactaaactgttgtctggactcttaagaatcaggtctttggattttataaactagtctgtagctttttaggttcttcattggttggatgtacatagagaatataaaacaactctcagattcttttaagcgtctgaagttttccttggatgcacactcggtcgggtattatgttcacgcagactttcagcattaaattgaaaaggtccaccgcttctcttagttaatgtgaaccgtttgtttttattgtgtttggtggagaagaataatacacttcttgcctaaatccagaagccccctttgaatgttaattttttaaaatgttagaatttggtgaacatctggaacatgtatttgcattatttttaaatttcagtgttttaaaaagcagaccattctggggtgtgtttttattgatctttcattaagagaaattgataggactggttttggtttttgtttttgtttttttttttttttttggttttctgagacagggtttctctgtgtagccctggctgtcctggaactcactttgtagaccaggctggcctcaaactcagaaatccccctgcctctgcctcccgagtgctgggattaaaggcgtgcgccaccacacctggtgataggactgtttttttaagtgagctgtgtggatacaactgagtgtgtggaaactttttcctaaaacaacattcatgtattatttcgatccatttttctgtgacatttggtgcaataaactttttgaatttatcttgcttattctcctagtgctgcatgatttctttgttgcatttaatcaaatacagaatctttcgatgactttcagtatctgtcggtgctctggaagtgcagggagattttgattagcaccctgctgagtgagaccactggccccagcacactggtgagctttgggaccggagatgtcaggagacacgtccccgagcccattgcagtgcctccgagccagtttgtgtgacctttaactgccctacctgacattcgctggcataataaatctctttttaatgatctaagctgagcgtttgtagttcctgcctgacattagcatgtgatgaattttccaggaatgtaactgctgtcaatcctagggttatggatttactttgtaaggattttaacaagtggtcacttgatctttactgcaaactgatgg

SEQ ID NO: 27975 - DNA, 1203 bp, Mus musculus
gcagtccgcagcctggccctgcccagacaggcattcccaggaggatcctcctgtcgaaaaggtcactttccacattgggagttccatctccccggagtctgactttgaaagccggaccaaaagaatggaggagcgattaaaggcctgtggacatttccatggggctagtgcctctgccagctctagcatggacactgggctgactcaagagcagcagggctctgggtgctccttcaaagctgactttgaaaaggacatcacgcctcaggaccactcttcagggggggaaggtgtctctgaggacagaggcctccgggccaacatgacacatgctgtgggacaacttagccaagttgatggcccccttgcacattccctttgtgccgcagaaagtgggcggagactgctggaacagactagagatgtgcaattaaaaggctacaaaggaccttcatcggagcctgttccaaacagatgtagacagcagggtggcctgctgattgctgcagatgtcccctatggggatgccagtggtaagggcaactacaggagcgaaggagacattcccaggaacgagagcttggatagtgctcttggagacagtgatgatgaagcgtgtgtcttagccctgctagaactaggtcacagttgtgacaggactgaagagtccttggaagtggagctgcctctgccaaggtaacactgtacagggaactggaatctgtccctagcctgacactgtgaccatgttagccactcatgatgactttatatgtaacacatgtttttctcttaaatattaggggtattaccacttcaagggttcccagcctgtctgatctccaaggatgctcaccatctcggtgcagctaagttcttggacagagacaggtggttggctgtctttgcagctcttgagacgtttgggggagtgaagagccacagtggccatgcttgcaaggaggagagggtcccctcatgtctatgtaatgagtatggctggctgtggatgtcttgtttctaaggtgataatcacactcactgaggcctccctcctgccgctcaggcctctttagcagctctccgtcaagttgctggttttttggtctgtgaagactgaaagttgcaattaaaagattccttctattcttcttcattgtggtgggcactactttctgcagataggttggattcataaagcca

SEQ ID NO: 27976 - DNA, 1179 bp, Mus musculus
cctaattttcctccaggtcaactgatgagacatttagcttggccgaagaaacgtgtagctctaatccagctatggttagaaggaagaagatcgccatcagcatcatcttttccctgtgtgagagagaggccgcccagcgggatttccaggacttctttttctcccacttccccctgtttgaatctcacatgaacaggctgaagggtgcaatcgaaaaggtaagggccccgggctccattccaggcaaacacttaaataaggaaatggaaggtgatatgattgtgacctacttagtggccaataggggagagatttgcagtttaaagtgacacgttatgtggagatggcctgcgtaaggcggtcaaagagtgtcctgtatgatgaccctaggatttttaaggctagagaccagggtgctgtagggaaggaagttactggttttgatgaggaagaatgtcattaccatcaatattttaaatgtattatagcatcgttgttcattagtgagtcagcaggccagtcatagaggaatatcttcttagagagtaacgtggctctctctcttccatgaaggccatgatctcctgtaggaagatctctgaatcaagtctccgagtccagttctatgtgagccgtctgatggaagcactgggagaattcaggtaaagttcaaggttggaaatccaacaggaagtgatgagcagtagtatgaccaactgtcatgagtctatgtcttaaaagagttgggggactggccatatttagtcatcttagtgtcgctacccatgagagcagggtacgtaaagccaaacattgagtaataactctctctgtgcctgacagttcttaatggggtcagtttttttgtttgttgtgttcttggggtggggttgttgttttgtgtttattttaaagtgggggtctcactatgtagtcctggctggcctggaactgcctattagactgagctggcttcaaactcacagagatcctcctgcttctgccacctgagtgctgggattaaagtgtgcattaccacgtctggcataatgggatcgttttcatcagaatgaactgaacactaattttaaagatgtcttgtaatcagtttcatgatcttatatctgttgtcccattaaactttgaaggcaaagcctttttatcctttgtacaaatgtt

SEQ ID NO: 27977 - DNA, 1099 bp, Mus musculus
cctacattcgctgcagttcatgccatacacagaagctttgaacataggtaaaaggtggtggtgttgggagcctggacagagcattgtccttttcgatgagagccagagaggagttatacattcttcttcttcgtctagaaacgtccttccccgagaggaggcagagttaagtgtgggtatagtacttgctaagaatattttttttttttttttttttttttttttttggtttttcgagacagggtttctctgtatagccctggctgtcctggaactcactctgtagaccaggctggcctcgaactcagaaatccgcctgcctctgcctcccaagtgctgggattaaaggcgtgcgccaccatgcccggcttgctaagaatatttacaactgccttctatatttcaggaactgtgctagagtctagcacgagactgtgaagtgagacatggcgtactttcagggagctagagttaacaaaccaacagaaaactcacactcctattaagtactgacagtgtgatccttgtcggttcacctgttctctgcagtgtgtttgtaaccctctggggtgatagcccatccctgtacacacaatgttcactgtataggtttatcatccatctcacggctaaatttttcagttcccttgtcatgtgattttcgttattatggcatgtaagtctggtgaataagaagatccagcaaataggggtaccgattcctctcagttctgtttgcgtaggggttggagagacaggcagcttcctcccaagtcactggtaactttggaccctgcgtttcagccatcaacatccgctactcaccaggcattggacctccttttcatttctctctggtcttggtgacggaagctggaagtggaaagcggcaaatcacttgccatcattgtggcttggaatctgtgcctcccagctcagtacaatggcaacacacagctggggctactccaaatgtgtctaatctgagtggagatgacctctaaaccactgaggtatggtgacatgctgtagtccctggacttcagaggctgaagtgggaggattgttgaggccagtctggtttaaagactaatcagtc

SEQ ID NO: 27978 - DNA, 1197 bp, Mus musculus
gatacagcttgcttacatactgagccacagattattaatatcttcaaagcacttttgtgctcgatgtgtgtatgtatgttccccagcatgtgtgtgtatgtatgttccccagcatgtgtgtgtatgtggagacgggttctctctgtccacctggatatgtgttccagggattgaatttaaggcatcaggctcaagattgttaatttttagatgcacctggtaaaaaaaaaatcaaacaaattcgataagctagacatgcaagtcttacttcatgtttatagtttcttttctcaggggctagtattattctatctatttcttttgtatccttctagaagtattctgtgcaaatacaaaaataatattcatatttcattgcatacggtgacattgcagtatgctgttctgctaacctgtcctgtgtttgtgtatgtgtgcgtcagtatgtgtccctgcttacacatgcacagcggagaatagccagtgctctgccgagttgctttccagcctgttcccttgagccaggacagctcattgaacccggaacctgccattttggctagactgacagccagctcaccccagcttcctcctgtctccaaccccaccacactggggtcagaggcacatgcagctatgccttgctctttcatatgtgttctgggcatcgagttcaggccccgatgcgtgagggacaggttctctttcccgtgagccaccagcccggcccactaacaagtatcttgatttactttgaattaatgtgtgcataccccttaagttagttgttctctgggctgctggacattgaagtcagatgacaagcccagattattctcttagagaccctgactttgtctgggcggaggctttcagtgtctatgaaaccctccccaagtaattcagtgcacagccaaccaatttgtctacagatggtttatttagattgaaatggtgaaattcatgcttaaagggtccttatgcataggtcaagtagattttcaggataatttccgccaacctgagagtttccacttgttgatactcttaccagtggtacatgctagaggctgtttagtggagatgacttaaatcacagtaaagaaattgtggggtgagagtgaatctggatactagctaactcagtagttgttgatcacgtgtgtagtccagtgttacttgcatcattataagact

SEQ ID NO: 27979 - DNA, 1205 bp, Mus musculus
aacctcagcagagtcaagattaaaatacaagcagctgtggagaataatagatagtttaatacatgtatgactatgatacaagttgagtatcccttataggaaatgctccatgctagaaatattccagtgtcatttgtattttgaaatatttgcatagattttattggttgaacattatctgaaatgtgaaagttgtggctcagaagtttcagattttgtaacgtgtctgaatttggtttttagattacggatgctcaacttttaggttggcactagctgtgtagaacaagctggccttgaattcacagagatcaccagtctctgcctcttgagtgttgggatttaaaagcacacggaaccacatgcagcccacgtgatagaaagatttagatcaagttagtagttaggagagacaatgaggaggtttgaacacttaagctaagcaaactgggccttcaggtgtctgaattcttgctaggctggactaaaaatacagatttccaaataaagtgatagcagcgatgggggaagaccgtggaaggccaaggaaagaaggcttagtctatgactagttaaagtcctcgggaggccgtcggggatggcgggctgttccaccagtgccctgattaaaagatgactggctgtggtgccacgcagagtcagtggccttgaaagcagaatcagatttagattggatagaggtacttaggtgggaaaagtagcgagagttatgaggtgcgcactagggtgtgccttcagaaagcctaaggtatgccgagcagaaaagtcactggcttgctctttagcagacggaatacaagctgttctttcgtattctgggaatcattgatttacctgaatgaaagtcatagattggaattattttccaaattagggaagttcttacctgaataacttgtctaaattcaatatgacattactattctcagtttggtgaaagaggagaatcatagtgtaggcctatttctgatggtgggaagattataggaattctcagaaaaatagtaactgtcacagaaaaagcaaagttagttaatattagatgtccttagtgtggcatcttcatctttaagatggaagtgtaagcatctcttgcagatagccagtttagaaatggcctgattcttgttaaactgacacttaaaaacctttgttcatttaaggtggagtgcttaaagtcaaac

SEQ ID NO: 27980 - DNA, 1150 bp, Mus musculus
ctccttaaatgcattttactggaattagaaattgacctgagtggaaagggagagacagtgggataactggcccaaactggcattttgctgttaaattcttgtgtgcttgggtcggtgtttatttgcaagttgaagctatacatggaaataatatcaagctgccctccgtgcctgtttctctgctcaggttagtgcagctgtcagacctcaccagggaggaggtttccttgtgcagtggattctcaaaactgatccaagtgcagagaacatgtgtcatggagcgttcggctaactgggacgtctctgccacagcccagtctaaggcccagggaccgttgtggaggaggaggtacaaagactgtaagagccggggctggcgagatggctcagtggttaagagcgtcgactgctcttccgaaggtcccgagttcaaatctcagcaaccacatggtcgagttcaaatctcagcaaccacatggtggctcacaaccatctgtaatgaaatctgatgccctcttctggagtgtcttgaagacagagtgtgctctgtacttgacagaaccactgctcatgagctcagggaagccaatgctctgaacaaaagcaagccagtcaatgttttagcattggggaggagaagtgagggggtcatgaacccctgcccttagctggtaaggtactggcaagagatggttcccaatgggagggaagatccagttttctttacaagtgtgggctctggtaggttaactctgctccagtggatgacccctcccccaccccaagtttacgggcaacacaaattagactcagtgggtcattaaaaaaaaacacagaaagaagtcacatagctgggagagatatggaggcaggggtggatctgtgggatgaatatgataaaaatatattgcatgaaattctcaattagtaaaacaactgcaaaactttgaagttgtaaagctacaccaataggagctaaagtggttatttagaattaattttctagacaagaactaatgcagagaaaagcacgcactgatcacatgggcctaaaatccaggcttttacattttcctgttacatattcagatttataagtgctcacatagaaacagacaaaaaagtatttgtgacatatgataccacaaat

SEQ ID NO: 27981 - DNA, 1124 bp, Mus musculus
tgttttctgtaggagctatagcacctggatcagagtacaggaaattctgttctcattaaatatttgtgaagtgttgtttttctagcaagactgtagcatcttctatagaagcaagtccttttgaaagatgccttccatgctgtttagtcttttcattggaagataaacttggaaatggtgggacagatcataataatacttgatgctattgatgaacctaccaaatctccaagtgttgtgtgtcaacagtgggcaggttttctagatatgctgatgttggcttctctcttaaaagtgctatttgtttatgtacctgtgttgtgtttgctgaggatggggaattgatatgaaccaagactcctgaaaatggtaagtagatgagaagccagcaaaactgggatgcttttcattttgaactttggctcatggacagcttggaccttaaagtcctagaaacatgcaagcagtgctatgctgatgaagtttgacctgagaagatcctagggaccactgataggaaaactgggtgaggccttagacggaagacatcccctgtaaatatatgaatagatcagtagccaattgctaatatgatttccttatattggaatcaattaggcccatggcattgtgctgtcagaatgaggcacattttaaagcatttttaaaaaatatatataagaaggtattgggctttgcattgtgctcagtttacaagaccattaaagaaacaacttcagaaccatcacattcagttcctagatcagcttgtctagctattacctatggtggtgattctatggtataaatatgggacagtttggcaaaggattaaaacagctgctttaaattttttttaccatttagtttcagagcttcacagcaagcatgtagactgctaggtgagttgtttttaatatttcaggttgtaattcagtatatattcagtttataattagtttataatatttcactgtttaatgtttcagttcagtaactgaccatgatgaatggctgtttgacattagcaagcttggttctacaaggagattgtgttttgttttgttttgttttgttttgttttgttttgttttgttttgttttgttttgttttaagtgtcaat

SEQ ID NO: 27982 - DNA, 1136 bp, Mus musculus
taaggtctcagtatattttccaaagtttgggtttttgatgtggatgacttgagctgtttcttaaattctgctacaagcattgcctagacggacgttctaaaagtgataagcacccactgtgttaagtttgttaaatctgatagaacgagacttaatagtatctggccatgcgtgtatatatcatggctcagtagatttgttttatgctccatgtatatgtgtgtgtatatgtatattttaatgactataccataaaacaaagtttatatcatgttggtgcatggcattctagaaaccattttgtacacgagtgaatctaagttttagggaaaaaaggcaatttatttgtagacttctgaagtaagaattagtatgctatattaggaaaaggagtgactattttgaagtatgtcaattcccttctgggactctattattgcaaaaattggttgctcattcaaattttatgccaattacattttatctaacatctacattgccctaatttgtactgaagtccttgtatattgtgtttggttgactactggtagctgtgatgggggctgcattgtttcacactgaagggttacatttgctttagcaagtgtttggggtcaaactatgtccaggaacaaggctgggaatacatagctaggacactgctgttggaggccccaccccagcccccgaacctgcccctggcctcgctccaggcttgagcttctttattagcttagaaggatgtcaacttatccaggatatcatattcagaatattcatcaaaatcattttaattctagcatagaatggactgaattcctgttggtatatttggcctatcatcctttaaatgtctctgataatttattgatatctatctttataaaatagaaaaaaagtacttttgtgtaaagatatttgtctttaaatttagtatttcatatcagcacatcaatgtatgtataaatgttacatgttaattgtgtaaaagattctacaataaattatttttaccacttgtctacagtgcgcattaatttaataaaatggtattgacactacttgcgatttttcttaatcttttatttaaaggcattttataaccttgttcgtgagctatcaactgattctgattt

SEQ ID NO: 27983 - DNA, 1518 bp, Mus musculus
atcagaaaccaccaggtgtgcacttccactcccggacaactttctacagtgttgtgtttgttaccgctgttagcgcctaactaaatcatgtcgaatggccgatttaagtcatctaaagtatttgggacataaggacttagtaaacattcattgttatcatttatttactacatctccccaccacggacatgtgggatgagtagaacagtagtcacttggcctacatttgtggcatacagaaaaactcagtctgctggtccatctctgacttacctgtcaccggcaagcactgcctgagacaggaccctctgagaagacaactccatactgctttcttgagatcgcctctgaagagaatgaagtgaccaatgaagatgagcccaatgggcccaaagccatttcctcaaacgtgatttaggatgggtctatttatagagcaagtaatagttttctcccctaaacttaacctgtactcaacctgtgcgggatttatggttaaatcagatttgaccctttctactgcagtgaatgtagagcagagctttggacagtgggtgcgcatccagttctggaatgtggcagtctgaattacagaggaaagaagcaagcctggtgagatggtcctaatatgtttgcctatttaagaaataagacttcttctgcatttccttcaaaagtaccaaatatcaatatagatttataaataataataaacaaaactctgacgtgaaagttagttccatagtagcaaaaagatagcacacacattacaaggaataaaacggttctttagaagagttcaagtttccttaaggaaatctgccaagaacagctcggataacagtattccagcagcctgcgcgtcacacttggaggtgccggttcactagttggtttaggctgtaaagatagcagcggggtttactgttttgctgctggttttactgacaaagcactaccttgtaggagcttgacagctacagctggatgttccttggcgtgatgtagcttgtactcaatctggactagatagactctatttctatgttgagtcacctgatgcccaacacttttgaatttgccaacctcaaatgcctagagttatcctcgaggctggcagtgggccctttgcccatcttcccacaggtgtggcccactcatgctcacaccaacttcgtttagctgtggttattgttcctggggctgcttgttactgtctcccattccccctttctccccagccttccaggggaagcagctgtttggcttctcacactgctctgagaaaacagtgcacttaaatcctaagtcatggcctaaaaaaaacccaacagagacaggaagtttctcagatcaggggaaaggaaaagtgcatgctagtcaaaattagtctcaaaaataagatagtacaggaaccaaaattgcctaatttcacttgactcttagttcaattgtactgtacaaaaaggcatttaaaaacccaggtgtgtccattctacacaaagcaaatctgttatt

SEQ ID NO: 27984 - DNA, 1191 bp, Mus musculus
caatcattaacacgctggcggtcaatgctgatggagtgcttgtgtctggaggtaacacaaggtttctatggtgtgttgagtgtgcccttctgttgatgtgagtgagttagtatctaaagcatcacactgttgtagtgacacacctactagggtgtatgtgcctgtttgtaatgtgcctgccgtcgtgctcagtggtgttccatgcagcatgttgcatagtttagacatctttgcattcccatgtgatgaaggtagggatttacgctaggaactgcctgatgtttggttggattttaaatgttatggtgtctataaattagagacttagagggaattagagagagagggagggagggagggaaagagatagtgtgtgtgtgtgagtgtgtgtgtgtgtgtgtgtgtgtgtgtgtgtgtgtgtgtgtgttgctggtgtaatgttcagctcctgggtcatctgagctgttgaggggatagaagtagagctgtgtgtttcccttgcagctgacaatggcaccatgcacctttgggactggagaactggctataattttcagcgcgtccatgcagctgtacagcctgggtctttggacagtgagtcaggaatatttgcttgtgctttcgatcggtcagaaagtcggttactaacggctgaagctgataaaaccattaaagtttacagagaggatgagactgcggtaagttcttagtgtccatctctgtctgtctgtctgtcttcctatcttccttcctttttagtttaatttaattttatattttatatttagagacaaggtatcacatggtacctctggctggcctggaactcactttgtagctcaagttgattttaaacttgaaactgtcttcctgcctctgcttctccgatgctgggattttgggcatgagccagcacacccagctttcacatgcattttaaagtaaaagaattgcatgtcaatttgacaaggactgctcatttgagtacaaaaagaaacagactcactatagtaccatcagtttcatcctctggatagtgatctgacctgctcagggcttctgtgtggtttcattgatgcagacacatcagtgataaagcattacgttttaagtacagttctgcctcagtacagttcctgggaaggaaatgatacattaatcgtggcaaacaggagactgctgagggaagga

SEQ ID NO: 27985 - DNA, 1191 bp, Mus musculus
cagcctttatccctcttccttggtgatccccttgaaagaggggtgttgctctcaagtatcaattgggcatcagtaatcagcaatattttgaagcctgaaataaacattttaataataaagggggcattataagtctctcatctattcagtagaatagactcaattttcttgatagaaatttttgtttgttatttctagagccatttgagtataattcagtctgttttgcagtttgaggctcagatcccatgctgggcaagtgctcctcttctgagctccacagagccctggagccagtcttagatgaaggttctacccggtcctgctgtctatcccaggcaaaccagacttagcttgtgccctgctgttctttcaagtctgtggtcatttttcactagctgagcagaggtggcgtctgagtgtaccctgcccttcttacccccttgtccacttgctcccacggcactagtgggaactgccttggtgcagcacagcccctcttctgcctctccagacagttactaccagaagtctgagaagaagtgtgcagacaagttttgctcggactctagctccgactgtggcagctcctccggcagtgtgcgggccagccggggcagctggggcagctggagcagtagcagctctgattgtgacaggaggccagtggtggacatacagcacttcctgccacctggtgagtcagaggccccctgtctgcctgcagccagtgcagggctaccgtgcaggggacagagcgcttgccttgcctcgggctgtctgcttagctctcctcctttctcctcctgatctccattgttactggtactatttctgtctttgaaacacttcgaagacctgaacaattgtatatcttttttattgtactaaagtatttcacggggctgactgttttgttttgttttttgaccattttaaatgtacagtgtggtggcctaaatcacgttcattcagactgtagagccatcgccaccagaacttcccatccttgcaaactgagactctgtgtccattagtagtcactgctgttcctctccaagcccctgcttacctgctcctgctctctgcccctaacgtcactgcttggatatctcaagtaactaagccatgaacgattgtagacatgcatggttgtcagatgtggagtgtatggttgtcctgtatggagat

SEQ ID NO: 27986 - DNA, 1222 bp, Mus musculus
cttagccgtggctcgcctggcatcaggtactcatacatagttaagcaagctttcccagtgctcagactctggctcctgggctgaatatgtttcttttgtaatgactgtgacagagaccttgtgcaggagaatctgccaaaggccatgtttctgagatttgtgtgctgtgctaacttcactgtctcctcttatgtatgcagccccaccccaacctggacgatggtatccctccttgattgggttgttctcgtcttctccttgaagttctatgaaagatggctgagatctttgaacttgacagagtcctgcattctttccttatacttctgtcttccatccatagccctttcatgtgttaaaaatggcaggcagttgacatttggacatctgtttttgaagtttctgtcagagtccacgtcatggcttctagtggtcattgaattgaaagaaggtatacattgaaaagcaaaacaagcaagcaaacaatccaggaagttgattgggtataatagtgcatacttgtaatcttagcatttaggcctatgaggcaggatgatcttatggacactcggctgtactgtgagacctggtttcaaaaatcaaaccaggctggggctggagtgttgtgaatgggcctggtgctgtttgtattttgatgctaattctgttctcctaggaggggttgcagacaaggagtgagtcatatactcaggtgacttcttgtgaaccaaccccctactgaataaaggagccaatcactgagcgagtaggagggacttctgggttggacagaggaagagagaaacaggagagagttagttctttttggatggggatagcttgaacaaaatgtagctacaagtgtctcctggtttcaatggcagatcagtcaggatttgacacctggatttggatttaaaacaaggcttatgagattaggatttcattgttgcacccagctattaagttacgattgttcctgaattaagtttgtatggtgttttgcttcacacagcagtttttcttggttcaagagagaaaggtatggctggcaaagtgtgggtttgcctgatgtgcaacacaaaggccgtgggggatttgaagcatggggctggcatgttagtgactggccagtgagaacctagcaagcagggtggagagattttggagctctgagtcagagcgtgactgctggggctaagagtagcagggtgtagcatag

SEQ ID NO: 27987 - DNA, 1196 bp, Mus musculus
agagctgagagactcacagtgtccacctcacgggggtttgctacttttaaagtgaaaactgtacataaatcccacattgtatcttctgacccacagcaagggctagcagtgtgtgtgtgtgtatgtacatgcatgtgtaagcatgtatgtgtgcctatatgtgcatgcatgtgtatgtatgtgagtgtgtacatgctcatatgtgtgtttgcatacatgtgtgtgcgcctatatgtgcatgcatgtgtatgtatgtgagtgtgtgcacgcacatatgtgtgtgtgcatgcatgtgtgtatgtgcctgtgtatttgctactggtattacaagtgctgcctttgctgtcactgttgctgctatggtgttgaggaagtgtgtcactgaggtttagggtcagcttcatgagacagaaagcacagtggcacacacactggagacgtttaccagtggactgcttactctgacagcagcagacaggcagcactcctgtgcttagcaagtctgcagctgattctgtcttgcagtctgaactagaatttagcccacgacttatgctcatgtgtcggtgagaggaaaagggctggagtaggatttaccccatacctttctccagagagtagccccaatgagtatgggtagggagagagagtcagaggcagggggtatccatatgaatgtgtgcacacatgcgtgctttccctaacagtcaacaggttgtgtctcacctccactgcaggctagaagaggggcttcctgtttgctatctgtctagttacaagtctcttcctaacactgggcatagtggctcatacctgtaatcctagtgctcaagaggctgtggcaggaggattgctgcaagtttgaggccagcctgggcagcactcagaaggctgaggcaggcaaaccttgagtttgaaggtcagcctgggtacatagtaagttccaggatagcctggactactgaggagtgaccccctctctgtctcaaaaaacaaaagcaagcaggcatctctttgtgatgtgaaaggaaaagcaacagggtgggcaggcacccctttactgtagtgagcctgtttatctactggcgttctctttgtcatagggagccttttctcacacacacgcctgagctacacttccagaatgctaactcattaggtctaacaccaaggaccactgacttagtacttatatt

SEQ ID NO: 27988 - DNA, 1203 bp, Mus musculus
aatttactgcatagaattctggtacaccattgtaagtcatttggaattctttctgtgtagatttgcctcttcttgtttatgtatcttgtacttcatgtgagtattcatgctctggggtacagcccagcactagggttcccttctgctttcatgccattattgttaatcttattatgaagtcattagaatctctttatgcctttcaatagccttttaaaaaaataatttaatgagctgcaccacaataccaacttttaatgatagatggacttgaagccaattaagctgtctttatcagttcaacaaaagcatgtgtttctgccttgatgttctagagcagctactactataacaacttgagactagagaaataatcttgactgtgaaacagtctgctttatgggaaagcatggttggtactgccctggagcactagagatgcaccgccaaggctgcttgaggtgaggcctgaccaggacatggctgttcagggtcgtgaggcctccagagcagcttgcctcttacctcactctccagtcgaggaagctgtcagtgtaattggccttggtgacaattttgtttgtgttatcttgacttcatcttctgtggaagctctgtaattgtatttggttgggagccaggaatgcactatttgaaaactctctaccttctctcctccccagccctcctcctcccctgggtgttctcagatagcagcagcaatctactttgccaagaaagaaagattgctttgggagattcgtgatgagagcgagtgaaccagagcgggtctagcccttgcttgagtgaaggcgcgctgggaagctggcctggctccctggtacacatctctttgatgagcttttttggagcacagtagtatttgataggatctgaaaagttttaagaattgctgaagaatgaataaagttgttattttacctttaaaaagaattatagagggttggcaagatggctcagtggttaagagcgccgactgctctttcgaaggtctggagttcaaatcccagcaaccacatggtggcttacaaccatccgtaatgagatctgacaccctcttctggtgtgtctgaaaacagctacagcgtactcatacacataaataaataaataaataaataaataaataaataaatattaaagaaaagaattatagaaatcacaaacactgcctggctaggg

SEQ ID NO: 27989 - DNA, 2115 bp, Mus musculus
cctcagagatattcagcaagagccctacagtcgggcagagcctgcagcccaaccctcagtatgaatgtcagtgtttctccctccaggcttccgaccaggggccaggaatgcatctaggcactgggaccagagggatgcttagaagagaaaggcatctctgcccttgtacagcttatactctggaaaggagacatcgttgtgctttaatagtctgcctgcaggactgtttctgtttctgggctacttaaaagaaagctttttttaaaaaaaaatgagtaaattaattgtagaaattaaaaatgtaaaagtagaaattttgtttttgttttttgttttccaagacggggtttctcaatgtagccctggctgtcttggaactcactctgtagaccaggttggcctcgaatgcagaaatccacctgcctctgactcccaagtgctgggattaatggcgtgtgccaccactgcccggccagaaaacattttttaaagaggctgccatgggctgtttttggttggttggttggttctttgttttgtggtgctggagatggaatcagggctctgcaactgagccacacctccacgttgcaactcttattttgaaaatgaatttaccaaatgagttctcattttgtacaatgttgagatatttgtgaactgagaaattaattcgtaaatgaatcagctgcacatataaaatatcatgtcaggcttgatagctcaataagaaataacacaaatttttttttcttaacacacaaatattggtatgaactggaatgaaagggtaatttaatttagacctgttccaccattggctactaaagcacctgctgtgggcactgcaagaaacactacattctacacctgggtacctgtgtgtgttcactgtatttctttgtggtaagcgaattgggggttgggggtggagtgctgctactaagatataaatagacaaggtctaaatggaattttgtctcatttggtcagaatggtttctggtaaactgagaaggattattacaataagtggctttttttgttctaggctactgttactgtccaattgatcttcgttgagtgtatagaacccgtcacacattcatgatacgtagcactgagaaagtaagcgttcagctttcccttgggcactaaggacaagcagttaggttttataggttaacgatagtgtgtcttctcccgccataaacctcccttgctggacacagggtggtagggagtcactttgactatccagaaacacacaattagaaagttgttatgactgtttgctggtgtttaaatgatgtgtaagattttgatgaaactttagtctctgtaaccaaataagcccccgagtttcctaaacttgacaaaatttgaggcaataagcacccctggtccatgcagctgttgcacatctgctcccactacatgtacagggtatgtatgtcctcacggggaatgaactggaatagcgggacgtaaccaggtatatggagcctcgctctaaagggttagcataaatgctttggtaatacctacggaggaaattggagagatcagatcaacatcaggccatctgtaggtcacatcaaatgggaaaagtctctctatgcatttgaactgtagatcaccctctctgttcaccagcttctgaacagggaagaggaatttctgtttttggtgaatgcttttaaaacaagacctttttccaagtaggatagcattgaagctgcctgatgcaaacctttctaatttcccttaaaatcaaaagtcctaatactgttactttatgtaaatgttgcagggtgtttaaaattttacaattattttaatatttttgataactaggaatctagtattgccataaaggaaactaagtgcccattaaatatttgtttggtataaataaatacttttttttttggttttgtttcaaatgacagtaagctacaaatcatgacgctaatcttcaaaaacactttctaatgaactgtgtggtagttgattgtgtggtctgtttgtggagaatgtatggatgcgattcattagtattctagaagagattaataatcagctatgttgttccaatgaatgtacagcacttcca

SEQ ID NO: 27990 - DNA, 1136 bp, Mus musculus
cttattttaaatgcatgtccttctgcatatgtaacttccctgatgctctggtcttatgtctatgcaggtttttgatgggagtggatcatttttgtcctatatcaacacatctgctgacccgctctatggcccccagggcctggctctcacttcagatggccatgttgtggttgcagactccggaaaccactgtttcaaggtctaccggtacttacagtaacagtggacagctctgtactgaggtcttgcactagaaactggaatggagttctcaaggtgggaccagactacgataggacttttcatactaggaagaatcttcggtgaacttcccaaggttatttctgaatgtaaccatttctttaaaaactgtctatccaatttccgtaattcacttttaggatttaaaaagaatcttcttctactgaatctatacaaactgcgaagttttacacccatgaactatggctcataggacagggatttctgtagttaaactaattttgcaaatcagacgttaaaaagaattagcgtatctgttgactggtgaatgaatgatagcctttgcatagagcttccaagaacaaaacttgtagttgcctattttatttaacttcgatcacaagacccaagggaccttctaacctcacttttacagtaggtgttattattctggtgacatgtttttgcttatcaacaaccacatataaattaccttagaaaaatccaaggctgtcttgcaagatcctttcagttcaactcaggccctgagttgagcccatcagaatcaatgcaaattccccaaatttcctgggtttgatcaaagatcgtttccatgtgttctcttcaccttctcatttctgctcaccttgcatcagaaaatgaaatatattttcaggaaaacctgaaattcccgatgctttggaaggcacgtagcaaaagcaaggggactctttggttactagcttcagatcaacacactggaatggaatcaagagaagtcacattcatgtgccatgcgttcatgtgtctttcctcttccacatcacgaaagcgaaagctttacctcctgcaaaacgtcagcacatgtagtcagacgccagtgtcctaggacagagagccataagcagcccttt

SEQ ID NO: 27991 - DNA, 1184 bp, Mus musculus
tcccatcgaacccctccaggagtaagatggatctgctgtctttagagagctgaaggatcaccaggcaatctcgagtctgtgaaacacaggagcgattggcccccaagaccttaagagtctcattaaccccacccatttgggcctcatgttttagtaatttggctttgagtaacagggttttctcttgtgcggtgttgtagcacaggtcacgtgctgcctcgttcatttttttttttaacctttcctgggatgagggctgttgttattcctgtcaggacccggaggctcgaggcagcctggggctaggcagataattggcacacagccaggagcacagccacagctccctgacgctataacttcgctgtcaggactggtaggcaaacctttgaaattgtagtctcacccagagatattatatagcactgcccctcgggagccccgcccctgactccctcatgagcaagggcttaaccactgagccatctccctggtcctgggtcttgaactgattaaagcactgtggtgcagtccatgatgactgaagtatctttaagtgacttcgtatattaaagtcttctttaatatacagtgttctgagcagcccattttacaggtaagaaagctgaagccaatggatggctgataagtgagtggcaggagaaagtaaggaaggaggtctttgactcagcagcagaagctacgtagaaagtgggggagcgctgtgctggagatgggcaccccctgaagccatagccagttattatgggttctggggatgctagagaagttttgagattatagcacttggacatggtggataaagacttcctaactgttcaactgtccacaaggagtcaggagagttgtgcgatgtcacggaggtgggagaccctggaggccactgcaccagttcaagggcacctgccctctgtagcgccacatgatgctggcctcttcatctataagaggtatacatctcttatggttgttatggggatgagtgagtcagctggcgtgaaggagagaactacaccagggctgggagttcagcactgtggcctggcgcttgccagaaatgtatgaaactccggctttaatcttcggcacctcaataaataaacaaaataaatgtgctgactggcggcccctggacactgtggaaacaagtgacagtggaagcc

SEQ ID NO: 27992 - DNA, 1448 bp, Mus musculus
ctggcccatagcttgttgcagatacactttaaaaattaatctgtaacactgtaattttgtttagatatttataaaggtccgggaatcacacagtcatattttatgacgtgtttaaacttatgaatttgacagttgtgctagcagttttgatttataatgaaatctgcttaagagggataggttttgttattttgttttgggtttttttttaacatgtggacatggaaattattagcagtttctagagcagaaatttatagattagaaagctagtttgggagtaaattccgttttgatagaagagaatttccagactgtgttcattggcttccatgcgtgactataccagttaagccttaaatcacagatacgtgccttctccgatgcagtaattcttgcccaaccattgtacatacatgaggaaacccctatggataacatttgattcatctgtaacgttgggatattttgtcctcataaaaccacacttgaggtggatggtgaaaacaacctttgaattttatattttgtttctcttgattcctcttgaagaagggggtgatgggaaagttttcccccttgggtaatgaaaaggttgtgtaaagtgtgtggaggtcgtaggacggaaaatccagtgctgggttacttgtgtagcactgtggtcttgtgtatgcggttggcttgtctactgtgtggttcctcagcgatgtaatcttgtttaaatgtaaagttcccttgattttgtcatacatataaatgagtattttcagagatcccacttcacctgttatttctattgtgttgaaatgaagtacttaaaattactgttctccgtgaactctgtagactgtatgatgtgttacatatggccaactgccttttagctggccttttttattaatatgcctgttttaagtgcttaatacagtataatgtgattgtaagtcatgagcctattttaaatcattccctcctgtgtatgtgtgctctgagagagcttcattttattctcccagcagagtaacttgtgatggttatttacattccccagagtgtgcctctggtgtgaattctgtcttcttattaaagtgtctgctgcagaatccagttgccctgtccttataaactttaaataagacgtaagtaactatttggaacttgagaggatgtacttttctgatctttagtgggagaaaaaggtgcttctgttcgctgccgaaccctgagttcttctcctcagcctgactctcaggacccgagcacattcagtctcaccgaagttcaacagcattgtacaagaggagctacaaattaatagactcctgggttaatgaatttttttcacaaaagtaaaaataacagtgatttctgaatagtgagcacataggcaaaagaagtgcaacctcgtgctatacagtggtttgttcagtttgtttcagaggcagttc

SEQ ID NO: 27993 - DNA, 1174 bp, Mus musculus
agttagcaagatcctgaagttgtttgttttttcctatttttctcttttgagggataggatcgtgcagtgcagtccaggttggcataaactcacagtcctctctctctcctggtaggatttcctctcctgggtcctaggaataagaggtgtgtgccgccatgtccagctgtaaaattttggatccccaataggtttttgtgggtattagtgagcacttttgatagctaaattcagttgggaaggctgatttaaactacgccagtcggaaggcttagagttcagaagataggaaaaaatggaaggtgactttgaaggcaaggcagacagctgaagtcccacccactttaacaccacagcatttgccattttagtatggaagctgtgtctctttctacatatattttacacgtcaggttgtgctgtgacatcattccttacagaccttatggactgtgacaaccagaacaacagagctctgttcctgaggtcatcagacatggagctgtagtcctggttccttacgtttactacttcctcatgggagccccgtgccttggataatagaaatatggtctttgtgtgatacggcttttaccctggatagcctctggaatgtctttcaactaaagacaagtaacttgtagatagtgacttgtatttaatttgataatggagatccaggtgcagattctgtactttcccatatgagactgtttcacctactgaggctcattgcccatagactttattgtaggtgttcggaccactttatatcagccagtctggttttaagttttgtagttcagaagtttaaagggacagagagtaatctctactttcaaaaatagtggcaatcaatttaggtctagcatatgcttgagttcagtgtaagtgggttttcatacttttacaactaaagcctatctttatcagaactttgtgtatgtgtatatgggatatgtacatttctaattatatattaagtagatattgattttttcctgtcatgaatgaattttatatatgattttttccagaaaatggcgggagactattattaaaatgatagtatattgtaggcattaggatcgtcccagctagagctagagaggtagcttactgagtaagagcgcgtgcttggtaaacgcgaggatttgaactggaatctcgagca

SEQ ID NO: 27994 - DNA, 1149 bp, Mus musculus
caggactccgtggtgttccttagtgtcttccttcttactgggataggctcccttcctctccacagccgggcatgctctgctgctctgcgtcattcttcactgttaagccaaagttaaagttattttcacttagctttttccttcaatttagttattaaaaaaattaaatttgcttgattcttggttctagactattctctcctgatttttttttttctctttccaggcattcgcaatatcatgactccatgcagctatcttagaagtagatcagacaaaacaagtctaaatctgagttagcagtcctcactcacataatttcacctttagcctactgtctcagcctattctcatggggcttcactgtctgtcttgtctgtctctctctctttcttataactattctggccttatgctctacatgtactatatttttaatgtagaaaaagatactcatgtcagtcattagggaggtgaaagtttagcctgcaagatagccatcaaaaaatagccagaagggctaaaattccaaggactcacaacagagatttccttgggaagataccccaggacccttttagatgacacctctggcagcctcttacaaattgaaacatgtactactactggacattgtcctcctatgtattccaaagagaaatgtaaacactcattcataggaagctctttgaaaggaaggcgtactagatttattcagaatatctgactactggaaacaacccaaatatctttcagtagctaatggctggagtttcctgcagtggaatgctactcattaataaaaaggaactcccagtgtaaaaagagacatagatgaatagcacagacacactcagcagaagaacctggatacagaattctataatttctcttatattaagttttagataagacagagctactctacgataaaaagtaaaaattatgaccactgactgcctttgagtttaactatgctagtggtggatagttgactggatatgtttgctaaagtgatacaaatgttcagtgtctgactggtatatgtgtgcgcgtgcatgcgttacagggtatatttatttgttggacagctaagatatgtgtgtattttctggtatggatgatttatctagtgattataaaaatagt

SEQ ID NO: 27995 - DNA, 1171 bp, Mus musculus
tacaggtgtcttcttataacatagattgagaatgacagactaagcaacatcctaggagtactgaaaacagttgtggtctcatagattccatgcaaggatcctgggaaccctccatgttgctggagtgaataatttctcactgggatactgtttatgaacaacatgctatgtttgtaaatggaagaatcattgtttaaagatatactagaaccggtttggtgaatttatatttgagacatttttcttaaagactgttgacagtaccttatgtttacttacacagataaaaatgggccaaagaatgtcctgccacaaagttgtgtttgtagttttctgaggatggatgaatggactgatggacagatgggtggatggagggagcaggggagggagctggagatctaaccaaggcccttgttcatgctaggcaaacactcaagacctctactacatacagtatttaacttctcaaaggaagaatttgacattgagttacttatagttaagaaggaaactagttactttattgaagtaatcatgagggctggggatgtggttatgatggcttgaatgagaatggcccccaatgattcatatatttgaaagtttggtccttagtaggtgaaactgcttaggaagggttaggtggtgtgggttttgttgaaggagctgtcactaggggttgggctctgaggtttcaaaagccaagactaggaccagtgtctctctctgcctcaaacctgttgacaagatataatctgtcagctccttttccagggccatgcctgcctgctgccatgcttcatgttgtagtagttatgagctcaccacctgaaactaagcaagcctccagttaagttcttctaaaaagttgttttggtccttatgtcctcagtgcagtagaacagtaactaagacaacggtatattccttgcttaccatgcttaaagccctgggttccatccttagcatcacacaggaaagaaaaatcatacttttaacttattattgataaattattaataaataatgttttctctactttttaaaagggcctgtaggtagacttgattaaatatgcactgtctttttccctccagaacagtattatgctcatttttctgatagttaataaatgtttacttctgttggttagtcttcaagttctgtc

SEQ ID NO: 27996 - DNA, 1206 bp, Mus musculus
gaatgatttatataggaattattttattggctaagttatatcttattgatccaagcaactaaaccaccaagcttttagagatttatgagaaaaggtagttaaaagtctttagtatgattttttttgaaaaaaattataacttacttaatttaaaacttatttattactaacgagcgcgtgaatctttaattatatacttagactataggcaaatgacacgaaaatagacagtaacaaagattgtacaaatcttgtttatcccccttttcctcctacagaatgtgaaaacctttgcatcttctgatagtctagccaaggtccaagaagtagcaagctggcttttggaaatgaatcaggaactgctctctgtgggcagcaaaagacgacgaactggaggctctctgagagggaatgcttcctcaagccaggttgatgagggacagatgaatcgcgtggttgaggaggatccacagcagcaagcgagacatcaagaggaggagcacactgcgcggaatggtgaacttgtgggtgcaaaccctaggcctggagaccagaacgatacccagcaaggacaagtggaggaaaataataaccgctttatttcagtagatgaggactcttcgggaaatcaggaagagcaagaggaagatgaagagcatgctggggaacaggaggaggaagaggaggaagaggaagaggaggaggagatggaccaggagagtgatgattttgatccgtctgatgacagtagcagagaagatgaacatacgcacaatagcaatgtcacaaactgcagtagtgtctcggacctgcccgctcaccagctctcctctccattctatacaaagacaacaaaagtgagtacctttagtccccttccagctggtatgctacctcgctagttcagttatagtgaagtcatccttgcaatcttcacatgcagaacaactttagtaagtcagttttagtttgttaaaggctttagtgttagaaatacagatactaataagaagtcaacttaattgcaaaactagggggtgcggattgatgttgtttaccaccaaaaaaaaaaaaatcaccagcttcacctttgctgccagagtggtttgggtgagtgtgcagggttggtgtgaaatatgatgtgtgtaaattaagtaatgaagaatcttatttgcagagtagctaatgtagtcactgtctgtcgtt

SEQ ID NO: 27997 - DNA, 1898 bp, Mus musculus
aacagactgaaaagacctacagactaagaaggcaagaagagacaagagaccgtaactgacaggaggcggcagctgtcgcatctcgcaaaggcctcacttgtgactgaggggcagcttggcaagacgactctctaaatccaaccaggtgcaattattctttgttttcttctccagtggtcattgagcagagctacatcagcgttgttaccgtcacctagaaaggagtggcagtaatatccaaacacgggctgcttatcttctaatcagagcatctgcaacaaaccgtcatttttctgaagtggaaaagcttaaaacaattactgtgaattgtttttgtacagttatcatgaagctttcttttttctctttttcctgtttctcttcttttcttttttcttttttttttttgccaaccattgccaatgtcaatcaatcacagtattagcctctgttaatctatctctttactgttgcttctactcttcaatgcatatgttgctcaaaggtggcaagttgtcctgggttgtgtgagtcctgagatggatataattcttgatgctggtgctagaagtaggtcttcaaatccggggtcgttgtcccacccctgtactgtactcccagtggccaaacttatttatgctgctaaatgaaagaaagaaaaagcaaattattttttttttattttttttctgctgtgacgttttagtcccagactgaattccaaatttgctctagtttggttacagaaaaaaaagacttttttgccactgaaacttgagccatctgtgcctctaagaggctgagaatggaaaagtttcagataataaagagtgaagtttgcctgcaaataaagaattgagagtgtgtgcaaagcttattttcttttatctgggcaaaaattaaaacacattccttgggacagagcctgaggtgcctgttctgtggagaaacttctttttgagggctgtggtgaatggaagaacatacatagcaaaactgacaagatattttaaagatatataaaacacaaaggaaaaggaggttgctggtcagtcgtagcatcttacagtattggggaaaacaactgttacagtttcattgctctgagtgactgacgtgagaggaattcgctctgcagtgacgctgtctgtcactcgcctaccagctcgacgagcaagagagcgggagtcagatggtccgcctcattcaccaggagccgtaactcaagctgaactgtgaaagtggttaacactgtatcctaggccgtcttttttttcctcctcctgtttattttttgtttgttttatttatagtctgatttaaaacaatcagattcaagttggttaattttagttatgtaacaacctgacgtgatggaggaaacaacctgtaaagggattgtgtctatggtttgattcacttagaaattttattttcttataacttaagtgcaataaaatgtgttttttcatgttattgcgcctgtttcttccactagataatactgtttcattataactatatagtatttgtgtcagatattttaaatagtcaagttttgggtttcttacatcccctgcattgtgacttagaaaccagcacttccgagctcagccaaagctgaggcactgcagatggcaccccgagctgtcagggaggccactcttctgtttgcattgtgtgtatgaacatgaaagctcgtttcttcagtcataaaacttggaattacaactagaagccttgtaataatgagttcaccttcaaatcccatataccaagtgttcaccaaagcactcgcaccattcttctctcaggctgagagaagtagcctctgtcacctttgactcagatggccctgagagcttcagctcagacagcttaggtggtgccttagatga

SEQ ID NO: 27998 - DNA, 1130 bp, Mus musculus
ttaagggcagtctagttcaactgctaattagtagctgtgtgtttgcaggattggctgtcaagtttgccatctttatgaagtgctttcttgtaggacagctattattgtacatgccacttcaagtcactggcccaggacagcctaatgtacagtttgctgcaaccctcaagccatctcagcagttagcatttcctgaggctgcggctcctcgggcagctgaggccacaacagctttaaaccattagggagccatcttagcccctttctgagtcagccaccagtctgtgtatcatatgacactaattccctatcatgtctcagcttggaacaacttgtcaagagtgagtagtccaccattaagtctgtcaagggaggagacattttaagagagcagagttggctgctgcttcttttaggatgcccatcataaacctaatgcctcacaagatgctcttagaggactcagaatggcttctgggaccattctgcctcagcaaagcccttctccatccaggcatttgttaatccagcacttgttttggaggacagattatctcggcagctcattaactggataaacagggctttcacaagagatgttctgtgaggctctttagggacgaggaccatgggggagggagaggaaggcacagtgggtagatctgtggattcttgctctcacaacccttagctaggactggtcactgggttcttgtctttgaaggtgtgagttagcccaggtcactgttgcccacacaaacctgaccataggattctgttcctgtgtacttggtgttcatttcatggctcttttatggagtttaaatgagctgtgtcttcacttcagaatctgcacagatgacggaagtactcaggccagattataaatttcactgagctgaggctgcacaatatcaagtgacattttactaggacaaggaccaccaaaagccagacctcttttgtcccttgcagacattttacagaagggatctggtgctgatcttgtttaaaagacttctgcctagctatggcctcagagtcagtgagagaggacttaaagcacatgccttctacctctgcccactgtggccacagccacactcttcctggcaatgggcagcttacat

SEQ ID NO: 27999 - DNA, 1164 bp, Mus musculus
tgctcttacccactgagccatctcaccagcccttgtttttgttttattttttttaaaccaaggtatgtaaacttttgtaagttacatacattgcaaatattttctactctgaagcttatctatttcattattgttttctttgtggtctctttgatgtcagtgtttctcattttaatatagatgactatgtaaagttttcctttataattgtctccacttcctcttcctggtgaataaatgctatccctacaataaatcctgagaacatgttttccctgtagcattttattagaatactcctagaatacggccaaacatgttgtaaatatttatagctattagtatttactttctatctgctttttgctactgctaaagtatctgaacttttgttccatctggagattggttgtgggttttgtttcagcagaagatacaacagggacacaatgtcaccactcagcaatcagatgtggtcgctgtgaaatgcactctgctcttggaaacgcctttgtcctactatactcctagagactgagcctggttctctatcttggcattctgtaagccatcagatgacgatgacagcgaccacaatgatgatgataatgataattgttgttgttattattattagcgtgtgggtgttttgcctgcatgttggtctgtgtaccacatgcctggtgcccatagaggtcagaagagggtctggagttccaggcggtgggatcccttgtgtggatgctgggaataaaacccagatcctctgcaagagctccaagtgctcttaactgctgagccatctctccggctccagtagtagtgcttaggtttcattattgtcaaaagttttctcttgtgacttaatttcaaccaatcagaagttgatagtttactttccttcctcagtcctggagatcacacccagggccttgagtgtgctcgggaaacacactggggaagcacctggggtgcaccccagcctcacattatctgtgctgtcttttgcttcctcttcttctttttaaaatttatttgtaagctaaatgctgaccattttattgtctcatttcccaatacacctgaaaaatgcacttttattccactttcccaacacacacacacacacacacacacacacacacgtataagtgtttgccttca

SEQ ID NO: 28000 - DNA, 1099 bp, Mus musculus
aagcctctccagccgtcacccgcagcctcagctggtaacctccccccaggtgtggcacctttaatcgtcttcgatatctgtgaagagcaaacttgtcctgaaaaccccagtgctacaagatgtccagtgccaaggccaagatcaaaaagcaacctcagaccagtagctagggatgctaacagtaaagagaaaaacagccagaaaagcccagtgacccccagagaagactggccaccccactgtctactggacagcacctgcaatttagatagccaggcaatgatgaacattatgaacacagaacaaagccaaaatactattgtttccaggatcaaagcatttgagggtcagacgaacacagaaatcccaggactgcccaagaaacccgagattattccccgcacgattcccccgaagcctgctgtttcctcagggaaacccttagtggcacccaagccagctgctaacagagcttctggggaatgggacacatgggccgaaaacaggctcaaggtgacttccagagaagggctcacgccatactcatcgccacaagaagccggaatcaccccagtaaccaaacctgaattgccaaagaaaccaactcctggccttacacgaagcgtgaaccatgagacttctggaggaagacccatggcggagagccccgatacggggaagaaaatcccaactcctgctccccggcctttgctgccgaaaaaatcagcctccacagatgccccaccgtacccttcgattccaccgaaactggtttctgccccgccccgactctcagtagcatcacaagccaaagcgttccggtcacttggagaagggctgccatccaatcccccagttccagcaccacagagcaaagccctgggggacatcgacctcatcagctttgacgatgacgtattgcccacctcggggagcccagctgaagaacccacaggttctgagacggttctaggtgagtaaaaatctgaagtggaagaaacctgagcttataatggtgtcttcagtttcactcgctgtttttggtattcagtccatatatatgtatagaggtatgtgcacatctttcaagatggtgtaa

SEQ ID NO: 28001 - DNA, 1271 bp, Mus musculus
aatcattcctttgacaattactggtacccaaaggaaaactcattttctttgcattaccccagtaatacataaaagctgtctcttgttatagtggtacattatgaagcttggatagtatcttagattacagagcaaatggtaagatgaagaacagtaccaagcccccatagctcatttctcctcaatataatcagatgttaacataacttaagaggactgaaggctggtgcagtgccccccgtcccatgcaacacatctctgcagttagtggagtaaatacaaggccactttcctgtcatccaggctcacatgttctgagtttcaaaagtggctcttgtgtgactgaatcaattacagtttacaaactaaagccaaatactttgaagacaatctaatgggccagtgggttaacatttcactggagatggaaagcgctctccagcagggtccgtggctttcttctgttttcaagaagagttccatatgctggaccacttctttgtagtcttccccgttatccaaaacctgggcggccagcggtttcctgaacgtgttgcttctataagggaatatttactttgttttctactaaagttcctatccttggcatatgattgcacttgattttggcatttagggtctggggtttctattgtatgttttcggttaagagtatttaaggaacatcgttgtaggttctcacccatgttagttttacgagaatgggatgacttgagtgttattcagactaaattctcattggcagcaagccatacaagagcaagaagggggcaggggtgtggagaggggtatgaagtgtgtctttgcctgtgagatttcaacatttaatagtgaagattctgagcaacctatctttattgaagaaaaaaaaatccctcttaaacattggctctctgtaagcaggataagtgcgatagttgtgtatctacttgacaccataataaactgaactcagcttttcgattcctcatctcagactacactgcattgttcagaatatatgtagatggtacctgtcttaaccctgtatctccagtcctttgcacgggtgggtggagtggttatttgctaggtgggtttggtagacagacggatggctttcacgggccattgagtttactcaataccgttgctatttgttgatgcagatatatattgaaacaaatttccttttctttcttttttttttttttccatctcactcttccatgctgttttcttgctatgtatttctctcccaactactagaa

SEQ ID NO: 28002 - DNA, 1711 bp, Mus musculus
cagatccggaagaagatgatggaaatcatgacccgagaggtgcagactaatgacttgaaggaagtagttaataaactgtaagtgcgtttcttttctctcctctaaaaatgttcagaatgcctgttaaatcatccttctgttaaagaagaggtggagttggacctcagcttaagcacttctaacattgaagttatcttacagtggacagtgaaaattagacttaatacacaatgaataacaactttaataatgcatgggaacatgtgatgagaaactgtttcggtcccagttgatggccactgataacattacatttttctgatgttcccatgcagtatacaggtggttaagcgtgttagacaaaaaagcataaggaagacttaaacgttgattttgttgctaggtgttaaatttagatactaagattgtttttttgccatttaaagaaaattgcttcttgtatgagagactttggtgggttttttgtttgcgtgtcttttaaaaaaagtttattgttcttgcaggattccagacagcattgggaaagacatagaaaaggcttgccagtccatttatcctctccatgacgtctttgttagaaaagtaaaaatgctgaagaaacccaagtttgaatgtaagtgggaaatcatgtttcatgagatagaagtttgtggaaccaagtacgtggttttagaaatgactggttaacattcttgatgggtgtatgtgtatgagtgatttgcctctgtgtgtgtgtgtgtgtgtgtgtgtgtgtgtgtgtgtgtacacacgttcctggagacgttggtgttgaggggctgcggctgcagatggttacgagccacctgtgggtgctgggtgctctgcaaggacaagtgccacctcttcaccactgagccagcctctgcatgaaggttttcagggcaaagtaacggtcgcttccttcgggctgtagtttaggttctgatacttgtttctaacaggatcctcttccttttcctttcagtgggcaagctcatggagctgcatggggaaggcggcagctctggcaaagcagctggagacgagacgggtgctaaggttgagcgagctgacggatatgaaccgccagtccaagaatcagtgtaaaatccagatttttaatagtgacaaataaaaagtcctatttgtgatcgtttgcttctgtccattgatttgaaacacgagagcctggtgaatcaggtgttgattttagtgggttttatccattaagttagaagccaggttagtaatgagacagggtggggctctgtctggcctccaacagatttgcatatatctggttttaaggcgtgtgccacaacaccctgaaaatagaaaccagcatactcccaaagttcttttctccctttaaataaccacactgctcagtagcagagttagttataaagtagcagcaacaaagatggttttatcatggcaaaaagggtcacagcattagggtggttaggaccactgggttagactatatatacttggtgaaccagaagactgaaaactgaaaatcataagattttatgaagcccagggatcatccagatctcgggccttacatgtgctaggtaagtgctttgccactgagcgtgtgtgtgagtgtgtgtgtgtgtgagagagagcgtgtgtaaatgtgtacatgtgctaggtaagtgctttgccgctgagcctgtgtgtg

SEQ ID NO: 28003 - DNA, 1711 bp, Mus musculus; identical to SEQ ID NO: 28002

SEQ ID NO: 28004 - DNA, 1192 bp, Mus musculus
acacaattaacattcataaaggatgagaaaatagcttgcaatgtctctgaggccatacagtagggactttagcttgtcaaacctcagcttaccctttgcatgaggcaaatactttacacatctgcggaccattcttttgagtaatgggaatgacgcatctggaatctgctctggcaagtgagccagctttgcagtgcacagggccaggacaagcacaactctgatgacatggaggagacccagtgcattttctggttctgttgtctttctcccacacttgagaacacagaagagcagattattccatgtcgtgttcgtcacagctagtaattcctgttgagggacagccaatatctactcattatagtagtaactgtacttatatctagatgtgaaaataaccttcctaagagacaagatgtctctactgctaatacatttgcccgtctcttcaaaattcaactgcttaatactgtacttctgctgtctgagcattttgttagcaactccagcatttccctacgcttctctgaatggtatggatgacttacaaacctctgtggagatatccactagaaggatggataaagggaaagtgaagaaggaataggaaggatgaggaagaagccagaacacaatcattttattgtgatccctttggcttttaccgttgatgtttttaatctgggatatagtacagtaaaacgacaaaattatttattgccctcaaggaagcaatgtagctacagtgtattgttcccatattaatggaagaaaacgtttgaatttaaataaggaagctttctggcttaaattttaatatgtatgtgctggatgacaaaagctacagtcatctgagaggaggggttcttaatttaaaaaatgcctccataagatgcagctgtaggcaagtctgtagggcattttttaagttagtgactgatggagtagggccctgctcattgtgggtgatgacacacttgggcagtggttctgggtcctatgagcaagccatggtgagcaaggcagtaagcagcacccctccatttcctctgcatcagtgcctgtctccaggatccagccctgcattaattcctgccctggttttcttgagtggtgggctatgatgtggaagtgtaagccaaataaatcccttactccctaacttagcaataacagtagtaagccccat

SEQ ID NO: 28005 - DNA, 1147 bp, Mus musculus
attatggacctcaacatatttacggtcattgtctttgatcaaagcctttcgcttgcctttttctgtgttctgaacattctttttgagttggagatggggatgaggacccaagtctttccgtttttgaaggaaaaaaaataaacctgcttagaaatcttcactagggaagtgtgtgagacgggatgtttatagtacctgtgggtttgggctgttttctctccatcctctgtggtcatctctccatcctctgtggacgtctaaggtatagtgctccacaaagccatcttcacatacacatcaggagggtattattttcttttgcctgactcaaatacaacccgctccctttcagctccagttcttgtttgtttcatcatgtaacccattgaacaggaactttttaaatgtaattttaagcaatttattttttgtacctcctgtattacttggcagggaaaaagagagcaactttctacttttagggaaattatcttagatatattactagtaattatcattcttatcatgactatgcaaatgtgagactacttttggcctaaactttatgaattctaaatcctgggttcaaactctacaggggaaggggtttagagtgtgtgtgtgtgtgtgtgtgtgtgtgtgtacacccatgtgtacaaatttacaagaagagatttggaaatgtatatttcaaagcagtacattttaacaattaaaattacaaagaatccagcggtaaagactctggagtggaaagcttctgccgcagacccaggacttggccagtgccatccacgctgcagggttacacttttagagatgatttatttaattacaaatcttttcttcttttttcttctcaaacaaccctttctagtcaggactggacaactagctttgataaaagagagtaagacacagacataggcagattctggccgtgtgtggagcctaggccactgtgggctgtggcagaggaccagctagtgtgtgctttctcaccttgcagcactcactacttttcttgtggaagtgcttttctctcctttactttttaaggaaagagggtgtcacttgatatgtgctcagaaatcaaaattgatttccttttgaaaataaatcccaactctatctgctaagatagata

SEQ ID NO: 28006 - DNA, 1156 bp, Mus musculus
attttgcttgttcaagcaaatttaagttacattcagatgtgatagctatttctatagagtggtgtttgaagtccttccttgcttgggctgaaacaggaccacggtgcattcgttcccctcagtagcgggtctggtactcatgatgccagcggttaaagtcattgtaaaacaggacaatgcttcccgaagccattccagaaatgatgcacctagaggaagatggagaaggcttggttatagggatgcatttgctgctgctggtgacagttttggtacactcaagtaagctcggttttgacagcacagagaccttccgtagtctgtgaaaggtttggatactgctagaacacacagcctgtcactgacctgtgaacagaatcatttctacagtgcaaacagtgcttacaggcatcagactcagaggagaaccccacaaagcggttgccactggaggtgagggagggagaggagagaatgctgcctgggccagcctatactctgagtagggccctgatccttgtaacagtgacctgatgtagtggtcactacagacaggagctgcctgctctcctgagaagatggtgcagggacagatggacaccagccacagggagctctgctacgtgaacccctcccctgcacagtttggttagggccagctcttagcaagttatgctgagtaccttcctgtacttctaacagtgcagaaggccaacacagaagaggaaaagaagatcgaactctcacagcacatggacccagcctgcaaatggcaagtccttcctcagccagtcatttacatgtaaagagattaaacctggtcaaatggattaaagaaataacccaagtacattgcagtatacagggtgttcatgttagaaaaacaagtggacggaacaaatgaaaaccaagttctggctaagtattaatagaacttaggtggacatgtcagagagcactgtggcaaaagacagtgacactaaatgttaccatgacacacatctgagccccaggatgattggggggtggggtggcaaattgcacagaaggaaagggagaaatagatggttctctagtcagctggagcctttaaagtcctactttgaaaaacatgtagaaaaccagccacatgtggacacaagctacacagactgaa

SEQ ID NO: 28007 - DNA, 1205 bp, Mus musculus
cccggtgacagtaactttctctagataagagtagtagcttagctagtgtagctggctgagactggtgatcaccagcacgcctgggtatgggtataagcaagacactcggaattcaggtgcagctcacagtggggaccttctcgggtcaccttgtgtaggccagctggcttgattctcgagcgctgtgacccatcactccctacccctagctcccagcacaggctgtggtgagggctgaggcaaagggcagctgctgggacgggagcaggtggggggctctgtctcccttaggcttctactagaagcctggcctatttctcctcttctgtttctgcgtcctgtgcatgccctgtcttgctttctggtcctggctgtgtgatggagcccggcctgggtaatgtgtgatctctgctgctctctctctctctctctccccagaacacggctctagataaagaggggcagattttctgcagcaagctctgtcaagacagcagcagaccatccagggagcagacctcgccagtccctccctcagcccaggaggcccctcccccactggagtctcccaggccccctggtcctccagccacctctggctgtgatctggcagggacctggcgccgccaccgagactgaaccctgtgtacacaggccaaagccgctcaccgtgccaggcaggccgctcttcagcgggcctcatcaactccttgctgaaagagcctctctctcctggctgctgctttgacagtttgttggcatgttctgtcactgcctgagaacagaactggggcatcctggagcccgtgtgcagcatggcctcatgcactttgggctctgccctctctagttcctggccatgtcaagcaagccatgtcagttgtggagacatatttggagtgactcattttaaatcatctgtgtttttagttcagtagacacttggccgctttccccagagaatgtgcaacttttatctggaattacatcgtttttacagaaatgcattggacgaattaggattctccttattgaaggacactccaagtgctcccttctcaggacacagctatggttcctttgttctgtgagaggcaacatggcctcttcgtcttcatagggcgctgaggcacctggcttctgactaggagtgtcattctgacttgagagggtcatttgcctcctgactttgggaagtgcattct

SEQ ID NO: 28008 - DNA, 1178 bp, Mus musculus
tcccttccttccttcttccttccttcctttttttccttttccccccgagacagggtttctctgtatagccctggctatcctggaactcactctgtagaccaggctgtcctcaaactcagaaattcgcctgcctctgcctcccaagtgctgggattaaaggcgtgcgccaccactgcccagcagaattttctttccttgaggctaggagagatctccggggcactcctctggttgactccacctcacacctcccctcctccctggtgggagttttgaaatgctcaggttagacatcacctctgcctggagatagtcatttatttaaactggcatttcaagatttgttgggtttattgatttttgtgggtttctgattctaaccagcaaggtcaaaaggaacgtggtgatttggcattctacttaggaaatatgctgagggctttcctttagttttgcttagacctataaatgatagccttgcctttgattattttccaagagcgcaggaatcagtaggaagtgctgatgtttgctcagagtttgcgtttgtcctcggctgcaggtgtgaatggaaaccggtgctccgagtcgttcccccttctggagaaatacagaatagggaaggtcatcggggacggcaacttcgcggtagttaaggagtgcgtggacaggtgagtggctcgtgatctggtccctgtacagttctccctctggaattagaagtgcctcttcccccacttttttgggcagaaaacagttacatacataaaattgttttgtatgcagaggacctatcagaaatcacatcccaacctagagatgggtaaggaggaaaacgagccactgaaagaagactgccgccttctgtggcctttcccacgccaggctctgcgtggtgcacgctgtgaaccttcagagcaatgctctctctcacccagtgccaagctgctagacccatagctctggatgcaggagccatgactgtgagatgagatcagaagaagtcaactctttaaacaatacgatagtcattatgattgcagataaacttttttttgtgtatagaacgctaccctacctcttacctcttctgaatagctggtttttatagtttgtggcaggttttctagaatgttctggtaattgcagtttatccattctgttgcatctccaatgag

SEQ ID NO: 28009 - DNA, 1551 bp, Mus musculus
caaaatacaaaaaaaaaatatctgcaatataaacacttctggtctcaaagggtgtgtgtagggtcaaaggtctgagcccactactaggtttgaaaaacctatcaaagccccatcagtcactaagcatgaaatcccaccaatccctgggcttggcttgaaatttcaccaatttccatcccagaaatctccaccctggaaaactcctcccccaagaaatcctatataagcttcttcttcgggaaaacaccaaatggtggagtgggagggcccggaggacccaggggcccaggattaggaggccgcggcagattccgcggagaattcggcagcggtcttaggggccgcggtagaggccgcggggcttgtggaggtaaagctgaagacaaggagtgagtggatccccgtcaccaagctgggccgcctggttaaggacatgaagatcaagtccttggaggagatctacctgttctccctgcctattaagaagtctgagatcattgacttcttcctgggtgcgtccctaaagggttaggttctgaaaatcatgccagtgcagaagcagactccggctggccagcggaccaggttcaaggctttcgtcgctattggggactataatggtcacgttggtcttggtgttaagtgctccaaggaggttgccactgtcatctggggggccatcatcttggccaagctttccatcgtccctgtgcggagaggctactgggggaacaagattggcaagccccacactgttccatgcaaggtgactggccgctatggctctgtgctggtgcgtctcatccctgcccccagaggcactggcattgtctctgctcctgtgcccaagaagctcctgatgatggctggtatagatgactgctacacttcagccaaaggctgcactgccaccctgggcaactttgctaaggccacctttgacgccatctccaagacttacagctacctgacccccaacctctggaaagagactgtcttcaccaagtctccttatcaggaattcactgatcatcttgtgaaaacccacaccagagtctctgttcagaggacccaggctccagctgtggctactatataaggattttatacaagaaaaatgaaagaattaagtctgctaaaagaaagaaagaaagaaagaaagaaagaaagaaagaaagaaagaaagaaatcctatataagcctgtcttctgctcagtcccccgatgcttcctgactgagcagaggtagccaccctctcgtgtctctcccaataaacctcatgtgaggtttgttgtgcattgtgactttgtggtattctttgattcccaactgctagaatacctttcacctcagaactgtaacacttccatcagggaaacataacctccggagatataacatatactatatattcaacctatatctatctatattctagaaagtatcattgtgctcaacatatattacgtattcaataagtgtatttttttgcaagctaacaaaggggcaagagcagtctcagttatcacaataactcctgtcccttgtcaa

SEQ ID NO: 28010 - DNA, 1209 bp, Mus musculus
agcagcctcccaggcttccagggaagagttgactctctagagcctggcacccactaccttgcttaccatcggctctcccagagacatctggtatcaggcctccctagtttttatcttgttcttttgttttgttttgttttcagcagacctttctataacatgaaaaaagcttcccaaaggagttgtttatccctatgggtctcacaaaactcccaaactatgtaggaggagggaaagcattgtgtacctcaattttacaaccttctttctgaaaaaggcaactcacagaaagaactcaacagaatgattcccaggcctgaggaggcatctgggtaaagttattttaagagcttcatgcttcacgtttgggtgacccaaagtgtagacctgtttgctgctttggaggccactgccttccctgtggtcctggcattcctttctacataaggactgttggatgaattcctttagaaatctaggagttagttagctttatttagttccccagcaaggttataatgtaaagtatgtctctaggtaagacttgaagagttctggttgggttttcctgtagtttctgtctctctgctgttgctagattagtattgaacttaagagctgaaggctcttcccgcctcagcatcccgtgtgcccactagggcccttgttaaaaatggacagatgatgagccactctgcataaactaaggctttgtaaaacagctccctcatttcacacattttgctgcagtttggacatatacaccaaattgttcactgaactatagaaaagtattcagatgaaagccaaggtttgttgactttgcaagaataagaggaaagccaggtgtggcggcacacacctttacctgtgcacaggagactgaggtgggggatctctgagatgaaggcacattttgtatgcacatatttgtggaaagccaagaatacatagctagagcctgttaaatcaacaactgtagtgaaaacaaagcaaaataaaaagccagcaagtacacacacacacacacacacacacacacaaacacacacacacatatacacgaattaagggggggacgcaaagaaaatagtgagaacagcagccacaaaatttgggttctatgaacctttgagatcataacttttaattaagaagtaaagaaggatgaaaaaaaaacatacttgtaaaatatttctttttaaaaag

SEQ ID NO: 28011 - DNA, 1196 bp, Mus musculus
ctgccattattcttaacccctgaggcacatctccagccctagaagtggagattctgttggtatttggtcattagaagccagagttgtggtaaaggtcccaagattcactggcagctgtagtacagttctttgggctccacatagtgctgagattttaaagtcctggtaatggtgttattcaaaaagaagtaagtctgtgagtattgactttgtcagtagaccacaagctgaactttagtttagaccttacatgctacaagaacatctgtgtcatctaatgggcacataagctttgatgtactggatatgtcagcttgtcttcattgtgtgagggtcgagtgtggttaggtagtacagctttacaaatccttaaggaaagatgtcctaaattcctttgtcgatatttcagtgccaagcatcacgatttaatcataagtatttagtacttaaaagcaaccatggtgtaatggtcaccggaagccgttagcttggttgtcagctgatggggtttttttggaagtgattggaaaacccatgggcttctatctcatcagtggatttattggttgatgggcccacaatttgattggctgcttcgaggtgctggaagctagcacaagcaataatttcttgggcacatttctgtgaggtcatgtcctgctctcactcttatctctctgtcaccttttgttggcagaggtgaacagtcttctctactgtgtgcctcagccatctgtcttggctcaggtccagtacagcgaggccagccgatcattcactgagacccccgaaatcatgagcaaaaccaacctgcattcctttacgttgttcttgggtatattttggtacagggagaaaaaccaaatatacatggttttcaacatcattaaagttgggtatagctcagtaatgggccccaggttccatgcccagcactgcaaaagggaaaaagaaaaagataaatgaaaattcttagtgtgcaacccatgtatttataaacaagttgactagaataaatgatctgcaaagaggaatactggtcgttttataattttatttaagcacatggtgaaatttggttagttagaaccaaagctttgaacttttaaacagttgtatagaaaacaaggcctttcaaatattcttacagatagaatgcctttcttgtgataagtcacagtgggaaagtttttttt

SEQ ID NO: 28012 - DNA, 1145 bp, Mus musculus
gtcttggtcactgccctcattcacacaagtttgctctctctcccccttccccctctcccactcttttcttcccttctccctcttagaattccttagagcaaaaaacaagagtggagcaggcagagtatggtggttcacatctatattcctggtaccctggaagcagaggatggggatggcattgcaagtttgagttcagccgagtttatagagggactcggcctccctccctagaccaggtgttgtgaccagatgaagtgcttagagttagatgttttgctttgagatgggggggtacactttagcccaggctagcctggaacttgtgatcttcctgcctcaggcttataacagattcttaccttgtgggaggatcttcccctcgcatcaccatcttgaaaataggaaagctcatcaaagccccacactggggccgcagtgtgacttatcctgcatagtcatactgggcctttgttgaactgctgttttgtgctgcataattttagttggtaggaattagtggctgtgttgttttgaaaagacctttcctggttaagatagcctactggatacttggccacactgttagaataaagatggtgaaaaaagcaagtgacccttgtcctcttctagttttaaatgtttttccagaaaaaaaaaagcagtatatatttatgtttaacaaattgtcaagttcttgggtgtctaatacccttgttctttgaatcagaaatattttaacacgaggatttagttaaatatactttcattccataagacataatttttattttctaacgcatggtctggtcagccatgcccccactagcctatggcaggatgctcattacattgtattttgtcagaagctattaattaactttatacaaagaaggactgggaagatgctggtttggtgagatccattacctgctttggcttacaggcttacaattattaacatttcgagaaaacacactaaaatagcctagttgtagctgatagtgttgtcttttgattatgtttgttacattgcagatgattttaatttatcaccgtgtacttttgtgcagtctttctttggcttagagctggtcgtatatacttggctggctgggagccccaaggatctgcctgtcctctag

SEQ ID NO: 28013 - DNA, 1671 bp, Mus musculus
gaaaaagaatctgacatgggaaactgtgggcatacgaaagctatgaaggaacttaacccgcctagtcctatcctctcaatgaaccactagaagaatcacatctattattatcattatcattattttaatgtgatatttatagatatctgggaggatccaaacttgtaaatggagcacctgcagacagcccctgctagctagaccaaaacgtcccttctatttttccccttgcatttttaataccatcggagttgtaaccgaaatacaattttgtcttgctttcgatattgagacgatagtctcaacctcattctttagtataacggaaagacatttttgttgttgttgttttgttttgttttgttttgtttaaaagtggtttgcgtagcggttctgagtaaagctgcactccaaccctcaactaccagggggtttggctttgtcaaagagtaatttaccaatcgtgcctgcgcgtccttccgggttttgctggctctgcaccaaaaaccccagagcctttgtgtaccagtccgggagcagagtaaagcgcagaagtcggagccgagggctgtgtagaactctggcgctatgcggtacctaccatggctgttgctgtgggcattcctacaggtctggggacaatctgaaggtgagtgagtaaaagcgcacacaatctagagaagggaggaagggagggagaaagaggctggctacaagctctgtgcagtagtgggcgggtggaggtgggcttcccggcttgcaacaacagtgggaggagcaatgtatggctgcggctcagggcttagctcagttcagaactacactgagcctgcctttccttccgcaagcgcagctaaagctgagctttttcctactgcagtctgtcctcagactgagcccactcgctaagttctttccttttcctttgtttccagcccagcaaaagaattacaccttccgctgcctgcagatgtcttcctttgcaaacagaagctggtcccgcacagacagcgtggtctggctgggggatctgcagactcaccgttggagtaatgactcagccaccatcagcttcacgaagccatggtcccagggcaagttgagtaaccagcagtgggagaagttgcagcatatgtttcaagtctatcgagtcagctttaccagggacatacaggaattagtcaaaatgatgtcacctaaagaagactgtgagtggaggggttggaaccctgaacccagtgggcaggagtgatccagaccccagctggataactgtgggcatcgggcatagcttctcttctctgtccacccttatggttttacttctgtctaaaagtaacccttgtcccttctaaaaatagcccatttctgctctagggcaccatgatcattttcctcaactggcacttaacgataatcttcataccaattcctttcttccaaatcccttaatcatgaactctttggtctctgcctactcctccttacagatcccattgagatccagctgtctgcgggctgtgaaatgtaccctgggaatgcttcggaaagctttttacacgtagcatttcaaggaaaatatgtcgtgagattctggggaacgtcctggcagacagtcccaggggccccatcttggttagacttgcccatcaaagtgctcaacgctgatca

SEQ ID NO: 28014 - DNA, 2347 bp, Mus musculus
agtggggcggtgggtttgcagtgtaggtccttgtgaatatggattcatacaggctttcatgttctctgacctctgaagccgtgggtgagccaaacacttctgaagtctaaatagagtggcattttatactccctaaagtcatcatcttgtgtggggtttggcttgattctcttgtttctctctgatttaagtagtaggtccctcctatggaaataagagcagcactaaggagaactctgagagtcaagcgcacagccatgcgagggacaggaaacagcaactgagacagactcctgccactcacactccgcaatcagaatcagagttgggccctgctgaatgaccagtgttgcttgtcgggggagttgaaagtcccttaatcacgaggctcttccgtctgaagctagcatcttccagcatgttggtactttgagtctaagcaccctgggtgctgttgctttagttgaaagaataagaaaccaagagtcgagagatccaggatcccattctgcggctgctgtttgctgagtaaccctggtctgacctccttattttccgtgcttccatcttctggtctttccctaaacctattctctgttggctgtgttcatctggggcaggagattgcccattcctcgggaacagtgagcagtctcggtgaggcttggggcagggaggcacagcctgctagaaggagctttaaccaccaacttcttgatcttgtctgtcaccctacccctgagtgaaatgaagttattggtgttgctctcatcttagattcagtaggctgctgtgatcacggtagggctcggtcatggatgcggtctgcggcagcacatacagactgggagaggcagagaaactgtcttctacttcagtcttcaggaacagtcatctggcctaaagactgctctccctgttcccccaacaaggtgaagcctacatcccccccgcccgtgcccccctccctgcagtcttgaatcagaaagcaggagagagagcagctgaccccgccctgtagactgaaaggggtgttcctagcaggaagaaggggttagtggtttttatataaatgctgcatatgttaaaggttcttgtggctctggataggccttgccctttgtagagaacccagcctgcttgctgaatcctggtccccaccccatccccaccactgccaaagtctaactacagactatgcatgaagcaggaaagagagaggaaagctcgcaggagcaggggcaatgctcagctttcacaaatgtctgggtcagaacgaaaaacatgagctcaactaatgtgattctgggtgagacaagacacagtgacccgtgtcttcccccttgtgctctgtcaggagccatagctcctgggatccttaagatagaagtgggtgacccgtgtacacttggccccctgcatagcaatgttaggcaattgggatttatagaaactcacgttaaagccaaagaccgtgtttgggcatgtaacgtctactggcttagtcactgcctcatcctgctgtgtgagcagctctgttcctctgggtgaattgcatgaactcccaaggccactgcaggctcaaaacacctgctttccctactattccatttctgtggaacccgaggccaggcgctacacccattgagccaagcgctgacggtaatacaatcctggggacacagacctcaagactccactgggggtgcattgactgttatggaaggactctaaagttgtcacctaaacaccacattcccttctcgctgcgatttttctttctcctctcctaaagacagtacattctgaccagtgctggctgaccttcctcagctgctgacaccacccgtgggccagtaaagaggactgaggtctgtggcttgttgtatggatttgagaggagggtgcaacattcagttttccagcatcactgtgagggaacctttcccaagggaatgtaattttttgcacagaagacagaggccacactaggaagtcctggtgcaaacctgctcttaacaaaagtaatgattctgtgtgcacagaactccccttaccagccctgtttgtaaaaccatcttaggcttttaatgttcacaaccactggcctttgcgaactggtggccagactgttccattggtttcaggagctgtccatcgcccctgggaataccaggatggaagggggcggggaaagaggggagcattcagtttgctgatacaatcaatacataggcttcttagcaaaagtgacccacaaggcctccacttttaacaaggtgcccaggtcagactgccaaccccagtcattcctcggattgttatctccatctgatgcctgttgaat

SEQ ID NO: 28015 - DNA, 1118 bp, Mus musculus
tatccatctgcctgagtggagagggcttcataaatccccaggaacacggtttcctttcttctcagctttgtgctggaccagccagatgtgtcctggatgtgagcaaggaggggtcagggccaggctctggttgataggccaaggaccatggtgtagtgcatggcagttcccagatccaccactagtgggagccacacaagcttctctccggtatctgtcccacttcttggtgttaactcttgagccttggagagttggggggaacagaggctaacttttcctggggctatttttcaaaagcaataaaacctcatttggaaagaaaagctgtaggggtttcccccactatacacaagtcccgtggaaaagagagggtcacctgccctctgccagactcctaagtccttgtattactatatccaagtctctaagcactttgaatctagcatatacatccaaatggtgagacctgcctgctggtggattctgataagagttaagcagtatcccgagtctcagactcagctatcctaccctgtctatcacagctagaaactaccttgcagatggcgtggtagatactttatccagacaaattttggttttgtctcctcctcactgccccccaccccacccctgaccaatcagattccttcttccattttcagtgccttgagtgtcaggtttgtgatgatgtccctgtgtggggagcagggaccttgtgagcttgagcttgtcccatgttagcatccaaggagagacaagtgagaggacatgaggggatgggggcctggaaatggtggcgaaggaaacgtcttactgacctagatggagatcttagtgtagaacaacacaaacggcactgaattccatgggccatgctatcttttcccacacagcatgcacacatgagcacacacacattccgtgccacatctcatctaccaccttctgaccaaagagaatctgtaactcgtagctcagcctcatcttcccaagaaaacaactgcccaacaggagcctactgtccatgtccccgctgagacctgcgcgatgggagggagtagtcccagaatgctccttgctttttctcattggtcaccattcgttagtcatgt

SEQ ID NO: 28016 - DNA, 1177 bp, Mus musculus
gattgagagggaagctctataatcagtgtctggatccagctagtaaccccagaaagagaaagccaaaggcagagtccttgggtgtcttctcagctaagggaagtgggggcacgagagaggagcgttgggcctcagtgggccgtgcacatagagcagacacagctttgcaggcaaggacacgggagtggaggctgaaacggagatcacagactggaggttggagacagccctgcttacgaaggagggacccagctcatgggaaggtatgccaagtagaggaagagagagctctgaggcaaactgagggcagggatggaacactggctgccctgacggcaactctggttaaactacagcacagattacaaaccagactcagcccagctcttctcaaatgtggcctagacgtagatgtcaacacggcccagcccaggcaaaacttacctttgtacacaatccagagttgccccagtaggttatggtcacatctttgggcccctatgtggctccatcctcattcctgttcctttccctcccttctatagaggtgttacctgtgggcatcattgccggggccaccatcggtgccggcatcctggtcgtcttctcttttgctgccttagtgttcttcctctaccgacgtcgcaaaggcagtgagtataggcgccgtagagtcacaacacacccttcatcccccaaccgtacccttcaaggtctcgtcagggggctggggctagaagtcaaccgtgcagaccagtagaaagcccccagcaacatctccctgtcctaggtcgaaaggatgtgacgttgaggaagctggacatcaaggtggagacggtgaatcgggagccacttacgatgcactctgaccgggaggatgatactgccagcatttccacggcaacgcgggtcatgaaggccatctactcggtgaggataatgctcctttcaacgtggcctaggctcttcattgtcctacggccagccccaccagcttttaatgatttccgttacctctaattcctctgtgcatttaacctgttcctgataccccagttcctatgtaccaacctgctctcaaataaacgcacccacactggtaccctagtgcacacttacttgtatagacgttcacacacatatgcataactactttctcccccctgcctacccacaa

SEQ ID NO: 28017 - DNA, 1165 bp, Mus musculus
agtggagtgtcagagcagctgctctacagtaagtgtacacacacacacacacacacacacacacacacacacacacacacacacacacaattgggaagaatagcaaccttgttgagttaacatccctgtcctggggggttagattatccatttgtcgagtctctgtaatgaatgttcagtacacagtctggtttgtcctccagctcagcaatttatgctgtcatgtaacatgtactctgagaagatgaaaaccgtgtatgtatgtatgtgtgtgtgtgtgtgtgtgtgtgtgtgtgtgtgtgtgtgtgctatcttccctataggataatagttgctgctaaaaattctccaccacgagttccagcgccaatcagaactgacctcagtgtggcccacacccctgctggtgtggcgtgatagacggtagatgactgagatccgtgtttcattacagctgatgatagggctgcctcgagagcggaggaattgtgggtctgaggaggaagaagcagcagcccatatccgctgtgattcttgctgtcgctacccattctgggacatgggctgagcctagaaggttgtggacccaacctcaacagcctaaaaatgaccagtgtgggctgccatctcaatcaaagcctcaatcattgggtcagaaacgctgtgtcccagagctgtccgttttgggaatgagaaatatgagatattttcattcttccaactgtgtccccattctcggtgaccacgacccagggttcactgagagagcagaagccacccgactggctccgtgctgtgcactttcctcttggctgcttcactcctctggttttgactctccaggtaccctgcatcttcgttttcttcctgagtctgctcttaactttgtaaaaactatctaacctcctcgggcctccaacagtcctaacatgacaaacttgggctgggcaaaacttttttctttacttttattttttcttttctttctttttttttgggggggggtgtggcaaggtcttactatgtggctttgactagcctggacctccatattgtggccaggctgcccttcgatctcacatagacctgactgcctctgcgtccctgctggatttaaaggtgatgagcagtagtcgctgaagctcctcttacctgtaacttgttt

SEQ ID NO: 28018 - DNA, 1147 bp, Mus musculus
gagccaaggactccccaggatcgaaccttccttctgcctgaggattttgatttgtaagaacaaaggcagtttgtggaaaacaccctttcctcaagtctcccaacctcttgtgtccactttcctctccccagcccccgctcctgcccagcagagctgatttctaaattaactttctcctaatcagctcagctgaggttttattattattccccctccccgaattctccatgcacagcctggggccctatgtgctccattacccaacattgccccaccatgaggcccttttaactgtttcttcccacattctgttcatttaactgggagcttattatagggaaggaagagatggccagagggactgaaaacagagtggagcaggagaaggcattttctaagcaatgaaaacccagagctgggcatgctggctgctcttagaaaaatggaagttttcttcttcttcatttttaagcaaccgaggacttcctgcctagaccatgggatgcttcctctatgacctccagccccaggatcttacccactgctctgtggatctgtcccacctcacctcccaactccttcaggaaatctgccacctggactgcattgtgggatggggtccccagtgtccccacaaaggcccctcccctccatgctcactgtggctatgctgacaaagtaggcaccattcagtgccagcactggctactttgtggatgatgctggccttgatgcgcctctctccctacaaacacctggggacatcactcatccctggtcagttagtggagtgagcgtgcaatctcattttaatgctagtatgagccagagataactagaagggaatactcacctctgcaaactattatgatgcctggcccaggcaagtgggaatgacttttggactgtctgtaccactcttgtgctctgtttatgcagcgcacggagaaattggtaatatttgcataagagggttttgcacacactttcaatttcactcctgggtcatgatgtaacacagcttactctgtaaaaacaggtaaccgagagtctcctaggataccaccacttaaccaggggactataggagtattaagccttttttgccagagttgggcactgtgtgccccttagagccttggcttgc

SEQ ID NO: 28019 - DNA, 1148 bp, Mus musculus
ggcgaaagggggctaaaagccgggcctacttcctctccctgggttttttcttccctctaaattttgttgtgccaaatgtgtaaaactttgtaggtgtaaatctattgcaatctcactaatcaagagcttgtttatttaaacagtttgcttttttagctgtaaagagtagcagactctcggggcatcagctctgctgtgctcgcgggtcttcctagacatcaggctgcacttctaaccccagctcgggaatgcagggaaccctagtgacccataggccaagaaacttccagaagcattaaaaaaaaaaaagttatattccactaccaagtggatagtcatttagctgtttgtcccttgtttttttatttattccataattatgtttgtgctttttcttgtgtgaacagtagtggtgaggcctatgtttttatgtggctttagagaaaacttcagtcttcaaagaactcttctaattagttccttcttagaaaaagttatgcgttaatttgtttcaaaatatttaggcattctttgaattataaacttgtgatgcagggatttatgaatgagacgttcacatgtgaagatgacttcactaagcatctgtgtaagcagaataagatgtgtatatgtacataaactataaggaacctgaacaccattgtgcagtgccttttagatgttctgctttctaaagtcttcaaattttttgcatatatattatatatatgatgtaatgttatagaaatatatgtataatatacatattttttccaggggtatctgatagctctgtattttgttatggaagtcgaaagaaaaaaagtattttacctcgaaaattaaagttaaatttaaaaacaaagagtacttaaatgtttgctgagtattgattttgttgtcccttgcacactgagccaaagtctgcaggcctgcaggggcccagcagagtgaggggtgggtctctcgacagtgtggaagtttccgtgagtgagagagagtgagtgagtgagagagtgagtgagagagtgagtgagagagtgagtgagtgagtgaagggtactgaaccccgaaacaggagtagggaggaatgcctgcatactgactgtcgtgaggattatttaagccacgtggtcgcctgtgtggaa

SEQ ID NO: 28020 - DNA, 1164 bp, Mus musculus
tcctcctgttagcccaagtctccgtggctttcgtctcctaagcatgctgaccacaatagaaaggcctccaccccacatagccagtgtggggtgtgctatgtgcacagtgcccttgaggaggcttatgtataaatgcactttcttcctcctcttcttcctaggccccgagacagctagatgcctggctctcctctttgccctttagtttcctataaatatgtctattgtatgtgtatctttgccattgtaaataacttagccttttattctgtccctggcatgttcaaccagtcacagagagccaggcagcagccccgcacagggccatgattgtttatgtcccactggcagggaggtctcccagattccagtgctgtcaagctccagggcctgcccacctctgaagcctaggccttctcagtgtcaggaaatgctcctgcagggagtgtcttacccagcccttccccacttgccccatagaaacaatacaccaggtacggatctcaacacagactctcaagagagatgtggagtggattgctggagtccctgagttaagtcagggcccttccttccccaggggccacagcaccgttggctcatcaccctgtcctcacgccactccctacaatgaacatacacactgtgctaggtgtatatatacatatatataaatatatataatatataaaatatagatatggaaatgactgttttactgttaaaataatgtatactcttattttcttcctttcatggttaagatttttttaaagaaaagttaaatattcttccattgtggttgtatgattcttagcctgatagagggtgtgaggctgccggtgtgaccggtcaaaaatgggtagagggagacaagaaagcccctgccacagccatcctgcaccaggtctttccacctgtcccaaagtgccggtgtgtagaccttctcagcagaggttggacaactggctctggcccagaaaaggacattgtggttacgtcacacgaaggaacagggctgctgtgacctactctcagatgcaaaccatgaagagggttaccacactgccctccttcccacagaccaggaagagccatggcagctgagccatgccttagaggacctgggacataactggaaaagccatggtgcaccttaacaca

SEQ ID NO: 28021 - DNA, 1134 bp, Mus musculus
gttcacccatcccactggctcaattttctgctggctcttgccatctatgccctgtgtttgacatatggttgggggggggtctatggggctcaggctgtatgtgtactgggttggggcagggctgttctagaggcagcagctacttgttggtggctgagctggtgtcaaacacagagcgtctgggggctcggctctgtcaggagcaggggagttgctttggtaccaggagccagatcaagagaggccctggcactttcctcccctcgcctaccgtcttgctctagcactactctgcccctcttgccagtgaggagcctggcactattgaagctagtctggacaaggatggagatgctgcccgggttatgatactccatgtaggtgtgtctcttccccaggccctgctgtattagctccagaggatgggctggccatgtccctacacttcatgacactgggtggcagttctctttcccctactgagggcaaaggctccggactccagggccacatcatggagaacccacagtacttcagtgatacctgtgaggaactgttatagtaggcgagtgtgagcatggggtgtgtgtgtgtgtgtgtgtgtgtgtgtgtgtgtgaagtccctgccccaggcctctccccatcctatctcaaagtctagcctgtctcctatcttcaatcctgtacctcccacgctggactctctctggtcagatgctccttcccacccccaccccatatcttgggtctgcactgcccttaccactgccccatcctgcccaagcgaggcctgccttctgactttgcaagcccctccctcccaggtgtccatcacatcaagcgccaggacatcattctcaagtgggagctaggggagggagcctttggaaaggtctttctcgctgagtgctacaaccttctgaatgatcaggacaagatgctcgtggctgtcaaggtgagactatggtcctggtagggactgctggcctctgtccctcagaccaccatcatgtcaggatggggatagttgaatggaacaaaatgagatggtgttggggtcccctccagttctgtccccatcctgacccccaggcactgaaggaggcatccgagaatgctcggcaggactttcag

SEQ ID NO: 28022 - DNA, 1173 bp, Mus musculus
cgtacacacacatatacatatacaatatatgtatacatatgtacatatatgtatatatgcatcatgtgtgcctgatggctgctgaggtcagaaaaaggtattggattccctggagctgtagttactagaggttgtgggctgcaatatatgtgctgggaactaaatcctgattgcctggaagatgaatagtgctcttgatcactgaataatttctctgaactcaagacttaggtttttaagaagggctaatgtgagattgagggcacgaactgtatttactgaagattcggagttcaggtaggatccgtgtcagataatcatggaacgagactgggcagagccgagccaagatggcctttcattgtggaaagaacatctatataagtcctggaataggagggcctaagtgcgtgatgtaacagagcatcaagggccgagggcctcagagaagtgtagaactatgatcttgtttgtcatattgctgctgtataacgtgaagtctcacttgtctttctttcctctcattccaaacttgggctcactagggatccggcgaggggactggtttgtctgccttgctcccccaacctaaaaacctgactgtgaaagagactaacaggttgctcctgccccatgccttctcccggaaaccttcagatatctcctcagatgctaagccctctagattggcttctaagaccaagcccgcctcacttgctcctgttttgggtaccacaaccaccactccatcaccctctgccatcaaggctgctgccaagagtgctgccctgcaggtgaccaagcagataacacaggaggatgacgacagtgacgaggaagttgctcctgagaactttttctccctccctgacaaggctgagccacctggagttgagccatacccttaccctgtccccactgtccctgaagagctgcctccaggcacagaaccagaaccagctttccaggacgatgcagccaatgccccccttgagtttaagatggcggcagggtcaagtggagctccctggatgccgaagcctggggatgactacagctacaatcagttttccacatatggcgatgccaatgctgctggtgcttattatcaggtaggtaaggacagagtgggcagcccaggaatattggaacatggtgctgaaggagagtttg

SEQ ID NO: 28023 - DNA, 2074 bp, Mus musculus
gagggagaggaagaggctgccaaggaagaggctgaagcccagggcgtcagagatcatgagaggtgagctagcttccctggcagtgggctgggagggcctagctactaacagagaggaggaggaggaggtggagaagaggacgtagagaatggcctgcagtggtcagccttattggaggctgggtgggctctccctaaagacctgcactggctggggtaaggccgggccaggatcacaccattaacccttctcccctcccaccctcccctgcagcctgtagccaccaatgtttcaagaggagcccctgccccgttcctgctgctgtctgggtgctactggggaaactggccatggcctgcaaactgggaaccctttcccaccctatttaccctactccctcactcactctctcctctaagcccactcctggagagtgtcttggccctcacctccagctcccttcctacatacaccctgtgccccaggatgagatgaggccttgtatctctttacacttgtttcccagggtttctgctggggtctaggctgctgtttccacctcttgacacctctgccctgctgcaggcattctagacctttggggtggatagtgggcaggagtggaggtgaaagaatataaaggagtgtgggttcatggatggcatcgtctacctgagctcctgtctccagcccccacacttattttcccatctgcctacattcaagaaacaggacactgtgggagagaggctaccatccatccataaatccttgttgatttttgggaacacttatccccctgaccccagggttcaaggaattgtagtttaacatctagactttggagtttccaagtttgggcctaggacctggagggagctaagagctgaagaatcaactgatttgcattgaggaaatgtctctttagatctcagggcagaaatgataacctggggagacctgctgccttcatctacttcccaatgcttgaggccagcctgtagtcagatatttcacccagacataaaggaaaagaccattttttttttaggaaatgtttttaataaaagaaaattaccaaaaaagaaaaaaaaaacccaacccacaaaagaagaaaaaaaggaaaaaagttgccccgcccctttgtgtgttcctctctctgctcctttctccccactgctgacccgttttttgaggtgcgctaggagggaggctcgcctctgaccgggttggctttctctttggacatggggctttgatgttcttccagagttggtctctggtgttttctcacatccagtttgtagcccactaagaatacagggaaaagtgtcctccagcctcttctagtggtttcttacatgcccctcttccttgtcttttactcccatctctcctctgggctctgaagaaaaattgctgactgtagctttggaagtgtagctctgagaataatagaaaattttgagttctaggaaaataaagccgctgattactatcctgattctgactaattcttttcaagtgtctgggttaactgaagaaagggaaagagacaatctctagatgtcttcctcagattgggggcagagacctcagcctccattccctcaccaggcctacaaagcccacatcatccagtctacccttgcaagcatcttggagattctaaaatatttttatacattttaagctatgttttataagtattttgtccacatatatgtgcaccacatgcaagcctggtacctgaggaggtcagaagaggccattaggacccctggaactggaggttttaagttcttgtatgggttttggcaagtcaagcccaagccatgcaagaacagcaactgatctgttgagccttttaaccagcaaatagtctaacatattttaagccaggtatggtagcactaatctctacttccagcaatgggaaggcagaggatcgcaagctcagtgcctgcttgggctattatacaaaatggccatgctgaacactttactcccactccagccatgcacgcacatgcgtgcacacacacacacacacacacacacacaccacttgcag

SEQ ID NO: 28024 - DNA, 1232 bp, Mus musculus
cagcaaactcaggaatgaaaggaaacatacttagtctaatcagagcaggaaggtgagtggagtcaaatagcgagctgataaaagagatctggtctctgctaaattttggtagggatgcctgccagtccacggatggtgagaggacaggtgaacatggtcgaaatcttccagtacatttcacacgagtgattgctaatataatatcactcttttctctgaaaaggcggggcatttttttttaatatgccgcgtcctggtccctcaagcagagaagagccaggacataaaggtgatctcatctggaaatggacaccctttgctttgaattaggaagccataactaccaagaaaatggagccatgttctctgtgaactacaactcccagtggtctccacgaagagcgcgaacgaacttacgcagcaaattagcatgtctttcgccttcaattcccgacatgcctttcccagtctggatttcctacggttggctaaatttcctgtttcctgtccattttgtagcaacggactagagttcccagacgctgggaggctcgcttcggttttgttttgttttgagccttcctttccgcaatttgactacatctcccaaaaatccggtgggtggggactgcggacgtagagaacgcacgtggaaagaaagttgcggggaggtgaggctactcagcgacggggaaggtcggaaggtggataagcgaagggacttcttttcctagttttaaactgagccttgggctcctcttttgctaggacgttggagctatccgcatatcggggtgagtctgacgagggaattacttgaggcggtgacctgaggacttgtactgagaagaaagccagccccaccacggaagtgacactagctagcatctaggttgtgtagggaaccaaagggaaagatggagtgggggcctgtccggggcctaaaggagtttttaaaacaaacaagcaagaccccccccccccacacacacacacatacacacttgtgatgctgcatgctaagagagggcaaggttttcctggatcttgctgttagcatcccttactgagttctcagttttcgacttgtcaggtagtagttagtgcttagtaatcgtgtatttgatctagatagaaatagtccccgtgtttctctagcatcatggtaacacttgactttgctcccatctcttatcctgaaatgtataaaaaaaggagtaatagttcactta

SEQ ID NO: 28025 - DNA, 1193 bp, Mus musculus
caaagtcatgaaccataactgtttacttctttagagtgctaaccacatgtcacagggtgcttgtgccagtcagccttgactttgaggaagcaaggcacaccagggaaaacagtgtcccacactaccttctctatgggacacatgtcatagatatgtctccttttggtggggagtagggtaaaggaattgagttgccagggctggcctcaaacacttgggctcagatgacttcttcctcaggcccgagagtagctgggactacaggtgtgtgttcaccactgtgcctagttcttttattttttttattttttttggtttttcgagacagggtttctctgtatggccctggctgtcctggaactcactctgtagaccacgctggcctcaaactcagaaatccccctgcctctgcctcccgagtgctgggatcaaaggtgttgcgccaccacgcccagcatggttcttttaattttatgggattttttgttctaaagtaaatagcagtatcttttcactttcagacaagtcctgattggagctcagcataatggtctgtaatctcaggactctggaggccaaggcagggagatcaaaagtttaagaccaatctgagtgcatagaaaaagctctgggtcagagaagtagaaacagagaaggaaagaattttgtggttgcttgctgaattttatagccacgttacatagcactgactaacagtgtttacttaatttaggttccacttagtttaaaaagaatttgtatagttttaatcgtctttcagccttttcagcctttcaccttgcaaatgcagcctcttagttcatacgattctttttatggatttttataatagaaaactggtgggtttgttttttgtttttttttacatataaagatctatttttattttacttatgtgtatgtgtgtgctttcagggtccaggagaggggtcagatcctgcagaactaaagcttcaggccgttgtgagtctgggaagtgggtgctggcggggaggcggagatcctctaggaggagccacctctccagctcacgtagtggattctttatggctttgtattaaataagatctcttcgtgtggaaggctgtgtagtcctgtggggatttctaggctctctggatgggtcactggagcccttgtttgctggatgatttgaagctctggtaagcctt

SEQ ID NO: 28026 - DNA, 1359 bp, Mus musculus
tctctagggtgactccctgtgcccttcactatgcagttgtcaatcagaaggtgcccaacacatgctctctccccaccagaaggttcctagcaaccatagtgaaggaaggcagtgtgagccaccgcagaccaccagcccctctctgtgtcaaggcttctcagctccctgaagcgcattccaaaggcctggggcaccctccccctcatattgcacagatgtgaccaacagctgagaaaacagcctcttgcctggcccagacagaagtcccgacgtgaccacctgcccactcttcttgggggagaaggattccagaacaagtgggaagtggaggaacccagcctgctatgaggagccgggggcagtggtggcccagctgctttccttccaagccttctcgaggcgactcttgataaattgctttttccttctgtttccactttgcctcctcttccgctgtgtaacccatctcctctcctttatcccatctcctcccgtgggagctaggttctcaatagcatgtgttaccatttaaccagcatcctaagaagaagcctggtctatctaggagaggcctggagtgtttcctgtgcttgtccgggggtccagcacagtgctccagacagggagaacgcaggtagaggaacaggactctgccctacaaagatgtgagcagtgaagagagtcatggcccagagcagaggcccctcccactcactctgccggcttgctttgcagctggctgtggaagccctggagcaggagaagcagggtctacagagtcagatcgctcagatcctggaaggtgggcagcaactggcacacctcaagatgtcccttagtctggaagtggctacatacaggtacacagtactgactgtctccttggctgaagggccccgaaacttgaccctgtaaaactgttctatttacgtgtatttgtgtataggccccatgtgtccaggtgtcttaagagcccagaagacactgggtcccttgcagctggagttataggctgtgagcagctccacactggtgctgtgagccacacccctgttctctgcaagggcagcaagcactcttaaccactgagccatctgtccagccctcagatccacttaaaactttttattacatgtatttatgtaatgtttttgtctgtgatggaggcttatgagtcccagagatcaaagaggttgtctggcttggcagcttggtaggcataaacttgagcccacctgctcccaggttcgggactagaagagatggttatgcttaaagagacaactcagtcttcagggaggagaccagagggtacagtcacctgctctcgagttctttgaaaggcaggcaatctccagt

SEQ ID NO: 28027 - DNA, 1148 bp, Mus musculus
acaggcctccctaggtgacagcagctcctgacatcctttccccttccctcacgctcccagcccatgatggtggacgagctgtatgagctggtggtggacgccatcttcggcttcagtttcaagggtgacgttcgggagccattccacagcatcctgagtgtcttgagtggactcactgtgcccattgctagcatcgacattccctcaggtgctgagactcaggtggctgggagactcgtgctcaaacctggctaaggctggtacccaggggactgtcccacattagggctggggagcaaagttcatgctgcctggccctgtggaaaaccagagcccgatagtacatgggactgagggctttccctcttccttaggaccaggccacctgtatgtccttatactactttctctcttcaggatgggatgtagagaagggaaaccctagcggaatccaaccagacttactcatctcactgacggcacccaagaagtctgcaactcactttactggccgatatcattaccttgggggtcgctttgtaccacctgctctagagaagaagtaccagctgaacctgccatcttaccctgacacagagtgtgtctaccgtctacagtaagggaggtgggtaggcaggattctcaataaagacttggtactttctgtcttgaaattggagtcttctggccttaataattatcagtgggttgtgctgtctctggggaaacagaccagcatttgtaagcaatgggaaataggtgtttcacccaggaatgattcttacttatttgtaatagacagggaggtagatgatgcctctaaactaattcagtgtatcattgtagcaagacccccagagggtaacaggattccttcaagtctccaaatgccatctactttgtgttcagaccttctcatgctgggaatgctgacatcaactgggaaggacctagaagcttggggtccaagctctcatttcatcatgatcagaacagtctgggagggtaacccaacccatacatataaatgtatgtttttcttaaccttcatggtatttaaaatgaaaacattttgtagggtatgatagtgtatgcttctgatctgagcactcttgaggcaaagatgcctggatttctgtgagttctag

SEQ ID NO: 28028 - DNA, 1230 bp, Mus musculus
actgagcagttttgggtatttacgttcataagcgtgctcgtgagcacgtgtgtgtgtgtgtgtgtgtgtgtgtgtgtgtgtgtgtgccttgcaaatgaaggaacagcaggatgaagccatgacttggacgtgaatgagtcagaacaagggcccatcaggagcagctcgtgcaagccacttagtgccagcatgggaggctacttggttctattcacaggcaggcattacagttggccgaatcatagaatgggcctggccagatcccgggtcctcagtgtcacctcttcacgccctctcttcccggacccttctttgcctccatttctggcctctgtggctgtgtttgctgtaatcttcctcttgtctccactgtgacttccgctgcagcgtgccctctgtggagctgccacagctatagagacttgtatggtattttattccttctgtggctcttggctggctattcccatgcactggagtgactggagggcaactgctaagtgctctccacctctgggtctccatcgtcattttacacacctgtggtcaaggtgtggaggttagtacatcccaatgtcctaataccttctgtccttcccagtctcttcctcttccggctgggattggctccacagatccatgacctgtatgggaaagtgaaattcacaggtaagccagctcctttcctttgtccatagactaagcaggggcttgggggttctaggcctaatgaagagcatccctggcgtcattgcagctgaggaactcggcaacatcgcctctgaactggccaaatatggcctccagttaccggccttcagcaagatcgggggcatcctggccaatgagttttcagccgatgaggctgcaggtagggctggactctgcccctgggtaggatgtgggagcatggggcagcatggaggggagggggcgccactgcaagcttcatagcccttgggagggatctggcacctcatccacaggcaagggggtcaagctccctggtgcttcggccaactgtgctctggtctgggtcccttctggcttcttgaccttgctgtgttacccctccaagtccatgcagctattctggccatcaatgatgccgtggagcgaggggtggtagaggacactctggtcaccttgcagaatcccaatgctctcctggggaatcttcgagaacctctggcagctgtctaccaagagctgctggccctagccaagatg

SEQ ID NO: 28029 - DNA, 1760 bp, Mus musculus
catctctccagccctacctgttgtttgtttctttatttttgagaaagggtcttattttatagcccaggccggcctggaattcataactatcctgccacgttctccccatgtgtgccggagttccaggtgtgtgccaccatggcttgatctggagccgtgatttttcagtacagattctccggtgtttgccttgagtaagaaacccgctttcaagtcctggctccacttggcctgacattggctcaaatccctgggcctgtttttctcatttgcaaagtgggctttgaacgccccgcttcagtgcccggtgctctggcaggtgtaaggctgtgtgacactagcatctcacgggctggccgagccactcccagaagctcttaactccccctccctgtctcttccctcctaggacctcttgcagctgcagtatgagggtgtggctgtcatgaaactctttaacaaagccaaagtcaacgtcaatctcctcatcttcctgctcaacaagaagttccttcggaagtgacggatgcaggcggaactgaggcctctcagctgactggctgctgcgcttctccattacccagctcttttctccgaagaccagagctcgggccacaatgcttgaccctcccgcccaagaggaattgtcctacttggctgaagtgggccatgctccaggtccggccgggtggcttttaccacatccccgggaaccaggagcctgcactcagtcctgcaaagaaccatggttttgtgtcgctactgctctcgtgtggtcaccacggtgtccgccagtcgtcctagcactgcccagcagccttatctcccttcctttccacgggcttccaaagcccgggccaggctgtctgcccaactccgcttcataagccatgggtgtcgctgtcccctacagcccaggtccctctgtgctgtgcccctcagccacctctatcatcctgtcctagccttgacttggtgcagcacttgctgatgtccatgacagctgagtgcacacctcaaatctcctttccccacttgtggtggttcttatgtgggtcactggggtatttattctaacctgattgttgtgtggccttaatcatggttttaattctcactttctgaactcagagttcttgtcttgccatcttctcgtcacctcagagctgacttccaggtggttctcatagacctgtaggccagccttggccatctctgtcctccccacatctcccatcttcctgcctcactgccctctagatttcctcttaataaaatgttatttcctatgttaacccctgcgttgttgctatagtacagccatcaggttctggggtgcagcttgtgagaattcggagatgcatccttcagcagcctctccccgccatgggcacaggcccactatgtctgcctgcccaggcttgcacacattggggaagtggcgtctctttctctctttccaccacaggggacagagggacagagagggagaggaggaaggcatgctcaggattgattcagttagccggccactctaacagctaaggctgagaagagcccagtaccggctcctcctcccccccaccccacctcccacatacacattgtacacagctccagtctgtgccgtgcctaagcctggacattccacatgagccacagctccttctgtcccctttccatggagaaagtttccctgctttcgggaatctaccggggcctgtgggggatgggacgatgatggacacctggctgaccct

SEQ ID NO: 28030 - DNA, 2085 bp, Mus musculus
ccttgggagagggttgggtgcatcctataggccacattgcccctcacaccaccttctccatctcctttcttcacagacattaaagtgatggttcccactccctcctttcagcctccctgatgaagagttgacaatctcaccgcccaccccctccttatcctgggctcctcccgctcgaccccacttcctttcttctgctccatgtcctgttgatggttacatttgtgtataattatattattattattgttattattattattatatttttaaattcgaattctcgctttagagagagggatgctcttgcccctttcttgcccccaccattttcactgatggggactctctttattgcgggaaaggggggacactttgcacgttgtacacatatgctgcaggaaggagggaggcggtaggccttggagaaggacaggtgccgagccctgcatgtggagccctcccatcccattcccagatagacgtaaagaaccaaaaactacccaacaacaaaacccagatagtggactgaaacccaaagctggcttgacgatgggcttgtgtctcaggggataggaggaggcagtttctgcttctgggctgttcacggctaatacccatcctggtccctccagcttcctgcatacgtatcacactctctgatcctgtgtgttacaccccaagatctgggtgatagaaaggctgcctaggaatctgaggccagggaaggggcttgaggttggaatctctagagataacatggagagagacagctgtagaaagagggctgatgaggacagaaggactgggtgtggtgaattgggaccctacccccagcttttcctttgagatgtacagtgcaatagctccccgtcctttagcctaccccaatcctaaagaaagctggccatgtactgggagatttgggagaggaccttcattgaagtggctccaggatgggccagagtcgtcctttggttccctggggcactgagagcaggaggcttgtcaggggcagggtgaggagggcacctcttggctttgtgcacctgtgtccagaagagtacttactgggcacatggaggctcctgtagatgaggcccgggcccttccccaggcctctgagctcctgcccctgacccacctcccagctctctgcgtgctccttgtctcgctacctcctgtccctccacctccaggccacatcccaaacctgccctcttgctactgtaattgtaaatagagacctttcaaatgttagtggtgtaaccgtccaggaaactgttgtgtttgttgttgttgtattgatatgaaatgagattctatttttgtcaaagtatattgtaataataatgactcaaatggcccgtactgtacagatgagattcttctgctgtgttcttgccttcctctccagactaatgctttgttgcctcctcagtggggctgcagcaagcaccaggggcagtggaagaagcattgggtccttggacctcttgctggatctgaggtcagactggagggaatagtttgccccctccccagcctgctgtcaccacccctgcccttcctctgcttccccacctggggaaaggggatgggagacagcacacactcccttggagttcctcccagctggagggtagagttagacaaggctcagtgttgtagtacgatggtctttgcccacctgtgacccagccttttgtagtattttgacacttgatgcagggaaggagccagaagcagaggggtgtgagcatgctcgtggaggcgtatctgggttcaccctgtatttatgtgtttgtgtgcagctgtgcggatgtacctttgagtgactcaagctccaagggcctctgtgtgagctgggtgtgtttacaagggatcagcgccttccaactctgtggcttcaccccctccccgggctgctctcagtcccaaaacattttactaaagtcatgggggacgggtgctagttggccttcctgtttctccccacagcctacctccaccagggcttcacatttggagctctgcctccatatggctgtccactagccccacccaggcatggttcatccctgg

SEQ ID NO: 28031 - DNA, 1365 bp, Mus musculus
ggccaccattacagttgtgggtgaagcccctatagttcacagtgtgctactcaacagtttgccatctgcttcccgaaagcaaacctggcttgtgattgccatgtacggatgcgtgcatgcactgtgtgtgtgtgtgcgtgcgtgtgcgtgtctgtgtctgcacacacacgtatgagttcttgtgtgtctctgtccctgactgaaggggcagtctgtgaatgagtatgtgacatttctgcagtttagtatccccaggtttctcctggggctatgcaggggcttctggctggccaggtaaatggatccctgggaacctagacctcaaatggggacttattttcttcctctcacaagccaaatttgcctactctccactccctatacagaactgggtatttgccaaagtagcctctggcgtcatccagtgcccttcccacccaggttcccctctgctttcagggatagtgggaccgagggccacccccacatgcctcagtttagcacatttcctccatccccagcagtgcatccacccaccctccccaactccaacaggaaggaagaaagaaatgcaccttctcttgctcgttatttatttgtttggagagacagaaatgatggaaaagtatctaaatctatctctctctctatttttacctaactctctggaacccctgtgggggaatgtaggctctcctaagaggctgggagctccttgttctaccctgtctgcctctacataagcagaaggggtgggatgtaatggggcaggagggctgagattcccaaggagaatctgaattctctacccccattcaagtcccagaaagagggaagaagggagggatgggccagccaagagctgacccgtccccaaacttgacaatcacccacactcctggctcctgggtctgggtgagtccaagtgtgtggctgttggtttgttttcattatttctttccgtgctgtacggtgatgctttctagtattctgcacattaagaaaagtcctcgagattcttacgagtttggtttgaaaactctttcactatatttgttgtaaagaggtttactattaaaagaaaaaaaaaaaaacatgtttctgatacctcagtttgggttttgatttctttggtgcggcgaggaaggggaggaagacctggtgtgcctggcagagtgagtgatgatttggagggcaggctgtgagatgccaggtctctcaggcactcttaaggcagaactgtgggcagttgctccaggtagaagccttgaaagggatcctgcaacatgggaagaacaaatgttcctagggtcagatctagccttcctactacagacagccattcttagcagatttcccttggcc

SEQ ID NO: 28032 - DNA, 1110 bp, Mus musculus
tatgagtgcactgtaattgtcttcagacacacaaggagagggcattagataccattacaaatagttgtgagccactatgtggttgctgggaatttaactcaggacctctagaatagcagttagtgctcttaactgctgagccatctctccagccccctagaacacttaccttagatgatgcttttggaagctgttgcctcttccctaaaatctgtttggccatgtaaaatgttttaggaattttagcagtatttgaaagtttagcaagatgtcttgtcactttaaccacctcattctgcctcttggcgtgttcttggcatgctcttatgctctttgaggcttacatgagtgactgtgttaaatgttttatgttcactgttttctggctttctttttccagtactcctgttgatgtcaataaccgtgagatgatgttgagcatcatcaatagctctattactacaaaagtcatcagtcggtggtcctccttggcatgcaacattgcactggatgctgttaagactgtgcagtttgaagagaatggcagaaaggaaattgacatcaaaaaatatgcaagggtagaaaaggtaagcttgtccagtatgtgcttgagagttaggtgtctggcatggtcattcctattcagagtagggtgtccttatttacttagaactagacagaagaactggactaccttagagcctggaaacaataacctaagagtatcaaggagaattcctgataccatttttggttgcctttactaccttccatacacaaggtttacaagggtaaggaaagacactgatgtgtccatatctatgcctgtgggtactagccactggtgagtatatcagttttataagtgctgaggttggtgaaatggcctagcggctaagagtgcctactgttcatgtagagggcccacatttgattaccagcacccttgtggtgtcttacagccatccataactccagttccagaaaacctgattccctcttttgacctctgaggtcaccaggtacacatgtattacacatacatgtaggcaaaccaccttgttggtcagggttctctagagaacagaactggtgaatattaaagagagc

SEQ ID NO: 28033 - DNA, 1173 bp, Mus musculus
aaacaaacaaaaaaagaatacagctattccaacaaggacacacaccactaatactatcactcccttcaggccaaggattcagacacatgagtatggaggccaaacctgttcaaaccactacatacgtattgaactcagtacttcaggcttgtgtggcaagcatggtacttactacctgctgaaccatcccatggccctgtttggtataattcgacttattggtgttcagactcaactgagttatgtgtgggaattcgttatccagattttattatctaaaaattacacttgaattcagctatgactggttgctgtgtgcctgtgcatgtgtttcattactaaagccaaatttcagaaacttggcctgtatgcatttataactttcctaccagtcagttcagacctctcagtgattctaataatgtattttagtctactctaaccacagactgtggaccactagatgagtaaaagcatctgaagtcacatcctccatctttccactcaatagagcctgtggggcacggatagtcagccgacctgaggaactgagagaagatgatgttggtacaggggcaggcttattggaaatcaagaagattggagatgagtactttacattcatcactgactgcaaagacccaaaggcctgcaccattcttcttagaggagccagcaaagagatactctcggtgagtgagccttggcagtgtgaccaaggggaggacattgttccatcctagaattgtcagcttaagaaatttaatgtgtcgactttaaaaggaaaagatgtagtttagcagttttattttcagtccatgctcattggcctgtagctgcatgtctacacagacgtgtgaaggagcagaatcagtcatggtgaagaggccaatgggagcaatgagtgccaggttctgcccctagtgccatttcatcaaggcctggtggtggaccagaaggatgggttattctacatacagagtatgaggccagactcagcttaaaggaaggaggcgtggaagacaggcacaatctagaaacagctggatgttggaagcatggtatggcagctcattcttgtgatcccatctgaggcagaaacatcatacaagtttgaaagtgtgaagggacaagggcaggcttattggaaatcaatacgccagtctttaaaaa

SEQ ID NO: 28034 - DNA, 2314 bp, Mus musculus
caaacttaggtgatccagcttgttagttaacaagagccttgaaccactaagccattgttgtagcctgcttaaattgaaattataaccctatccctattcccaaggggagtgacttatcctggatatgtagctgttaagcagaggacagtttgcagtacacatacagtctgctgggtggcacaactaggaaggaagggaaagataaaatttgtttctctttggtgtaatacataaagacctaactcataattgaggtatgacatcccctaaccctcttgcagggcccctcctgtgctcacattcctgaggtagaatgtgaacatcacttctgcccctctccaggagaggtcacaaggatcttcctagttgccctctttttgtggtttgctaaaagcttgacagtcaggaaatcctttgcctctgatttctctctgaatcactgagctgactatacaccatttctctgcttccccaaggaagtagaacgcaacctccaggatgccatgcaagtgtgccgcaatgttctactggaccctcagctggtgcctggtggtggagcctctgagatggctgtggctcatgccttgacagaaaaatctaaggccatgactggtgtggaacaatggccatatagagctgtggcccaggcgttagaggtcatccctcggaccttgatccagaattgtggggccagtaccattcgtctgcttacctcccttcgggtgagttcttttctacactcatgccttgccgaggtaaggcaagctggttttatcctaaggaaaaaactgtgtttctgacagtttgtgattattcgcacatatgcttctgttcatgcacacatttgcatgggtgtgggttggagtgtaggccagaggtcagccttcagtgttcttcctcagcagctcgtttcttcaaaagtcttgtagtctgccttgttggctgtcagtttttagtggtttggttttgtccattctctgacacaagcaagctttattgtactccctacttgtgtatgttccacctgcaggccaagcacacacaggagagttgtgagacctggggtgtgaatggtgagactggtaccttggtggacatgaaagagctgggtatttgggagccattggctgtgaagctacaaacgtacaaaacagcagtagaggtaagacaccatatgttgtttctgtccagataaccagcttctgagctttgtctaaaaggaagggccaagtattccccaaagatgtcccaaggaattccatttccctacttagctttggcttatacaaaagcagtgtaacgggatgagttatatcccttgcttaggtagaacttcattgttcattcaagactctggaaaggaagattccagataaaatggtaattctgtgggaggagctaggagaaggctaaaagaaaacagtgtctttcccttctctgctgacctgtttttctcttagactgcagttctgcttctgcggattgatgacattgtctctggccacaagaagaagggtgatgaccagaaccggcaaactggtgctccagatgctggccaggagtgagtgctgagcacggtgacttccatgcacagaaccagcagtctcccctttcctgagccagagttccaggaacactgtggacatctttgtttgcgaaggatcaggttgaggggcagcccccagtctgtcccatctcagtttgcaaaaagcactgacacgtatctcttctattgtaagctttccatttagtttgcttccaatgattaaatctaagtcatttgagaccgttgtcatgtgtttttcaaccttgggtcacatctctgcctcctagcaatgcaagaggaggtagaaaaccgtactgggagcaaaggagagaagtcactatttgctgacacacaccctccctctcctaccccccaccccctttaagacaaggtctcaactgtgtgtgtagatctgagcgtggtgtttctactgcctctgcctccagggtgctctgagtgctggtatcagatttaaaatggagtgctccaccacaccttgcttggataagttttaaattaagctaatccttcataggtgtgccttgaaacacactccccacagctcattctgcccacactaaccgtcacagctaaatagccagtaggacactagcctgtgctgtgcttgtctcaaaagacaaaatatatagagttggtgaggttgctcagtgggcaaaaatgcttgcaattaaagccaatggcattcattcagtcctcagttcccattgtggatggagaaagaaaagaggttcccaaaagttgtccaca

SEQ ID NO: 28035 - DNA, 1860 bp, Mus musculus
agaccaggctcagtaaacaggaaagaattcagaggaaagagacaacaaagcagagggcagcagcggagatgggaacgtagagcagatttgaggctttccagccaagactgaagcttaggaggtcaccccttgggagcggtgttgccaggcttgctgccatagggactgcgtgaggcctgcgccaccttgggatcagaggcttgctcttgagcttgctgtaggcttgcgctcagcgttagagtcttaatctgtgaaaggccttgtttccttcctgtgagtttctgttagagaggagaagctagcccctggctctcattttcacagtccagaaaaccgctcctggggccttgctgggtcccattttcccagtcatccatgagtgctttctgttgttaatctgcctatcaggtccctgtgggcctcataacacaagtcctcaggtatgatgcttgacctcttgctgctcttctgcattgtctttggctggaggactcctcctttttctccccagagctctcaaagtttgtggaaccgcctgtctgtgttgctgaatctgttgccagcatctgctgagctccaggattctggtgagtgtggccctaagactatccttccctctcactggccccatcaaacctggtggggcctggtcctgtaacagcatttgggataaggagcgcctccctctcacatagcagtcagcatatggtccaggcctctccagtttccacactactgctcctagtgagctggtggtctcatgtgaataggtgtgctccctggggaagaagtgggaacagggaggagtctgggagccagggttgtcatggtcatctctgctgcttgaaagagtgacatccagagttgatcaccagttcatccccttttccagctcccgagtagaaagcccctgctgttctgcctcccaagagcctgccactcttcaggaacccttctctccttgtcatcaagggtcctcccaggctggctgtccttgttctccagccctactttctcctccagtttcccagctttggtgtctgtccttcccctttcaaccatctgtcctagagctgtgtcctttctctggtaattccctacaggaggtttgtatctcctatgtggtcattccccagggcactgctctgattttctcctcctgcctaggcctggctctgtgttccgaagtccaaggtctccttgaaggctgcgagctgcctgacctccctgccagcctgctgctcccagaggacatggcactgcgtaacctacctcctctgcgggctgctcatagacgctttaactttgacgcagatcggcccctgctcagtgctttagaggaggtaagagacttgcttcatgccacaggcccaggctttcatcacacagggcagcaaggcagggattatcaaggccacagacttatctggacaggtgtctccttttccgttctcctccttctactgagggcagagcaagttaatcagggcttggaatcttcagcctctctcaccagcccagaactgaccatcagtctgaatagctgagccagaaagcacacactttggtcaccagctttttcccttgagtctctcaccacataggccatctgggggcagcaaagggaagtccagccaagcaggcaggctactgagttttcttggccctcctcctggttgctttctccacagccagagaagcctggctgtacttggctttatattttagggttctgggtcagatttatatcttgcagagaggaagcagggttttactgaccaaaaaaaaaaaattgagaaatgtgatcctggataagtttctcttgtttacatttgcgaagctaagagcctgaggagaggg

SEQ ID NO: 28036 - DNA, 1667 bp, Mus musculus
ggacgtcaagaacgttctagacttctacaggcagtggaaggagattggttgagactggtctccaggccctgccgtggggctgactccagatttctcctgttctccctggcgaccaggaccaccacctgtagtcaccccaccacatgcagactcaagcaggcaaacaggaaggaaggccagctgcactgaggctgcagggagggcccaggagccagcggggaggatgggggcccctgttgccaaggcgaaatcaggaaagtgaggaagtgcttggcgtaggagtggccatggacccccggccagccttccaccttaaacctgcagtccccaggggcatgggcaggggcaggcatgggggtctgcatttcattggagcagttcctggacttctgagaggaaaagatgacagaagggccctgtcctcacccaagattcagggtgggtggggctgggagtttggagcccctagctcttagggaagagtggggagatactgagtgtctgcatggttctctgcagaccccacccatcctcaaggaccccctcatcccttgtctcccatggggaacagggcagctctagagccagctgtgggggctcttagggaagcagggtctgcacacttggaggccccacttctcctctgctgctgcccagcttccaggcccacttagggtgtgggctggatggctgtacaccagcagtcatcccttccccaccagcagtcactgtgctttgtgctcttggctgctgtactggataaggggtgccaatgagggagcgaaggccaaggccacccctctgaccatccagggagagctggaggaagggtggcagaggggcaaggtccctgggagctgcttacttagggccctcctccatcctagactaccctccttttgcccacccccagaactagagccctggtaggctgagcacaggctggttttggagtgtcaaatgacacaggagcagagatcatgaatactcaggggcagagtagcaccctgagagcagagctataggagaggctctggccaggacgaccccagttctacccctcaggctggaagcagagcatagctggggctgggttcttttctgcttccccctccttgccccaactggcctagctgctttggctgtgcttaagaggagctggcttccagccttccactaagaaagaaggtctgggaaaaccagggaacagttggggttaccacatttccaattctggcagacttgagactcaagcttaataaagacccccttcccaagtgcactctgcctgctgtgtcttctgttgaggagctttgctggggtggatttggtgtgctgggcaagtgccacactgtgagaaatacacaccaccttagtgagactcagacattacacttggaagagagtcaaccttgatggggctggagagatgacttagtggctaaaagcacttgttgctcttgcagaggacggatttcaattcccagcacgacatggtggctcacagtcatccacagtcccgtttctagggaatctggtgccatctcccacttctgacttccatttgcaccagacatatacattgtaaggatttatccaggcaaaacacaaacgacgttgaccttgaacaggaaatactcacactttatgcttatgcatgccgcaaa

SEQ ID NO: 28037 - DNA, 1349 bp, Mus musculus
tcagctctcatcctggcctggtctgaagcacagcaggggcctcgggtgctcgctgtgggaccagtgtgggagctcagagccccttttcactgtctctgttctcagtgagtgagcacttacccagcatgcctagaccctgggttggagtttgagcactagggggctgtttctccagtgagggcaaaggatctgcagccactttagggagccattgttgaatgtggagaggcccaggagaggtggctagggcatctagactgccataaatacctatggatggtcgggacttccacttggcctttcctggcacatcccaccaagaccagtgacaggaaacacagagcattggcactgttctagaggtacctgggctggagccgtgcctgtcgtctcacctcacacggctattcccttcccttggttccaggctctacacagagagcagagggagctgctgtcagtgctgagggcgcctgagtgaacagctgctgggctcagccctctagagcgcctgtggaggcagtttccaggcagtaatggagtccccaccaccgcttaggttctgctggggtcacactgccttcagattcctgccgccatcttctgcctgcaggattgggactcccaccctggcatcagacaccaggctttgtcttctggagttgcagccagcgctgccccatgcccttctgatcctccccctctcccaccgccctccctggataggatttgggcagggtttcagtctccactgattgccgccttgttctccctgactgattgctgccttgctggctagcccaagggccctgccatgttctccccacatccgtaaataaacttcctttcccacactgtcatctgtgaggaggtttccttgccaggtgtctgagggctctggaagcctacagccaagagcgggttgttcagatgtcacccgtgcagaggcccggggcttcctgaggtgaactgtcaccatggccagtgctaccctgtgctgctctctggggcacaggagagtgatgaggcctgcaggtagctgagcagaaggacttaccttgtctctcccaccccactcttcccccaaggcccgtgagtgggagagccagtcagtccttcctagggtggggcagacattcctctctcctgcctgagagcctcaccttaaccaggggccgattggttagatctgtctgtgtgaccctaaggacagaaaagataccatagtggtctctcctctgtctccataaacagcctgggcccttctagctgctcttcagaaagccccagggtttgtttatccctctgggcactctgcctacctggcccgtgtcatttgaattcaggtt

SEQ ID NO: 28038 - DNA, 1173 bp, Mus musculus
ggggaaggtacaaactcctttgtcctgtaaaatttttccccactctgtccaggctgcaagattaaggctctgagggccaaaaccaacacctacatcaagacacctgtgcgaggtgaggagccagtgttcatggtgactgggaggcgggaagacgtggccacagcccggcgggagatcatctctgcagctgagcacttctccatgataagagcctcacgcaacaagtctggcgccgcctttggcgtggcccctgctctgccaggccaagtgaccatccgtgtacgagtaccctaccgcgtggtgggactggtggtgggccccaagggagcgaccatcaaacgcatccagcagcagaccaacacgtacatcatcactcccagccgggaccgcgaccccgtgtttgagataaccggcgcaccgggcaacgtggagcgtgcgcgggaggagatcgagacgcacatcgctgtgcgcaccggcaagattcttgaatacaacagcgacggcgacttcctggctggcagccctgacgctgccttggacagccgctactcagacgcctggcgggtgcatgctccaggctgtaagccgctctccaccttcaggcagaacagcctgggctgcataggcgaatgcggcgtggactcggcctttgaggccccgcgcctaagcgagcagggcggggactttggctacagcggatatctgtttccgggctacggtgtgggcaagcaggacgtgtactatggcgtggcagagacaagccccccgctgtgggcgggtcaggagaatgccacgcccacctcggtgctcttctcctctgcctcctcctcctcctcttcagccaaggcacgcgcgggccccccaggcgcgcatcgctctcctgccacctctgcggggccagagcagctgaccgggctccctcggaggccacccggagagccactgcagggtttctctaaactggggacaggcgggctgcggagccccggcagcgggcgggactgcatggtgtgctttgagagtgaagtgacagcagccctggtgccctgtggacacaaccttttctgcatggagtgtgcagtacgcatctgcgagaggacggacccagagtgtcctgtctgccacatcaccgccacacaagccatccgaatattttcctaagctccatgtccc

SEQ ID NO: 28039 - DNA, 1151 bp, Mus musculus
ggtggggacaaggaggcctgagtggctgggggcggggccattttcagagcctctggttaccctttgggaggggccataagttttactagagttacaactctgatacctcaacacacccttaaatctggaagcagctaagagaagcttttgtttagccagaagtggccaccaggacacacatcctgacctttcccttctccctatccacatgtcattttgccccttctctggaggggtaagaacagggagacttgccatctgtagttagaggtgctcttcctgattcgctagccctctggtcctgacctcccatctcctaacatgaccctttagcccacacacacacacacacacacacacacacacacactcactcactcactcatatcctgagttcccaacagtatagggagatgggggcctattaaagatctgcatagatcttccagggtgatggaggatgtcgataaagggctcacaacttacccatcttacaaagctgggctagagatctggaaaggggcttctcttcccccttcaattgtttgcttggcttttcccccaatttttttttgtttgtttgtttctggatctgccctttggtttctgttgttgttgttgttgttttccctattctgtccccctctccctcagcccccagccacatgtttctttccatcctcttacctcttctagcccagctttggggatatcattttcttgggagagaagtctggagagtgttttgatagcccccacctccagttcctcttcatgtagaggacagcccttttcccccactcctccaaagaatcagtttgagacgggaaactagtaatggggtacatgaaaggttggaaccctgcctttatcatctatgggcattatacttagggagcatcttatcctgggtcttctgcccaaggcaagggaaagccaaaagtaggaaaagtcctggggcaagagagatgtgtctggacgggctcccctccccctcacctgcagtggcctacccccgacctctctctgcacctagctgaaccattattgagtccttattagccacaaatcatgaattctctgtcttacccactggctgaggagagaggccagatctttggtgaggggtcaggccagggcaaagcaggatt

SEQ ID NO: 28040 - DNA, 2322 bp, Mus musculus
ccctgggttgcccaggggcaggggatgggaggggggtgggaagaagggatgtctgtctgtcagtcccctccccctctccactccttacccacaaaggcaaaagactgttacactaggggctccacagatccaatcccacccttgctgagtgagcctttcctagaaacaagcgcaaaagtgagcgagcagcaaaacaaagcaatgggggagtgagatgggcgaccaacagaggagaggaaacaaaaatagcaaaaaaagaaaaaaaagcagttctttataatttaatattctattttaataaaggcatttattaccgtataaatgtagcaaagaacctgggctaatatgaaaaaaagactttttattaggtaatttattatatgaaaaggatattttattttatgataaagtgatccttaaaaaaaaaaactttagaaggtttagaatatatgtagggagagaagaaaaaaaatacatttgtattcagagttaaatcttaaaaaaagtttttaatatatgttcgggtttatgttcttttttttcccccacttctttttggggagaaatgtcatttgcttttcttgggggagcatcctggggtggatggtggagaggggatagggagttggtcccttctggggcccccaccagtagattggatttcattctgtgggctcccctccccctccccctcaggggagccggcagagccaaacaaaggaagggattaaccagaaaggaagcagctttgggactaaggactgagggtcctggagtgtccctccttcccctaccctgtgccaggggcagtcaggagggaaaaccagaactgaggcctagttggccgactgaaaccctcagaggtgtgagatttaagagaaatagattttttttaaccaaaaaattaaaaaaaaaaatgagaaagaaaaaccgaggggtttaaaagaagagaatactacaaaataattcaaatttatttcatataatcctagagaaagaaaaagaattactagttacttagtagacgatactcaagatagcttaaagtttagtagcattgtgggcccctgagcccggtagaatgtataaaagtatgggggaagaaaaagaatagaggccagtggctgagctgccctatccctggggacagggctagagcaggctgctagctgagattgggagcttccagtctgctggggttgattctgagaatccttgggtttaagtgtgggataagtacaggagaggctctgtcccagggtctttgcaagggtacacactggtcatccgaagctcagtgcagctcggctgagcctggccatctgttaggaagcccctactcctaatgtccaaccctcccaggccaccctgaggaagtccttgaagtcacctcggtccatcttgctaccagtgggttcaagagccaggtggagctattctgtgaatgagccagcaactgctgatcagcttagcctccagcacccatgcagtatgagagcggcattgcagtttctagcgctgtttcccttcacatctgtagtggggattttgttcatttgttgttttttgacacagggtctgtagctcagtctggccttaaactagcagccatcttgctgcctttagttgctgggcctacaaggttcgcaccactactcctggcttcatggagtctcaaagaagttaacattccacgaaagacttccgactcaggaagtagagtgcaagtattgtccttatgagcctgggagaactcccccaccccatcccacccccaagaacagataaaagtgcaggaacttgggtggcctctgtgcaacccttgtgtcacagctcccagctgtgttcagataagaatcacccattagggccacatcacatcatcttccccacagaaatccggaagcctggctttgcatgtgagaaataggcatttttaagcacttgccttctttccatcagccccagctagcaatcagatcgggaatgggagaggcctcttggctttagcttaagcaagcgggacaccagtgattgacattgccacttcttgaccctagagcccaaacacttctccctctccgcagtttactcttctcaccccatctagagactagaagtccccctgccctttttgccctaggaccctcagtagttggagatggtagcatctgggaatggggaggatttccctagcatgctcgagggtgagtgctcagagggtcgagtggttgggtggagacagccctggggcagggaagatggtctctccactgtagaaagtagagtaggatcgtggtcagacttaatttgaggcatcca

SEQ ID NO: 28041 - DNA, 2168 bp, Mus musculus
aaggtagatggagtgaggtgtctggtttccatttggacccctttcttcctgttttgtctctgcctctttgttccagggatgttcaacagcccagaaatgcaggcgctcctccagcagatttctgaaaacccccagctgatgcagaatgtcatctcagccccttacatgcgcaccatgatgcagacgcttgcccagaaccctgactttgctgctcaggtatgaaactgctgaagaaagtgcttgcttctggggaaagggctgctacggggggcagttccgcactggtgctgaagcactcaggggccaggctgcctaagctcctacccccagttctgctccttcacagctatgtgaactaagcaagttgtttaacctccccctctctgcaaacggtggcagccacagcacctttcctgctgggatggaggattgcaggagcatggcatggcacatgggacaccctgtagacttgaagtggtagctcgggtgactgtcagacgcaggctgactcctgctgcgttttctggccctgcacacgggcccatttttttttctgtcactgacccacacgggcttctgtggagcactttgagatttctcgaagtgctggtcatattcgctgcagtagtgggagtgctgaggagggtctgcggctgtcggggggcttcccagtgtcggatgacccaggcctccctaccccttcacgtttgcagatgatggtgaatgtgccgctgttcgcagggaatccacagcttcaggagcagctccgcctgcagctccccgtgtttctgcagcaggtgagtgaggttcacagagggggaagcctggcggccagagttatggtgaccaacaggcgccagctgtacttactggctctttcctgcttctcctgttgccttctctgcttgtttcccaacagatgcaaaacccagagtctctctccatcctcaccaatccccgggccatgcaggccctgctgcagatccagcagggactacagaccctccagactgaagcccctgggctggtacccaggtaaggagtgttggtggctattaaggttttctttttctttcttacatccgcgcacaaagatggggacacacacacacacacgccgttgtacgttgggctgggtctgcttttccattttgttctgactttcattgtggatctcacatttccattccttttcctttttttctttttctttcttttcttttttctttttttctttcagacccagtctcccttttatagcccaggctagcctcaatcttgtggtcctcttatctcaacctcccaaatgcccagattacaagcactgccctccacatccatttcccaccatgttctgcactgccatcttctaactcttgttcttttcctgcctccagccttggctcctttgggacaccccggacctcggtacctctggcaggcagcaactctggatcttcggcagaggcccccacttcttccccgggcgtgccagccacatctcctcccagtgcgggttccaatgcccagcaacaactcatgcagcagatgatccaacttttgtccggaagtgggaactcacaggtacccagggcagtagcatcctgagcagcatcaggagcaggggcagtacaggcagcagcacaggcctcacgggaggcagactgggctggagggcctggtccgccacgcattagctttgggcaagtgtcctcaagtgaggtttctgcagattctttttgcttaaaattttttttcaagacatagtttctctgtgtagccctggctgtcctggaactccctctgctggctttgaactcacagatcctcctgcctctttctcctgcgtgctgggattgaagacatgtgccaccacagctaagtggtctgtatagctttaaagtagggtaagagtagtggcagtgctcagcacatgcctggcaccatgcagtcacagtatcagtatggcactgatggggaaagccaagggcaaagaggtcaggtaactggcggctcactcacacagctagtggatggtgaaaaggaaaggccaggactttaggcaggcacagaggtggcttggcatctctgacctctgcctctgtgactcttctggaaacttctggactattctacaaacacttgtgtaaattctgggagggctgagc

SEQ ID NO: 28042 - DNA, 2280 bp, Mus musculus
agtattcatgcctgtaattccagcactcaggaggctgaggcaggagaattgcaaattctagcccagcttgggctacataacaaaacattctcaaagaaggaaggaagggaagaaggaagggagggaggggctagcccgagaatgggtctatgcccacttgccaagtcctgcctcctctaggtgccgatgccagaagtgagatttcaacagcagctggaacaactcaactccatgggctttattaaccgtgaggccaacctacaggccctgatcgccacaggaggggacatcaatgccgctattgagagactcctgggctcccagctctcctgatcccttggctggtgcctcctgccttccccacctctcagcgccagcctctggctcctctgtgaagccctatcttccatggcctgtcttctttgacccctacgaacagagcagcaagaaccgcagggtgacttccaacttccaaggcctctgcccaacccaaagctctccaaggattttgattcgtttactgtctcatgaaatctctcccggtcctcttggagcagagctatctagtgtgcacagtgtgccagtttggccacatctccttgcccacaagtaccttggcaacatacattcttctccaggggactgagaggaggaccccgcctggcgtaccggaagtcttccgttggtaccactagagtttagctagccttacattactcctaccctcctctccctccctcacctcagcccaaccagtttgaatctcactctttggccaggtcctggtgaaactgttttttttttctctacccctatactgtttcatatagcctgtccttctgtccaaaggcagcagtgagtcagcagtctgggtagggttatcaagatcaaaccagaccagtggacactggtgctctagagccacagctgagagctctcggaagcagggacccggggagacagcctgggcaggaggcttggaagttggagttgacagagtctagaaagaccaatagatttcatggtggagaagccaggctcaggcctgacagaagaaagtctgatggacttggaactgaagatagaagttcagcaaagctgaacagtgtgacccatgagaaatcaaattggctccattgtttccagacatatttgcgctcacgttccaatgaacccagtcttcaggctccagtattttgagccccactctccagaagatctggtggggtttctcagcattgtagaaaatctatatgtgtgcgtacatgcaagttggggaggtgtgtgttctttgttgatttctggttcacaactttgtcaacagagataagtgggtacaagggccaatcttgtggaagactatagcattgagggagccgggtccctgggcctctgggtattgggtaaccagaaagcagattgagtaattctctgagcaataatggctctgactggtaccctggccaccattgcttccttggtgaaagaatagtgaggtttctcttccagagctcctgcctttcagttatttgctggttccctctaggccagaaacttgtatttgaggagaggtgggatggcagatgcctttggtatggaactgggctttgcttaacgagtaccagaggaagctctcgccacattttctctgctgtgtggtccaggtacttggaggacccctggctgagagacaggtaaggaaaggcatcctgccgtaggtgggggacagtcccagacagttcagacatgccttcccttccccccttatacccaacacccactctggcctttgtaaataaataatgtgatttttgttgtgagattatattggtggtttgtttgttgttttttcctgagggaggaaccgtgctgaagacagaccactgtctgtcttgagttaggttcggtgttctgagagggtgtcactgaagaccaagctggcctagaacttgcacaaccctcagcctcagtggctgagtgatgggattgaaggctgaatgccaagcttgcctcatctttttggcagtggagctatccgtggtgtctggtgatgtaagaatgaaccatgcttgggagaatgagagactggtccaggccggtcctccatgcaaatcccagtgccagagaaaagagaagaaaatggaaacatgaaggagcgggaagtctggcttaaaacttagcacttaaaggctgctggtagccataaaatttttgcagcctactttaataaaccttcaacctcctctagctccccacccagcagaggtagtagaagagaaa

SEQ ID NO: 28043 - DNA, 1320 bp, Mus musculus
aagaaaaaagaaaagaaaagaattttgccttattgtggattacaaattactcctgaaaaaatacaaagaagagattctatttttttttgttttgttttttgttttgttttgttttgttttgttttgtttttgagatatggtttctctgtgcagtcctggctgtcctggaactcactctatagaccaggctggcctcgaactcagaattccacctgctgcctcaccttgcttctcctgtcccagcggtggcccgggcggccagcgcgagcagcggggaccatgttccgacgcaagctcacggccctggattaccacaacccctcaggcttcaaatgcaaagatgaaacagaatttagaaactttaacgtttggcttgaagaccagaaaatcagacactacaagattgaagacagaggtaacttgagaaacatccacagcagtgactggcccaagttctttgaaaagtatctcaaagatgttaactgtcctttcaagattcaggatcagcaagaagcaattgactggcttcttggtttagctgttagacttgaatatggagataacgctgaaaaatacaaggacttagtacctgataacaggaaaaatactgacaatgcagctaaaaatgcagagccactgatcaacttggatgtaaataatcctgattttaaggcgggtgtcatggctctggctaacctccttcagattcagcatcatgatgactacttggtaatgcttaaggcaattcgcattttggttcaggaacgtctaacacaggatgcagttgctaaagcaaatcaaacaaaagagggcttacctgttgctttagggaaacatattcttggctttgacacaggcgatgcagttcttaatgaagctgctcagatcctgcggttgctgcacatagaagagctcagagagctacagacaaaaattaatgaagccatagtagccgtccaggccatcattgctgatccaaagacagaccacagactggggaaagttgggagatgagcacatgaggatgtcagcttctcacctgcctagtgatgggaaccattacaccagcatgtgcttggaaatcagatgtcacacttggaagggagaaccccaggagattgaccatgttctagagatttaccaccgctgctttttctttaataaagttggggaagtaaaaggctaaaaaaaaaaaaaaaaaaaagaattccacctgcttctgcctcccaagcgctgggattaaaagcgtgcgccaccactgcccagccaaacctttatatttaagataagcctttaaagcactagagctgggcagagatc

SEQ ID NO: 28044 - DNA, 3057 bp, Mus musculus
ctccactctttctttccatgagctgatggccagcctctacttctccctctctctctctctctcctaactctcagctcctcttcccatgccctgaataaactattctatactatactgtcctgtggctagtccctgggggtggggggaagggatgcctcagcatgagcccgcggtggcattccctaaccccacaccttaccacacatccaccaaacacatttcctctccttatctttttataaacacaacaggcatggtgacacatgcctttaatcctagtttcacttagacaatagaagccaagggatctcttgtgagttctaggccagtctcaaaaaaagaagaaaaaaaagaagcatagggtgtctgtcccaggagagccaggcgcagtgggagaaggttctctcatcaccccaccagcatctatagtagtgccagagcacagagcaggtgcagagtaaacccatcctggatgtaagagtgctacagaagggatgtggaagaactctcctgcacatgtgctataagcatgtttacatgttcatgtgtttatgcacatgtgtgtgtgcacatgtagagttcagaggagaacttgtcggtgccctattaaatgggtccaaggattcaaactcaggtgggcaggcatggtggcaagtgcctttacctgccgaggggtctctctggccctgtttactagttgtctgaagtctctataaagtgctaattacataaggcagtgactagcagcttggaaatctaagaattcaaggaaaggctatatcagctacttcagccttaaaacaaagtcggcgactctttgaactttgaaattgtgcctatgcagcttatttcgttttagtttaaacagaggggttttccatggggtaagcattaatgagaagaaattggaggacacacaggaaagagtcaaggactctaggtaactcaactcctttggggtatcagccgccataaaggggaaggtggggcttgtttcagaactacaacatccataaggcacaggaagggacatcagggtttccggtcagatccgtttccggtctttcggaggctgacgttgttttccggttgtctgtggcccagggaggcgtttggggtgctcacggtgagtctgggagacgcaagagcgctggggtccccgctgaccccgcctggccggcagcgcggtacacactgctgtggcttgggctcgcggctgcggacctggcggcggggctggagtgtggcgccgcacaggctgcctggctggcagtgtttcccatgcttgggtcgattgctcactttgcttttttccaaagatgaggctgctggcggttgtggtgttggctctgttagccgtcagtcaagcagaagaaggagccaggcttttggcctccaaatcattgctcaacagatacgctgtggaagggagggacctgaccctgcagtataacatctacaacgtcggctccaggtaacggcctagagttcgccagcttccttctgaattccgagtttccacgtgggcatagagaacgttttgttggggagtgaattctcttttggagtcctccagtatcgagtgcagtgtgtgagtgagtgaatgaatgaatgaatgaatatactagagggcttacctttgtcgggtgctttttgaaggtgaagacatccttaggtgaattacaagaaaccactttggggtctcagaaggctttcaaaggcagggataaattcagcttgtgaaaaaggaaatgcagacacagagtgtacatctgtcctcttacctcgggtgcggactcccagctttcttctttcacttacaatcactttttttgttgtttgttgtttttcaaggccgagtttcttaactggctgtcgaagagtccactcttagaccaggctggcctcaaactcacagacatctgtctgtctctcacactgcttcccgagtgctgggattaaaggcatgggccaccactgctggctcctatgagcacttttttgttgttctttccttttatatatttttccatttatatcttacttcccctgtctagaattagagcaagattacctttggcaattcacttctgagcaacagaatccaggccttgatctggattcttcaaaacaggcccaacttactatgggggtttcttttgaccagcaggtggattttccagtcagttcccttagttttatgtccctcactcttatttactatatgtaagtacactatagctgtcttcagacactccagaagagggcatcagatttcattacagatggttgtgagctaccatgtggttgctgggatttgaactcaggaccttcggcagagcagtcggagctcttaactgctgagccatctcgccagccctgtccctcactctttatttcctctgctttccagcgctgcattagatgtggaattatctgacgattccttccctccagaagacttcggcattgtctccggtatgctcaatgtcaaatgggaccggattgccccgtatccttttttttaatgggtggtgagggctgggggaggaacattgcctggaaaacatcaagggggctgcaaacagactggatgtgtggtctgtttcttgtcatatatctggggaggatgaagtatcagctgagtgagtgtgccttcttccttcaggctgtaaggctgtctgtatctcccaagctccattagggagatgcaggcatataaaggtatctgtggctatgaatggatattgaatgtgctttttttctttgcactgctggagacagacctgggtattcacacacattgggtaagaagtgctctatacctcaggtgctctcaaagcagattcagtggggtgtcaccatggagaccccgggtaacacgttagcatcttctcttagtgtctgctttctgacttgaaagttattattatttattcttattttatttttattattattactattattgttgttgttttggtttttcaaggcaggattttcctgcataatccaggctgtcctgaaacttgctgtgtagaccaggctgtcctcaaa

SEQ ID NO: 28045 - DNA, 1448 bp, Mus musculus
gcaccgcctgtccagactgtaagtccagagaggattagccaggcaaagaggagctgagggaggagagactgagaacagctcagattgactcaaggcctggtgtgagccaggaatgacaagtgtttaacaaagatggaaggtgaagtatgaagccaaggtggagacatccccccttagggcatcccccttctcaaacactatctagaatttgggtgaaatgaggcttggctgcacagcttgaaaaggagactagtcgtagagagccattttgtctgagggagaggctggcaaagtcctgcttacatcctgggccctgctgctcccttctcttccagaccattcccttcttccttttccctcctgcatctgtacccagactcctaagcaagaccttgttttcctccacagctggactgggcagcctttggggtcatgaccttgccctccataggcatccccctgctcctgtggtattccagcaagaggaagtacgatactcccaaacccaagaagaactgaatgcagtttcctcggcccttctctcccaagaaaccaggttttttctagactccagagggtgtcaaaagtgttctcttggcccttggcccgtggctattttgtcctgaatcttaccccgaactcaaccagaatgcgaggggcaggcctggaagttggagagggcctccccgttgtcactgaagccatatagacaggacagcccttagccacagcttcagggcttgagggtcccaccaaggtgctgttggtatattattagcaatgtgaactctttggggtccaggaggggccctttggatactgtctgacacccccatcccctggcagctcctctcaagagggtagaggattatgggggctacacaggccctgcctggattaggggcacttaccaaatgaattttctaataaaaacaaatgccataccgatgtgtttgtcttgcgtcaacagacaagtaagtttgcagcccaggtttggaagctccagctccagggcagccagggggctttcttggcattgaagtatgggctattcccagaggtgtgcctgattcctttttttgttttttgtttttttttttgagacagggtttctctgtatagctctggctgtcctggaactcactttgtagaccgggctggcctcgaactcagaaatctgcctgcctctgcctcccgagtgctgggattaaaggtgtgcgccaccatacccggcctgattccttttaacccctgtgctcatggctctccatggctggagatggtcctgatcaatttactggcctttctagcccactagtctaactcagtggttctccacctgggggccgaaggaccctttcacaggggtcaaatatcagatatttacaattcataacagtggcaaaattgcagttaggaagtagcaatgaaaataacctatggttggg

SEQ ID NO: 28046 - DNA, 1188 bp, Mus musculus
cctccaacagccacaccgcagatgccaacttttcatgccttctccccctacttaggaaaaattatttatttattgtttaatggttacagggggcgggcagggagtaatttaaagggccagggacatgggaaccaagccataagtattggagagcctctcctctaataccactgggatatgtttggccttagccacacagcctaacacccaccccagtgacacccatctgtggccacagcctactgcccctttaaggagggctgtgggtaggaccatgtcccttcccccactccccctagcctctttctgctcttcgttctcatcatcctccatggaaatctggctccttggagttgatggagcagaggctagggcggccataatgtatgggggaggggaaggaagaacctacagggaccagaatgtttggtttttagtttttgtttttttgtttttgtaccaaagccaaccacacctgttttatatttttaaaagaagattgtaggcacttctagctccatatctttgaacttgaggaattagggagacagtgacttatttcattgaccgtcagggggctcctattcagaactcttcctcagccatttggaagaagctctaaggtgggttgggaaacctctacgaaccctcacctcatctcccacagcggcaacgtttgaaacgtaagcaagaattgagggagggggatttttttttcaatgcaaccctaatgtccaccagcgatagccatttgtctgcaaatttaattgttaaaaaacaaaacaaagcaaacagtaacaacaaagaaaagagaaagagagagagagagagagagagagagagagagctcaagcagggaaaagacctaaagcgcatgaggtgctgactcagtgcccgatccaaggactgcggtgcatgcagccaggcagtgaccacggtttctgaaaaggggctgtcactacctcactgaagagggcatgaatggatgcagctgctcaaactcttattaaaaatcttaaaattgcaaggctggaaatgaagcgccgttcagcctccagcggctgttaatgatgcacacattagaaaactcgtttgcatcttattcatctgccatgcttggatagcacatctggttcttgccacccctctgttcccctccctgcccctcccattttcatgcccaccctg

SEQ ID NO: 28047 - DNA, 1129 bp, Mus musculus
ttggtgggggatggggtcggggttgtggttgttctctcttctagattatccagccaagaagatgaaaacggcagagaagggatttggcttagtagcttacgctgcagactcctctgatgaagaggaagaacatggaggtcataaaaatgcaagtagctttccacagggctggagtttgggctatcagtatccttcatcacagccacgagctaagcagcagatgccattttggatggccccatagaaaatagtggacagagctttgaccctcagtgactcttcttagcaataatgcatgcacttgattaaacaagactctgggacctgttctgggggccatcttggatcttcgaagatgttagggacacagtgtcccctgtcataaagggacgccattctttttaaaaccctatttctgcagtggcataacatccgttaaaattcacttagaatcacaaatttgcatcaagctttttaacagttgatgaaatgtgcttgtccagtgagataccaggacagagtcattgctacatatgtttgacctgatctagccttttccaaatgaatagcctcaactctgttgtaaagaaagttttatttgtattttactactattgggtcaattttgataactggttacaaacaaaaagccttactatttattagtgggaaatggttttaagacccttccttccatacttacatgtaattctaagagctcctcatccctctttccatttggagtctttgtttggaaaatgctgttttactaatttagaatggtcaaatacaactggatcctgaacaggaaaatgcagttatttttgcattctttctttactgggatgatccaaagctggcacctttaggcacacttgtttcagatagccattgctgttggcactgcccttctaagctcccggtttccaactgggtcaaagaaaacgcgaaacactcatctgtctctctcagaactggctgcagcgagaagagggatgtggtgccaccgacaggacggtgactgactggaattgcaacttgtccttttttcttggcattgcgggttttgccaaaagaacttttttgtatcaaatattcatgtgtggaagtgaaggaattggtggtgagc

SEQ ID NO: 28048 - DNA, 1584 bp, Mus musculus
gggatcacaccactagtccctgtcctttaacccatggaatgtaaatattgtatcatacgtagaagaaaatactttttgttttctaaaaaggcattttgacatagtttaatgaaaacccggcaggagcattctaagccccattagggaaaaaaaaaaaaaaaaaaaaaaaaggaaatggttcctcttcgtcgccttaatgtgtaaagatcagaagtcactgagcagctcctcggagaagatgcgaagtgacaggtggagcctggcctctgtcccgctgtgtgtgcctctgttgctccccctgagaagtctgggaaacagcgctcctcccttccccatcccgctgcagctcaatcccttgcatcctctgggtctgcagagcagagggtgctggtggaggagccagtacttctacaggctcggggctgcctcggtgtctgtcggggtgggcagtacaggattcctccctcctacctcaggcctgatccatcatgccctggacgcggtaccctagagcttcttagctgactctggctgtcacatctgttcttcacagagctcgctgatgtgggtagaggcagaatgcctctccctgtccaatgaaagacaagagagtcgcttcctagcttttgcacaaggctcttgtggttaggaataggttagggaaaggtcactcctgatttcccagcagccaatctgtctatggagatttcttgactctttgggaactctgagagctattcacaatatcagaagttccctcttgagttcttccttcttttggttctcagcacggccacagtgtacatgtttatggacaatgctgtgctggagagcagacagaaggctgtgtgggaccagggggccctacttaggagggggataggaagacaaaattttaacactggtcatagtgacattgccctcaccacgatccctctccaaagtggtcgtctttctttaccttgtgtcttctcttgtaaaaataaaactcaagaaaaaaaaaatacaagtgtcaaactaaaaagaaaaaaaaatggaaaaagctaacatgaactgtgtgaaattgcatactgctgtgacgctaacctgcaatatgtaatgctatcttgtatgtggaccttgttaatgcgccacacacgtgcagaataaagactgattctgattaaataggcacagtgctacagcctgggtttctttttgtttgtttgttttgtttttttgtttttttgagacagggtttctctgaatagctctggctgaaagaacctagtggggaaagccccactcaattcccgtttggcgcgcacccaagaatcacgaacagacaaccatcttgatgaaaaagcatgaggtagtttaatgacggagctccggcccgcaggagacagaggtgtcgaccacatggtggagccataattgcggagctccggttcgaaatgtatctcacacaggagacagtggtttcgaccccgaggcttggaagctagggacttttatagaaaaggggtggggctggggaggaattggcacggtttcacatgattggtccatttaaacatcaacagactgtctgaagggcgagag

SEQ ID NO: 28049 - DNA, 1148 bp, Mus musculus
tgccttcctccctccttccctttctttcattctttttctttgttttcgagacagggtttctgtgtgtggccatggccgtcctatagctcgtcctgtagactagcctggcttcgaaatcagggctacgtctgcctcctcctcatccatctatttgtcatgtgttgggttactttttccatgaactgacttaccagggctgtggcttcaccaggccctaaaacatgatggcgccgatcatctggcgcatgctccttgacgcggaggtcccgcgcatcgggggcgcgcacgtcagccggtgccgttgcgttacttccgctggtgcaggagctgagtttccgcgggatcagagcgggcctctgagggtatttggtagtgtgtggtggggcgggaagcagcacgttagacgtggggctcccgggcggagggtgcccaggatgaggggcgtctgctccgaggctgggtgcccggtgcgggagggtaatcgggtagcaggggtgtgcgtgctggtgcggacctgggctaacgttgagcgctgaggtgtcgagagcggagctaggagtcctgtgaaatgcttgttcaggggggatctggggactgcttgctcggtgcgttcactcactcttggtaagcctttcctggccttcaaggagcagactcttgcggggcggtggtggttgcacgcctttaatcccggcactcgggatgcagaggcaggcggatttctagagtgagttccagggctccacagagaaaccctgtctcgacaaaacaaaaacacaaacaaacaaacaacaacaaaaaaggagcagactcttggaggtatggtagtttgaagcgcttggagcgatcctctcacagttctgactgaatggcccctggctgcccctctctccccgcttcccctctgcttccttctctgtgaaccttaggaagtcatctgtgaaataaggaatcacctaggttatccccactcccctccgtactcttttactctcctccccgacaggatcagcgaatcttctcttggttattgagctttacgatgataaggacctgggctcttagggcgaggggcctcccttaatgccctagagaatgtgcgtttcggaggcttaagattagctttatagatcaaactctgagtaagt

SEQ ID NO: 28050 - DNA, 1173 bp, Mus musculus
gcagaagagattaccacatggagagtcaggcaggggtcagcttgctttatcagatagctctccatgtgtatgtctgttcgtcttgtttgcttttgagacagaatctcatttatgtagccagccagagtttgttactgactaatgcagcagcccagtatgcttgtgaattatgaacaactgttttacatcaacctcctgagaactgggattatacttccatttttattataaaaccagtgaacattttctttgtcttcctgctagactttaaacctgatggaaatagactccttcctatcttgttctttcacgtgtctcaggcatcttgagcaggacttgagttgctgcatggtggatggatagagccttggtcagatgctttgtagaaacagcatttgttatctccttagagttctttcttactacaaaatggacctaagttctgctaacaaactcctttccttctttacagaaaaagaagtgaatgggctgatggaagagctgtttgagactgtgagtagtgattttggagtcagtaggttagtggaattctgtagttaagctctgtcctttgctctttgaaattgtcttttcagcagaatgatctgcccgggttagggccacctaggagttgattggccagaaaattctgagtagtagactcttgatcacctacatgctttttcccacgggctacctttgcaggttatcattaggatgctgatcacagacttttttttttttttttataaatttttctcttgattttaggtaatttttcacttgaagcagtaatttgtttagcccaggaaagtttactctccaaagagagattcggctgggtggttgtaaaggcaattggcaggtaaatctgtctctttgaagattttttggttgtgtgcagaaactggagagacggctcagcatttgagagcatctgctgcttttccagaggacctaggttcagatgttgggtcataggtgccttagcggatagaagctcaccaagatgctaagccttcatttctcaagggagcagagtggtttagtcttcttggaaaagatttgacagccaggtagcttactccagttactttagtccaacatcatacaaggttaattggggctggaaaaggttccaaataacaaagttatcttgcccttgcccttgcc

SEQ ID NO: 28051 - DNA, 1106 bp, Mus musculus
ctccacccccctcaaccccacctgacctctgaactccctggggtttccagtctcttgacttacttaggtcaagagttaggttaggtgcatcttctctgactgaacccagacccagcagccctctgctatatatgtgttggcctcataccagctggtatactgcctggttgatgttacagtgtctaagagatcttgggtgtccaggttaattgagactgctggtcctcctacaaggctgccgtcctcctcagcatctttttttttttttttaatttttttttatttatttattgtgtgttaagtacacggtagctgtcctcagaagagggcatcagattttgttatggatagttgtgagccaccatgtggttgctgggatttgaacttgggaccttcggaagagcagttggcactcttaaccactgagccatctcgccagtcctcctcaacatcttttagcttttccctaattcagccacaggggtcagcagcttctgtccattggttgggagcaaatctctgcatctgactctttcagctgcttgttgggactttcagaggatagtcctgataggcctctttttgtgagcactccttagcctccgtaatagtgtcaggccttggggcctccccttgagctgggtcccactttgggcctgtcgctggaccttcttttcctcaggcttcacttccatccctgcagttcttcagtcaggaacaattatgggtcagagtttagactgtgggatggcaaccctatttctcacttgatgccctgtctttctgctggaggtgtgctctacaagttccctcaccccatggtaggatatttcatctaaggtccctccctttgagtcctgggagtttctcacctttcaaggtctctggtacattcttcagggtccccccacctcctacctcctgaggttgcctgtttccataaggcatttttttctgttatcccctgcctttcagttgctgttgttcctgttttattagcttttaaaacttttaaagttgataaggcattgttcaatctatctttgggggttcttattgtttcacctttttgttttaaaagcatctcttttaatgtatgattagat

SEQ ID NO: 28052 - DNA, 1092 bp, Mus musculus
gtgcgccaccaccacctggctgtaaagaaactgtgagtctagcagcgtgtgtgggttctcttttttttctttttctttttttttttttttttttccgagacggggtttctctgtgtagcctttgctatcctggaactcactttgtagaccaggctggcctcgaactcagaaatccacctgcctctgcctcccgagtgctgggattaaaggcatgcgccaccacgcccggctgcgtgtgtgggttctcttagtgccttgtgtgtctgtgtcagtggagaaagtgtaccttataggaacagacaagagaatcagcttggcagacctcctgttagcaagtgttacgttggagtgactggaaacttgaggggtcaagtacgaggaagagcctgtgtgagtgctgtgtggacttaggccttggtgaaactctttggtccttgcatcatatttatctcagatgttctttcttacagccagtgaatttccctgtttgccaaagcaagtggcttggatcctggccacaaacaaggttttcatgtatccagagctcctcccaatatgttccctgaaggccaataatcctcgggataagaccatcttcaccaaggctgaggacaagtacgtatagtgaagctgacattagtgcagtagcgaaagtagagacagtggtttgagaagcttggggcaaataagaattgtgtaacaaggacatagaccaaagaaaagccatgtagagacaggagtttatcagtttcagtcctgtctttcccaggggatgccatacatactgttaaaactttattctgattttatttttgagtatgggtgtcttgcctgcttgtatgtctgtgcagcttgtgcgtgacagtgctggcagaggccagcaaaggcctaggagccaccatgtgggtgctaactgaagctgggtcctctgcaagagcaggctgtgctcctaagcactgagccctccaacacacacacacacacacgcacacacactcacacacacacacccacacacacacactgttggtcttttttatttttatttttttgttcttagcctttagttttctgatgctcccacttctaatt

SEQ ID NO: 28053 - DNA, 1204 bp, Mus musculus
actcccccctcagcctctcaagtgttgagattgcaggagtgtgccaccatgcctgggatgactttttctgaggtgtaatgctcttttgcttgtttgtgaattgtatgctgtctcatttgtgcttgttcagtgctgtttctcaggtcttctattctcttgaaaccagtctagggcatgagagagttcaatcccagggtcttccatatgttaggcaagcactgtaaccaatgagttagcttgtgccagggagccaggctggtcttgaccttggcatctcctgcctcagccacctcggtgttcagagtatgcagttgcttgaattttttttttttctgtcaccaagaatgttagtgctttaagcatatttattttcagtagtgctggtgattaatccagggtcattgagcttttcatgtttggttattaaaatacgcagtgatctgtaactctctaagggtgtgggaggaggctgtgaagcatgcaggttgaagagctccttgcagaaccatatgtgactttggttctctctcagtctgttggctttaggactgaagcatttcgaagggaccgattttcctaagcctctgatcagcaagtaccttgtaacttgtaagactgctcaccagctgacggtgagaatcaagaacctcaacctgaacagagctcctaacaacgtgattaaagtgagtgagtgagtgtgtgtgaaaactccctctgcctcctttccctctcagctgtcagtgatgggaggcttttgttataaaagtgttttatcccttttcctggtagcccaggtgtttgggaaggtggtaggcttactgtggtgttactcagcagggttggaactgacttcttggtttttggaattaggcctaaattactaactttcagtcatggactcctgtctgtcttcctctccctgcttttctgcctccttccttcagtgttagacactgatgtctcactgaaccctgtccctagaacccttccttattcattcactatttcacaaatagatcggggttgttgttgttttggttttttgagacagagtttctctgtgtagaactggctgtcctataagtcactctatagaccatgctggcctcgaactcagaaatttgcctgcctctgcctcctgagtgctgggattaaaggcgtggaccaccactgccgggctcatttttaaaggctttgtcaattt

SEQ ID NO: 28054 - DNA, 1195 bp, Mus musculus
cctgccactacagtaaaggttgtgagccttggtggtggctgtaacatgatccagcctgttactgcagctgtggcaccaagtccccagaccattcctatcaccactttccttgttaaccccactactttcccctgttcattaaaccagccccttgtggcctcctccatctcccccctaattgtttccagcaatcctctgactcttcctgtgacatctattcctgaagataaggcccaagtgaagttggatgttgctgaagggaaaaatgctcctcagaaccctgagtccaaattaaaaccccaggagctaactcctctctgtaccactgtcttctccaaagaggagcccaagtcctggcattcttcagcagatacgggaagccaggaagcattctctgaatccagtacctgcagctgggctgttgtcaaaacagaaagccaggaaggctcttctgaaaagagtgcctgtggctggacggttgtgaaaacagaagatggtgggcatgctgtggagccattgcctcagaatctccaggactctctgagctctccatcgaaggatttattaaatatggtcaagatggaagctgaagattgcatggtggaaatctccagcaaccttcccaagcaggacattggggaggaagtgaaagaggaacgctctatggaattagacagtgagtccccacaggagaagccgagtagtgccagtgagatgagcaaacagacagtcctgcagagggaagacacgcaggccgccaaatccccttctgtgccccaagacgctgctgctgagggacgaacaagtagtcatgcaagcagaggactgccaaaaagcactctgtcctccatgggccagggcggggggctgagcggtcctccagggaagcttgaggactcggccaatgctgacggccagtctgtgggaaccccagcaggaccagacactggaggggagaaggacgggcctgaggaagaggaggaggaggactttgatgacctcacccaagatgaagaagatgaactgtcatcagcttctgaggagtctgtgctctctgtcccagagctccaggtaagggccagcgcggctccaagtagaatggggacttggtacaatgcttactctattacattatagccataaacccttacttgacttttgagtatctgtggaacatagttttgacctctgtgtg

SEQ ID NO: 28055 - DNA, 1134 bp, Mus musculus
gtaggcttaagtctcagcacccacatggctgctcacgacccatagtaactccgttgaagggaatttgatgccttttgcaggcatgtggtgcacagatctacacacaggcaaaactttaaaattatacagtaataattaaaaataattttaaatagtcataagaattgaggaatagctaaacagtagagctagtgtactgtcgggtatggtgttgcacatcaagtcccagcacttgtgaggcaaaggcaggcagatctctgttccaggccagcctggtctttagagtgagttccaggacagccaaagtaatcttgtcttgaaaaaccaaaccaaaccaaaccaaaccaaaccaaaccaaaccaaagagtgagttccaggacagccaaagtaatcttgtcttgaaaaaccaaaccaaaccgaagcgaaccgaaccgaaccgaaccaaagcaaagcaatgtagcacgtgtacttaaaaaagttgctaagcaaagctgtcctcaggacctcaggcttctctggttctcagtgttggccctgctctgcctctgtgccttatgctgctgctgctgtacttcagcttctgggagctgcaaggagcccttggaaacattttcggtgtagtacaaccagtttaatccaatcctgacttccttacaaaagagtgagacccagactttgtttagtgtatttggctttgataattactggggtcccccccaatctactttcctacctgctggcctggctgcctgccccgcggtgttccccaaagacttgctgtttctcttggccgtgtgctcatggttccgctcctctctcctcttcctcattttctttgtcttggcttttctgccatgcaccagcaggtaactaaaaagcctgcccatgtctaatccctctgctaatggttgtagccatttttattcaaccagtatctttaaattaaggaacaaggtttgcacaacaaaagatggcatgcaggagaaatcactcataagtagaccttctggtacacattttatcattccatgcatagcagcagacaaaacctcaacaaaatggtgcttttaggaaacaatggagaaactgacttggctggcatctgaaaggaggatgagtcaggagggtgagtct

SEQ ID NO: 28056 - DNA, 1149 bp, Mus musculus
tgtccaaactgcaaggtgtcagaaaaatattttataggactgtcgtcaaactgcacaagcgctgtacgagaggttaatgaattacaggtttaagcttagatcccatctctaataaatctcacgaatacacatgtttttattggacccaagcacctgtaatgcacagacaggtaacctgtgtgtcacttagttgtgttgttttgatgtttttttgagacgggttctctgtgtagctctggctgtgttagaactctctatggaccagcctggccctgtactcacagagttctgcctgcctgcgcctcctgaatcctgggactaaaggcgtgggccactatcacctggctcgtcttctctttctgtgttgcctttccggtgaaatgtatctgtaaagggaaattgctgtggtttgggcttggaattgtgaaccttacaagtgggttgagaatttcttttcctctccaattctctatattctctttgacctatcccctccccattaaaaaaaatgtatttatatgggtatttcacttgcatgtgtatatgtgcactatgtgtgtacctggtgactgtggagccagagcagagtgtcagaacccctggctctgacattacaagtggttatgagccaccatgtatggtgctgggaaccaaacctgggttctctgcaagagcaatgattgttgtcaagttttgagttgtctctctagccttttcttccccttttacttttagactttatcctgtatatctggggaggtgaactgtgcacttcattagtcttgtattcatgaagtgggtctcatgggatgagggcagtagtttaaaggaagactttgaacattgagaaagggtttccagagatggagaacgctttggactgagggcactgaaggttgcagtttgacagaatggagccttggacacctggagtaggaacaacttgaatcggtggtgatgtagtagcttggaagaagtagggaaaggtgacttgtgaatggcaggttaggtttcagttgtagaagaatttcaacttccatacttagacattgtagtttttccagtaggtaaacagagatagcactatttctagcttctgtttgtttgctcagaggtacatggatctatggacgtgtacatactagacat

SEQ ID NO: 28057 - DNA, 1991 bp, Mus musculus
gtgtgaccacagccactgagagcagcaccgatcagcacttacagaaagccagccctgccctgggagatgaacctcagtacccactgctgctacccaagggtgtggtgctcaaactgaagccgggttccaagcgtttctccagaaaggcttggcgacagaagcggccattggtccagaagcccctccttatccaacccagcccctctgttcagcctgtgttcaaccctgggaaaatggcaacgtggccaactcagtcagaagttcctccaagcaacacagtggtccagattcctcatctgattcagccagccgctgtcttacagacacttccagggttcccttcagtgggggttcgtggagaagatggttttgagtctccaacagcactgcctgctatgccttgtgggtctgaagccaggaccaccttccccttgtctgagactcagtcagcacctccttcttgctctgcacccaaattaatgctgccctctctggccccttctaaatttcgaaagccatatgtgaggcggaagcccacaagaagaaaaggagccaaggtgtccccctgtgtgaagcctgctcccatcatccacccgacacccgtcatcttcacagttcctgccactacagtaaaggttgtgagcattggtggtggctgtaacatgatccagcctgttagtgcagctgtggcaccaagtccccagaccattcctatcaccactctccttgtcaaccccactactttcccctgttcattaaaccagccccttgtggcctcctccatctcccccctaattgtttccagcaatcctctgactcttcctgtgacatctattcctgaagataaggcccaagtgaagttggatgttgctgaagggaaaaatgctcctcagaaccctgagtccaaattaaaaccccaggagctaactcctctctgtaccactgtcttctccaaagaggagcccaagtcctggcattcttcagcagatacgggaagccaggaagcattctctgaatccagtgcctgcagctgggctgttgtcaaaacagaaagccaggaaggctcttctgaaaagagtgcctgtggctggacggttgtgaaaacagaagatggtgggcatgctgtggagccattgcctcagaatctccaggactctctgagctcttcatcgaaggatttattaaatatggtcaagatggaagctcaagattgcatggtggaaatctccagcaactttcccaagcaggacattggggaggaagtgaaagaggaatgctctatggaattagacagtgagtccccacaggagaagccgagtagtgccagtgagatgagcaaacagacagtcctgcagagggaagacatgcaggctgccaaatccccttctgtgccccaagacgctgctgctgagggacgaacaagtagtcatgcaagcagaggactgccaaaaagcactctgtcctccatgggccagggcggggggctgagcggtcctccagggaagcttgaggactcggccaatgctgacggccagtctgtgggaaccccagcaggaccagacactggaggggagaaggacgggcctgaggaagaggaggaggaggactttgatgacctcacccaagatgaagaagatgaactgtcatcagcttctgaggagtctgtgctctctgtcccagagctccaggtaagggccagcgcggctccaagtagaatggggacttggtacaatgcttactctattacattatagccataaacccttacttgacttttgagtatctgtggaacatagttttgacctctgtgtgaattgctgtgtataggggacatgttctttgaattgaactcattgaagtgttaatttgagttacttgagcacacttaatttttttttaaatgttttacgctattcattaatttgtatggtgagtctatgtgatgacatgtgcagaggtcaaaggaccaggtcacgtggctatctccttcc

SEQ ID NO: 28058 - DNA, 1146 bp, Mus musculus
gcaagcaagcagggaaaagcttgaaaattcttatttatcaaagataggatgcatgggccgaggagatggcttacctggtaaacttgttagctgcctggtgtcttaaattaaacccctgagacctgaatgagtttgtgttaattaattactttccaaggcacacagtggcctgtgcgcactcactgccaagcctgaatacctgagtttgctccctggaatccacatggtagaaggggagaactgactcctagaagttgttgtcatttgagttccacaggtgtgctgtggtttacacacacacacacacacacacacacacacacacacacacacacacacacacacacttaatttaaaaataaaataatttaaaaatcaaaaaagttagttaggctctgtcgaaggcagaatgtgggcttcatggggacgggtttagcgcagtctaggggtgttctgctgatgtcttcttagccttcacaactttccccagctcaagacacagatgtggcagctcctcagaggccacgaccacctacaggatgagttctccatcttttttgatcatctgcgcccagcagctagcaggatgggtgactttgaagagatcaattggactgaagagaaagagtatgaggtataggttgtcaaggggaaagactgcctggggcaggggttggatccccaagtctactcactgccaccaactctcatttagtttgatggctttgaagaagtgatactccctgatgtggaagaggatgaagagcccgccaaggtgtccacagcctccaagagcaagaggcgaaaagagattggggtccagcatcaagataaggtatgcatgctgtgggggaaatagctgcttctttctcgctgtgaattctactttgtacttatcagtggtgtgtataggatagctgcaagtcttaagcttggagatgcttatggggcacacaccacaggtgaggctgccgtggaggatccatgagtagttgggaggagcacccatcaagcctcgttagaaggaatcacagccaggcatgatggcattcctacccctcgaggctgaggcaggcatattgtgctgcttcaaaggtagcttaggctacatagtgaaaccctccctcaagaaagaaagggaacaaa

SEQ ID NO: 28059 - DNA, 1151 bp, Mus musculus
aactcaaaagatacagacagaaggatggtgagtttggggtcaagctgggttatgtaacaagtcactgtctcaagaccaaacaacaagacaaaccatgacaacaaaaggaaaaatccgcccatgtcctttggctttgagagagggtgttaccatcccaggctgccctcacaattgtgatgtagctgagtatgacctagaacttctgatcttcctgcttttacctccttctcatgcggagtttacaggccaggcatctggctccattttagattttgtagaagggtccatttattttatgtatgtgcacatctgtgtattgcatataatctgatgtatatgatcactttataaattcaaaaagacaccaacctgtagtagcagaacagcacctatgaggagtgttggcacacaccttcactcccagctggcagagcagaggtaggagggtgtgagcccccagccccatgccaacaaagccccagcatctgcagtgacatcgaggcctgggcagtccccacatcaagcgcctttctcaccttgctgctgcagtgacaatttctccttttgctcttcttcagcttagattcgggacctccctcatggcaggaacaggaacagtccttggctgcttcaggccattcggtgtcctacaacaaaccccggcttccttagccgcccactactttcagaactgagagaaacagctgagttgagaggcctcccactcctctttgagaatgtaccatcttatcactgaggggacactggttacagtcccttaagaatccctgaagagtccacaatgatccaaagaaagaggcatgccataggcccaggacaaacttaagtcaaacagattttaaagaagaaatgcactggggaactccagagtagatccaggtcagactttctgactcctggtgtattctctaaactcttagaaatggctttgtacagtgactctactcaataaagccaaaacccgagaactgtaattaactcgatgcacaagttctcaaggccatttatttactcaaaagctttgcagacagacactaaagaaatgtggctttaagaggctagagaggctagctagctagagggctggagagatggctcaggggttaagagtgctgccagttcttccagag

SEQ ID NO: 28060 - DNA, 1175 bp, Mus musculus
ggtcttgagacagtgacttgttacataacccagcttgaccccaaactcaccatccttctgtctgtatcttttgagttttaggactatggacataaatcccacactcaatttatgtgtagctgagatcaaacccagggctccttttatggtaggcaagcactccaccgattgagctacatcttcagctttagatttttttgcctttttttctgaggtgatgttggttgcttttaaatttttaagataaagcctcatgtagcccttgctgtattgaccatgtagtgagccttggactcctgcctccactgcttaagtgctgggattacagttgggtgtctctgtatatccttgactgtcctggaatttactctatagaccaggctagtgtctaactcacagagatccatctgcttctgcctcccaggtcttggaattaaaggtatgctccccaacttcctatctggattttcctttttaaacaatctatgacctacggccataccaccctgaatgcactcgatcttgtctggtcttggaagctaagcagggcgaggcctggttagtatttgaatgggagaccacctgggaatactgggtgctgtaggctttttttttttttttttttaaggaaaaaaaaaacagtctttgatttgaatatggtgttcacatcttgggagacagagaccaggggctgggaaacaaacactgtatagcatggagcgaacataaagcctcagtctcagaacactggtggttggagggatagtgcagcagttaagaacactggctggccttccaaaggccgttgcttcttttccctgcacctacacggcagctcacaactgtctataactccagttctaggggatccagtgctttcctctggactcagcaccataggcacatggtgcacagacatgaatatgcataaaaatatgcataaaatgaatatgcacagccatgatatgcataaaatgaataaaactaatgcttctagaaatggagagtaaaactgtagttaaagtacttccttatagacttgttattgtctggggacatcctctatgaagtctgcttctgtgtgatatcattgtgggtaggccctacaattgtctccttaggtttccctttcttttcatcaaataaacctgtgagcaaaacggagtaaagataac

SEQ ID NO: 28061 - DNA, 1809 bp, Mus musculus
catttctcagcagctgggaaataagacccctgttgaggtaaggtgggaggggcaggtgatgatggggacagaggtgagcggatgggaccagccggggtcacggtcaatcatggcagcaactttaaagagtgctctgaaaaaggctcgacctgccaggtgctagggtttctttggagacagcattttcactgtgtctggaaagcctagaacaatgtaggtcaggtggtctcaacttgaactcagagatccatctggctcagcctccttattgctggaattaaaggtacacacatactgtatatgtgtgtgtgtgtgtgtgtgtgtgtgtgtgtgtgtgtgtgtgtgtgtgtgcatgcgtgtgcgcggttctctttcctatacataagactcagccctggtctccctccccctgcacccccccccccccccccccggctgcccacctgcctgtccactgtaagagcatggccctcttcctgtcctaggtttcccaccgcttccgagagctcatgcagctctttcacacggcctgcgaggccagctctgaggacgaggacgatgctaccagcaccagcaacgcagaccagctctctgaccacggggacctgctgtcagaagaggagctagacgagtgacatctgccaggacccaccctacagccatcagcactggagatagggcgcgcctcactcgtggagaccttgaggacagagcaagaatggagatggctctacagctcatctctcaggggcgttggtgaagaccctacaagcccaatctatctgtacatagcactgagggagctcggggcttgcctcggagtctggtggtctcagtgtttttaaatgtacaaatgcgtatgtcatgtaacaggtccctacacactgggttcctgcacggcagcttttattataaattctctcccactaccctcccctggacttcagttcgagagactgtcaccctcctggtaacactgggccaacctgtgtaactcgtgcagcatctcttccatgtcatcctgctccacgccagcgtccatgaagctagcccagcgccgcaggtcaagtctgctgagctcttcagccaagtctcccagcgtacggtgcaaggatgaagttgaacgcaaggccccaaacacagggatgctctgtactgctgcggagggaaagaagagggacgctgagtgggaggtacagcggtgactcgtgtgctgtcccttctgtgtgctccccaggggctcgtagtcaaggagaggaacactgaactgtgaactttgttttctttgcacttttaatcctcctggaaaaaactgtaaaaagaaaagagtaaaactgttcctatgtagctcaagtgttcgttttcttcatgtcctacctgcgcccttgggggtactgtccatggccagccctttctgactgaagcttgagaagaagtgtgggtatggaggagccactttgcagggagtcagcagcagatgtgacgaactgcagacagagaggtgatgagcaggggccagggctgcaagggctgggggaagggcaggtgcatatggaccgacctcaagactctaggatgctgctgctgtaagtactgggccaagacttcttctccagaggcgcatgcgtggagagcagagggcagaggtgtccctgggttgagcttactgcaaggaaaaaaccgcatttacctttggctgcacgaatgtaagctaagattcatacattcttggaccatcaagtgaactggtccagagctttttttttctgggtaaggtgtccatggtagcaggaaaagggtgtcagaaag

SEQ ID NO: 28062 - DNA, 1166 bp, Mus musculus
gactgttccctatcgcctgcgctcctcaatggttaccatggctcacttggctgatgtgctaagtttctctgggaaaaaggtaaggagctgtgtgaggggctaacccaaagctcagaaaaccctttgtaacctgctccctcccggtgtttaggtggtgacagcagaagcaatcatccccttcccactggttcgaggccagtcccttcctgacatcctgacgcagcttggagaagccaccccatggacctccctgtcggcatgcggggattctgctggacatcggtgctttgcccagtctgtggtgctcagaggcatagacagagctagccacaccaggtaaagactgctgggtcttccaggcccctgtaagtactgggcatgtctttgtttccctagcacgctttctgacacccttttcctgctaccatggacaccttacccagaaaaaaaaagctctggaccagttcacttgatggtccaagaatgtatgaatcttagcttacattcgtgcagccaaaggtaaatgcggttttttccttgcagtaagctcaacccagggacacctctgccctctgctctccacgcatgcgcctctggagaagaagtcttggcccagtacttacagcagcagcatcctagagtcttgaggtcggtccatatgcacctgcccttcccccagcccttgcagccctggcccctgctcatcacctctctgtctgcagttcgtcacatctgctgctgactccctgcaaagtggctcctccatacccacacttcttctcaagcttcagtcagaaagggctggccatggacagtacccccaagggcgcaggtaggacatgaagaaaacgaacacttgagctacataggaacagttttactcttttctttttacagttttttccaggaggattaaaagtgcaaagaaaacaaagttcacagttcagtgttcctctccttgactacgagcccctggggagcacacagaagggacagcacacgagtcaccgctgtacctcccactcagcgtccctcttctttccctccgcagcagtacagagcatccctgtgtttggggccttgcgttcaacttcatccttgcaccgtacgctgggagacttggctgaagagctcagcagacttgacctgcggcgctgggctagctt

SEQ ID NO: 28063 - DNA, 1169 bp, Mus musculus
atatttaaaataaagaaatgctggagagatggctcattggttaagagcactcactgtctgttcttcagaggaaccaggttcaattcccaccacccacatagcactgtctgtaattccagttgcatgggatctgcaacctcacacagataaatatgaaagcaaaacaccagtacatacaaattaaagaagatttgtcaccctataacaggattagtacaagaatgagaaactcaaatttctctttgcttgcatagtcctttaaagctagcaggcatatgagcagaagcaagaatgttccctaaataccctagctatttcaatagttacagctcacattcttcatgagaaactatttttatttactatcactgtgttatattttaaatatgcactatatccgtcataatcctcaatttttaaattattgtttgttattgggggttaggtttttgactgtcaagcctcagaatagttacttttccccactccaagtttcagtgtggagttttctagtttttttagttcaaagacctttaggatctagaacaatggcttagtattattaagagtactgtgtgttcctatagagaatacaggttgaatccccagcctgtatgatggctcacagctgccagtgattggcattcagttatctggtcctctctggtctctagaggcaccatgcacacgtgtggtacacaaacgtacatacagctaaaacacccatacacataaaatgttatttttcaagtacactgtgctgctggggaggtgactgaatggtgcagaacactggctgtctttgacaagactcaggttcaattcccagcacccacatggcattgcatcacacatgtggagcaccgcatatatgtgcggacatgaagctaggcaaacactcatttacataaaaataattagtatctccacaaagaaaagagagggtgttcataggctggagccgcccactgcatgtacaggctctcagttctatccccagcacccctttaaaaaaggattttttttttcttctttgaaacagtgtaagccagccaaactgtcaacatcgtcagcctctggagttctgggattacaggcagggaccatcacggttagccaagaaaaataaaagtttaataaaagaatgcaagcaagctgtgctggtagac

SEQ ID NO: 28064 - DNA, 1099 bp, Mus musculus
atgccatgttcatcggtcacgccaccgccctcatccagtccctggactcttcccggcgacagtaccaggagaaggtcagcagggacaagggaggggaggggtgggcttggagaagggctggagatatgttctgatgggctcctatgtcctttcctgcctcatatccatttgtcccagctacctgtgtgaaacacatctgtgactgtccctatgcctctgtccttggaccctccctctcctctgtccacatttggggttttctgtaactgcgcagtcttacttgtatccaccattttccgtatatcccttgcggctctgtgtgtaccacgtttatcgcctctgggtccaacttgttctgcacaccccgagccccactgttttggccccacgtctccacatccttttcccactggcaactggtgttacctctccagtacaagcaggtggagcagtacatgtccttccacaagctgcccgctgacacccggcagcgcatccacgagtactacgagcatcgctaccagggcaagatgtttgatgaagagagcatcctgggggagctgagcgagccacttcgggaggtggggccgggctggaccttgtgggaagggctcttctaggatctgggcttctggatgtgccgcctgggttacaagggagtgagtgcttgggagggggggacaagcatttgaggggaggtggctttctgtgcaaggtcttatggaactgtctcagggaggtccccacacgggttgtagcatccccatccagtaaccgatcttgacaggtggacgggttttctggagacagatgagcttggggacagggcatcttccggcagggggcggagcctgtctgataggccccgcccatgtccaggagattattaacttcacctgccggggcctggtggcccacatgccgctgtttgctcatgctgaccccagcttcgtcaccgcagtgctcaccaagctccgttttgaggtcttccaaccaggggacctggtggtgcgtgagggctccgtgggcaggaagatgtacttcatccagcacgggctgctgagtgtgctggcacgtggcgcccgcgacacccgcctca

SEQ ID NO: 28065 - DNA, 1152 bp, Mus musculus
agtggtgttgctcatctgggtggtttgagttgctgttgagaactgacctgttgtccactcccagatctcatggcccctgggttaaaggtggtgggaatcacacaggggtttcttcccctgcagccatctatatctgttccccttccttcatctcctcaccccaggttgctgtgccctgttttcttccagttcacctcattccccccttttctccctccctctccccgaccctactttctttcgtttcagatgaaattgtaagcaccttaggagaagggaccttcggccgagttgtgcagtgtgtggaccatcgcaggtaacaaatgtcctgccgcttactccacatctgttaggcagagacgattgtcagggcatcgaatatgtttagagattagacagtcagaagttcttagtctgatccattaatcactcactgatcattcaatctgagatgttcttgaacccaacaaaagcctcccctattaccttacaggggcggaacacaagttgccctgaagatcattaagaatgtggagaagtacaaggaagcagcccgactagaaatcaacgtgctggagaaaatcaatgagaaagatcctgacaacaagaagtaagcaaccaaaggaacatgtgaggaggccgaggggctctgtccagaaggaaggctccaggctgaggctaggcgggcaggggatacatccagtcttgtcttttctttctctctctctctctctctctctctctctctctctctctctctctctttctttttttggcatgcttttctctgtgtagctcttgctggccagaacctggttgtagaacaggcattcctcaagctcacagagacccttctgcctctgcctcctgagagctgagagtataggcatgtgccgcacccattaaacttgatcctgtgcttgtggcagagcatcaggatagcctgtgagagtctcttatccatcagcttgtgttacaacacctgcagtcagggaatgaataggcctggcattggtgggcatcactgtaggtggtgcaggcctgtgatcccagccacttgggagaggaggaaagacagatagaagcttaagacagcctgggcaattttaataagaaagatcttttttcataaatggaaatggagctagagat

SEQ ID NO: 28066 - DNA, 1116 bp, Mus musculus
ctttgagtactacgttggcttcaccctcttccaggtaaatggtggataatcccaggctgctgggtttcttggtctgcagaggacattcctgctcagtcctctgtctatatggcatattgtctatatggcaactagtctccagcgctccttgctgtgtcctatgctctgctctctttgtttctcagacccatgacaacagagagcatctagccatgatggaaaggatcctgggtcctgtcccttctcggatgatcagaaagacaaggtgactctcacgcgggaggcactagagcgtctctcctcgtggaatttgtctgttaggcatcattttcttgttttcattgacatctccctagcccccacttacttgggtaaacaagggaaagggttttatagaaatggagccttctgatgcacaaacctccccttcccctccagaaaacagaaatatttttatcggggtcgcctggattgggatgagaacacctcagccgggcgctacgttcgtgagaactgcaaacctctgcgggtgagcctggccagggagaagtactgtccaccatctaaaggttgcttctttcttcgggtggttggtccctggagtgcattttctaagtggaggttagggcaggagggggaggaacattgaaagaagataatttggtcaacggtggacagaggagatcgagggttcacagataacctcatctatagacaaccagaggaaagcagacagaaaagaataaactacctttgaaaagcttacactttacactttaatgtggagctaaggaagagtcatgaggttgacaagtatatacaagtaaaacagaatattaaggattaattgtgctagtgggaaggtaggttgagctgtaatatcagaaatattatgaccacataatgttgtgataaggtagctttcaaattccatgcaagccgaactttggttctttttctaaagagcaaaagtggggctttagaggaagcagggagtcgtaggtgacacaggcctgcaatcccagcactcgagaggctcttgtgaggccgaggcaggtgttccaagtcagctgcagtgcgtagctccagaacagcctcgactgcacagtgagaccc

SEQ ID NO: 28067 - DNA, 1151 bp, Mus musculus
gtgatgctgaagcgggtgagggccggtcgggagaaggtggggctggggagtgagatcattgggtccctaggggctgctgagtggaacattaaggaaatggggcagggcgggtgggttatcaactaatggactttcttgggtgggtgagtttgtgtgtttggagggagtgccaacgcagaaggaacggtacaaagcaggagactagtgagtggtgccatcctcctgggatgggaggggcctgcctcccttataatctcttccctcttgcagatccactccctgtaccgccaaacgggtgccagctttcagaaggcccagcaagaatttgctgctggtgtcttctccaaccctgcggttcgaactgctgctgccaatgcagctgccggagctgctgaaaatgccttcagggccccttgacccctgctgcacccgctgggatgccctgggcctgtcacctgtgggaaccaagatagtccctatccctgaagtctctgggattcagggagccatcaccacttggtgacttctatggggctcttcattccacagccatgactttaatcctgacttgaggtgtggagagcccgctgtgactcagtcattatttgccttttatctcccatctggccacactgctgccgccacctctcacacaaccccaaccccagtttccttctgctgtgccaaggatgtcttcttccgttatttaaattaaagaaaaaaaagtgtaactggaactcacccatttcctgtatctttactggagattgggccattgtatggagtggggaactggggtggaaacactctgcaaggagagggttgcacttggcaaagtgggcaggctgataggcgggagatgggggagccccagctcggtttaccatgcctctgttaatgatgaatgagcagtcagtcccttttggtgtgaacacctcatcccgggaacctgtggggcagaaaatggacccagaaatgatccttaactgctcaggcttcagggcgaggctagggatggaggagggcctctccctatctcctcccttccccagggttgctttcagactacagctcccgggatgcattgcaccacccaccacacccctcctccgcaccacgcaccatccaccatcccccacctccacaggctg

SEQ ID NO: 28068 - DNA, 1200 bp, Mus musculus
ctacgtgctcgctcagccgagaaacgccgcccagtgcccaccttccagaaggttcccctgccttcaggtcctacacctgcccactctctaggggacctgaaaggaagctggccaggccggggcctagtcactcgtttcctccagctgtctaggaggtctccagaccctacaggaactggagcccatggatataagcaagtaagcgttagggggaccaggagcatccctagaaaagcctggcgctttaggttggcctataccatcgccctctctctgtcctcttccaggtgcgcaggagcccatgggggcgaccaggtcgagagagcctccaccttcgcagctgtggtgatttgagctctggctcctccctaaggcgactcttgtctgcccgcaggctagagcatggcatccgcccacacagcctcagcctcaatggaggcagccgggagactgggctctgatttgggcatgttacactgaacagatcagagcaatgctggagcccataagcattagctggttaggaccagcagccttcagcagccctgtgcaccactggctggctcaaaaagaaatccgctctatactctcccaaggtgttcctttcctgcctgcctttgagggctcctgttgcttgcctctgcctctctgaagggcagagcttctgtcctgtgctgcatgggtgtgggaggaaatgccccctgcttacagcattgacagaggaaaattagtaacctcccccccgcatgagagtgcctctttctgatattccagggcactgtatgggggcaaaagcctgagtgtttaagaacacggcgatttgtgccttgccaagcggtggtagggcaggcaaaaagagacatgaatctaggtggcttttcagctttgccacctctagctgcatgacctcaggcaagttatttaaccttaattgcctgacctgtaaaacattgtgaacatgaatgtttgtaacactgagtaagccttcaataaatttccttttctcccttctctctttggagtattctgttattgttaaagtagtgttgggatttattaaagatgtttgaaatggactggagagatggctcagtggttaagagcagtgactgctcttccagaggtcctgagttcaatttccagcaaccacatggtggctcacaaccatctgtaatgagatccgatgccctcttcttgtgt

SEQ ID NO: 28069 - DNA, 1838 bp, Mus musculus
tccaacatccatttattcccccttggagtcagactcacgcatccccaaagaagaacttctgagagcccagacgctgagagagaagggttaggcactcccgagcctcttggtatagctggaggaagggacacgaagcatgtggttgtgggagctgtgacacttcccactgtagattctcattcctagccccaagttacctctttttctagttcctcctcgttctctgatttgtgctcgccacacagcagctgtagccgctccatgtactggcgctgcatgcggccgggcaggaagaagttgaggggaaagggcatagcctctgcataccactttcgggtcacttccacatagttcttggcgtctatccaaaaagtatggatctggattgggcagacaggaagagaaagcctgagcccgtgcacctgcctgtcacggggtgggcttctaagtctcatggctctgtagctctgctcccttctgtgcgggctgggactgctaggtctgagcgtactcactagcacaggcagtagtttctcctccagcagagacatgaaggctagggtatctgctccttggcgagctgacagatcgtagtcggcattatacttctgtggaagaaatgttcatggggtgaatattgaaggattgcagggacacttattttttcagtagagaaggaacagtaaccccacactagcctcaagcatagtagaggtagaagaaggagtctttcctgctgaggtctccttgcctcagctcagtgagtagcctgttgctgttggcagaaagcctgggctttggagcccactggctgtcaaggtcctgcacccactgcggggagggaagaaggcctggccacaaagtgggagcagctcccggactttccacggaaagctggcggggtgcctgccgacagcagctctctaacagtaacttcctgatctagacaccacaccacagagctagcaacgaggcactcggctgcaggctgggcctcagaagtcagggggcaccatccttacccttcttgaacccagtcaatttacatccagccaccccaaccccagcttgtcccccacagcaagctcttggctatgtcttgcacttcactccaaacccttgtgcaccactactgtaccttcatcgcaccggtatttccgtcttgtcttagtgtggcccacctttccaggcttcaggctgttccttagtaccccctccacagactaagaaagctttgaacctgcagagcctcttgaagatgactcttaaatttccctgaatctcagtttctcctttatggaaggagacagtaatgtttttctctcgatgtggctgggtttggaaataatttaggaaaaaaccctttggaaactgaaaaggctgtgtttatatgcaagtaacccgggtcctgccaggaacgctggcttatatctggatccggtttctccaggccgctaagcttccattacttccccagctccctggaaagtagaaatgagaaaggggattctatttctgactgtgtgttccctcttggaacaacgctatgaatgccaggcctctgagagcatcctgcctaagcaccctagtttacaagtaaggaactgtagttggtgagctgccttagcaggtaactgtccttgctgtcaggctcaatgacaagagttgcattgcaggaggccacatagcagaaggaaaggacttagtctaccaagctgtccaaggacctccccaagtgtgccacggcatgtgctcacacacacacacacaccccaaagcaagagaaataaatgcttacaaaacaaatagttcattactttgagaagttaaatcacctg

SEQ ID NO: 28070 - DNA, 1208 bp, Mus musculus
ggtctggtggggggatggcccatgggtggtgtaggagaggtggtaggagcagatgacacaagcaaagattctttactggctggaagggaaaccacagattggccaggacacaggaggaagagatgctggctgggtcctacattcccaggggggaaagactaaacagcgatgggagggtcagagcgctttgtggacggctgtaagatgtgtgtgatgagcccctgggatgggaggaccggccccagggtttggagtgtgctaaacccagcaatggagagatggtactcctggttcctgagttgtgggcaccaggtgccactccagactctagtcagcaatgtctcccttgcgccacctggtgggacataggaagtttgcgagtggctttggtatttgtaagtgggctctaagcctataggttcccaaggctttggaagcaatagaaggtgctgggagggaagcattgccttgataacaaaaaaagggccaatggttttgtttttagagatagggtcttgtagcctggtctaaagtagcggaggctgcctgattgcttgaggcagtcctctcagcctgaggctacaggcatgtaccagcatccctaaagagtttgagttttgaggatgcagttcagaggtaggaagatgataattagggatgcctcagccgggcgtggtggggcacgcctttaatcccagcactcaggaggcagaggcaggcggatttctgagttcgaggccagcctggtctacagagtgtgttccaggacagccagggctacagaaaatccttgtctcaaaaaaaaaaaaaaaaaaaaaaaaaaaaaaaaaaaaaacaaacataaaaaaaagggatgcctcacctctgagagctcaggagagagggcaggcctacctcagactccaaccacttcctctaatttttaaatccctatctggccagtaattgacctgctgacagtgggcgaatccaggcagatggtagctgtggcagagaagattcggacagctttactcactgctggggatatctacctcttgtccactttccgcctccctccaaagcaaggtggtgtcctctttggcctctactctcgccaagacaacacacgatggctggaggcctctgttgtgggcaagatcaacaaaggtgactggtgggcacccctttccagcatcaatgaccccttgagcagtctccctcatgcc

SEQ ID NO: 28071 - DNA, 1135 bp, Mus musculus
atgcttgcgacagctgccctgaaatgagcaatcctacccaggtacagaggagtgtcagggtgagggagggtggggattggaggatgaggcccagtcctttaccctgtcagttatcaggaaatggtgacatcagacccgcctctctcagacagatgcagacagcgacctggtgggggatgtctgtgacaccaacgaagacaggtagggtctgggccgagacatccagggtctcccagggatattttttttcctctcctcattttcagttgtctctgtaatgtaagcttaactcaccacccctgctaagcaggaagtcattctcactgtctaccctccattcccactgctggatggccatctcccctgaatgatggcaagggaaccaagttagagggtaggcaggccccagagagcacacagaaggaaaagatggagcccgccctctcagctgggatctgttcattttcttctgagcagcgacggagacgggcaccaggacaccaaggacaactgtcctcagctgccaaatagctctcagctggactcagacaatgacgggcttggagatgagtgtgacggggacgatgacaatgacggtgtcccagattacattcctcccgggcctgataactgtcgcctggtacccaatcctaatcagaaggactcagatggtaagactggagtcccggagatgcttaagctgatcaggttttgctcaggagacaggcctactggagggagtggaggatggaagggtagggaggactcaggaagaaccgggcggtgacagtcgctctttgcaggcaacggtgtgggtgatgtctgtgaagatgactttgacaatgacgcagtggttgaccctctggatgtgtgcccggagagtgcagaagttaccctcacagacttccgggcctatcagactgtgatcctggatcccgagggtgacgcccagatcgatccaaactgggtagtgctcaaccaggtatgcggggcagtaggctgggcaggcgctgtcagacctggctgcctgttgggacctggggtgtcactgtgcacctggatcagggctttttctcttcctttatcaaccccagggcatggaaattgttcagactatgaacagtgacccgggtct

SEQ ID NO: 28072 - DNA, 1179 bp, Mus musculus
gtgcagcttgtccagagagacagcagatgccttggctacagaaggctggagaccaagcagggcggtggcctagaatgctcttagaagcattatttcctccttgccacaagagggcgctgcacccaaggcgcgtagaggaagaagtaaagcaagtccacgttggccccgacgcctgcgtacagacaaccgcgccggctttggctcccctctttctccagggacacggattggaccacggacggggcgtgatgggtaaccgcaccggcgggatgcccgggctgctctagcgggagtgggcgttggggtggtcctcttttctccgtagcctcggtaaagctgacgtgtcctgggaactagcatttcctccggacaggcgggaacttgggtgtgcagggccgggtggttcctggaggtcgctgtggggtgggggctgggtcacttggaagtggttggtgagccaagctccggagtgaatctgcctgaatcttagcctgactctttttctcatttatagtagtcggtaccgggacctccttggcgctgtcctccctcctgtccctgctgctcttcgctggcatgcagatctacagccgccagctggcctccaccgagtggctcaccattcaggggggcctgctgggctccggccttttcgtcttctccctgactgtatcttcctcgcgctggaaggggaggcgggggtgtatgaacagaacatgggcgggagtgggtggcaagggctttgcagtccctctacttcctatcttgttgcgtgagtttctccttaattacatcacccaggccttcaataatctggagaatctggtctttggtaaaggcttccaagcaaaaatcttccctgagagtaagtgaaactcaatagttaactggactcttttttttttaaacctctcccaaacatgatgccgaatttccctgtgcttagatgataaaggagaaatacatttgcttaacacaatcttgaagacagaagatgctttcagattaagcattttattggagctggaagagaagcacaaaaaggggggaggggaggggaggggagggagaggaaaagaaagaaaaaggccaacctggtctgctctcaggacaggtttcaagtgaacagtcaagcctgggctgatgtctgataggcatccaggagaaggtgttctttgt

SEQ ID NO: 28073 - DNA, 1106 bp, Mus musculus
ctgagcgcggccgaaattgtcctaagaactacagttcccagaaggcagcccggaaaaagggcggtagtagaaagggacttccggatgctgatgcgggccttgtcagcgcggcacacggaggtacgcttaggtggcgggcagagtggaaagacggaaatgggtggcggagactgggaataaatgtcagatgcagagcggggatcggtagaaagaacccttagctttgatttttctccctgcagccaacatgacgaagttaacacagtggctttggggactggctctcctgggctctgcctgggctgccctgaccatgggagcactgggcttggagttgcctttcccctgccgagaggtcctgtggccactgcctgcctacctgttggtctccgctggctgctatgccctgggcacggtgggctatcgcgtagctacatttcacgactgcgaggacgctgcccgagagctgcagagccagatcgtggaggcccgagctgatttagcacgcagggggctgcgcttctgacacctaaacccattccagtctggacatctttcctcattccgcattaaaatgcagttttattttctaatcttgtgtagttttgagtatggaggatagcggtggggtggggggtgggatggggattctatatactagaggtcaagaggtgagggggcaggagaaccaccttaccaggccttacttagctttgcattttgatggtgttctgttcccttctcaagattttttttctgtttgaaataggatgccatgtaccctagactggccttgaccccagccatatggctgtggattatctcgattctaacgtctctaattacaggctaaacccaccatgactagactagtttatgtcatgctgggcttcaaacttggaagtccacaactgaactatatccccaaaacaggtttgtttacttgtgtatatggttttaatatatatggttttaataagtagttcaacctggcttacaaccaaccctgtcgtgctacccaggctgccctcaacctgtggtcctcccgcttcagcttcaaccttggaagtgctgcgaggcttcccatacaaggctgcgcaggaagc

SEQ ID NO: 28074 - DNA, 1193 bp, Mus musculus
tgcaaaaggaccttccgtgtgctaagatctgataaggcccaggacatcatgtgtgaaaggatgccaagtgcccagggcctaagccctctacctttaatggcaagagggtgtgtatggagtcagcctgcatgtcccctccagcacatgccactccccgcatgcagctcagtgacctcactgcctctggggccctgctgccctctctgaacactaacccctttctgcccacatctgtctgtttcctcttgcctactctgcctgtctgctcctcctgccttctcagcaagctagtgtggtcagctttccagtgcccccctccaggccgctgccacctaaccccgtgcccaagaaactccaggtaaatctgggctgggccttgccctggctcaggacaggtgggaggtgtggtgcccaatcgcagttctcatccctgcttccccccagtggtgttcttcattaggagaccagggtgccccctcagccttcaaagtcccagatgcagcaaagggtgagcctcccgccatggtctctactaccacctggtggtctatagtaggactgcagccatccagggactccgtgatcgatctgcaccttccttccccggggctctgcgcatgctcccgttttcctctggacactcccacccccaccctcggctgagtttgcatgtcgacccctgggtagtgtctgcacgctcactaccttggaccatgctttccaagccactgctcctctctttgttcaggctgcgctggctgaccgatccaatccccccactcgccctctgcccgctgaccctgtggtgaggcgcccaaaggtaacagtgagggggaacaggacattgcctctcctacctagagcaatggtggcaatgggagacaggttgcctccctctgtgcctgacggcatgtatcccagtggcacctttggtagtgacaggtttgtttggagacaaaagtgaccactagcacggctcttagaacccctacattgtgggtgagaaacatgacctctttccaaactggccttctttctcagtctcaggggcctaccaaacccccacccccaagaaagccactgcctgccaacccacagggccagcacccaccaggtgacctgcctggcccaggagatggaagcttgccgctggtggtgccctccaggtaggtgaagagggtgttgctgaggtt

SEQ ID NO: 28075 - DNA, 1673 bp, Mus musculus
aggagggcagggtggcctgattggctcgcccgcccctgggggtagcagaaggtctccgcccagctaagggagctctccacctcttccctcccgcgtcccggggcagggaatgtcttgttcctggcgctccctccctggggccagagggcagggcgggccgggcgtcttaccctcttctcctccctacctccccgcccaggtgcaagcgggagccgcctctgctgcttgctgcccctgactcacgccgcccccgggctggcgggcgctgggtgtgggatggggtgaggggttgaggtagccttgtagggagcggacaagctagcgccatctggtggccatgccctgtaagggcgagcgctaccccccaaccccaccccccagcgaccacttttcatgagctagggtcacacccagccatctaggcctgtgaacgggtgcccccttgccaacatggtggctaggcaaggcaactcacttgcccctgggaaaagtgagctgcggagcagacccagaggtaagggaacctttcctcagaccttgcctggcactcttaggactgagtccacccccgttctgtacatagcctcttctgatggtcttgttgaaatccaatttcacatttttaactatcagttttcctggggtggggaagagtcttcaccccaccccttcctcgctgggtgctggacccccattgcggcctgggctctgccttgcactatttacccctttggcctagtggcccttccccctcctggaaaggggcaggttcaggggcccggtgctctcctctccccatgcacctccatgcccatttgcacagctgcccaggtacccccaacagtggggaagggccacacagggaggggtggcgggaccagtccctgtatctatttaaaaagtgatgatgtaatatattaggagggaggtcaggtaccctgggcctcatcttagcatttcaggtgataggggagcccagggctggagaaacctggggcttagtcccagagagtggagacagtggcctccactctctctccttgtggcttccccactcagtgccttagtgggggaacgcattcccctcccccattcccttcatctacccctgcccctgcctcgggtgtaagtgacaggaagaaataataataatttaagattcatatttgtgtccacttttggttcctttattgggggaggggggcggcagtgggaggggtcgggagggtctgaggctggggaggggtcttgtttggggacagggatttccgaagtggtgcctggggttctgggagaaaggggaggcccacaaagccagatgagcttctgggagatgctgtggacgcttcctctgaagtcactgctttctgtcctggttcctgggaggagaggaaggaccagtaaactcaaagtcactggtgggtaacctctgccaccgtcccagctcgggccctaactgccgcccttctggcatccatcccagttcttcctttcctctcttctttgtttttataactctgtctctgttttgttgagacggggtttctctgtgtagccctgtccctgtagaccagactggtctcaaactcacagatccgcctgcctctgcctcccaagtgctgggattaaaggcgtgcactaccacctagtgctctgaggacctggcaactgga

SEQ ID NO: 28076 - DNA, 1101 bp, Mus musculus
ggactccagtacctagcctcccagaccagagcatcttctaaagggatcaggggatgggaacaatgaaatgcaagtctgcctaggatcacaggaagggggggcctgcagaagcagggtagagccatgtgagaaccaggaaggtggtctggatctgctgactccgagtgaccctattcacttggcactgcacccggaaagccagttgcttcgtctgtctgaaccgcagttcccttgtgcatgacatgaaaggtggtttgggagggtatgggccagaataagcactcgcgctcttttaaagatttatttaatttacatatatgagtacatcaccattggtctcgtcagacacaccagaagagggcaccagaccccattacagatggttgtgagccaccatgtggttgctgggaattgaactcagggcctctggaagagcagtcagtgccatctctcttaacctcaccctctacttgaccctgcaggagaagatggggagccccgaggatgacctgattggaatcccattcccagaccacagcagcgagctcctgagctgcctgaacgagcagcgccagctgggccatctgtgcgacctcaccatcaggacgcagggtcttgagtaccgcacccacagggctgtgctggctgcctgtagccactacttcaagaagctctttacggagggaggagggggaaccgtgatgggaacagggggtggtgggacggcttctgggggagcaggggccggtgtgtgtgagctggactttgtagggccagaggccctaggtgccctgctcgagtttgcttacacagccacactgaccaccagcagcgccaatatgccggctgtactccaagctgctcggctactggaaatcccgtgtgtcatcgctgcttgcatggagattctacaaggcagtgggctggaagcccccagccccgatgaggatgactgtgagcgagcccgacagtacctggaggcttttgccactgccaccaccacagcctcaacctcaggaatgcccaacggtgaagacagccctccacaggtgcccctcctaccgccgccgccaccgccacctcgacctgttgcccgtcgca

SEQ ID NO: 28077 - DNA, 1115 bp, Mus musculus
gcctccaggtgcctgtcattaaaatgggcacaggttgggagggcatgtatcgaaccctgaaggaagtcgcctacatccttctttgttgctggtgtatcaaggaactgctggattaatggtggcagggaacacctcctgtcacccctgacaccaagacctgcatccctcaggtggggaggggagggcagactctcaggaggtgtggctgcagcttctggggtggaacctgcagcccagctctcccatcttttctatagccctaagactcctggagccagctggccttcaccaaggatgggtcacaaagaactgaagaaagaaccacgaaccttgctctgagctgtccatccatctgacctgcctcaccctggggaatctctcctcagctcccatctctgctgtgctcctggtacgcatgagcttggctcagactccattgagactacggcaggatctaatattcctccaaaaattggcacagtgagcccaccaacccacgtacttgaagaactaggaatggactgcccctgaaatgcctggtaatcactccactataaatataataaataggcctcgaggccaaaaattctgaacattcaaaggggaatgagggcatgtgtgcttggaaagggcttagagccagagagcaggaagaaggacagatctcgggagtagtgagaccaagaaccagctttgctgaatctctgttgccaggagggaagagcaaaacagaaaagccatgttcctcccaacttttgtgcagagaggacagaatggagcaagccctattctatgaggcctgggatgctaggatgaggacccaaagactcagccttttcccagaagatgtgacctaggcagctccctgtcctaaggaacacgggaagtgtactcagctagtcccagttcagatacactaagacaccctaagagaaagcacccatgaggtcataccaccccttcaagcctgtcacagcacacgtgtgacagcacataatctgcgtgagtgaatggcctcctgacttgccgttggcagccaccagcacttgctttctttgaactgttagcagcctgtgcacatgcgtatacatcaacttgttcatgcgccatcccca

SEQ ID NO: 28078 - DNA, 1201 bp, Mus musculus
gaggggactctttttaaagccacatatatcctggtgatggcccctgcaaatcactggatctgttccagataagcaaagacagttaattctattgtaacacttctgtgcgtggcagaaagggcaggctctcgggctgtgtgcacctgcatgctgtgaagagtccgtagcactgcactgcgcagtagcatgcactgtcgactgctcagaatgctgggagtttctttcttagatttcactgtttcttccagaacctcacatcttactgttccgacggccactgcccaagaagccaaagaaatgaagccggcgaaccgccttccggcctcgagcggtccacagctgtcctcactccctgccatctttctgatcgcgtgaccatgttgctttcttatttctcactttgatatgtaaaggatacactgtttgaatgtgctggtacctgctttgcttctggagttgagccaccagtgccacagccctgtcagatgagtgtgacctcaaagccctcgtgtgcgcgggacccagcaggccatattagtcatttggcagaagcatgtgaaatctagatcatggctgttacaaggatggtgtgaatttgctgacgtgttttttactattgggtattgtatttatgatgacttatggatttatgtttcaatgtattggaaattttgcattttatctgacagatctcttccatgttacaagccttgattaaaggaagttttttataatcttaacgctgtggttataagactgtcccatcctgtaccctcactccttcatttcctctgagccatctcctctcctgcacccaagtgatacacgatggaatcattctgactctatacccttcaggtggataatggaaacttggctcattgcaggaaagaggtttagttgaatgttgcaataactaatttataatgttctaattggactcactgtaaaagcattcactgaaatgtatttcacagattattagcctaagataatgattttattggtacagccttgtcccatcaaagcagatgaaccgatttacatagtccagtcgtattgtcgtttatgcagtcccaacatgtgaacacctgaagagcatgcaaagacatgggagtgggattaagtgctacataggactccagcctctgtgagtaatggctggggctgaatttcaagtactgagacctccaaagtcatt

SEQ ID NO: 28079 - DNA, 1682 bp, Mus musculus
ccgcataacatatcccactccctctgcttccccttaaactttgtgcctttgactatcataggtctgcagatacttaatgcagagttctcaggcccttcacgtgtggacaggggttactgccaccttggcttctggagccctgtcctattcagcaccccttcctgtgtctagggagaatagggacaggagtggccgctatctgctctgcctttcggatgtgcagcccttaagagattgccccaagcctgaatatggtggcgcacgcctttaatcacagcactcaggaggcagagacaggaggaattgtgaggccatccgatctacaacagagtgagttccaggacagccagggctatggagagagaacctgtctccaaaaaccaaaaagagcgattaccccagagccttcttcctgatggtagcggggaggggcaggactggacccatcttgctcagtgcctcctgacctcaatgcctttcctccaaggggtctgtatacatttctcaagcctgctcctcccatgtttgcatgtgtgttatagtctacagccaaagtatagccctcactgtaaccccatcctgcctccctcctttgggataggtgtgtgcgtctgacttgggcctccagggtgtgtacagtcagtgtgggttttgtggaggcaataagactgaagcagtagacaatccccaataccatttgcaggtctggaactgcactctcttttttaaaaaacatgtatacattttagggctgtagatttattttcctggttttgtttttcattgctgacttttgagcacagaattatgataatcaattacatttatacatcacctcgatgacttttccaaacttttatttttttttttaaacaactgttgggattttactccctggccttaactaggacaggattgtaccccactcctcccccccccctttttctttttcgccaagacaactgagcagaaatttggctgagcagtgttgtgggactatgatgtgatagttttagatcctaccttctgctttcgggcagctgcagccagcacagaaaccttgcaagctcactctgtgtgtaggctttctggacaaggaatggtcgccaaatttttggtttggatgtcttataccaaagggaaatagtcttcattaaagttcgtatttcttttacctcggcctctcaactcctctggaaagtctgattgatgggggctgtctgtgggaggtggtgacggaccccatctgggctaggtccagtgggctccaagccagcgccagcccgcaggcaccagtttgcagagatttggggagctgcgaggctgtgcggtagggacgtatctgcaaggcgactggctcgcggcgggaaggggcgtgtccggaccgcccccaggcccacccgcagctcgcacggcccctgtcgagtggtgcgttccactctgctaccgggctagctgggcggcgacaggcgcacttcggaggagtggcgtggcgaggcccagccttcctgggtgcggcgtctgggcccttccctgctttccctccccaccgcgttccgtggtggtgacccattggagttccggttccggttgctgtggctgcgggcgggcggtgagtctggagcaggcgcgcagttggtgcaacggctctgtgctttccccctcggcgtggctagggcttg

SEQ ID NO: 28080 - DNA, 1621 bp, Mus musculus
ctgcagagtggctctctttctttccttgtcttccaccactggcatcccatctccatggagcagaaacatgtttcctggaagcagaaaaggaactgaggcggacaggcagaaaagcctgggttgcttgtcttctgttgttgttggttttgtttttgtttttttctgggaacttgtgcactgagtaccttcagagatccaggaagctaaagcctggttgagcagagccattcctagagtctaaccagaggctgcaagagaaaatgggctggaggaagttttagagagcaaggatgtcctgtgcgcagatgaccccaacacccgtgcctacaatacctgtatagccccatggctgctgctgtagctcttggagtcgaatgttcaaggttccttggctccctgaggtagagcccctttccttgggttcaggagacaaatggggatttctttctttttctctgtgtccctttgcttcccctgcacctgacttactccattcccctcggagcaccaaataccttgaggaaataggagagttcctgactagggcagttgtctgggcttcaagactgtaggtaagagatgctgagaggacgtcttcctcataccaaagtcattgtcctctctcagcttctcttgtggttgtttctctcagtgaccatgttttgccaaaaattggtatatgtggtctgagtgaccagagtatttgaagttggggctcccctagaagtctggactgcaggtgtaaccccccccaatctggtgcacagtgggacagtgctacttttcagctcttggtgccctcatatcctctgtctccagaaaacatttgggaaggcacgaagcccttatacctcactccttcccctgatgaaaggatccaagggaggccctgccatggctttggggacatggggccgagcagcaggaccctcaaagccatggtaccgcaagctggaagaacctgaagtggtctgcttagtcttttttatcctgcgatgtcatcgtgggcctggcgatccagcaattaggctaggtttatttttggttttgtagcactccctgccagagatgggatcgaggcctgatcaggagcctctctcagctgctcttctttccagctaacccaaaagtccattcctcaaatgggtggggaaggcaggcttgggtgtggccctcctgagagtcggaggtgcccagcttgaccgcgaaggctgccctctgggatgtcccgtctcagccctcacgctccctgcatggggagagagaagactcaagagttggcagccttggaagctgaggagggcgagggtggacctgcttcttactctgccccccaattcctaaactacacgaggcagcccctctacttagctttgtgttgtgctatggttttgttcgcccatgttacctgccgctacttttgtgttgtctccatggtttgtaaaatgctcccggggagggcccatccccttgttcttctctgctaccttttggaagaaagtgggttggcagggatgtggttacaggatctttttgtacggttggattaataaaatgacttgaaaatccaaacaaggactcctttgttcatccgcagaaccgttaggctgagcccctgcta

SEQ ID NO: 28081 - DNA, 1194 bp, Mus musculus
caggtggggtggcctcaagccaggtcattctccgcagtgtggtgtggtgttcttatcctcagaaagagagctgaagggaatggagtcagtgaagcaaggaagcagacattctgtttctgccacacaagaatcgatcccttttttggagcgtgctgtggaggacagggaacacgctaacctgggtctgcagaggtgagggagccactaggtggcgctctggcttcacatttctctagacttctccctcctgcccctggtcaccaccccacaccccagacaccctacccattgactagctctcaagaattcccagaatccccctggttattcttcaggaacgccccgccccctcagttcaaacctctacgccattggtagcacactgggcttctagctctggaactctcccagggactctagggggcagtgaccacacaggtcaggtcaattaaggaggggattaaggactgtaagcttactgggcaatggtgatgcacgcctttaatcccagcccttgggaggcagaggcaggctgatttctgagtttgaggccagcctgatctacaaagtgagttccaggatagccagggaaacaaaacaggactgtaggctctagaaagtgctggaatcgattttgaattatttagcaatgcttttatgtcactgttaaaaggcttttaagtgcagtggcttgtttaatttccgtgctagacaagacaggtagaaagggtggctcattccacaaatgtttaaacagtctgctgtgtggtgctggagggatggctcagccgctgagggcacaggctgctcttccagaagccccaggtttgattcccagcacccacatggtagctcacaaatgtctgcaacttcagtctccagggatctgatgttctcttctggccctgtaggcaccaggcacacacacacacggtacacaaacatacacgcaaaaacaaaaaaagatcacccatcaccacatttcttgaaaataaaagtctattgtgtatgagaaccaggtagtgaggccctaggcctgtagaccctttaatatgcatggaatctgcagcagcaggagctctggttagacttaaggcacattaccttacacaggtcagtgttgtaggctgggggctccaggaaggagccgtctggtttagaaagacaattatattccctgtctctctggaccag

SEQ ID NO: 28082 - DNA, 1225 bp, Mus musculus
agactcatgctttacaactcccgtgtgaatgctgctcttcccatactcatggcccatgagggccttggcccagacaagtcaaatctctttctcaaggccctgtttccagccctgaggacacagcctcccagcaggctccagcctgggctaacagtgtcaagccctttcgggttgtctgcagttgttgatccagtcttctctcagtaggcgatggtcagagcagagtgatttcatcaggggctgcctgggagctcagcccctggtgggaggccacacctacttcccagaggttctcagaggagaggcacagggtggagggctggagtctgactcctctgttcttcctcccaggggtggacgatgctgagtcagagtgtggtctggacaactttgggaactttgactgggtcattgagaaccacggagatgagcagtgcctggaggatcagctggagcacctgctgggatttattcaagccaaactttagtgatgaggcttgaggggacgagcagagactgatgggcctggcgaacagtggttctgccagatgtgggtccccagtcccagccgaggtcagcaaacagacagacagtctggcttgccagaggtctgggcaggatgctcgtgagtagtgggcaaataaagaaacctctggtgttgtgttttccctggagaggacactctgcctctttagggcacttatagggcaaaggcaggcgcatgagttttgcctgaggcaggaacattgccacacccatgatgggcaggctgcagagctgtgatggtggtgtttccctgtgtgtacgctctcagccctggagtcctaataaacttacttggatcacagctcagagctggagactgatgatttccctgacatcttggaaaacctgggggtggaacaaggccatggtggcgcacgcctttaatcctcatgcagagaaggcagaggtgggcagatctctgagttcgaggccagcatggtctacagagtgagtttgagggcagccaggactacgcagagaaaaccctgtctcaaaacatgatacaaaacaaagaaagaaaggaaggaagaaagaaagaacataaatctggggtattggggtaggtatgggtcccactctgccttgtacttggctggaatgaatcctgcagaggttggcctgagcctaaagcctgggacaggtctctgtgttacaagtgggattggggtctgtagttctt

SEQ ID NO: 28083 - DNA, 1190 bp, Mus musculus
acggtgaggacctcgcttgcgccacgctgggggtcccttgtctggtgatcgaaatcacaccatacaacctcctgctctcgaaggacccggaggccagagcccccctcttggtgcttggctccttctctccaggctacacttgtttcttcagcttgaggttctgtggtgcagtcacagtctctactgttgacccctgagagcaagggacatcgggacatgtggcccctcaaccacctcctcctatgaatccacccacacctcaggttttatgattttggctccttctgcttactcctccacaactttaccatgtcacctagaaatgacccattcttctccccaccccaactctaataagattccaggcctgtgctggaaggacgtagcctggaactcagcccggttccataatgacccttctcagtagttctttccacttatatgtacccacctgtaggctccctgcctaggcatccctcgtacaacccctctttgctccctgaatttcactaaagaatagtgccgttcattgaccccacgttggatctcctcttactaactctggtgtaactaacctttaattcctctttttgccttggctcgtagcagctttgccacttcctccccactcctggggtcacatctgcttatcctaggtgactgtcaccttttctggtggtgacagcaatgtgtgttttgagcggcagcagtgccatcgctccccagtaggcatcgttccatcctacctatccttggtcaggaggcatcttccatgcgtcctgccttattttattccctagtgtcccttgaggaaattgttgggtgcaattttataacagctggtactgcgcgatacagtgctcacgttgttggataacgcccactgtaatggtcttgtccctcctggagcacctttatccacactggaaacgggagttgcctggggggaagacagacgtgaattttgtggttcttggaggctttgattcattttttttttcatggtgttttctagccctttctgccaccaaaccaggtcgtggtttggtgaggtaactttgggagtggagtaataatgagatacttgagttttgatggggcctcatctatcccagctgaggcttacctcaccaagctaggaccaccaggagtggctcagtcaagtaaagattgtagcatctttggtactg

SEQ ID NO: 28084 - DNA, 1128 bp, Mus musculus
agaagacagtccctttcttggtcctctttgtagctctgctgctgtggtttaggaatttagaaaggaaagaaaattaccttggaaggccagacttgacataggcctttaattcagtactcaggggtctgaagcagtataatccctgcaagtttgaagctagcctggtctacgtagtgagttccaggacagcaaaggctacacagcaagaccctgtctaaaataaaagccaggtgcacacctgcatccataacacttggcaggtggaagcaggaaaattgggattatccttgctttataatgagtgtaagactagtctgggctatttgaaactttgtttccaaaaactaaaaacaaacttgccttaatagggctgagctgttttctagaactgggaaattactgctaagaccatggggggagggggggtggcttggggctctgggacaagtggactgaggaaaagtctatccactacttttgtggtaacattcctttgcactcctgcctcaggatacagaagacctagatcactatgaaatgaaagaggaagagccagccgagggcaagaagtctgaagatgatggcatcggaaaagagaacctggccatcctagagaaaattaaaaagaaccagaggcaagattacttaaatgtacgtgccttgtagagaggcaaggcaaagggttgttgggtcccggctggggagtggcaggccactgcccatcagtatagagagccgtctcctttattggatctttccagtcctatccctagtccagactgccttaaggtctacccaccagactaaggagtaatggtgtttcccctcgttcccagggtgcagtgtctggctcggtgcaggccactgaccggctgatgaaggagctcagggatatataccgatcacagagtttcaaaggcggtgagttcgcacaggggctgcacaggataccctcaaaaaggacacagtatgaagatggagcagtgggtaaaaacacttgccaccaagtttcaggacctgaattcagtttccagtcccacatgacagagcctctacttcatacccatacacgtgtaataagcatattaatgtaattatttttaaaaggatacagtatgctggtaagga

SEQ ID NO: 28085 - DNA, 1241 bp, Mus musculus
tctgctttattagattatctaagaaaagacttgaactttggattctttctagccattcccaagttgtgggtctactggaaacagtagctcaatgtggttgcattgtgtagtgggacctcggctcagctccaggaactgcacagccggggagaagtctgcagagccacagctaccagtgttggacctgctgttgtgagactgcacgcagtacatggagcctgcatctccctctttgagcttgctgtgggaccacctgcctgcagactggaggaagactgaagtgacagaggcaagggacagccaagccaagtcctggagcttaggaaacccagccctggaacagttgcctggatgtttgctaatgcttctgagatgggcattcgagtttggccatcttcccccactccccatctcttctagggatttgaatgtcttgctgctttagggggatggagagttcaccagtcctacttgatgctgctctaattctgcctacacccaccaggttaggggtgctaatacatggtgaggttgagacacagaggatacaaggggaataagtcattccatagaactgaaatctatctcatagcctgtaaggcttccttctgaacttaacaccagccagggctggcatgtagattgtgtttttagtaacgtgtactgtgagctgtcctctgtataatgtattttgtaatgtatttttctcatctaccaaaggatgaatcaaataaagttatttaaatagtttggctctaataaacttatttaaagaaaccatgggttcatgtccacttgctatgatggaaaatgccaggttctgggaactgtgacaccagctcttgacaatcctccattttccttaccaacccttttctaacaaaattttaagtttaggcttcttataaagttacatgcatttaaaggggcagatttcttctctgcagtcggaaaagcaaggaatttgtatctctgacccaggtaactttgcctgggttgtagcccacagcctaggggctgcttttcggtttccatgccacagtttagagggcaggacagggcagcaagcagtagccaggagaaggtatccgtcaccccaagcttgagccatgacaacctttatttgctggagtgatggctcactgactctacatgcaataccaaaaaacctaggcaagggcccttccagcctccccaagtctgccccggcatccaaagatgaggaaaatttgctcagctgc

SEQ ID NO: 28086 - DNA, 1147 bp, Mus musculus
cgcggcggcctccagcgtccagccccggggaatgcggcggcccccggcccctggcgccccacggtgtctcagctgggcctcctcactcttctgctccgcggcctcgacgctcccgggccccctgatggcggcgaaatggttcaaggagttcccgcttactctgaagaccgcgtcggagcgcgcccggcccgggggcgccggcggcaagccgcgcaagaactcggagactggcggcgcggcgcccaccccgggcaagggccggaagaactcagcggccgagctgggggccagcaaggcgagcagcggacccccaaaggacagtcggctgtcccgggacagcctgcagggtctgatccaggccgctgctggcaaaggccgtaagaactcccgggtcaccgccaccgccaccgaggaggagccccaccgtggcgcggtgaccaagagcgcgggctgcagcacctacatcagtaggctcatcaaggtggacacgcaggagaagaatgggaagagcgcctacccgggcggtggcagcaccagcagctccagcagctcctcttcctctgcgtcctcttccccgtcctccctgggccctgagctggacaaggccaagataatgagacagcaagacacggtaagaacacagcatctctatcctcctctcagttgtggaattggaagggcttggggggggggggcggggaaggacgcatgggaacctgatgaaccccaatattcattaggcataagtgaagttgaagatgttttctaaggccttcctctgtattcattctgactcccaagtgactcttcaaaactcactggagaccttgacagcaaggtttgttgtggttggtttttgttagttgtttcaaagagcagtcgaagggaagggaaaggaactggccttccaatgggtgtggtgtactgtggttcttgttttcatgtttgacatcgaggggtctatcaagctagacttctgtaaggcttacgccgcctgagtatgcaaaacatcggtagcccgtgaactgtgaagcgcaggttgcccatcttccagccactcagtttcagctgctgtgcaagcggcaaaggcttccattcattctgtggctgtactgtacattcattctgtttattgtactgtagccat

SEQ ID NO: 28087 - DNA, 2131 bp, Mus musculus
cacgaaggctgttctcacagcactgacaatcattttggcttctatgtgtagtgcagggctctcggtttaagttttcagtagccacaattccgcccagcaaatgtcagtcatcatgtattaccttgtatctgtgcattgttcactgtgttgaacctagtttagctcagcattctagccatgaagccttatttttttgcttagccctccctattcagcaaatggagccgttgtctttaatggtaagaatatcataaaatgtttctgggtggggaaggatttgggcacacgcctcatgactctgatgaacaccggcctggcaggtcggtgtcacctggcctctgccacacgcctgagcgtgctccctccatatttgctttacatgagtgaaagtggaggagacagagtttatatatagtccagtcttcatggtagggcatggggctataaaaagcaaaaatactgtagactagtggaaggccagtgagggagatgttaaagctgctattttcttcttaggttgtgacacaagctgacaggagccaggggactcacagctgggtggtagcataaagtaccctatcctaccgtgctaaaaacaattaagcgcagcagggtgtcctaaccactcactggtgagcctgccagctggggcttgtcctccgagctccaaaagattgagctttttgtccttttcttcctgataaaggtattttcttgttatctttattcctttgaattgattctgtctggggggggggtgtttcttctggtgaaccctcaagatgctgtgaacatctatagcatctagagagctgtccactttttctcctttagcaaaacttatttgtaaaaaaactgctttctttgttccagagtatggacttagacagggacccctgagaacggaaggcatctgtaatccatccagctgtccaggaggtccaagagtccaaaactaaccttggcaatagagcaagggtgtctccaaaaagaatacaggaaggcaaagggcatttctacttcctgtaatagcatagcagattctgtccagatgtattctaatcactgtctgagggggcgctggccagtaggatgtgctgaggaggcagagacaggaggagttgaattagaggttactcttgggttacaccttgggccaaagaaatggctcagaggtggaaaatgctgcacttgtagaagaccctggttagttccagtatccacatgctgtccaggtctaggggatctggcgccctcttctggcttctgagggtactgggcaggaacatggtacacatacaagcaaaacattcatgcacataaactttttaaaaacctgaatgaaggaatagaaacaatggaggaagtctagtgagtatgcacaaaagcaagtggtggtaaagaaacaggtgtcccttccggttactgagaatgctttaataggcatctgtaagaacagcctgtattgttggccgtttagagtctgcgtctgtggtgctggagttcagtcactggtctctgccacaggaaggggagctgggcagagaaccagtagggaaagctggctcttctcaacacaggtcctaccttaatagtccttgtttggtgtttagattatttaccagtgttgcccctgttggataggtcttaatgtttaattcaagaacaactgtaagtcattctttgcttactagatgagtctgttaacattttcgttaggagctaatgacttatttttcctggcctcagtcaagaagccagtgcatctagattcatgccccctgtacatgcttctgaaacttaggatttcattgctcccttcctgggaccagacagccattggtcgtctttctgtcttctgtagccagcacccatttaaccgtaaactcccttgggatcaatcttttgtcttctctttgccacctacatcccactaacttggccttgaagaaacttgacctgtaagagccttccctgtaatttagcttcccggcttcatggaccctatgcaatgaaagatggtgttctactgccatctactgggacaagaaaaaaactgcagttgagaaacaagggtgcatttagggtagtttgtctcaaggatttttgatacagtccataaatcaaaata

SEQ ID NO: 28088 - DNA, 1114 bp, Mus musculus
cagatcgtgatcttcaggggatcggcgactgtgctcactcacagttcttcagtccctcacagggctctgctgttacccaagccaggcagagcaggcagacggaagactgaaatccagatagctcattatctctgtgagttaaatggctttgatctccaagttgttttcactattgttgtaaggggatagcctccccccaacccgtatcaaaaggatgctttttccttttgactttttataagctaagtcaacaaagtctgtttcgtccggtttcgttcacttcacacaggtgtatgccctcagctgcttctggtctcaattctgtgcaagctgaataggtgttccatcctcgggtcattcttactggagtttctgcagcccacaggctgccttgtcaacagtaccacttaacaccagcattcagcgaccaggcagccaaatgcctggtctagacagagatgatttaaacatgatctttgttgcatggtagaaagagggaacacatactggttctagttctaaggttcttagatgtttggtccttctggcattagtgaaatagctttaaactatttcaagggagaagccttggccacacccacgacatttggccgacagtcctttctctccatgagccttgccttcccacctggctgaaagctcacactgaatctttcctgtgtccttggtgtcttgggagaaagggaaccccggtgtgggctttactgccggcattggcttggagccagcgtggagcagagcccaacagggtgggccaggcttagttatggtgtgccggtttaaggaatgcctggtttgcctggttgcctgggctccgagctagagtttcctagtagttctttatggctgacctagttgggaaagactcccatactcagcttcaggtagaggtggtgagaaaccttttcctttgtagaggcagcatcatcccaagagcctacagtgaggtgaggtgggaggggcaggcgctggggagggtctgccaaagtgggagggggcaggccagctggggagggtctgccaaagtgggagggggcaggccagctggggagggtctgccaaagtgggagggggcaggccagctggggagggt

SEQ ID NO: 28089 - DNA, 2033 bp, Mus musculus
ggactgctctgtgagcctcaccagcttgtagaggtagagggagtagaccccagggacagcgccggttcaagccttggatggggccacagtgagggacaagatgtggaaccaaaaacacatgaaaaaagaactatgagattgggtccagccctgtcctgcttggagtccacagggagactataatctccatatttttttactcctattccccagaggggcccttgcgcccttgttcctgaattacacaagaatgtatcacgccgggaagccagagacctgctggggccgccaagccccctcatatcatcgtgtgtcctcttggtttatatttgtgttgtttggttttgtctttttttatttggtaagtggaggaggccttcgtgtgactttgtgttgtggttagtgtcttaactctcctgggaagaggagactggcacacactgggatgccctacctggtggagtagcttgggagggaccaaactacttaagggtgccagtgtcctgatgggatgcagaagctacagatagggatgaactgtcagcaagaggttgttgggagaacagaaaggaagcatagtcctggctccctcctcacctgtgctgtggcctccccagggcacacatacgggttcttggatctccaaagtcctgctagtgctggactagagcccagatagtggctgcatcattctcagtaagccgtagctgataggaagtgtagtcctgagacgggaaatagggtttttggattctgaattgagtccccaattccttagcgtactcacttccaacttcccttccttcctacccctcattatccggtgctttttctacctatccctgaggtgagactgaaaagggaagctgacctctgctgctttggcccagtaacctagggctctgtcctcaggctcagcctccagcaagagtgctaggagttagataaaacctgttcgcccggagaccacttgcccggtctggacagagcatctttggacccctttcacagcccagctctccaagtcaggtacatattgagcttgttgttacctgtcgcttccagaggaatctcttcctcttgtttgctagcagcagagtaaggaggaagactggcgtggagctgggactggtggacacagaatctagatgtcccatgcagttgccccaaaggagctgggggtgaggtgcagggaagtggggtgcaggaaggaagggaagacaagactggggaatctcttttggtcatacagtttacaagcccagtatcatgtctgtttgtctgtctcttaaaaggaaagtctgatttttataccaaagaggaaatgatttttttttgtatttggtttgtctatattatataaatacatattatatatatatagctatatatatatattatttttttgttctctctcattttttagggagggaggaaagtaccatattgcattgagctgtaattaaggaacattctgtataatttatgacatttctataattgcaaaaattatatcattttatggatataaaagaaaaatgcctttttataaaattccaatttctgagaggtgagtaatttgtctcttttctttgatgtttaaacaagactgtgggtaaaagcacaggcagaaaccctccaggggttttgtgggtggatctgagtggaatcagagtcttcagggcaactctccccagtcctgtggcctgagttccaacagctccgggcagcgagagctggcatgggccaacttactctgtgtgcatgctcggtgcacatgcgatgagtgtgtgcatgtaccctaggctggcctccagctcccagcacagctacagatgaagtctgtcctgcctctgcttccccagtgctccagtgcaggctggaccactgtgacaggttaacgtggttaggatttgaacccagggctcggtacattctaggcaatcgagctgtatccacagccttcaactttccttttaaattttaaagccttttcattttgacgtaaatagaaacttaccaggttgcccagg

SEQ ID NO: 28090 - DNA, 1215 bp, Mus musculus
agcaggatggccaggtaacagcccttccctcctctctcctttcccttcctcttccttcctatcccttaaaactacctcccttttccttttcttaaccttccttaccaccaccttcacccagccctcaccagtgccagccaggggcacacagcacatacacaagcgcacataacatgaacagttagcaaaggaaacatgaaagaatgggccagattgaaacccttttatccggttcctttggtacctttctcctccacctcccatggcacagttgtccttatcctgtcagacctgggtcacaccttccctctaacctctcccagccttctcccttccctgacattatagctttcccttctaacagtggagttctattgtcaaaagtttgtccctttattttccatatatcctggttctgcctcagctaccatatttgcagatgattctctgttgccagcgccagcaggaggagcaggtaatgaaactgaataatatgcttgaaccaacctttttagtccccatttcacctccacagcctcagataacttgaaaagcctacccaatcacaaatcgggatacacaaacagaaacactgtgctaagctctctggcctccccatcctctctcttccttacccccctcaacaccctctttatctttctaccctcctcaactctggaaagcacttggttactagaattgaaaagattcttggggcagcatctggagcctgatgcctcaggtctttgtggctttgaattggtttcacattaattaatgtgtggtggtgggagaatctgaagggtggtaaaagagacctcttaagattcccaatgtaggtggctgggcaactaaaatagggcttttttgctctcaaagatagctttctacgtttcagcattcacagagatgagtgagaatgtaatcaccttgtcatcactcactttgaaaaggtcagaattctcatagttgctttgtttgttttttagacaagggcagtgggtagtggggaagtcaactgaacaagaatagaaccaactcaccattttatctccaaagttttcttgtccatttttcattttcttctactttaaggtttaaaaaaaaaaagtcaccttgtaaaagaggctatgtagaccaaattttctgtgcttgaaaagtaagcttcatagtaggttctaagtaaaaaaaaaaaatgagagagcatgactattt

SEQ ID NO: 28091 - DNA, 1180 bp, Mus musculus
aagctctagtactgaactatactcccaactttaatgggtgtttttggtttttagctagtccatcttttcgctagaaatataattggttgttttggttttggcttttgtttttttggtttttcaagacagggtttctctgtatagccctggctatcctagaactgactctgttgtagacctggaactcagagattcaattgcctctgtctcctgaatactgggtttaaaggtgtgtaaagtcacctctacctggctgatttttgtttgtttttacatgactgaccaatcattatcttttcaatttccctcaactattgttatccttcaagctttggagaaacaagggtgcattggagatgatagaaaacaagatggcaaatgaacattgggaggtatcattctggaagcctctttgcacattatagagtgtacagctgcccttcttttcataggcgacctcaccaaattcggccgcggggatgcctcctccccagccccagccacaaccttggcccaaccccaacagaaccagacgcagactcaccacaccacgcagcagacattcctgaacccggcgctgcctcctggctatagttacaccagcctgccatactacacaggggtcccgggcctccccagcaccttccagtatgggcctgctgtgttccctgtgagtaactgagtggttgtggtctccttgtaagggatccagtcctgagcaccatcctagatgctttcacagctacatgactccttagaaatacatgaggataacttgtacctttggcccatttctggcctgggaataaagggtatgaaatttttaattagaacaagaattgcctgatagtagaattatccaaaagaggactatgatactgtgtgtctttgctgcccctcctttccctgtaaccattgtctctatctctaaaccactctaccttttgatttcttgggtcaattctaaacattagtgtatcagttacttttttgttaatttataataccatgattaagagcaactcacagtagaaagttgatgtttggcttacagtttgaaggagagagtccataatggtgaggtcccaggagcaggaagtagagatcaagaatgcagggcagggcacaaaccctcaaatcctatcccagtgatgtacttcctccagcaaggctccacctc

SEQ ID NO: 28092 - DNA, 1160 bp, Mus musculus
ctagtattagtataggacatttccttggaatgtatcaatgtcactggctcataacttgtgtttcttcttgcagatctgaagagtgcaaatgattcaacagtgcacagtccttttacaaagcgccaggcattcaccccatcttcaaccatgatggaggtattccttcaggagaagccacctgcagtggctacctcgacagctgcaccacctcccccgtcttctcctctgccaagcaaatccacctcggctccacagatgtctccggggtcttcagacaaccagtcctccagccctcagccggctcagcagaaactgaaacagcaaaagaagaaaacctccttgacgtctaaggtacttgagcttcttagggagatgctgttttaaggcagggaggttatggtatttcaggatgagatagtctaagggtttatttggaaatttaaacttgaaaggaataattttatttctacaaaaagattgtattaaacgtttacatatttttttcctacctttttcatagattcctgctctggctgtggagatgcctggctcagcagatatctcagggctaaatctacagtttggggcattgcagtttgggtcagagcctgtcctttctgattatgagtccacccccaccacgagcgcctcctcaagccaggctcctagtagcctgtataccagcacggccaggtagaggaatcatcacccagaagacctcttttggtagcttagttttgtgcttacttcttctcctctggagaggccatatttctgactggataaaagtagtcaatcatagcattttgttgtgtgcttttaaagaaatacgttgttactaggattatctatgatttaaaacatttagataaatgccatttagatacttctagaatgtcttaagctcagtttgtttgtttgttttgttttgtttgtatgtgcagacatacacgtgcatctggaggcccggggtcaatatcaggtgtctttctcaaaaatcactctctacttcattttctgaatcagcatctctcactgaacctggagctcactagaccaatttggatagccaataagctccacgaaacttattgtctccatttccccagtgtactaagatcataaatgtcttcttcccagattttatgtaggtgttcagt

SEQ ID NO: 28093 - DNA, 1144 bp, Mus musculus
atatggtgttttgttttttgaaacagaattttgctctttaggccatgttgtccttaagctttaaagtagtcctcttgcattagctctaagtttactggtgtttgcaccaccatgctcagctgagtatatggtctcatattttagaaatactaatataatataatactaattatgtattaaaatcatagctaaacagttttaaattatttattagattttgatattcagagtagagtgtcaagcgtggtgcacaactttaatcttagtaattggagagaaaggcaggtggatctctgttcgaagctagttagagctacatagtgaaaccttacctcagaaaaattttctgagtatgttatggcccatggttattataattcaagtacttgggaggctgaggcaagagaaacatataaggcaaatcttggctacatagtaagactctgtattagagagacagctccctccttaaaaaaaaacccaaaaaccccacaaacccttgaagatttagtatttcattaaatcagtgctatctttaaattaaatgtttaactattttgtcagtttaacactcagttactttgattaatggaacacattaggactttacaagactgtagcatcggaatataaccttcatgttcatttaaccatgatctaagtttgcagggtatgttagaatgttcattcataaagatccttttctttcccaaactagaattgaccttgctgttctgttggggaagacaccatcttcaatggagaatgattcatctaatctggatccatctcaggctccttccctggctcagcctctggtgtttagtaattcgaagcagaatgccatatcacagcctgcttcagggagtacattttctcaccatagcatggtaaatatgaaaccattacactaaccccagaatcacatacacaggaccattcctttttcaatgattgtaagatagagcctcactgtgtataggctagtcctctgagagtacaaacatgagcatcattcccagctgctctgtagtgacaagtttgtagttttgtaagaatgtttttgttttaaacccaggtatggaatatggtgttgcttcagattatccacaatagctatgatttgcctcctggtctggtgggg

SEQ ID NO: 28094 - DNA, 1216 bp, Mus musculus
gggagggtccatttttaataacagagaggtccttttgtctgttttctttgttcagcttccacacctacttattctcctttcattaaacatgtgccaagtttttgtagttttctactactggtgttgtttctcttcatatcatcttgagtttggttttgtttatctttatacaaaataaatagatgttacttgcatgttctgttttaaattagttgctaccatctcattaaatgactgctaagacaaagctgaggtttttaaagatactgcatggcatggtaaatatggtggggaagagggtaggaaaggatcttaaatggatggatgtgtttatacgtatgtccttttgtgtatctcatccattcctgttacagctctgtaatccaattggctatgaaatcataatcttattaaaaactatactttggtgtttctaaagagtttttccctatctctgaagtcaacaacttctttctgtttgctaaattctaataatcatactattgcttgtcaaaatgttaatgcagtattgttgtctgaacatgttttatgacactaaatttattttacctttttttcccctcctaggtgcatggaggactgcaacagaagagtggggaactgaagactggaatgaagatgtaggtattcttgagctagtccttacctaatgcattctatccctaagttgtgtttagggatagaaaatggatatatttctgcctttcaaaatcactgctaagattctgacctaaaacttttacatccaaaatagtgttctgaaccagaacatttcacatatgttatatgaaggagactgggcatggacaggactctgtggaaccacactatggaaagggcaagtgcaggtgtgtaagtccaatacctgattgtcagattgacccaggaagatagactggttgggtagggtaccaacaatgaaattaggactgggaagaagctaaatggtagaacacttgtctagtatgtgtgagaatcttgcattcaaatcctagcactgcagaaaaattgtttttagttaagcatatggtaggttgtacattgagtcacagctgctaatgtcatacagctgtacttggagctgttgcattatttggtgttaagtcctataatggattggcagtggatagttatggtacctaagccttgagtttaaaatccagttgtttgtgaaacttctaactacccaatgccc

SEQ ID NO: 28095 - DNA, 1234 bp, Mus musculus
atgcatatgaataaaaatgtaataacagtcatatttattacactataacaaaaaaaatgtttttttcagtggcacacacctgtagtcacaatactcaggaagtagaggaaagatgattaggttttctttctttttttttttttttttttttaattacgtattttcctcaattacatttccaatgctatcccaaaagtcccccacaccctcctccccctgattaggttttcaaagtcagttttgctatagtatgtttgaggccagctcacactaaaacccaaaatatatattaaaagatggatcttgagttgaaaatatagctaagttgtagagagcttgcctagcatatataaaggcctgagtttgatccccagcaccactagaaaaaagaataaaagtaggtgaattaaaaataaaaataggtgagttaaaaaaaaatagatgaacttccttggtttgttgagaatagcaaagtaattggtggtaaagtactgataaaatggaatttaaactttttacctatgtttaaccatctgttttttcctcttcagtattcttccttgtaaatactgttatttgtatatactgtaaatgatgacgtcggtgggcactaaccgagcccggggaaactgggaacaacctcaaaaccaaaaccagacacagcacaagcagcggccacaggtaatgaatccaaggatgtgaatcaatgagtaactataccacctgatagtggtttccatgcagtgtagcatcattctgtgctttggggtgttgatttaggttccttattgttagctattccatggtctgataactattagcaacattctgtgtaaatgtgtttacttttttattgtttaatgttgtgaggcttacgacttcattttgaatactgtgctgtgtccagtattagagctagttgagcagtacgttacttattctctttaaccaatatttatcaaatataacccttttcgtgaaagattttgacttctgctcttattttcccctaaggttttgaggccttccttacctgagtttttccttccccatgagaaactagcatattcactattcttgtacgttaacaaatgagaccatagagcaatcattctcaacctccctaatactgtgaccctataatacagtttgagttatggtgactcattcatttatatataaagaaataattttttttgctttttcataactcattttgacactgtaactatga

SEQ ID NO: 28096 - DNA, 1841 bp, Mus musculus
atgctggaccagaccctgctggacctgaacgagatgtagacctccccatccctgccccgcggccattcctccctctgaccttgactccgccagaggccagcctccctgaagctgaccttgaaactgagggctgatctttttaactgaaggctgctttccctcctgccacccccttttactacccctcttgtctttttcacaaaactgtgtcagccttttcccagagttccagttggaggggctgaacacctttgggaacaatatttaagggaatgtgagcacaacgcagtgtcttcaatgcagttgtgatacgcacattgtgattactttctgtcttagcaaccatttttaacattccaagcacttctgccgcttggagcagcacattttagcctaatggatactgtctcgccatggaggagaaacccaggattgggcctgccttcctgagagccagcagagcccaggcaggctccactgtgggagacctcagtgctctgcaccaactcttagccaaacaacagggggattctaggaagttagccaaaaacaaaaactgttctgggctgtgaaggttttcagctttggtgtctttgaacaattttacacttatttttattttttactttttccatcagatgtgaccaaataagacaatgagacgtctgagacagccccacctcccagggcctcatgcatgttagttaggcaagcgtgctaccgttcagccccagccctgagcccaaacttatcgcagctctacccctttcctaactgctcaaagatggatcatgccgccccttagtgttgtggagacctcttagaggtcacctgcccccaagggagacagagaaaggaaaattatgtttgtgccactgatttagccacatgaacatcatctcatcgccctctcctgaagctgcggtctctaaagtgccatctcattgtgctttgtatcagtcagtgctggagaaatcttgaatagcttatgtgtaaaaaaacaaaaaacaaaaaaaaaactttttaaattttatattattttgaagttttgtttttggggggttgggttagcttggccaagccattgactgtgagaattctttgcagtctgtgagctagtggtgtgctgatctttcaagtgtccccacccaattgccatgttcaggtggtttcttctcggcctgttaggtgggcaccctgcagattcctggcttgtttgtactctcctccgaccgaccgaccggagaaagagaaccccgcagtgcaactgttttgatactgaatatcgataagtgacattttgaaataaagaaccagtccctccacgatcagaccggcttgactttgttaaacgaggtgcgctttctccacggtttacggaccctgttggcagtctttgtggctgacagcggacagacttaacatagagcacacaaaaatagcatgggttcagaatctgcctgtggggtttaggaggtagcacccttggtaaagtgatcacccaagcaccaagactgagttaggtttccagcacccatataaagactaagcacagcacacggtctgtagtcccagcccactagactagacaggagcatcccccgagcttactcaccagccagttagccactcaataaacttcaagttcagttcagaccctcaaacgcttggacatggcactgtacaccttgagtcccagcactcaggaggcagaggccagcctggtttatgtagtagtttcaggacagccagggctacacagagaaaccatgtcttggggaaaaaaaaaaagagacctgtctccaaaaatgatggagtcctggagaggtgccttggggatt

SEQ ID NO: 28097 - DNA, 1275 bp, Mus musculus
atataatatacatatttatcatttgaagacatgggaaatttcctttttttatttttgtttgtcttactatgtagcccaggctggccttgaatgcactgagtagcccaggctacccaagagcttaagatactcctatatccatgtccacttcctgaatgctagaattaggcctggattactaggcctacttaaatatacctaaaagactgctttttttctcttcaatgctgaagactgacaaggtctttataagaacagtttatattccacagctactggtctacagctgtttttatggtagcagttgtagcattcctctgtgggaaagaaactgttacacaatttaatgcctctttcttagccacacagaaggaggattacgtgtgacagacacaaggcaaattgtgtgtgtgtttgacaaaaagatggtctgttttaaaacaaatttgagatttgacttaatggtgaaaatgttgagtgtttaggtgcacttcttaaatcttatttagagcctgcagttgttgcgaagtcttccatcctactagatgtgaagccttgggatgatgagacggacatgacaaaactagaggagtgtgtccgaagcattcaagcagatggcctggtgtggagctcctctaaattggttccagtgggatatggaattaaaaagcttcaaatacagtgtgtagttgaagatgataaggttggaacggatatgctggaagagcaaattactgcttttgaggactacatacagtccatggatgtggctgcttttaacaagatttaaatcattctcaagtcagtgcacttaaataaaagcttgaaagataaaaaaaaaaaaaagaacagtttatagctgagttacatcaatccttccaacttttacttaccattttatttatttttctttttttactttttttttctttttttcttttttgttttttccagacagggtttctctgtgtagccctggctgtcctggaactcactctgtagaccaggctgtccttgaactcggaaatctgcctccctctgcctcccgagtgctgggatgctgggattaaaggcagtgctgggcatggaaccaggcacagtgaatgctgggaaagctctctaccaaaagagctttaggagtcattttttttatttatttatgtatttatttatgtatttatttaaaataatatgtaagtacactgttgctgtaccagaagagggcaacaggtgtcattacggatggttgtgagccaccgtgtgattgctgggatt

SEQ ID NO: 28098 - DNA, 1155 bp, Mus musculus
aataaaataaataaataaatcttaaaaaaaaaacaaaaaagaatcccctgagcacagtggcttacacctgccatcccagccttgggaggtggagacaggagtgtgagttcaaggccatcctggattctatgagattctgtctgctcgggaatttggtcctcgcaatgctgtcgctgttcttatcacacttaatcctttctgcctggaagaaaggttctgctccccaggaatttgttgtcatcgcaggaaattagtcttgactctggagattcattttctggaaggttcatttagcaagaattaaaatacattaagcatcttagaaagatgaattactgatccttctcaaaacctgacctcagcagggcttagtggcatttttaattaatcctttaatcccagcaccaggaggcagaggaaggcagatctctgtaagttccatgacagccagatctgcatagagggatgctgtctgaaacagacagacaactgccagatctttctcactggtaccacatggatctttgcagattaatggaagatcaggatgagtactctgaaaactacatgctccgtgctgtcactgttggacaaaccacacttgtagccattgccacagacagaatggggaagaaattcacatcagcgcctcggcatatcgaggtgggtaaagtccctcatgtcctcacgtcacagcattggccttccctggttttgtttttggtttttttggtgtttttgtttttgttttttgggacagggtttctctgtgtagccctggctgtcctgtaactcatgctgtagaccaggctggcctcgaactcagaaatctacctgcctctgcctcctgagtgctgggattaaaggcctgcgccaccactgccaggctatacattaatatcttttgctggggaatttcctgtgtataattaactattttcttccctccaagattaataaacacatgggacatagttcttgtagaaagtttagaaagcacacacaaaaatttaatatgtatatatgcgtgtacatatatctgcatgagctggtgagtgcctgatctgagggctgacggcacttgagttcatggaaaacacagtagagagagaaccgactcctggaagtttcctctgcctccacacatatgacatg

SEQ ID NO: 28099 - DNA, 2212 bp, Mus musculus
cggaactccagcagctccctcagccctgcgtgcttgtgtcctggtcttctccttagccttgcactcagtatttgagggcctggctgtagggttgcagcgagacagggctcgggcaatggagctgtgcctagctctgctgcttcacaaaggcattctggcagtcagcctgtccctgcggctgctacagagccacctacgtgtgcaggtggtggctggctgcgggatcctcttctcatgtatgacacctctgggcatcgggttgggtgcagctctggcagagtcagctgggcctctgcaccagctggcccaatctgttctagagggcatggcagctggcaccttcctctatatcaccttcctggaaattctaccccaggaactggccacttctgagcagaggatcctcaaggtcattctgctcctagcaggctttgccctgctcactggccttctctttgtccaaatctaaggtgcttcaagagaaagggcaggggaggttggctatcaggtgcccctgtcctccctccctacccttctcaattggtgggaaatagaaagaagtggagaagggaagtagtgaggaccaaagagttctcttagatatagggatgggacatttggactatgaataatgagatggaagtgggcagagaagaggctagccccagacccaaagaataagagatagcgaagttactacagacgtggtcagggacattagaaggaggcagactgctacagtcagaggccaggcagtacatctcagagacaagctgacagaagaactgagagttaggcatccagcctctttgcgataaagatacagaggctgtaagtcaaagccagtatcctgttggttctagcccatctcaccactctgatggctgaaatggttcctcctcctttcttccctcctactcttatatttctctcttgtcttccactaagggactagtgccaaatggtctctctgccagttttcgtaatttatctggcctctcctgtcctcacctttttgggttgctctgtgtagccttggctgtcctggaactcactcttgtaaaccaggctgggcttgagtttacagagctccacctgtctctgcctctgcctccttaatgctgggactaaaggggtgccatgccaccactgcctagctcactagtctgttgttaaagtgccaaatacccacccacccaccctttaggtttgtttgcttttttttttttttttttttttttttttttttgacagggtttctctgtataaccctggttgtcctggcctcaaactcagagctcagtctgcctctgcctcctgagcactgggattaaaggtgtgtagcacatgtattgctcacctgccccctttttgaaagcacagtgctgaggtgctggggcctgcctagcacctcagtggagacctatttgctcttttatttaggccccatagtttggggtggggaagaaatatttgctgaactggtctggagtgagagaaaagtaggtactgacaccagacactacagaaagtggacatggtggtccatacctagaaaaaaaccaataacctgccaaaactttatatctgaggagtccggggtggagggagacagactccctcccccaggattatttttggggagggagggctgtgcataggtctgtactctgtagaatctattttactaactgacctgttttgggatatgttacccaaataaaagatgtttctatacacttctatggtatctgattctgtgtgtgtgtgtgtgtgtgtgtgtgtgtgtgtgtgtgagagagagagagagagaagagatggtctgtgtgtgtgtgtgtgtgtgagagagagagagagagagagatggtctgtgtgtgtgtgtgtgtgtgtgtgtgtgtgtgtgtgtgtgtgagagagagagagagagatggccagtcgtgtgtgtgtatgtgtgatggccagtcgtgtgtgtgtgtgtgtgtgtgtgtgtgtgtgtgtgtgatggccagtcgtagaggatatgaatctcagttgcatacagttgatttaagatccttgttttcactcaccccacttctcacctttcctgaggatgaccaaatttctcttttttctcttcctttctgtctccaccccttcccttcctcgttttttcttcagcttccttggggaatccctctccctttcccgttcgtaggctcgggactgttgt

SEQ ID NO: 28100 - DNA, 1149 bp, Mus musculus
agggcccagggtcagttagatgaattttgccgggaagaggtgaacacactggagaagtcgtgggagtagtaaagactgggttggagttatttacatatgaaacaggggtcgcaggaggagatggaccgccgaaagtccatcggcaggggaatggcccttgtctatccccagccgagtcctttcaggtactccaccgaagcatcctcaatcttggattatgtgttgggagcatagtttgttttatccctaatctgaccctttctgaatctgtgatcacagtgcctgtgctcttatgggacaactaggttccaaggggaaagggcccctcgagtggtttgatcgggctgtgctgggtatattgggacaggaagtcccctcctgtgtcccttccctttgcttcctttttcaaatatttcgtgtggtttcctgacttgagtcaaggtgaagaccattgcgcacagtatgggtcttggtgtatggctctgggcgactgtgaggaaaggtagagctttgaatcgcctaattgggctaaagaatcaccctttcctttgactggggatgtgctgaactctctaggcaggtggtgctacctgtggctcagtgtctggaatgctttctagagtcctgtatgtgtgggaaatactccttcctaggaagttacacaaagaagcatcgggcctcagacaagttgtttttggaagcacacccctgacccctgccttggtttcttgcttcccagggcaggttgtgagggaattagggtaaacactcaagagtttgcaggtaagcagccccaacttagggacacaattatttttaaaacagcaggtgagggatattgcagtatctttcataataaagagcttgaaggaaactaaggggagatgatggagcataaataccatatttcaaagctctttagttctatatatgactgactgactgtatttatgtgtgtatctccctctactctttgagtcctgtgtgtgtttcccctttgatttttctagagaccacatgttctagtttatgagagttcaagatagataaatagagatgcaaatctggtgtgtgtgtgtgtgtgtgtgtgtgtgtgtgtgtgtgtgtgtttataacctcctcttaaccaccatgaggattatgaactat

SEQ ID NO: 28101 - DNA, 1197 bp, Mus musculus
aagtagcctcccttcccctctgaagcactctctcagcctctagccccttgcaagctacccgccaggcttcttcccaccttcagcaccctggggcacctcaggactcttggggcttccactccccagggtcaggccatggaggcaggtgagataagttaccaataggctgttgtggccccgattctgtcttgggctgggtggcgcgggcatggcatgactggagctgactcctacagtccctttgtgcctaactacagacacctaaggatcctggagatgggaaagtcctggttgcttggccaactaggtaaagttaagctagggaaaaaaaaggatacttgaaatctgatgagcagaagctaaatcttgggttttgtaagccttcctaggcatctgtaaagtcttctagaaatgaaaggatgggtgctttaagaacattagctgcatcggaaggttcttgtggtgttgctacaagagcagagacctttgacaaagcaaaagttggtgtaatgtggtagccagagtgaatgatgtcattgcaggccattacagaaaatactgtgttctctgagacgtaattgtagcgggcaaggagaggcaggcctttaaaggaataggtgaggaatatgtcagttgtgtgttgtagagtggagtttgggttctttgggaaaaaagggctgatgtcactaagaaggaaggacctagtggtctctaaggagctgtggtggaatatgagagtttggtgatgtcacaggtggaagaattcaagattggctgatcatttatcctttccttagaagaactaggaagaagaagggggggtgtccactatcgttgccatgggaacattatcctctcttgctccatctcttcctcgattgaccattccagatgcagtgagtgaagcagaggccatggcagaggagcggcctccccggttggtggattactttgtggtggctgggcttgcaggaaatggagcgcctatacctgaggagaagtgggttcccgagcctaccgggcccctgcgccctccccggccagctgaacctattacagatgtggcagtcatcgctagggcactgggcgaggaggtgccccagggctatacatgcattcagacttctgcgggtggccaccccttggagctcagtgctgggctcctgggtggaactcaaccagtcatctgctaccgca

SEQ ID NO: 28102 - DNA, 1164 bp, Mus musculus
tacagagtgagttccaagactgccagagctacgtagtgagtccctgtctcaaaaacaaaaaacaaaaaaacaaaaaaaacaaaaacaaaaaagacaaacaacaacaaaatgctgtacaaacattagcctctgttagcatgtcatttgccctcctcctcatcttcatccctgagcattctggggacatggaagctggctacatcttgcaaggtgttcactcatgctccagggccaggctgcttgccctactgacgttcccgggagggttgtagcttcggctgtgcctcagttctcctgcctccttagaacacagaccctctctcgggaaaagcgttacttcccacactgaccggtaatcaggaggctgaggcaagatgtagtgtttgagttcagcctagggtatatgacaagaccctatctcagaaaaatatcaaaataagaaaagatctgcctcggcattatacttatcttggtgtgtttctaaccccacctaggagatgaaggttgcacagcgaatggcacagaagtcagccactgtgcctgagctgtgggcccggtgcctgctgggtcactgctacggactgtggttcttatgcctgcccgcctacgtgcgttccgtaccctcccgggtgcgtgcattacatacggcctaccacgtgttacgggaaatggagaaccgcaaggtggtgctccctgatgaggtaggcgcccactccctgcgtgttcatacccgcctgcgatcccagccaggatatgcgactggagggactgtgagaagggagaggtggagaccagttaaagtgggtgggtagcccagggttaagtagcttcaccatcaacaatcgcaaagtgcatgggcacgtgcaggagaaaacagtggagacttccgggagcgggcgagtcctgggagaattggaaggctggaagaagatgcttgctgagatttggtctcctccatcctgtgcctctcttggcctaggtgtgttaccgcgtgctgatgcagctctgctcacactatgggcagcccgttctgtctgtgcgagtcatgctagagatgcgacgggcaggcattgtgcccaacaccatcacttacggttactacaacaaggtacttaactggggattagaggtagaatggcagtgtatactccggcctgtgtgggg

SEQ ID NO: 28103 - DNA, 1149 bp, Mus musculus
tttctgagttcgaggccagcctggtctacagagtgagttccaggacagccagggctacacagagaaaccctgtctcggggaaaaaaaaaatgccactgttcctggtctgtgtgttttgagataggttctgtagcctaggatggatatgtgtgggagaataacctacttcttcctttacttccaactgctggaattatagttgtgtgcccaggttctggttcactagctgttttgagacttaatctcattatttagaccagattggctgagaacttaccgtgtgtcagactttgagcaaattgtttgactgtttcctgagtgctagcattactgacatgcactaccagactgggcaccatgatcttttataatcctttttagtcttggtgcattcccctttttctttttggaggtagagtctcactgtggtcaaggctggctcagaggtctatattcccttggccatcttttaacttttaacaaagttctcttgctttgatctcctaagtgctgaggttgcattcatggaccactgtagttgagttcttcttttttttttttttctaaatgttttttttttttttaatattgattgattgattatatgtaagtacactgtagctttcttcggaagagagcatcagattttgttaacagatggttgtgagccaccatgtggttgctgggatttgaactcaggacctttggaagagcagtcagcgctcttaaccgctgagccatctcaccagccctctaaatgttttaatattcatttatttaatgtatgtgagtacactgttgctgtcttcaccagaagagggcattgaatcccattacagatggttgtgagccatcaagtggttgctgggaattgaactcaggacttctggaggagcagtcagtgctcttaaccactgagcttaggctgacttactctgttctcttttaaactgatcatatctagtctttgaggtgttctcctaaataccttgaacagtctacttatttttgttaaaaatattcagtaatgtccactcattgaaaagataaaatttaaacttgcttagcattcaagaccatttatgatcttgacctttgcctttttatccagtatgtcttttcttcattacagttaatatgtgaataaat

SEQ ID NO: 28104 - DNA, 1312 bp, Mus musculus
acctcagtcttctacaagagtagcaagtactttgaatcacttctccagtccagtttgtttaattatatacgggatctggcattatagctcaggctatcattaaattctagatcttcctgactcagacaccaaagttctggaattttaggcaagctctattatctctatcgtgaatgtttttgttgttgttgattgtttttagagaaccattcacaagagtttagtgtttgattttgggcactttttataattaaaggcctttggagactatggcatatttgaagtttgtttttattgctgaagttgactggagaaatacttaatatagatgtcgttggacagtaatagcattgggagttagctctgttatctgtaagtttaaatgtatgttacataaattattttttctttacctcagcatttctttcacttcacattcctacatgaggaactttattctgatatttcattccataggatggatagaatgacagaagatgctctgcgcctgaatcttttgaagaggagtttggacccagcagatgagcgagatgatgttctggcaaaacgactgaaaatggaggggcatgaggccatggaacggctgaaaatgttagcactgctcaaaaggaaagatttggcaaatcttgaggtgccgcatgagttacctactaagcaagatggcagtggtgtcaagggttatgaagagaaacttaatggaaatctcaggcctcatggagacaacaacaggactgctggaaggcccggcaaagaaaacatcaatgatgagcctgtggatatgagtgctagacggaggtatggaacagtttagctgcctttagggattgggtcgtcttaaaataagcttgtaaaaatgggatgaatctcagtgagaggatggtgctttttatcctaaaactgccctttttgtattttgctgttttgcaacagggtctcattctattgtagtcatgctggtcttgaacttatagcagtcctcttgtctcagcatatcagtgctgggattacatatattagctaccacatcatggcatcctaaagcttctagaaagatctgtgtcctctggcttgaactgagcaagagtttctcttttttccagatgaagctagtagctcataatgaaagtcattattcttacctaagataaaatatttatttctagggaccagagaggtgacaaaataactcatagtgtttgctgcccagtcttgaggactggacttcaaatcctagttcccacatcaaatggttctcaaccgcctgtaattccaactcttaagtggtccagca

SEQ ID NO: 28105 - DNA, 2852 bp, Mus musculus
gcaaaaccgaaaaaaaacagaagacaaaaatagacatcaacaagaaaacacatgccctgccctgccctgccacctcccctttattcacactgctgcgatctgctctcctgctgctctgtcttctctcttcgatttcctttaacagtgagctggatctttgcctctgatagaggtcagaatgaggtcctgggagaattcaagtcctttgatgtgtgtttctaaagtatgttttatgctataattattatcatttttaattatattgtgtgttttccctttgttctgtagacggttaaccccaatcttctgttttctttacttccctaccaccctctgctaaccctcctccttattgaaaaaaagtatatatatatatatatatatataaatgatatacaattcaatgatcacatgcagattgcagtggatcctcagctgccaataggaaataactgagaatgttagggacagagatgttgagtgcacttaacctgagttgtggagtgggtatcatcagacaaagaggaataacatcccacctatggttggttaggatctggagagtttaggaggcagtgttatagtaatgaagttgagctctgtgacaatgagtaaaagagcctagagggaaaagcttaaaaacaaaaactacctgttgtttaaccatgggctaaggggaagaggggttacataagctcactagtgtcccaaagagggctgcagccacgtcctgaccccagtgaggacacagaagtctgttccaggccaaccatcttgagattgtttatcttattttctttgtaaaattgtctctcatcacaccttcataccctttaacaagtgttcatcttccttctaaccatagtcccagaggaatgggtgtttccaggctgcaggtggctgggtatcctagaagttggaatcggtatatgtggatcatgtgacagaaagggaaactaaacatagaggaggaggaagaggtttctccccgaagttgagattctagcatgtttctatacctgtaccctctgagtgctgagagataacgggtgtagacccccccaatcaggttggtattccactctgactctgctatgctggctgtagatccaactccttagagccaagcagtttgtcaaaccagttttggaccttagttatacaagtattgtcctctcccaaaattttgttcattttgccttttttttttcttgcctttttttttttttttttggcactattaatgtagagaataaattgaattgtgcaatgtcgctgttctgaggttagggaggttattaacatcctgtttgcccacactgtggcaaggaggaagggaggggaccaagctgtttttgaggtaagggaaacctgaaaatgaagggtctttgctttcctcagattgtacatgtagtaaaacctgcctctacagccctagaagctgtcagagtgtactagggacactttgaacaaagatgtatgaggagttttataatattttgcccttgataaccacctggggaaattccctcatttttatttttaaaaactaaatttttttaaagtaagaaggcacttttaaaattacacacacacacacacacacacacacacacacaaatacacaaactatacacctttcccataaaatttgggggtagggtgggaaaagaagctaaatcaagctcaatccccccactctggtctcttctttcccaataccccagtgccactgtgggtgattatactggccctacgggtcttcctgggttttttctttcttccctttccctcaaatgtattgagcacttaataaaggagcagagatacaactgtgtctgggctctccaagtggtgaaatgacctggaagctagatgctagtaacaagtagtttgagcaggtcatttcaagtatttttctggggaatgtggtgcccctgactgtaagtggtgggggaggggggctaatggagctggggttgggattattttaaaattatatatatatataaaaagatatattcttacatcttttccttgccctctgtgctttgaaagcactgaataaattgatctgtttttctcttccacaaaattggaagatttttttttcttccattttttaaatgttcttaccagtcatcttgcctcgtggcatgtctgtctaacctctccctaccccgtgatgaagtgccatttctgttaagtctccctgacccccaactcagaggtgctcagaggtacaaggtgcccaagtttgtcagttgagattaaaaggaacagagaatgtgcaataccgtccagctggggcctgtccttgccctgagctaggtcctctccctgggagccaggccactttgactagggtttggaggtaagatgtatggaaatggggagtggtggcaaggagagcctatagttcagtgcctgtttaggtgctgaggccatagggaagagggtagggtcttccctgtttttatcccttcagggtcaattacatagaagctgcttataatactagtatagctctgtggccctttgctcagtcactgaggtttgatttctcatcctctttccctatcatcatactcttcccaggaattagcaagaggggtgaaatctttcttaatcatggtaaagtattagccttccatctcctcccttaggttctgccctgtccccctttcttaaagcctctacattttacatcactgattgccttgtgtccttccaagacttttttttgtttttgttttttgttttaattaactcccatcctccagctgtgggcccttgtagacactagccctcacgccctaaggataggaggaaagaccctgagttcagtgttc

SEQ ID NO: 28106 - DNA, 2068 bp, Mus musculus
ttcctctagaccttgaggcactacaagcagtcattcatggatggtgtcttattccacagcaacctgaaacgggtggattagtggcaaggctggggtaaaattaggagacagaagtccttatttgtcggttttattttgtcagtagaccacaacatctgaactccctccattgctgaataagtatttttcctgcattatgagatatatgtatggtagacatttctttttaaagaccccgagataaatgttttcctgccttggttacctttcctttcccctttaagaggaattagctatagaaccgctttgtaaagatgcttcttgatattttacttttgttcctttccccaaccattcccacttccccttctctccacagccccgatcccactcatcctaggctcccttcctttccatcaagatcttcattagcttatgatatttgctgccgagatgttataacaaggactcattcatgtatataagctatttcttgatccatttaaaaggaattgtacattgtgtagaaaaaaaaaaaacatgaaaaagagaaaaaaaaaaaaagccctagccatggatattgtgaaactgtgttatgtcattttgtaatgtgcccgtttgtgtatgatccgtgcaaaagggtttctggggaaggggagggtggagggaggcaggactgtggagggtggggagaggagtgggccgggcccagcacactgagactggcagctgctccaaccccatccctcccttaaagatgccacctcccccaccacccacccctattttgtgccttgccctccccaccctggagtaatctctccaggtcaccagcactgccttggcagagcccactccctaccccagcctgcccactcttcctaccccagcattaggttgataatgtgggaaagtgctggaggttgggaggtagccgaggaatggggcagttcctgggggcattgaaaccaagtattattatgaattgtaattgtatttgcactgttttccccctctgattgcatcagcatatatacaatatacctatataacaaaacccagtgtcaaagctttcttatgcaagggattttcccaacccttcagaaaaagaacctcatggacttctaaaagggtaggttgtcaggagatagtagaatagtagaaagaaagaattttaattgtcctaaggaagttctgtccgaaccatttaaggatatgtgattgagttgaggctgtctcctgtaaattatagggctccaggtccaggacagtacaaagaatccaggacacaaggaggcacagtgtggatacctggggcctactgacttgctgggtgagctttggtgaaactggtatcttcaaccagtgaatcgagggagaaaaccactgacctccatgctctaaattccacaattcttcccccatctgccaaaaagcaaaaagcaccttgagatgagggaagtgctgggctgagagaccagggaggaaacaaaagtggcgtgctagtgttacttgtgtgactgtaaagtttggaaagttgccagtcccttggttcaggattggtatgggagaagtagtgatacagggtgctgggctgatggcatcttggcccttgtgtttctagccatgttgtgaccagcctccaagcctcacctcacaatcacaatccttaagggtggttaaccagcaaacaccccccaggttggtaatctagttgtgagctataggatgtggaaatttccctcatcttggtaacaagtagggctcagatgtagcccatatctttccttccctcagatctcatctgaacccccaaaggcaactgttccacagtctgtctccttcaaaggcccagtttatccctccccccagccccccaccccaccccacccccaatttcctgagctgagtatttctattctctagttattgccattaaagcctggaaaaaacataggttgatgggtgaggccttggtgaaggtggaggatagattggggtgggtggtggggagcagggaggtggggtggcaatggccttccctgaatagggtgggtgggagggaaca

SEQ ID NO: 28107 - DNA, 1390 bp, Mus musculus
aggcagctctgtccagccctcgaagtcgaaagaatgctacccagccccccaatgctgaagaggagtcaggctccagcagtgcctcggtgagcctctcagccagtgcacaggagggagtaatgggtgcgggtggggtgtggtcagctgctgtccaggttagtgatggccttctgctcccctcatttcttccaggaggaagaagatacaaagcctaagcctaccaaacgaaaacgaaaaggctcctctgctgtgggttctgacagtgactgaggcctggatccccaccctgccccagcctgagaaaggtccatgcagccccacctctcctctcctcccagggcctccagctcttttcaccccctcttcactgctgctcccactggtaggttctcacagcaaccagaagctgtgcagaagcagatcatggtggaagtcctttgccgccggctcctccccaagtctccgaagagccatttggacagagaaaggagtgatgaagaggctgctgggcagaggagctggggtgacagcagatgctgtgtgagtgggcatttccccctgcttcctgtcagtctgcatttgtagtctgtggacggtggtcattacaccagtgtgaagtgggcatctgacctggtgtgggcggtgcccatctgggcagatgccacagccttcagaaaagaacccaatggcagcgtgagaggctcttgctgcacctgggatgcttgggttggcccggcattggcacttcaagctgagccagagcccaggggagtcctggaggcaagttcctcagaactgtcagatggcctgattttctgtggttctgtttttgctttttcttttggcaaagataatcgagttttaaattgtttttaagtgataatgaaacaagccagaacatcttttgtgcctgagttgacatctctgttcgtcctgtgtatataggcgcctctgtttaacttgtacccctctccccactacacaatgtctccaggagggacttggctttgatctgagatccttcccactagagtgagtcagacatctaacctttccacttagaagctgatgctggcaccatctccctgcaggctggctggccttgcccattgcttctcgggaacttcatctttaggaggtggggtggggtgggaaggggaggggaggggttacttagtagataaaaaacttgccacacacgaatgaggaccagagttctatggtggcttgcctatgatcccagagctcagaaggcagagactgggtccctggagtcagatggctggctagctatcagtgagctcagggttcagctgagagagcctaccttgacgaatgaggtggagagtgatctaggattcctgacttgtaccttgggcctccaccccat

SEQ ID NO: 28108 - DNA, 1195 bp, Mus musculus
gttcttggtggctctgggtcccaaccacccaccagatgttgaggcacttgggccttgctcccttggccattctttcttccatgtccatagctgtctgccttctctaccctcagaggggggaggtggggacggaacatcaaacgcgaagggtcagggccagggaccacagctgccttcatcaccctgacagaagagccagctactaagaccctagagaaagtgagaggttgaggaggggacttgtggggactgtagcattgcacctaccaccacagaaatggaggaatctcatttctcaggctcctacagagaatggaaccaggcattccttggcccaaagagaaggggaaagggatgtgagagcaggaagccaccagggccaagaggcgggggtttgggaaatcagtaagcgacactgtagccattcccaaggtaagccatccatgtatgcacggctccagcatgctctgattcctaggccgagtgaggagatggtgaagatggtgctgagcaggccctgccatcctgatgaccagttcaccaccagcatcctgaggcactggtgcatgaagcacgacgagctgctggcagagcacatcaaggcgctgctcatcaagaacaacagcctgccccgcaagaggcagaggtgggctgcagtggctgctgcccggggatgctggcttgccagtcctacagaggattggtttgtgggcgacgtctgatagtctgagtcccacagctgaataccctcttgagtcctcaccagcactgtgccacttaggactgcctctgacctaaggagggacgctggaggagtggacagtatctgactctctgccttctcatgtagcctaagaagctctagcagcaagctggcccagctgaccctggaacagatcctggaacacttggacaacctaaggctcaacctagccaacaccaagcagaactgtatgctgcctttcttcttgcctcttcctcttggaccagtttgggggaggtgctgccctggttcagatctcctacagctatttggggcagggatgacattaccaggaccactgctcaaacccatagaagaaataattttctgtgctatgtataatcttcctgacatattaactgtgcttcccttccatagtctttagccagacaccaatcctccaggcgctgcagcatgtccaggcaagctgtg

SEQ ID NO: 28109 - DNA, 1156 bp, Mus musculus
ttctctgcatgaggacctgcctctatctatctgtctgtctgtctctctgtctgtctgtctgtatctctgtctgtctgtctatctatctatctatctatctgcctgtctgtctgtctgtctctctgtctgtctacacacacacactctctcttgaaccttttctgtggctaagagtctgctcagattggatctctcctttgccaggcataatacaaagatttgtgtacttacacttcccacagaactggtcattatgtccaatctctgtcagctctggctttatctctcggcacactccccccaacactcctacacacacacacacacgccattcctcttttcaaacacagtctgctcatggtggacatacacagatactgaaacctggggtttacaagacatagattcccagatttgtagctgtttggttcagtgcaggaccagaaccctagtttgtgataaagagtggggcaggctaggtgaaagccatgggtccagcccatgatcctgccccttctctttctctccagtttccagatgaaactttgaggagtggggagctgctgaacatgattgtggctgttattgactctgcacaggtaaacattgagccttgacatttccaacaaggcctggagggcaggacttgggaaatgagggtatgttttctctctctaggcctgtacacgaaagcccacatcctcaggcactctgcctcccattacatgtgggtgccatttaggccattagggctaggaagggcaagcagagctcaagaggctggggtcaaacctgtcctctctgatatttctccatgttctcaggaagttcctgtttgtgcagggaaagctgagggtgggcaggtgtgtatgtgtatgtgtgcatgcatgcttagtcatgggttttcaggtaggggtatgtgtgtgtgtatgcatccttagtcatgggttttcaggtgtgcgtatgtgcatgcatgcatgcatgcttagtcatgtgtgttgctcttaccctggtcttctcttcagttcataataaaaatgtttgggccatttctacttaacctttcccatacacaggacccctacagattgtagctttgcataagtccatatctgaatggggtgggtctcatttctactcatggccactcagctcc

SEQ ID NO: 28110 - DNA, 1569 bp, Mus musculus
ctgttttgtttgctttctaagtgtctttgtgtttcaggcgctgcttgcagattctggctgcaggactgttcttgcctgggtcagtgggcatcactgacccgtgtgagagtggcaacttcagggtacacacagttatgaccctagaacaacaggtattaagacaaccacgaaatgagtggggttctggccagaaggccaaggaccaggggacctgtttcacacggatgttagtcatgtatagtctatttattttggctcatttccctctccttgttcttcaggatatggtctgctacacagctcagactctggttcgaattctctcccatggaggctttaggaagatccttggccaggagggggatgccagctgtaagttatctctgtggtgtggttcaggggttctgaactatagagaagccgtatctaaaggtggtctaatattaatgaatatagcttatcttgtttactgggatatttgtatgaagtgggttttatccctgtttcttctagatcttgcttctgaaatatctacctgggatggagtgattgtgacaccctcagaaaaggcttatgagaagccacctgagaagaaggagggggaggaagaggaggagaacacagaagaaccacctcaaggagaagaagaagaaagcatggagactcaggagtgaccttccctttactgtttctccccaagggaagagaggctaagccagccaccatggggctttagatggcggcatttctgtggcatagggagacagcaggaagggaaacaaactgaaaagaaaaaaacgctactgtttcgatagtggccaagcagctagaagtctcccatttgtgactgcgtatgccctctgtccgtctgtgaggaagcagaatgccacacattcccaatatttaaacctaaccactcccaaccaagtactttgtgttgaaatgctgtaaacggtcattgagtatctgggaatttttttttttttttctaagaaaaatgattaaagtacttcctactagggcttttggttttatttttcttcaatatgtagcaactacatttggcttctataacctcagtagaattcaagttgagtcttttattataaacattgagattgctgttttaaattatataaattgaaagtaatagattcctaggataccattgtgatggctaatttcttcagcttggcctaaaataacctgaaatttctgcaaaggattaaccctaaatgtggggtgaaagcatcttatgagctcagtgcatggacagaataaagggataaatggcagagtccagcattcccttctcttggaagcttgatcacctcacattctcatgtctcaaaataggccccaaaatatgcatcagtgtgaccatgtcctgaaccctttgaaaccataataaaataaatttttttgttaaaataaccagtacaagcatttatttaataatgttgagcaatacttaatattaacatagtcaagccagggtggccaagaggataaattatttaccttgactttacctaagtcctcagttgtaaacaaagtggagttacaggt

SEQ ID NO: 28111 - DNA, 1158 bp, Mus musculus
aagagccaaagccagctggacatataagcaggcaaatttctgagtttgaggccatcctggtctacagagcaagttccagggctacacagagaaaaaacagtctggggacaggggcagaggggactcagttaaaaccttttacagcagtcattagattccccatcttcctgtcttacaggaacgactaaggcggttaaaccacagcgtggccaaggaaacagctcgcaggagagctatgctggattcaggagtttaccctcctggttctccaagcaaataagcacgggcccgtgacctgagtatacaagtacaattctccaacggctttgtctggtagacacgagaagattccaggaaagtctctgtagacctttgattttttttgcactatgtactcattcatgtagccgcctcaagaaacatgcgtacggcaggactatttcctaaagaacctccatcacagcttgtccatccaagaaagagcctctaccttttgggttttgttaatcttgagacaagatctcagtatgtagtcccggctggcctcaaacatgtcctcttgccttagcctcctgaatgctgggattataataggcatgtgtcagagtgccgggctcaagcctctatatatttcccccaaagaatactaagtaaattaggcatcgtgtggtagaaaattgagaaaacaccagatttagtgagaaagtatactcctatttctccccctctgcttcaccacagttcctctcagaaggtaataacctttccaggatcatcttacactctataatgtttaggttaactcctattaacaagtttcgcaactgttgccttcattgctacccaaggagagcatgccagatagcgaggatccaaggtcaaggcagagccttgacagctaagagtcctaagcttttgcgatttttttttttgtttagactacatattttaagggctagagggatggctcaatggttaagaacactggtgattcttccagatggcgtccagtgcttagcgcccacatggtgactcacagcagcctctaactccagctccaggggaacccaatgcccttgtctggccttttggcccagcacacacacacatatgatgcagatatatatgcaggcaaaacaaccatcctcataaaataaa

SEQ ID NO: 28112 - DNA, 1456 bp, Mus musculus
atacttaagaggactcattgtgtgtgcttttcatgtgctgctttctgcccagtgtgtttcttgttttttcagatctctcctctttgccctgtctttgagcttgtctcagctaggccccacaactataaaggggcatttttttttttaggacccatcaaactaatgtgtaactgtctttttcttctctctctttctctcgtttggccaggtcggggtatgataggtcggggaagagggggctttggaggcagaggccgaggtcgtggccgagggagaggtgccctcactcgccctgtattgaccaaggagcagctggacaaccaattggatgcatacatgtcgaaaactaaaggacacctggatgctgaattggatgcctacatggcacagacagatcctgaaaccaatgattgaagcctgcctgcctgcccgcctgcctgttagactcttgttaaagtcaccacatctataaaacaaccttgagaaaacatgagaagaaatctgatcgatgctggaaggacctgtcacaataggctgtggacttacctgccaccagttggtgcatttagtctgttctgtctactttttgatactgtgttatatgaaaccctattttcctttaaatttggttgagtttgttttgttgtttatccagtcacccagatatctgtttgaacaggaatgcgttggccttgtgagtagaacagttttctagcctctgcctgtcatatactcttgacatttttaaatatttcctctgttgatttttatgatcccagaaggagctagagttttcactattgggtggtctttgggatagagttctacatctttctttaaaagcttcttgttaatagctggagctaaaggtgtgtttgctatgttgatagtgaaggtagtaaattggaaatgttggtattgctactgggccacagaatgggtaacacgtggtaccaactttgatttggtcaaagttgatgttgcctacattgaaaccacatagatggtagctgacaagctaagttggaatttccaccctaagaaaagatttttaagcttataaatctctccttttggctttctgtctcatgcccaagaggcttctgcacctctcacagagaagaagcagctgttggtgtagcacaagtggcagaagagacaagagtgggaaactggtaacaaactgactgctgggaagggctcatgtgctgctcgtgctgaagtgcagttaccttccacttaactggctttatttgaccctcttgaaggtttaagttcaaccatattttgtcagctgttcagtttcagtggaatcttgtatttctgattcattataacaaattgttctctcaaaatttaacccaggctttctgtttatttgggggggtcttaaaatgctatataaccatttttgtggtgtgttaatatgtcccttgtatagttgaaaattcctggg

SEQ ID NO: 28113 - DNA, 1099 bp, Mus musculus
gctgcaagaggcttgctgcctagtccgaggccagcagtgttgtgtctggcctgtaagaggcaggtagcaagccgagactatgtccaaaggcccctgaatggcattcttgggccttgtaagaggcacttgctttgctccatttcactttcttcccattctgctttttagtttgttttgttttgaaatctttcatcagctgtgtgtttacttctattaaacttaatcataacaggaatgatagaataatgtcctcttaggctcttaagcgacttaactaatttaactttctcagaagtcctgagtcagaaagagtggttatttgtatttaaaggcagtttttgtttctgagaatttcatttatttggtgtctttcaccattttattatgttgttgctagaactcccaaggcatttaatttagtgcctgtgtttgcttcagaagcacatgtgcttctctgttcatcttttaagatgtgatacattaatttcctgtattcatgtgttactaagtaacatgttagaatgtaataaactcccataactcatgagtctgttatttcagtggactttgaaggtgctctgatccttcctcctgtttgtcctttgaatgaactttcactctccaaaagtgtcggcatttctgtttgtctttgtaactgcatctctgtttcttgtcatcatatttgcttactgcgtgtatttcatgctttccacttctcttaagagctgttacctgagcccttgttatcgcttctaattgtgctgcccttggctgcatttctgagtttctggttcttgcaagtttgtggaaacagaggagtctttaacccacatcagccttgatccaaatgtgccactttaaagttcgtgggatctggagctcctggtctagcaagccatgagaatgccaataagtgttttataataaagctttatttaaacacccgttttgttcgaccttgaagctttactaatatgctgaagaacaaacagccgatgccagtgaatattcgggcttcgatgcagcagcagcagcagctagccagtgccagaaacagaagactggcccagcagatggagaatagaccctctgtccaggc

SEQ ID NO: 28114 - DNA, 1226 bp, Mus musculus
tggcttgagactgactgcctcaggcaggggggtggtgagagaactctctgctatcagcagcactgactagcccctctgtcaaacagcttcttctagcccagtgatcagtcatggcatgccctctggatcaggccattggccttctcgtggccatcttccacaagtactctggcaaggaaggtgacaagcacaccctgagcaagaaggagctgaaggagttgatccagaaggagctcaccattggctccgtgagtagcccctgtcccggttccccctcctgcctctcatctgagtggcatttaatcacagttcctgatcttacttcctgtggagggatgctcgtatgcctccatgctgccctgtcccctgagggaggagcaggggctgaggagagtaaatcaaggtaaacccaagctgaaggcccatctttggtcccaacgagcacttgtttgagagaggacttccagggaaggggtaaggaatctagggtgttggccaccactgagtgtggacttctccttcttaatgtattagaagctgcaggatgctgaaattgcaaggctgatggatgatctggaccgtaacaaggatcaggaagtaaacttccaggagtatgtcgccttcctgggggccttggctttgatctacaatgaagctctgaaataaaatgggaccgttgagatgacttccgggggcctctctcggtcaaatccagtggtgggtagttatacaataaatatttcgtttttgttatgcctactcatgtgttctggcttcccactgatttccagttgcttcctgccttgctgctggacccaccatccagtggtcttagtcacagttaaactctgggagtagtagctcattggcccaccaggccaggtctgccagctgaccaggaatctttatgggtattagaagaggaggcccctctaggcaaagccactctaaacaaaggctcaatcaagtgaccttcaggagaaagtggcctttagaggcaggtctgcagtagtcccagcagtctcctggcagacacactttggtctgggtgtggtgaaacagggagtactaggtgggccctgacgttgggcaatccaccttttcactgtgtgtttgtgtgttatatgagggaggcgtggggagaggcacatctgaggtgagcagggagggacacaggatgactgagttttccgtagctgcctgtgttccagttggaggtggaggag

SEQ ID NO: 28115 - DNA, 1184 bp, Mus musculus
gattcagacaccaggttatgctacctgcacttccttcctggccccatcctctaagatcgcacacgcttaaggctgctttcagggaccaccacctgcttctggcccctttccctactctggaactcaccatataccagccccagggactccccaggcactatgtgtgtatatatacacatagtgcctatatatggagagagagagagagagagagagagagagagagagagagagagagagagagagagagagatttggagaacaccatagaaaaatctcacctctgaggcatagaaggagattgccatagcaaagacatagaaaatatgttcagtaaatcataaaagaaggacttctaatcgcgttcttccagtcctggcctttctcttctccattcctccgccatcgtgtgcgctattcttgattcggtttctcgccatgtcttctcacaagactttctgaatcaaacgattcctggccaagaaacaaaaacaaaatcgccctattcctcagtagatccagatgaaaactggtaacaaaatcaggtacaactctaagagaagacactggaggagaacggagctgggtctgtaaggattcacacaatggcaagactgaggatttatactgaattgtcatcaatcagtcctacctagagacttttcgtgtcttaaattaggatgtttgtccagtaataaaatatagaccctttcaaaatgaaaaaaaaaatcataaaagttcccaaacctggagtgagagctgtctattcaggagaagtctatagaacaccaaatagataagaccaaaaaaataaaattttcatgctgtattatattttaaacattagaaacacagaatgagagagggtattggagctgcaatataaaaagtctaatatcttaaaattgaagaaaagtaaaaataattcacgataaaaacaaattaaaggaacctatgactcctaaaccagttctacagaggcttccagaaggaatacttcagtatggagagaagaataaacacaaataaacaatgctaggatagaaaagaccataaaattaacaaaacgacagaaattaatacacacatttgtttgtttgtttgtttgtttgtttttcaagatagggtttctctgtatagccctggctgtcctggaactcactctgtagaccaggctggcctgg

SEQ ID NO: 28116 - DNA, 1185 bp, Mus musculus
tctaaagtatcaccttgaggactaaaattcctcttttgcttaaaagtcagcttgaggactcaggctccgaaaaaagctactctctgagccagctcccgacaggaggccggagactagcctcagctttacaatttgcatttaaataaagtacctagagttccccaaaagaagttctgctttcctactttctcactgtccgagattttgtctttcaagcaggtaaatcaacattctcgaggcgaccagcggatgtgcatccccacgcccctagagcacacatgtggctgctgttatctccttcccaaggacatttccagcatgtggctttcagtctgagttaaaaattaggtttaccaagagggctagaaaagtagatatttctatattaataaagattggtttttattttgatagacaggcttagtcccttagctgacctctggcttttcacccttgctgttactgcaaggtgtccttaggctgtggaaaaagcagggatgaggagaaacgacttccagctcctattttagccacaaatcgtggtgttactaacgacataattcttgcttaggctctgctaattctgaggttgataattctcctttaggagctgcacagcactcagaactgtgcatactggtttgtgattgtacaaattcagtatgggcatcgcttggtgcagaggtactgcaagggaaggtccggcttgaccatttctgagtttcctgtgagataaacccggtttaaaagaggttggtatcatattttggttaaaaatcaaaaatattttccggctctgcctcgcctccccaaaagatacccagagccacatgtgtgggtcttaccagtacccacggggggaatcgggtccatgtccacccaagccaaggttaaaagcccactcatctatggatgagaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcgaactccttctccctgcttcccacctatcatccaaaaatgcggaggaatatcaacttagtgttattttcacattgttcagtcaaacatagccagagttccaacgccctacttaaa

SEQ ID NO: 28117 - DNA, 1169 bp, Mus musculus
ttagcctggtcagcatgacaaggtaaacaatacaactgaattttttttttttttttgtaaagatgtgtgtaaagaggaatcccctttcactgttgttgggattgaaaactgttccaggcccctaggccgagtgtgagcaccgccaggatgacgacttcaggcgctctgttcccaagcctggtgcccggctctcgggggtcttctaccaaatatttggtggagttccgggcaggaaaaatgtcattaaaaggaactacggtcaccccagataaacggaaaggtctcgtgtacatccagcagacggacgactcccttattcacttctgttggaaagacaggacctctgggaccgtggaggatgacttgattatctttcctgatgactgtgagttcaagcgggtacctcagtgccccagtgggagggtctacgtgctcaagtttaaggcagggtccaagcggctcttcttctggatgcaggagcccaagactgaccaagatgaggagcactgccggaaagtcaacgagtgtctgaacaacccccccatgcctgggtcactgggagcaagtgggagtagtggccatgagctttcagcactgggcggtgagggtggcctgcagagcctgttggggaacatgagtcacagccagcttatgcagctcatcggaccagccggcctgggaggactgggtggacttggggccctcactgggccaggcctggccagcttgctggggagcagtggacctccagccagcagctcttcatccagctcccggagccagtcggcagccgtcaccccatcctcctccacctcttccgctcgcgccaccccagccccttctgccccagcagctgcctcggcaaccagcccaagccccgcacccagctcaggtaatggaaccagcacagcagccagcccgacccagcccatccagctgagcgacctccagagcattctggccactatgaacgtgccggcatggccaggaggcagccagcaagtggatctggcgagtgtgctgaccccagagatcatggctcccatccttgccaatgcagacgttcaggagcgcctgctgccctacctgccctctggggagtctctgccccagactgcagatgagagccagaacacattaacctcgccccagttccagcaggccctggg

SEQ ID NO: 28118 - DNA, 1166 bp, Mus musculus
cgagatcctgaactccccagagaaagcctgctctcttgcaaaaacagctttcgatgaagccattgctgaacttgatacattaagtgaagagtcgtacaaagacagcacgctaataatgcagttactgagagacaacttaacattgtggacatcggatacccaaggagatgaagcagaagcaggagaaggaggggaaaattaaccggccttccaacctttgtctgcctcattctaaaatttacacagtagaccatttgtcatccatgctgtcccacagatagtttttttgtttacgatttatgacaggtttatgttacttctatttgaatttctatatttcccatgtggttttatgttttaatattaggggagtagagccagttaactttagggagttactcattttcatcttgaggtggccaatatgggatgtggaatttttacatgagttacacatgtttggcatagtacttttggtacattgtggcttcagaagggccagtgttaaaactgcttccatgtctaagcaaagaaaactgcctacatattggtgtgtgctggcggggaataatcaggataatgggttccagtcatgagtgtagtctttgtgggtactgtaaggcctggagcacttgtgaggctgtgacacaaacaccctgtggatgcacgctaggatcgtgtgtgtctgcgtgcacactcttgaccacagctccagaagatgtctctagacaaagtcgtgacccaatttactctggtaagggcagaaacggttcacattccattatttgtaaagttacctgctgtttgctttcattatttttgctacacattttatttgtatttaaatgttttaggcaatctaagaacaaatgtaaaagtaaagatgcagtaaaaacgagttgcttggtgtgcccggctccatacgtatcaagcacagcggtaaacaaaatcccatgtatttaactttttctttctttcttttttttttttttaagttttttgttttgttttgtttttgcttttgtgattttttttttctttttgatacttgcctaacatgcatgtgctgtaaaaatagttaacagggaaataacttgagatgacggctagctttgttttaatgtcttaagaaattttcatgaacaatccaagcataattgttaaga

SEQ ID NO: 28119 - DNA, 1305 bp, Mus musculus
ccaaccagaattatcacagttttccccaaaatcaagattagtagagtatactttgaaaacaaatgaatcatgaaaagaataaaattctgacacatgaaataaaaaagaagagtagcttgccaggcgtcctcgttggagtgacatcgtctttaaaccccgggtggcaatccctgatgcaccgccgtgatgcccagggaagacagggcgacctggaagtccaactacttcctcaagatcatccaacttttggatgattacccaaaatgcttcattgtgggagcagacaacgtgggctccaagcagatgcagcagatccgcatgtccctccgagggaaggccgtggtgctgatgggcaagaaaaccatgatgcgcaaggccatcaggggccacttggagaacaacccagctctggagaaactgctgcctcacatccgggggaacgtgggcttcgtgttcaccaaggaggacctcactgagattcgggctatgctgttggccaataaggtgccagctgctgctcgggttggtgccatcgccccatgtgaggtcactatgccagctcagaacactggtctggggcccgagaagatctctttcttccaggctttgggcatcaccacgagaatctccagaggcaccattgaaattctgagtgatgtgcagctgataaagactggagacaaggtgggagtcagcgaagccacactgctgaacatgctaaacatctccccctcctccttcgggctgatcatccagcaggtgtttgacaatggcagcatttataacccggaagtgctcgacatcacagagcaggccctgcactctcgcttcctggagggtgtccacaacgtggccagtgtgtgtctgcagattgggtacctgactgttgactcggtgctgcactccttcatcaatgggtacaagcgcgtcctggctttgtctgtggagactgagtacaccttcccacttgctgaaaaggtcaaggccttcctggctaatccatctgcatttgcgactgctgccatcactgctgcccctgcggctgctacagcacctgccaaacctgaagcaaaggaagagtctaaggaatcagatgagaatatgggattctgtctcttcaaagaataatcccctcaaagcaaccaagtcagcctgcttaatttgagaaagatggaaatgaaggcttatttctctttaaaaaaaaaaaaagtaactgacttagtaaaaagtgatgtttaatagctgatatttaaacattaattcagatactattaacactaacagacaagaagggaaaagcataaa

SEQ ID NO: 28120 - DNA, 1170 bp, Mus musculus
aaaatggtgaggatagttcttaggcacaatctaaatatgaagttactgaaaaggcactctaaagaaaaaattaaaaaaacatgctgatgacttaacaaaggtcacttaggacctaagactagaacaggaggacttgagagattatccttatgcacgtggctgtcagaagtttgaatcagagaagataatagtcgcctatgttttaacatcattaactgacattgtttgcctttgttctaattatttactttttttttttttttttttagaatcaaaaggaccctctggctgtggacaaaataatgaaggacctggaccagtgccgagatggcaaagtgggcttccagagctttctatcactagtggcagggctcaccattgcatgcaatgactattttgtagtaaacatgaagcagaaggggaagaagtaggccaactggagcactggtacccccaccctggtgcgtgttcacccacggggtcacttgaggaatctgccccactgcttcttgtgagcagatcaggacccttaggaaatgtgcaaatgagatccaactccaattcaacaatctgagagagaaaacttaatccaatggcagagaagcttctgagttttatattgtttgcatcccattgccctcaataaagaaagtcctttttttaagttctgaatttgacgtagagtgtttcttgctccttctgaaatgcttgctccctgcttctttgagtcaggaagagtcagcatgaccttgggcaatcagcataccacaggactgtctctccataggaccagtgaaatgggaaagcattctcctctcaggcttggatctgacttttctatttgtttttcaaactatgtctaagtgaagaaccaaacctcaaagcgttccaagagggctcttcaagaatgtaatctaattctgtaactcctcagcatagtcttacccagttaaatgagtgccatggtagctagcaccttggatacccatgatgtatgaatccattttctcactgcaaaaactacaacaaaatctagagtcaaaataagcctatcagaaaacgagccaaagttcatgtggtggtggcacatatctttaatcccaggaagcaggggcaggcagatctccaaggttgaggctagctggtctacagagtaagtctcaggacagc

SEQ ID NO: 28121 - DNA, 1102 bp, Mus musculus
ggactgctaagctattttgtatttgctttgcattttctaaagtttctaaaatatgcaagaattaagtagtctttatataaatatatggtattttttgcatgtagccaattttttttaactcaaagataatcttatattctttatactccccacttttctgtctcctaatgtctcctaacccaggttatttttgcaacaaatagtggatagcactcactgtaaatatttcagtatgtatttctaaggaacaaagtgtcttctttctagatagaaccacagttctattattatacactccaaaaaaatcaatgtgttagtagattttaaaaaatgaactaattatatctttcttagatacttgatcatctaaggaagataattagtgcttggtgattgtgttaatcagagtgcagccaggagacagaaagaatgtggtcattttaacagggaaagtctaatatgaaaaacaactggttagtaacatgaatttagctaagagataaaatgaactctgaaaatatagtagccaggtatgttggcttaagcctgtactcccagcacttgaaaggttgaggcaggaggattgttatagattcaaggccagattgagctacaaggggaaattctgtctcaagaaaaatatatagagagatcagatacagagagctacatctgggattaaggcagacaagaacaaatcaaatgggttttcttgctgttgagtctttttatttctctcactcaccagtcaacatataattcagtgatctttggtcactctaccgtgtggatttctttctaccaccaacaagccatctattcttcaacaggcagcatgagtgtcttttactttagttgagtttgaacattgtcctcctgaaggcggcatcatactccacagcgtgagagctagaaacacatgccaacctcctcccaaactcagatgccttctgagatcccaggctgcctctggcccactgtctctatttagagttataaaatgctagagcatctctgagttcaagaaagcacattacttgtgctgactcttatcaaagggagggcaagatatgacctgccctttcagtgttatgcaacctcc

SEQ ID NO: 28122 - DNA, 1150 bp, Mus musculus
tctgaggtctctgagaactcagagtggaagtcaatgatggagtcccatccccacttggtggctgaaacattccactccctggcttctgcacagtgtttcttggaaccctcaatcaaacacctaaaataagtttaggggatggaaatctatgaccaacatctgtcttccaacaggtataaccagtgttgttaccactgatttctggttagagtacagtattgctggaacatttatagtgaacctgtgaaaaagaagcatggtggctcaggatttaaaacagctgttatatgttaaaatggtgggtgggggatgggcagcactggagtctgggacagtctccttgacttctactctgttaatgttctagtatgatttttgtctgatatttaggaaactgggatttaatttaggtgctgtccctaaggacagacaaacctgagtttcttctgagaaaactgtctgcactggactatgtagaagagatgagtggggcccagagcgaaggataaatcaagcacaaatgttaactcattgggatggaaaagacaatgaagacttttcatttttaatgattcatttatgggaactcagcagtagaaacagttaaagctcactcagagaactctggttcagttctcagcacacaggagagtttttcagccacctgtaacttgtgatccagaggatctgaggccctcctcgtgtctccattgctacaaacagctctgtagacaaaaccttaaccaaataaaatataatatgaataaaacttttgaaaacagtttgtgggttctagagatgtttatgttcagagaagtcacatgtagttcagttatcctgctcagctctggatgtttgtgcagacctctcactgtcctaccagtattagaagccctctaactttttcttggcatttagtgttgacaaatgagaactctaccatcatgctcttatgactactgggaagagtagaccagagtggagggagtctactccttctgggatagatgtgtttgtttttcaaggtaggcaaaaatcttttgtatgttttgaaaacattagaagggattagttcattacagattcatactcccgaggccagtaatcttccaaaagttgtgtccccttaatacagttctgcatgttgttg

SEQ ID NO: 28123 - DNA, 1111 bp, Mus musculus
agacgtgtgacaagtgtagttcctaataaatgcatggtgtgtgtgtgtgtgtgtgtgtgtgtgtgtgtgtgtgtgtgtgagagagagagagagagagagagagagagagagagagagaaagagaaagaaggggggcgccaaaggtccaccttatttgatacagggcatgagttgagcccccagggatgtaggtattacctcccctcagtgctaaggttatggacaatatccaaactcagatcctctatgcagctggcactttaacgactggaccttataacctgccctagtaaattgacggtggtggtggtggtggtgtttgtaaggaagaataaaaactgtgagaaagtaagggctgtctcttttctatgcccctcccttttggtgatgctggagatgtaccccaaggcctgagtacactaaggcacagcctttacctgtggctgatcccatgatcatcttttccatagcctgcagagatttcatctgccattcccgttctcattgacagaaattggagtccggggtgatctggtctcagtgaagaaatctgtgggtcgtaacaagctcctttctcagggactggcagtgtatgcttctcctgaaaataggaagctgtttgaagaggagaaatcggtgagctcaaaggaccaaggggtttggaaaaataaaactttaaggtacctgctaggaagtccttccttttgttgtttaattcaaagatgaagtaacagctagaacccagaagcccaccagttcccagcacagctgggctgtaattactcagtgtggcgcattgcttctactcagtttcatctctttcagctgagacgcgaaggaaaactggagaagatccagacaaaggcaggagaggcggtgagtaggaagtttttattgattcctcatggaggtcatcgccctcctgagtccctgatggccttcacgtctgcttattgttacacacaaggatgagctaaagtagtattgtggctgatgctctgtgtagctggtatggagtcctctggaactgctgtgttgggtacagtgtactggaactagctctgtacatctgcctgcctctgcctcccaagtgctgggattaagggcgttg

SEQ ID NO: 28124 - DNA, 1148 bp, Mus musculus
gattaagaggccgcggaggattcggcagcagtcttaggggggccacggtcgtggtcgaggctgtggcagtggtcgatgctgtggggctcatggaggtaaagctgaagacaaggagtggatccctgtcaccaagctgggccatctggttaaggacatgaagatcaagtccttggaggagatctacctgttctccctgcccattaagaagtctgagatcattgactttttcctgggtgcatccctaaaggttatgaaaatcatgccagtgcagaagcagacttcagctggccagcggaccaggttcaaggcattggtcactattggggactaacgtggtcacgttaatcttggtgttaagtgctctaaggaggttgccactgccatccgaggggccatcatcttggtcaagctttccatcgtctctgtgtggagaggctactgggggaacaagattggcaagccccacactgttccatacaagccgtgacaggccactgtggctctgtgctagtgcgtctcatccctgcccccagaggcactggcattgtctctgctcccgtgcccaagaagctcctgatgatgaccggtatagatgactgttacacttcaaccagaggctgcactgccaccttgggcaactttgccaaggccacctttgatgccatctccaagacttacagctacctgacccccgacctctggaaagaaactgtcttcaccaagtctccttatcaggaattcactgatcatcttgtgaaaacccacaccagagtgttcagaggacccaggctccagctgtggctaccacactagggtttttatacaagataaatacatgaactaagtctgatagatagatagatagatagatagatagatagatagatagatagatagatagatagatagacagatgattaaggaagacaactgatgttgccctctggcctctatgtacatatgcacacatgtgcacatgcatccacatacatgtatataaccacacaaaaagggggagagagaagggaagggaaggagggctatcttgaggagaagcagtggtaggtaccattaacaagtggttaccattaacaagtggtaccattaacaagtaatcacttttgcaggcccgaaggatgagaggagat

SEQ ID NO: 28125 - DNA, 4221 bp, Mus musculus
ttttgttgttgttgctgctgctgctgttgttgtttgtttgatttttaatcaataactctccatgctgttcctgacccaggagagcacctgtccagagttttagccatttgactggataagtcacagtagtgtctttcttcactaaccaagaaaataaatgtgggggaaattttttgctactgttgtttataggtgtcagtgctggagcagaatttagaaaactctgtctaaatacttggttacttactctgaaagaaaaatcagaaaatgaagaagtatagtcagtcacttggaagttggtgttcttgctctagtagaaagaacactgggctctggaagtcatctgggatttctcctgcttcttttgtctgtgattttgggcatagcaaccacctttttagatctgaattatctcttttgtaaaagagaaagactgagccaggtggtaaatattcagagtcctctgtgatgtgagcggctgtgttggcttgggattgttgaatccggttgtcagcgcgtgtgctgctcccatcgtgtcggagggttgtctccagatcggaggccctgctgctcctcagtaactcttttttttttttttttcctttcagaatattttccagatggcgaggtcacagcagagggatgtggccacctagcctttcctcatccctttatcttctctttgccctcagcctcttagccttttcgtctcccatgtcagacagtaaccattaacacaaaagaagaaaaaaaggaaaaaaaagtcactatgtcccaaagtcctaagctaaatattattaataacttcctgagaatttcccgtctctggaactgagctggtagagagcaggttgatagtaccagaagtccactgagatcagacacacaagcccagccaacacgccaaagtcatctttgtcgtttgacccgggcctcataccaacagactctccttgtactatatttttaaaactggaactatgaactccatccatttgcactgttcaagcatatatatgtatgtatgtatgtaaaaattatatatacacaaattagctgcacgtatatacatatatatatttctttttaaatttcatattgatggcagtaccttttttagcttgtgtttttacacacctttcacagaattcatgacctctctcttgctctctttattttgaaacaaactttaaaaaggaaaaaaaaatacagggaaaatacctctcctcatgaaggactcgaaaagtttacaacctgcttgggttttcttcccttttttgtattgagtacagtttctggctgttggtttgccatagagtctgaggatcgaggagtgtagtgtctttatcttcaagagggtgctgaggaggagaaaggccgtttctcaagagcagttgaggctgcagggagtctaaagacctagagtctcgattccaagtcattttccaagccatggtccatcgatcgacgttgagtccgtcctccatctccttcctgtttctttagggtcttttattatgctcccttttaactgacccaaaacagttcagggtaatctgaggaagctgttatagtaggaaactttttcttctgcaacaggggttgtatcaggactaaccctgacatcagaggttggacagatggaggaaagggaggatggaagctgtgcctcagatttataagggccttacctcttccattcctgtccagtaaccatctattttacatcctctgtgagttctttaaacagctgtacgtggaaggagtgtcttgggtaaacttagagtctgggttgctgccaaccaaatcagagccctgttcatgacagctgagggcccaagaagtgggagtatggtcaattttagttcaccaccaccatttacttcaaaggagactgaagagaaatctcttaaagagttctttacctggagctggggctggtcccgaggctgaggctggggccgggagtgtttgcctagcctgcataaagccctcaattccatccccagcaccacataaaatttgggtgttggggtattgtagcacacacctgtaatctcagcacgtgggaggggaatgcaggaaactcagaattttcaagtccacctctgctaactaatgagttcaaggctatcctggatcacatatctcaaaagtagaagagttccttacctgcccctgcacttagacctcctaggacctaaaagcaacatttgggacagaggccaggctggcactagagtaatagtctcaaaccttgagtgtaaagaactctgaggttaggtacaactaaaacacgtctttgaaactctttatctacttttccttcgatattgaagcctccacaggcttcgtctttggctttatgtagctgaaaggcagccagaattggatgtagttggcagtgttggatttggtttaaagtttctttcatgccttggttttgcagagcattcattatgaggctacttttctgtctccattattctggcagccacttgtcgcaggaaggtgtaaacacaccttttaggatagtctttccctcccctgtccaaacccgtgggaccacaaagtacaaaatatagtagtgtttaaagttgaaaagggcaatacctgatttggaggctttaatcaggatcaactctccctcttggctttactaatgagtctgagtaccttaagagggggcgagttgatttcctctccaagatgctctggaggccagctgtgttcaaactgtaaaaagagcaacattgcagctaattccctcaggaagagagccttccagaatagggacagggctttggaagtcctgaagagtcagccccactgtgttggggttaacagaatctgtaggaacaccctgctttaggtagtcttcctaccagaacacccagctgcagcagggagctgggaagaagcagctcccagggtctcccagtggagctgcagtcctggaagaggaggtcacggtggcctagaggcccacagaggcccacaggatcaagttcttttgcatgaagcagtgttagatgtaactactccctcccccaaacccctacccttcctttctctaatcccttctatgtttcttagacctggcttctgcccaggaaggcatctacaggttttttgggcagtttgtctctggggaagggacttcccctcccagcttcactccagcagaatcttcctggtctccaactgttctttcctccacgaggagtttctgttctctgatactaaaactcaagagatctttacggagcaggaaactacttagtccctgagaagccaggtgctctaggaagctttgcttgggcagtgctttgagcttgccgctctttgtacttttattccggtcttcgtctctccgccttccccttgcccttgcggaggcctcagctcagcacagctacagtcagtgttcagggcagttcccaggccttgacagagctctcagggaggaacaaggtaaatgctctagcatcctcttgcctggcccatttaattttatcctttagttacctgggccagtagctttgaattatcccttcattgctccaaacccgatgcctgaagcagcaaaatagggcactgataagagggagcacctctctcatctcagagtttccagcttaagggccagctcctagaaagcagtcttcttaaagggacctacatgcatttgcgtttagctgaagtctccaggaatggaggtcctttctgccctcctttccattctgctggcttcagcacactgctgctccttcaccagttggatgggttgctttaacttctttttggaggagcagcagtgtggctgaatacttagcgccagcgggagggagaacgcttctttagtcctccgtcttggattcttcttcctctaaccctcagcatatctgccagggctcctttccctggatagcagcagcttctttctcagcagtaactgagggtgcatggaaatcgggctctggggaggagcgacaccagagggactgatcctggtaggagcacttggttagctgctgaccatgggtgccaacttgttattatgcccccttgtaagctgctgagctgggcttcagtttttcccaggccatgcacacttataatttatttgagagaaactaattgtattttcactgcagtatcttgtacttttatttgtgatttacaaaatgtgaagagaaagtgcagagacccactggctcc

SEQ ID NO: 28126 - DNA, 1105 bp, Mus musculus
cagcctgattgacccagttttatgtttcttctaccttacttaacacccttaaaatccatttcaattcatagtcttaagattcctgtttgaatgcattagcaaactcattaagccctttagtgatatggtgtactccttcatgaccacacctttgatctcccagcctagccttaggtctagttatgggactagaggcaactattggtggttcctaagagacatcaggattggcttgcctggtgtctccttcagagaaaatcacagctgcttcagcatacaatgaacaattaattcctcttggcaaaggtggagagggcaatacttcaggggttaagggtccatcctctgctaagggtccatcctctgctaaggttacttcctcatatgcgttaaaccccccgaggatctgagggttcaaagttctcagctttgggtcctcccacaaatcttcatcctaagtgagaagatcccattcctgccaatcagtgtttttacacactggtgccctctcgggctgggacttgagtagactactgtaagttagccagccttaaaatgacgcttgggtttgattatctgccgcttgagctcagtggctgctgaaaagaagattctcatccagggcacacttaaaaacctttagaccagtgggtctcatctttcctaatgctccgaccctttagtataattctcagccataaaattattccactgctacctcataactgtaattttggtactgttgtaatgtagattatctgtgttttcacagcccacaggttgagaaccactgctttagacagtttatgtgaacctagaactggctacatttttcattgagctcatgcttttccattgtcagtttatcaagagctcctaggagaaagtagccagcactgttattttctttattaatccataaattgtcaaaagtatacagtcattagattccttgtggccatcacatgtttctagctttcagtgttcttcacctaccaggggtgtttttagtaactgagtgtcagtgaattgtaaagccttcaccagaagcttcaaaaattcatccctatctgggtgacggtggcatacacttttaatcccaaca

SEQ ID NO: 28127 - DNA, 1189 bp, Mus musculus
cctctgcctcccgagtgctgggattaaaggcatgcgccaccacacctggcttaagtgtttatttttaattaaatagagtaagaattgtatagtcttagctagaatattggtaatgacacaatttacatctcaaagtctattgcacattttgaagatggtctgattatatcaaggttcagaaaggacatcagcatgtgcctttagcccatgtaagctgccgacttattcaaccagtgttgagacatctcctgtctcctgtttcttactcctttgtaagttctaaatggagtgacaagagtgaactgaaatctcatctgggcttcacctagactgtttcacctaggcaggattctattttgaagtggcaacgtatctgttcatcttagaggataacttctacaacctaaagccagctttatgagttgtaaatatataaacttttaagacttaattttttctcaatttaatagaatttactttctgtctcatgttaaatattatttagctagcatgtagcaaggagaatgaagatttaatacaaattctttctcttcctttagaattacaatggtgtgtctgatgtagaactgagagtagcactaccggatggaacaacggttactgtcagagttaagaagaacagtactacagaccaagtgtaccaggtaaagccaacttacattggatgatgcgaaactaagaaacaaattaaatgagttagtacatacaaaatgtgcagagtacacttattaattcatgttactactatgaagttaactttgtccttcttaaaagaaaggtgtatgagaactgagtatatggcatgtgcttgtaatctcagtgcctaggaggctaaggcaagaattctgcaagtactagaatattcaggagtataaaacaaaaccttgtatttttttttaaaagtgcagtaaataccccagagtgcaatggttataattaactgttcttcctcttttgttgttgttgttattaaaaaaaaaatacaactttttttaaaaaagtgtgtttgtgtgtgcatttgtggaagctgggggtcacattgatgtcttcctaaacattgattgtcctctatcactttctggcttactcttgagacagaatctctagactggtggtcagcacactccagcagtccccctggtttcaccccagtagtgctggggttacg

SEQ ID NO: 28128 - DNA, 1201 bp, Mus musculus
cataggtccttgcatctcttcagttgcaatatttttgttttcccccagtcactgggtccaggagatcgtgtgtctttcttttccatccctgccttgctgctttactctcagtgccttaccagtgtgagatggatgaggatgctgttcttgccttttataaacctgcacattcatacctctccaaagaccagcctttcctcattgggggccctcagcctgtcctcctaccccagtgactgagcagctacaggctgctctgccaagcagcccctgggagaagggctttgatacgcctggtaaggtggtggggactggttctgctcagggtttccatcttccttgccctctgtgactgaggatgctgccataaggtggttgtacctgggaaccatggcaactgttgatacaggttctaaagtccaaacatctagtccctgtggcctccttatggcttctcagatgtgcccagttctgtgggaaccaacagatccttgcttttctcaagaagtgggccctgattcagagcctcgcctggggttggaagctgactctcagtagagatgggaaggggtcctggagaatgtattcctcctttgagttttggggtgtgccaagctcttgtgggtgaaggtaatggggatggttcgcctcttatctccaaagtaagttctggtctcatcaatgacttgtaatttcatgatttaaaagaagatattctgcaaatcagatattttctcccaatccagccttggtttattttaaattaaatattaaaaatggcatatctatatgaaattcttgtcttcatttttctggttaatttgaaggcctactccaaaaagttttttttttcttttctctctcttttttttttaacgtgtggtgtgtgtgtgtgtacacatgtgaagactacatttgtagaggtcagaaaacaacttttgagagagaacaacttttctcattttccacagtgtgaatcctgggattgaactcaagtcgtcaggagtcttggccacaggcacctttccctgccaagtagatcctattccaagagtcctttaaagtgtacattaaaatgaggctttagctcattttttagaggtctcttgtggctgatcagggatctaggaaacagactacttgtagtagaaccatcctgtcctaagaagctctgggaatagcttatacagagtgctgtatg

SEQ ID NO: 28129 - DNA, 1767 bp, Mus musculus
tgcgatggccaagcatttagtgttcaacccctcccacagatctagcaacatcttaccacggggtaagagggggaaactggtactgcgggtaagatgtcatactgtatgagccaggaggagcatcttcctctggcctcacccattcactgtttagatgcacactatagcagactataagcattctaacctgggaaggctggctatagtaagagccgattaagggggtaacatgttgaaattccaagatatgtctatggaatgcttttcatttctccccagtgagctaaccatttcttcccaatctcattttcccagggctcagttggatgtctcacttgaggtaatgctcatttcatggacactttgcacaatgtctgttctttctgatactgtgatttaactcctgaagtgtaactgacatttctgctctctgttcccatgcccattcctttaggcctggccaggcttctgaacgagtgttcgactggagcatgaagaatacatatcttccacctcccctcgtccctaacaaagctgccactgtgaagcctgtaggagtcaccccagcggagccccaagagctggcaggtcctgtgctccaggcacttccatccccagcctcaactgcaaccccaccagcaacccccactcacccacagccctccgccctgccaccctcggccacagaggggactgagtgtctgaatgtcagtgaacaggaagaaggaagccctgtcacccaggatcctgagccagcatcaggtggtggaggtggcagtggggttggcaagaaagagcagctgtctgtgaagaagcttcgggtagtactgtttgccctgtgctgcaacactgaacaggcggctgaacactttcgaaacccccagcggcgaatccgtcgttggcttcgacgcttccaggcctctcagggagagaacttagagggcaaatatctcagctttgaggcagaagaaaaactggctgaatgggtgctgatccagagagagcagcagctccctgtaaatgaggagaccttgtttcagaaggccaccaaaattggacgctctttggaaggggggtttaagatctcctatgagtgggctgtgcgcttcatgcttcggcaccacctcactccccatgcccggcgagctgtcgcccacacgttaccgaagcatgtagcagaaaatgctggactcttcattgagtttgtgcagcggcagattcacaatcaggacttacctttgtctatgattgtggctattgatgagatctctttgttcctggacacagaggtgctgagcagtgatgaccgaaaggagaacgctctgcagacagtgggcacaggggagccttggtgtgacgtcgtgctggctatcctagcagatggcactgtcctccccacccttgttttcttccgaggacaagcgaatcggttcgctaatgtgccagactctatattactagaggccaaagacagtggctacagcgacgacgaaatcatggagctttggtcaacccgtgtatggaagaagcacacagcttgtcagcacagcaaaagcatgttggtgatggactgtcatcgcactcacttgtcagaagaagtactggccctgctcagtgcctctagcactttgcctgcggtagtccccgccggttgtagctccaaaatccagccactagatgtatgcatcaaacgaactgttaagaacttcctgcacaaaaagtggaaggaacaggctcgggaaatggctgacgctgcttgtgattctg

SEQ ID NO: 28130 - DNA, 1182 bp, Mus musculus
tcagactgaggctcgggagcttgtggagcgctgcatgagagtgctgtactacagagatgcccgttcgtataaccgggtgagaaatgggctggaaggtacaaattctggagccaggcatggtggcacatgcctttaatcccagtagggaaacaggggtgggtgggactctgcatttgaggcgagcttggtttacatagtgagacgctatcattgcacgctttgccttctttcagtttcaaattgccactgtgactgaaaagggtgtcgagatagaaggaccgctgtccgcacagaccaactgggacatcgctcacatgatcaggtgagcaagctacagtagggatcggtgacacagggaagctcttgacttttacagaatggctcttctggagggttcaagcagaaactctgtgtgggtggttttggagggaacctctccaggttgggggcgggggaactctccaggtgggtggtcttggaaatggggagctccttcagaagttgatgcctttatccgccttcattttccctaaatgtttcttctttctttagtggctttgaatgaaatccagttgaatgtccagagtgttgaagctttgctcttctaaacgtgactgtagctggctcaaaggcagacttttgtaaaataaatcagtcgtttgaagtgttcgctgagttggattttgtgttttgaaacaggatttatgtagcccaggcttgcctggaacgcagaaatctgcctcccaaaagctagaggtaaaagcttctggcatagctggcaattcagtgtttattctaacatggtcacattgagacctcagctaccaagtactgctttgtaccatgtccgtgctgtttcctttcctggagagaaccatttaagtcttaatgtgtgtgcccagaggttgtctttctcaattattttcctttttttttttttttttttggtttttcaagacagggtttctctgtatagtcttggctgtcctggaactcactttgtagaccaggctggcctcaaactcagaaatccgcctgcctcccaagtgctgggattaaaggccctggctttgacatggttttcatgaacctgagcttatcagttcagctagactgactggccgccgggccacaggggttctgtctctgctgccctaagcactgggattgtaagtatgcatg

SEQ ID NO: 28131 - DNA, 1145 bp, Mus musculus
aagcccaaagatttaccatgattaaccagccaaggtcagttccacccttggccagctagtatggccaggaagatgtttatgcaaatgtgtctctacacatcgtggaccacccttgggaaagggtggagtccgccgtctcacagtcccaggttccccagatggaggcttgggtggaggatggaattgttgctggggagcagctaacgaccgctgggtgcggtttagcttgctaggctgggatgagctggactgctgcctgtcccctgaaccttgcatctccctcagtgcagctctaacttttatctcattgtagcctcggaaggacagagaaggaagccattctcgttagtctcttcattcttacaggacagctttcgcacctctgtctcccagaacaagctccttttagggtctgaatcttaaactttctccgcagccgtgtttcctacctcccaacctagtgtcaccttctcagaggatatgaatgcccctcccaagccatttcattacattaccttcattctgcagccaccagatgtcatgcacttgtcacatgtgtcaggacctagccaggactgtgggcttaggctggattaacagatgctgcgagtcagggagcacctgcaggaaggatgcagacgctccagctgtgtccttgggaacagcaggaaaccagcccatattaatcaaggacctactccgtcctccccacaggacagcttcttgtcagggaatcttggttttattcccaagaaatagattttctttcagggagataccacccatttgtccatttatttccatgagaacagattttttaaaaattataagtaatctttgatatctataaagaaatatgtactataaattatgaaatgcaatgaatacctatgacccatcattcaatttatacattgaaagtagttttttcccccttgcccggcctcttcctagaggtaatcactgtctttaatttttggttattaatcatttgtttatatatattggccatgtgtatatatattctttaggaatgtataattttgtattgcttgtatttttagctttaaaaaatgttgtcctgtgttccttgaggtttgcttttttgcacttacccattgtttctccgactcctctgttgtaat

SEQ ID NO: 28132 - DNA, 1195 bp, Mus musculus
atgagtcgcagtgtaagtatttttggagacagaggtttgccaaagaggttgagacccccaggttgagaactgccatcctataggaagggaaagatttacctttgcattctaagtatccaacgtttttataccacagggaaaaaaattcacacatgttgatacagcagtcagcttgagttcagagcagatatgagaatttagtgggacataaggaagatttacgaagttgtaaaacaatgtgattatttcactgatgtcttatttgggaaagtgtactttttaaaagtgaatacatttaaaattttaaattcataggtttaactaatttttctacattcctatttgccttttttaaaagtcttagtccttttgttttatttggaaaaaacaaaactaaaaccaaacaaacaaacaaaaaaaatcaccaggagtttggctgggcatggtggcctcccagcaaaggcaggcagatctttgtgagttcaagaccagcctggtctacataggtagttccaggataggcagagttccataaagagaccctgtctcaaaaacagaatctcactctgtaacctagcctggcctcaaatctgagctcttcctccctcagcctcgggagtgtgggacttacaggaaggctgcttggcttctccttggtatccttaagtgtcagatcataaagccattaaaagcatagggaattatattccaatccgattcccaaataactcaaccatggcaagaatattcaactctgaagcatattatttgtactattctttaaattcttcaccaccgaccctttttgtgtgtgtgtgtaccagtgcatgtgtttgctggtatgtacacacatgtgctgtggagaccagaggacaagttttggtagtgttccctcaggtgccatccactttaggctttgttattgtttttttcggtttgtttttctctcactgacctggaattcactaaataggccatgctggctgtccagcaaaccttgggactcttcttgtctttgcttcctcactgttggggttgtaagcaacaccaccgcacctggctttttaactgcggattttggaactggagagatagttcagtgattaagagtgctcaatgctcttgtgaaggacccaggttcaattcccagtatccacatagtagcacacaaccacctatgaccctagcggcaggg

SEQ ID NO: 28133 - DNA, 1192 bp, Mus musculus
gatgttgaaggaaaaattgcttgaacaggcttcatggtaaagggaagacctgaagatgataccactaaccagtgtgtgtatgtgtccctttctgttcttttctcccttcctcctctagcttggaagctcgaagtctggctgtagccatgggagacatggtagtggagcctgccaccctgaagccaacttctgagcctactcctagcccatcagggaataatgggggctccctactaagcgtcatcacggagggggtcggggaactgtcagtgattgaccctgaggtggcccagaaggcctgccaggaggtactggagaaagtcaagcttttgcatggaggtgtagccatctctagcaaaggcaccccgctggagttggttaatggggatggtgtggacaatgaaatccgttgcctagatgatccacctgcccagatcagggaggaagaagatgagatgggggctggtgtggcctctggcacagccaaaggagcaagacgacgacgacagaacaactcagccaaacagtcttggctcctgaggctgtttgagtcaaaactatttgacatctctatggctatttcatacttgtataactccaaggagcctggagtgcaagcctacattggcaaccggctcttctactttcgcaatgaggatgtggacttctatttgccccagttgcttaacatgtatatccacatggatgaggatgtgggcgatgccattaagccctacatagtccaccgctgtcgccagagcatcaacttttccctccagtgtgccctgttgcttggggcctactcttcagacatgcacatttccactcagcgacactcgcgagggaccaagttacggaagctaatcctctcagatgagctgaagccagctcaccgaaagagggagctgccgacattaagcccagcccctgacacagggctgtctccctctaaaaggactcaccagcgttctaagtcagatgctacggccagcataagtctcagcagcaacctgaaacgaacagccagcaaccctaaagtggagaatgaggatgaggtaaagctgggggagggacagatgggcaaggtgtctgagcgttgcatggagacaggatgtcttatatgggggttactctactttctgtcctttcctctgttcatttcacttatagaaacatggaatgttagaatgga

SEQ ID NO: 28134 - DNA, 1148 bp, Mus musculus
tactcccaattcttactatgttgtctgtgtactggagtgatgtgattgtcctcatggttcatattctctcagaggaagtattgaaaaagaggattttccttgacatacatctcactttatccagtttgtgtgtctgctttcctgggccctgaccttagcatgaacccacagagcttctaggcctctctgtaagactgtcattgatagtgggaacagtttttcccagttgcacctgtgccttctgaagccctgatgataagctcagaggcatgtacaccctttacccagatggaatacaagctcctacctgtgcatgttttccatggtcatagtggactgctgatgaaggttggaacagagagaactgtcagtagaacttagatagggaggtagtggcaaatgctctctcttctcacccaggctccctacctgatctacgtggaagttctcgaatgtgaaaactttgacacaactagtgttcctgcccggattcctgaaaaccgaattcggagtacacggtctgtagagaacctgcctgaatgtggtatcactcatgagcagcgagctggcagcttcagcactgtgcccaattatgacaatgatgatgaagcctggtcagtggatgatataggcgagctgcaagtggaggtgagggatctccaaggagataatcctaggggcacagcccctgttctctaggagcttttaatacatgtgaactaacacacctgttaacagagcgaggcacaaatttgcatgaatattgtacatagtaaggggtatgagaaggaaaagctctgagtagctggttggaataggttcaagctcctcttacagcaggagttcaggttgaatgtaaggaggacctaggggaaactaataaaatattcaaggaacacctgctatataaagttgattgaggacagtagagactgacaagccacacattcatatatttagtcaaatatataaagggctggagacatgacccagggttaagagcactggctgctcttaacagagaactgtgttcctttcccagcacctctgcagtagctcaccactgtcagaaactccagtttcagggtactgagtactatatgctaatgaatgagacttggcttatacttgtaagagtttatgtgcta

SEQ ID NO: 28135 - DNA, 1192 bp, Mus musculus
atccctgagggacaggcttttgaggattctagtgacttgcacccccttccctctagggtttggcccctaggttctacttaagtgggccttctttttcctttctgaatccaacactaatgctcctgctgcagactcccagtaactgtggggggaggggggaggggaccttggcaagcctgctagacaggcatagggatggactgaaggatgtacagggtctagcttctacccctctactagagttcttcaggcacagaccagtatttcttcttctgggctgggttctgtcctagtatcccctcctccaacactcattggcactaacacccccaccccaatccctgcagtgccttccatttgtcttttcccccagaaatttaggggtggggggttggtggggatgagtcctgtcaagtaggttccagggagaggagaggacaggctctcaggaatcctttattcttgtagtagtagtaatactaacagtgggagaaacaggagggagaaaaccagaccattaaaactgcttgtggtttaatccccattcaggcttttctttttatgtgagttggataatgtgtactcatagggaggggcgagtcagaactggggaagcccttctcagggaagaggcagtattgacgaagacagatggaaaaagcaatcttccttcatcttgtgtgtttggtgccttttgtatgctggacttaaccctttccaagcactcctcccccagaagcaacaagacagatggctaactaaggattttatttcaaacaaaaattaaaaaaaaaaaaaaaaaaaaaaaaaagctgtttccctggatgtgaggaaaggatcagggtaagaaatttccccatggctaagccagtaccctcaatacatcagagggttttgtcagttctcccttccttacccccatgatggggacctcagcaagtgcaggacccacttgtcgggaatgtgggccaggggtcagcccccaggaggggactgagttaggcagcagcatggccaaacataggattaagtcctaagtaccaagaacctactcctcccagtttactgggacccagggaaaataaaagatggtttgtagaaaacctctgagacccctgaggggaagaagactccagtcctcctcatgttcatcacctctgttctctggagggcagtgagtcctgggatctgt

SEQ ID NO: 28136 - DNA, 1207 bp, Mus musculus
tttggagactcccaatgatttgtataaaggtgtttgggggaaagtaaggatcatccttactcccaaccttcttttccttaaaaaaggaaaaaaaaaaaaaaaaaaaacacaaagagcacacaatgtaaatttgagccagtctcagataaaagttctctaagtgttgtagaagagccctagtgtttgtgaagcagaaaggctggggctgccccaccagcagctgctctctgactccctcacttagggttgagggaatagagagggcctggcccttttttaagacaaaggggcagccatgttaggagagtggaccttagcaggaccctactcactgccaggtcttcggttattactattctgcaatttggaatgtatcctcatagttttttctagatataaagaattatcaaatgattttagaccattctccaaaggagatttctttgttcttcctatattttccaacagtattctgctctttgtggagctacggtggagggagatgtttgtgtctgtttaacaggcagtctgtatctatgaggctagagaatattttcttaaactcctagggagccacagacttccctctgtacggttgtcgccatgtcacctggcctgcccttactctgcagagaagctggaaatggggccacggagccctctccttcctctcagttgtggcccatctggtcctggctggtggggcagtgcatggtgtttcaggctggctgttgaaatcccacattagttccttccctgtcccgtcccaccttgatagcaggttagccaacccccacgtaactgtctatattagacacccccagccaccttctggctgcctgtctttgctgccatgttcttttttacaagaaggaaacaaacaatttcttgctatttttttttcataatttactatttatgatgtatttaagtgttttattcaggacagggttctgtaaggggtgggagggagtatttgagggagggctgggacttagggaaaggacatgggattcaacatttttatggagtgttactatttgcctctactttgtattgttgaaaaatgacagatgcaatataaaagtaataaatatctggttttaatgtattaaagttctagcaatcatttagacctatttttaaatgcttttattagtgtagtagtcataattgcattgcgttttcatacatgcacataatgtac

SEQ ID NO: 28137 - DNA, 1101 bp, Mus musculus
tatactttcccagctttttccgcctgttcctccagctgccttttctctcttggtttgtggtttgtcctggttttgtttttgttttttagacaaggtctcccattgtagctctggcagagctggagctcatggtgtgcttggtgacaggcgtgtgtccctgtgcttactcagccttctctagcagttgaacccagggcctcagacatttgctagttttccctgactcgtcagggaattagaagctgcccttccccctggcagaatcattgacttagctagaagcagcattggtctctgtggactaagtactaccttgccagttctcttgaaagcctatatatacagtggatgtgtttatctgttgaaggttttctgttatcatggtctttttaaggtctctaaaataaataattattatagtctttcacataaaaaaccagtgtgtgatacacatttttcttggcaggtttgttaagaagttggagcactcttggaaagcactggtccatgatggggtgagtgtaatgtcagctgaaggccttcttcccacttctccattttttgccatttgtcccctcagcagtttcttcctttttttttttttttttttttcatttatgggttttacccctctggtagggtttcaatctaagagaacaagctttttaacaacacagccttctgctgggcctctttttctctgtagttgtgtctcctattcaaaagacatggcctctttcctgctgggcctctatttaaccctgtagccgtatctttgctgggcctctgttaagcctgtagctatgtctcctcttcaacaggatacggtgtcagtgcatcgtccaggcttctatgctgagcggttccagcgtttcatgtgcaacacagtgttcaagaagattccctgtaagtggcttctaccagatgatcccccagtggctcccttcccccaagacatggggggcaagacacctctgtcagggagctgccaaggccagaggcctctcctgctctgcctacatcctgtgagcgctgcttctcgtccttgtgtcagtcactgtctgtcccagtgtttccgcgttgctgctcccccctggctct

SEQ ID NO: 28138 - DNA, 1196 bp, Mus musculus
catctggcctccatgggcacaaggcatacacatggtatacaaacatacattccagtcaaaacacccatatatatatatatgtatatatatatatatatataaataaataacataaaaataagtcaatcttaagctgggtgatagtggtgtaaaatacctacttttaatcccagcattttggaggcagtcaggccactctctgtatctgaggccagagggagttctaggacagccagggttacacagagaaaccctgtctgagaaaatcaacagcaacaacaacaaaaatcaatctttaaaaaacaaaaatatggggggctggtgagatggctcagtgggtaagagtacccgactgctcttccaaaggtccagtgttcaagtcccagcaaccacatggtggcttacaaccatccgtaacaagatctgacgccctcttctggtgtgtctgaagacagctacagtgtacttacatataataaataaataaatctttaaaaaaaccaaaaaaaaaaaaaaaaaaccaaaaatatggtctcagtgatgtgtttccaatagatccttctgaccctccactgtggactcaaaacagggagatgaagaggacagtgactgagagaccgagaaaaaaaaacaaaaaaaccccaaaaatatggggctggaaagatggttcagcagttaagggcactaattgctcaggccctgggttcaaatcccagtatccacatggcagcttgtaactgtaaagccaagatctgacactcttacatagatatatatgcaaacaaaacatcagtgtatataaaaaaaagtaaggggctggtgagatggctcagtgggtaagagcacccgactgctcttccgaaggtccgaagttcaaatcctagcaaccacatggtggctcacaaccacccgtaatgagatctgatgccctcttctggagtgtctgaagacagctacagtgtacttaattataataaataaataaatcttaaaaaaaaaaaaaaaagtaaaattttaaaagatttaaaaataattaaaataaaaaccatgagacttataaaaagtttgtgcttcaggaaaaacagaaactaatcgagtcaacctgatatcagcaaatatacatgattatttttgaggctcttttatatatataaataagtaaatttataattgcttaagtatatcatactttttca

SEQ ID NO: 28139 - DNA, 1102 bp, Mus musculus
tttgcctgcctctgagtgttgggattaaaagtatgtgctaccacctcctggccttccttctgctttaaaaattatatttaaaaaaactttgagagtatatgaatatacacctgtgcatgtatatgcctgtaagtggaagcaagaggacaccttacaggcattagttttttttcttccatcttgtgggtcctcagacttcctgtgttaattagtggcaaacgcttttatccaccgagctgcctgccagcctaatcccccacctctttctaaaccacaacaaagaacatcaggtcttcctgagctgctcctggactcctaagacttcagtgctttaccttagactacagtagtagctgtgcactactgtatgtgcactagacacataccatacttgacttttcatactgtcaatgtttttgaaatatttatttctgctgtggctgtttaagcccagtgtcatgtataattatagtttattttataagtgtctagtatctgagattagttggtatgtatacttaaaagttagctttgtcaaaatagtatgttttacttgtggactcctgggttgatattaactcttctgattaatacctttgctgaaatatgtgctacctaaaagctattaaatattttattagcttgtttttctttgataatataatggagactgtggacctatagtatgaacagtgatatctgacaaccagagctggatatgggggagaggggagagggtgtctttttttgcttgcttgcttgcttttttatgagccagatttcattgatatttcattgatgtgatccttttgcgttagcctttcaggagatgagatcctggagtgagcaaccaactcgggcttttttttttttttcttttgagatagagccttcctgcattacccaggctggtttctttataattttcctgcttcagccttctgagcttagagtacaggtcaatgccactatgcctagtgtggtttttatcctttaaagttcaaccgttttctccttttgagacggagtctcactgtgtagccattgatggtttgtaacttgctatgtagaccagggcttccttctagtaaataagtaaatc

SEQ ID NO: 28140 - DNA, 1178 bp, Mus musculus
gaggcaggtggatttctgagttcgaggccagcctggtctacagagtgagttccaggacagccagggctacacagagaaaccctgtctcggaaaaaaaaaaaaaaaaaagaaagaaaaaggtgtgcgcctccttttgactcttacaggcctagagaagcatccactgttagaaggaggctgtgacggagctagagcagtcagctagcaggcgtcttttaaatgtttgccatctttttacagcggagggtttatgtgccacacctacatgtaaaagtcaagggacaacttgaaggaggtgttctctctcccaggcgggccctggaatcaggtgtcaagtttctttacatgctgagctgtctcactggccctaacatggcttcttggcaggaacaagctctctgcttgtgtctaaatccttattctatgaatgtgctgtgcgtacctgtctgccttttcacctacctgtaattcactcttccgtcttggctgttttgaacaatacgtgtgtattaaatcaaggcttttctcctttttgtccctcagagtgatgcagcaggttcagcaagctgcactttgtttagatccggcccactacctgtgttaatagagcagtatatagtttccctgctgggtatggtagcaggcctataatcccagcccttgggaaagagacacatgaggatcaagagatcaaggtcatcctgggctccatagagtttgaagatagcttgggtaaaatctgtttttattaaaacaaaacaaggggctagagacatggctcaatggttaagagcatgtactctctttcagaggacctgagttcagtccccagtccccatgtcagttagctcacaatagcctttaattccagtgttgggagctgatgctctcttctgaactccagagggatctacacttagcacgtgtgcacacttgcatgtgcccgcgcgcacacacacacacacacacacacataagcacatgcatgcatgcacgtacatataagtaaaataaaaattctaaagaaaagagtttctgttcctttggctttttttttttttttttttttaagatttatttattattatatctaagtacactagctgtcttttagatacaccagaagagggcgtcagatctcattacggatggttgcgagccatcatgtggttgctggg

SEQ ID NO: 28141 - DNA, 1233 bp, Mus musculus
ataatccatcattgaaggaagtcagggcaggaattggtgcaaaggtcatagaagacaatgtttatcacattactttctcagcttcttttcatatggcacccaggaccaccagcccacgtgcccacagtgatctggtccctcccatattagccatcaaccaaaataaaataaagcaccgcacctgtatgtgggggtgcacacttttagacccagcattggggaggtagaggaaggcaggtctctgtgaattcaaggtcagttttagtacttagtaagtaatgagccattgagagaacctatctcctggaactcgctctgtagaccaagctagcctctgcctcctgagtgctaggattaaaggtgtgtgccatcatcttcctgctaaactttttttcttaaaagtccatggaaatgagaactcggagggggctctgcgttctggagtggcactgcttggtccggtggctgggtgagggctgctggtgtcacgtttgaggagaactgcgagtgtgtttggcatatccccgtcgggatcccagctacgatgagtgctgcccgggagtctcacccacatggggtgatacgtttagcctcccctgacgatgatcttggatctagcaattgggaggcagcagacttaggcaatgaagaaagaaaacaaaagttcttgagacttatgggtgcaggaaagaaagaacacactggtcgtcttgttataggagatcacaaatcaacatctcacttctgaacaggggaagaagacaagaaaattaatgaagagctggagtctcagtaccagcagagcatcgacagcaaactgacggtatcggcggcactgcggactcggcttcagtgaggtagaagatcattatggagaagatgatgtggctagagatgacgatgaagacgactcccctgatgctgagagtccagatgactcggacagtgactctgagtctgagaaggaggagtctgcagaagagcttcatgctgctgagcatcctgacgacacagaagacccgaagagcaaaaaagatgcgaagagcaattataagatgatgtttgtcaagtccagtggctcctaactaccaaacacctagtctttgtattaaaagtaaaccttattgttataatgcacagtggaggactgcttatagagcacagacctctgtattataatttttttaaaaaggcccttttaaataactacaaagagtgtttgctttcaaatgc

SEQ ID NO: 28142 - DNA, 1170 bp, Mus musculus
ctccgccccgttcacctcccggccgcccgcctcggagcccggcgcctcgctgttcgtggactccagcccgatgccgcgggatggcgttccgccgctcaggctcgacgtgccacccgaaggcaagcgcgctgccccgagcgggcggcctgctctctcggccccagccccgcgcctgggtgtcggcggcagccgccgattgccctttcccacacaccgggcgcccccgggcctgctcacgcgagtgccctcgggaggcccggccaggtactccggggggcccgggaggcacctcctgtacctgggccggcccgaaggccatcgcggccgctccctgaagagggtggacgtgaagtctccgctgtcgcccaagccgcccctcgcctccccgccgcagcccgccccgcacggtggtcatttcaacttctgacggaagctgctcgcgcccgcccgtcgaggcgctggaggccgctggccttcccggactccgagactctcccggggccccccctctcgcctcggtttatttattgacttgtctttcccctgtcctttggcgaggaactcgcccctcggagcgccagcatttcaggggacctggccgactcccactccccgctcccttccagccacgctgccttaagtcgccgctccggactcccgcggactgagccccgggcgggccggccggggctggagccgcgcgctgtgtagagtcctcgggcctcccggggccgggacgtgcctcctcctactgtgtaggagccccctgcttcccaatacagccgtgtccccaagccgctgcctgactttcctcgcggtgcgggaggggaaggagggcgcggcgcccggccctctgggtaaccgtgctcctgaaagtcggcctccactgcagctcggcccccaagtctctccggagcaattggcttggcgggtgtcccaccggggttaatcaggaaaggtttcctgaaggaggcaatcaaagacctggtgtgtgtgggctgagccggggcccaggagagcagtgggtactgattgggggtgccggggaaggcgctcagcacgtttctggatagaggtcaggcacctttccacggcctacactctggggtgggagagggaacttttggagaaataaaacgaagctgctgcgtgatttgaatttcacatcag

SEQ ID NO: 28143 - DNA, 1811 bp, Mus musculus
aagttacatagggtttctttgaattcccttaatccaagtgtggggggcggggtatacatgcgttgctgtgggtgggggaaggctgtagagggagcattaaggaagttgaggcccgaggagatggtccatgttcgtggggaagcaagaaaataaatgcaaaggctccttgtcagtgcacagtgatagggaccaaagtgagccaccatcatggctggctgcctttatacctgttgaagaaaacccctcagagccaggcgtggggcacacacctttaatattgcactcaggaggcagagacaggtggatctctgagttccaggcagcctagggctgtacagtgagaccctggctgggtaggaaatgaaaaaccctttagcttccagacaggaaagcccagatgaggggctgtggatggacagatggcctaggctctgcattcccagctcagaatctcatgttgagagagaactcattctaagaatgccaaggtggacatcccctaacatcagccacttccaatgctgtaagaactgaggcacgtggtgaactctggtcactttctgtcctgatgtttcagagagtagcttgcagttctctacttgagcagatgaatttacaccaaggctgccagcatgcactttaagctcttacctctattttgttttttgtttttctttgaattggggtctcactctagccccgactagcccaggactcacagcaatccttatgccttcatctcccatgtactaagattacagactgagccaccatgccagatcggctctagctccatttaccgaagtgcctctaccctttttggagtttgtgctccatttcttgtgactatccttaccaggagaccaaaagcaagaaggatgtgaattagaattaaatagctttgagcctctggtgctgccctttcaaaggttttaacctctctagggttaggggaaggaagataattcctaaactctacacaagtaattaggcttgttaatagcaggaaattgtgatcctctctgtcttccctgtttccaatcccctactgtttctgccatcccatggctcttgtctttggaaggctttgccaggcactggaacataattagttggtcatctctagtctgtgggactcacctttcctttctctcttttctccttcccaaccacatattttgttctgatgtgatttgtttctgagaattaagtaggttatactctatatttccacttagtttctgacatcttgctatgtcaactgttacagtagcaactctgctccctggccttgctcaatgtgtccttctgccaaggccatgtaggggtgggtagcccaggattcttttcacagtgtcctcttgtttttcaagttgtctggcagctttatgtacaataaacgttcaggaaaacaaaagtttcttttttaggataaaatagttcaattctgatgagcaagcttatatgtacatgtgtgtggatatgcatttgtgtatatatacctatacagatctatattatatatacaattttgtactatcatttaaaataaagacatttcttaataaaatgtcagtattgttgaattctttacagcatggttaaaaaaatgtttttactgtgtgctacagtttctactgagccagtccaactgggtgtgtggtgtgtgcctgcaagtcccagtgccctaactcttgccttggtttttttttttttttttttcttttgagacagggtttctctgtgtagctctagttgttctggaactcactctacagaccacactggccttgaactcagagattcaccta

SEQ ID NO: 28144 - DNA, 1170 bp, Mus musculus
aaagagggtccagtgaccctccaagtggggattacagcatgaggcacaatgatcagctgtcttgttgctatatacaaatttgaaggtccaaattcagatcttagcacccactctaacaaaccatgcatggtctcaggtgcacctgtatccctagtcctctagaaggatgaggcaggaggatcactggggcttgctggctgccagccttgccacaaaggtgaatttcaggttcagggagagacgctgtctcaagtgaacaggcagaaagtaatggaggacccgatgttctcttctaccctgaacctagacacacatgcatgtacaccacactcacatatagacagcacacacaaacgcccaaataagtagaaattaaatattgaatacattaatatcattttatgacttcacataaccttccaagtcagctttttttgtttgtagctcttctaaaaactgggctctactctgtagctcagacttgcctcagactcagggcaatctttctgccttggcctcttgagtgctaggactgtaggagtgaaccgcctcatctggcttgggttggtggagaagatgactcttagatcttctgagttaagacatgttagcggattagtggagctgggttagtgggaatcacgtagcagaggaagtgttcagagctgggcctccagcagggagaaggccaggcttaggcctctacagtaaagctgctttcaggaatacagtgttaagtcagggctgtagattaatacagggaattatagaccctacatttgcattttggttataagagaaagaactgtagctgggcagtgttagcgcacgcctttaatcccagcacttgggaggcagaggcaggcagatttctgagttcgaggccagcctggtctacagagtgagttccaggacagccaaggctacacagagaaaccctgtctcaaaaaaaaaaaagagagagagagagagatgtgttacaatatctgttcttcctggctttgggaaattgtgccttccctccatgttcctgcctctgggggggtctcattattgcaaggtcagagcagagaccacatggctgacataggagaaagcagctttatggggttttgctctgaactctgtgccttaaaagacacctttctgtcagatgtatatttacttttc

SEQ ID NO: 28145 - DNA, 2745 bp, Mus musculus
cacatgccttgagttccagcactcgggaagtagacacaggcagatctctgttgagttcaaggccatgtggtctacgtaccaagttccaggccaggcaaggctacacagtgggaccctgtcttcacatatagcagagcacagctggggtggagaagtggtgcttgctcttccagagaacctgggttccattcctagcacccgagtcaagctgctcacaattacatgtccatccagctcccagggatcatgcccttttctggcatgtgtgtatatccacacacatacatttatatatacatatcaatgaaagagttttaaattaataacaaaaaaattaaactagttgaatgcagtggttcacactttgggaacctgaaacagaaagattacgagtttaaagccagcttgaactccattgtgagttacaggtcagcctaggctacagtgtgggatcttagtgcaagagaaaaatcaagtgtcatggtgtgcacctctaattgtagcactcaggaggtagaggcaggaggatctctaagtttgaggccagcctagtctacaaagagttctggtatagccagggctatacagagacactgcctcaaaaatagagaaaaattagcaaagaagggctgacttaggaatacctgataaattgtgtccattgcttagatacagtataaaaaaaaaaataggcatagtggcacagcctataatcccagcacttgggaggtgagacggaagaccactgtaagttaaagatcagctttggcttcagtgagatctttctcaaaataacagcaaaaacccggaaatgaccagatggagcagtgacgggctctcatccctgcacttggggagcagaggcaagcaggtccttgggattctaactagcctggcccacagggtcagttccagcctagcaggattactcagaccctaacaaggactccctgaggacatagttcagtggtagaacgtggtgcttagcttgcaaggaagccctgggttcgtcctttgacactgtatgtacacagcgagaggagggcagaagtgcagggaagaaaaccgttgacagcagacttaaactcaggagagaagctgtgctgctgatgggtagaagctatgtgcagagcagcaccctccaggctgtgcttccagagagaggcttctgggctctgagtctctggtcttgagatggaaactatatattggctggactttataaacctgcaagcaggaggatcactttcaaaagtttttaaattaatttttatttgtcattgtaacaacatctttcatccaaacatctatttatataaagtcaagcctaaaactctttaaattatataaaatttggccaaattttctgtgtcatgtgggacactggtgctttctgtagcactgagcactctgtcaaacacaaagcagtgtggcagactgaccaggctggggaggtttgcccctgttgatttagtgtgagtgcattgctgcttctgttagtgtggccatggagtctgtgccctgtagtgctcaggtgacaaagggagcaggtatcactgccacagcaaggagccaccccaggcccattgctgacctcccctctcccttactccacattccccttgctcagacacttgaaacattttcagtgctaggcttttgaggaagggttggggcaggtctctctagcatgaagtgtgtgtttgtgtttgtatagctgggcacggtactcatgcctgttagcagtcaagagctataggaggagggttgacatgagtgcaaggccagcctgaactacattgtgtgaacctgtctcaaaaaccacaaaaattagacacctgagcattgtgcctcgtgcctgtaatccccactcagaggatcactgggggtctcagatgagacttctaggcaatacagtgagatgtactctagggcaacatggaccacagagactatatagtccaggatgtcttgtactgtagtcccttgtatgtctttttatgaggtcctgggttcaatccccaggactgcaaaaaacaatatttaaacgtcttatagacaggatgtgatagtacatgtctacagtcccagaactgggcgagggaggcaagaggtcagacggcgagagtcatccttggcaatttctcaagtttgaggcctgcttacaccaaagtgggagaggaataagcactcagagagggattggggtaggtgatgggtaacgtagaattgcttgccttattgtacaggtgccaagtacacttttgaataactgttgagaataggtttcctgattagtgatcatgaagaaaacatgcatttttaacctggaaagagcttggcagttaacatggttctggttaccttgattagtgggataatttgttgcagtgtttcagaggtatagaatcatttttggctcaaaatagactgaaaacataattctccaaatcacatttaacaaaattgaatattagaggtttataggcaaaaataaccattttgaagttaaccttgactgctagcactgtctgctccagggatctgagcatcagggatgatctagtgtgtagagagtgttgtgggagcacagggaggaggcgtgtgaggttgaggatccgtctgctgtggattcttctgtttgcagcgctcttctgagacacccaggaaatggggtgctagcagtaagctattgtgagtggcatttcagagccttggtaactagagggagcaggtttctttgta

SEQ ID NO: 28146 - DNA, 2482 bp, Mus musculus
gctttaatccagccccggggaggcagaggcaggaggatctttgcatgtttaaggttggcagtacatagtgagagcccccttccttgtgactcccccacagaaatgcacattgtatagcgccttctccctcaggcttgggagtttcttcttttccagtgggatttttgatgggcaggttttgaatttgagttacttcagcagttacttggaggaggagaattgctacgggtttgggagcagcctagggtacagtgtgagaccaaaacttgatttttttttttttaattcaggttctgcagtcttggagttcccattctgtgattctgtgtccagcccaaaagaaatgccaccaccagatcccttcaaccagtgacccaagggccccccctctttctctctaacaagtgcctcaaaaggagtgggggctggtctcccttttctccctctggcctctgcccctcctggagatgggggtcaaggcagcaggactgaccaagtgactactggtgggccagaggagctccgctgaagccctgcacacccttgatctgagctgggggttctctgggaacctggaatgggttccttgctcctgaatgaaggtcgggtgctacctgtttaaacttcttgcttttattctctaatcgaggcaggcaggagtgggagccacagctgaaccccgagtttgctaaattcttcctgcttccctgtactctttccttctggaatgaacaacacagaggtgatggggctaggtgaccactgcccagtccgctcggaatttcagaccttaaggtcacagccccgccatgtctctccgctggcaccagggtcttgctccagttaggcctctaatcccatgcttctgtagtattaatagcttcccagaatttttttttaattaaaattttaatttgagttcttttaattacccccatcttgctatctctgtcttttccctgaccctttaagaaactttaggtttcccattgagtaagagttaagggatggatcttaacttgaccacattccatttaagacttggagtcctggcctgccctctgtcagcccccctgctggcccaggtgaaaggaagaggagggttccagataaaaagccaggatgtagcaaaattagctgtatctcagggtcaacttcctgtgagggtggtgaggtaaataggttgaaagcgctctttggagtacaggccctcggtcctttatggaagcgtggcttttcaactccaacacttgaaaatagcttggacagtttgggctgcacagtgctttgtaatggggagggctgttctgcacagactacagcatctcttccccacccccgaccccctgcccagtgtggcaaccaaaatatctccagaaattgccaaatgtctcccagggatgaagttacccacagcttgagagtcaaggtatgttttccttaagtgacttccacatggccccccacccccagtcgggtgattcaccttgagccatgggtaagctagcgccctcatagctcagcagagctgcacatccctgtttcagatgtgttgcttgcactcccgtctctgttcttgatctctgcaagagggcctttcacagtgccaagacgggaacggggtgtgctgggatgggaggacaggacagttacgctggctgtccgtccgtacgctatgcgcctctctgctctagtctttgaacccggttaagactcagggactttggaagatcaggtgtcacggagtggctttaaacgggaaagtactgtagaaacggagtctgtaggccttttgttttctcaggtgttgtcattctggccctttctttgcaggctgattagaaaggcagaacaagacaaatgagctcctgcctgttcctagaagagagggctggggtctcattagctctgtaataggaagcttgttttgtggtaatgggtcagggttgtggaaactgatccgctcctggcgactccagccatcccgttatcccttgcctagtgactgagactttcatttgtccaaagctctgcgctccgtatggcatttcaggctctaagactggtcatggatgttcatttggagtttgcctccttgtggttcaggcctgcctcctttaagggaggagcttgcaggcacggaggtcctgtgcccctagcagcatgctcccaggaaggccatgaatgtcaggtcacagtggcgaaaggttgggcactgtgtggggttaactggagaggacacggtgtgggtgacccctgagctccagtcttgtgtcagtttctttgagcacagtcttctggtggatactctcctgcatcgagctaccttctctgtgtgtctgctgccaccacttaacaaggtgattggaatgagtttgcgagtcgtaatttatattaaaaagatgatagacttttaagatacatttttttttccaataaaagaattaagcaaaacggtttcagagtaatcactacagatgtg

SEQ ID NO: 28147 - DNA, 1890 bp, Mus musculus
ttggtggatgagtgccctctggatcaggggctgcctaagttctccgctgaggctgtctttgagaagtgcagtcagatctcactatcccagtctgccagagcctgcacatcaaataagtgaccattggaagtagggtggggaagtgtggaggaggtgactggcctgcctcaaatgcatgttttgagatgtttgaccacttcagcaactacgtcagtggcttcaggatcgggtgtactgttctcataaccttgggaggagaaagagaaagagagcggctgctgtagggacagctctctgcctctcctctcctggctctaccagtaagacaagatttatttaattttattatttaatctgcactgattttcctgtctttggtgggtacagtgtgataggaccactgtcctggcagagcaggactaaaggaatgtagaccccatctcagtgtcttcagaaggactgtgaacagaggcagcgtctgccatgaaaccagttcaccgctcctctccatgaattgaccttttcaatttttttaaagttatttttgagacagagcctcatgtagcccaggctggccttgagctctgtatgtatctgaggctagtcctgaattcctaactctcctgagtgctgagattgtcaagcactgcattaaacctggctggtctcttgtcttgacttcctatatctttggctccttctgtctcagaatgatgggaagcctgacggggacctgaggattgaggtccttgctttctcctggtggccatgggacctcagaggcatttttgccaagagggcagaacctgactgagccctggatatcccctgtcttagtgggtctgccaaggtcttgtcagtctttttctggttttgctcaagttgaagaatgcgtggagagtcttctggtgagacatcctctgtcccgggtcccatttccccacctgtaactgaggttaggaaaagatgtgcccttccttcctcccagcctttctcccctctgcttcctcattacttttgtcctccctgggagcgttcgcgctctgggtcactggattgtttcgtgtttatgtgtgattgtaccaaggaacttagcctcatgtagcatgtacagggttgtaatggtgacccagcagcgagctctctcccagtaatttgttccgcatgtgtagtctcccctcgcctcccccacctcccatcccccttttttccaatcaagctgtttcccctgttcttaccctatataagttgcaaacaatatcgctgaacagtagggtgtgtggtggtttggggcagtctgacttcactttagtgtatgacgtctgtagccaatgggaacgtgaaatattggtgcgatcactgaaccaaagggattgtgttctgtgactttggtactttgttttgcatttttgtttcatattaaatactttctttctgtttgaggtcttgtttctttttaaaagtataatcaggccttccctctggtaatagctgcacctcccacagattcatctcctggtctcacacaagtgattcatctctaggcctccccccatctccgggtctcccacagactcatctccctgtctcccacctgtcctttgatgacccggctatgagatattcctgtttatcttcaacctttccttgactcctgtttccagagcttcccttccagggctgggcggtggtggcgcacgcctttagtcccagcacttgggaggcagaggcaggcggatttctgagttcaaggccagcctggtctacagagtgagttccaggacaaccaggctacacagagaaaccctgtctcgaaaacaacaacaaccaatcaaacaaacacacacctcagttgtagctgggcagtggtggtgcacacctttaatccca

SEQ ID NO: 28148 - DNA, 1717 bp, Mus musculus
aattttatgatggcagtgctacagatgctccatatcttctgggcctacttcattctgcgtatggcccacaagttcataactggaaaggtgaggaaggcccaccccccttttgtaggtctcacttctctcacactgtaactctccaaattccttgtcatgctgcaactctctttaaaaagtatgagggtttgggggttaacaggaaacttagaggcagcccttggatactgaaggatatataacccttttgtccttttcacagctgatagaagatgaacgcagtgacagagaagaaacagagagttcagagggggaggagactgcagctggggcaggagcaaagagccggctcctagctaatggccaccccatcctcaataacaatcatcctaagaatgactgaaccattgtcctagctgcctcccacatcaatgcatgaggccaagaaactagccaagcttccctttaggggcatttgagctctggggagaaaggatatgaggagtctacactgaccttccacttcttttttcacccagttgcctttaaaccagactctaaacagcctatctccaggtagaaaggaggcttggccacatccacatcctgttgagagacatagtctcatttccctctctaccttctaagctacccttcttgctaatccttcttcagctctgagggttggaatcataactcacattcctcattcctaagaatttggagctagctgtttgcctttgactccctgacttcaagccagggttgtgccttactgtcccttttctgggcctcattctgccaaagctggaccaaggttccatctttctaagctccctagctcaggccaagaaagaaagctgagctacttttaactttctcttccttaaatacaagtcaatgaagtgaaggagggtatgcatacatgcccctcaccctaccccagggaccatggttcctaggatctcactgcctccctctctggccttcctgtcccctcccttcagctatgacagctggtgtggagtagaagggcaactagttctgttatttattgaacatttggggtttcagttgtaaagccacaactacaggtaggacctgatatttcggcgagggaccatttcagaccaaaatgtactgttaattttttttaattaaagtatattaaaggttaaataaaacatgactgtgtcagactattaagacttgagaaagggttagtttttttcttaggcctcccttgtggttatgtaacatttttagttaaaaattacacagggcaaataaaatcgaggtataaactaatgatagttgcccactgggaaatgacatggaagatcaaggcaggagataagacaaaccacaatctctactttaccatcttgttagaagactttcaagaaaccatacaaatcagggatggcagatacacagcccatgtgaatcatgaatgcatacaagatgagaaggacctcaggctgatgctagagtggtcatgtctacccaccctagtgcctgctagcaccacgctgggaaagtcctgattgagaatccccatctctatctactaggagctgggaagaagctagatcagagacttggggtcagagttcaacagtcaggaagacccagttcctggggaaaaggatagttcaagcgttctcaaagtgaggaagtcttcctctaaagaagtctccctctgcattcaatggcc

SEQ ID NO: 28149 - DNA, 1221 bp, Mus musculus
gtcatctttaaacttacagcacagttgcagccccaacctgtttgtccagaatgtgtttgtggatacccatgatcttcgcttcccttgggtggccttctttgccagcaagtaagggggagaatgaggaaggggcaagttgtgtggaaatcggggtgaggcgtaccttcctttgtggtcaggcttcacttttaccctctacacttattctttttcgcacttcaggagaatccgggctggaacagaactcacttgggactacaactacgaagtgggcagtgtggaaggcaaggagctgctgtgctgctgtggggccattgaatgcagagggagacttctttagaggaagacttcctcactttgagaacgcttgaactatccttttccccaggaactgggtcttcctgactgttgaactctgaccccaagtctctgatctagcttcttcccagctcctagtagatagagatggggattctcaatcaggactttcccagcgtggtgctagcaggcactagggtgggtagacatgaccactctagcatcagcctgaggtccttctcatcttgtatgcattcatgattcacatgggctgtgtatctgccatccctgatttgtatggtttcttgaaagtcttctaacaagatggtaaagtagagattgtggtttgtcttatctcctgccttgatcttccatgtcatttcccagtgggcaactatcattagtttatacctcgattttatttgccctgtgtaatttttaactaaaaatgttacataaccacaagggaggcctaagaaaaaaactaaccctttctcaagtcttaatagtctgacacagtcatgttttatttaacctttaatatactttaattaaaaaaaattaacagtacattttggtctgaaatggtccctcgccgaaatatcaggtcctacctgtagttgtggctttacaactgaaaccccaaatgttcaataaataacagaactagttgcccttctactccacaccagctgtcatagctgaagggaggggacaggaaggccagagagggaggcagtgagatcctaggaaccatggtccctggggtagggtgaggggcatgtatgcataccctccttcacttcattgacttgtatttaaggaagagaaagttaaaagtagctcagctttctttcttggcctgagctagggagcttagaaagatggaaccttggtccagct

SEQ ID NO: 28150 - DNA, 1160 bp, Mus musculus
aggtgggaatctcttctataaaggacatgataagtgatatatacctgaataggtaggaccagagaggggcaaaggtacttcttaaacagtagaagggaatcagattttggctattgatgtttctttcagtgagagacatcatttaattgtattattttctccgagagatattttaacccaggaagtaccaaggaggtaaacaaaagaaaaaagaaaaaaaaaaattgggaagggcaaagcaacaagctgcagtgacattgacttaatgtcagaggcaaaggtggcaaagtaagcatataatagatttaccctgctggtgggtgtagtactgatgaagaccatcaattctcttgattctcaggcaaaatcctgacagatgactttgcagacaaagaaggcctggagatgggtgatgagtactttgcaaatctggaccacattgaaagtgtggagaacttcaaggaaggatatgagagtgatgtccccacttcctctgacagcagtggggtagatatgaaggaccaggaagatggcaacagcggttcagaggaccctgaagaatccaatgatgacagctctgatgataacttctgtaaggatgaggacttcagcaccagttcagtgtggcgtagctatgctacccggaggcagactcggggtcaaaaggagaatgaattgtctgagatgacttccaaggactcccgccccccagacctcgggcctccacatgttcctatcccttcctcagtatctgtagggggctgcaatccaccttcctctgaagagacacccaagaacaaggtggcctcgtggttgagttgcaatagtgtcagtgaaggtggatttgctgactctgacagccgttcttccttcaagactagtgaaggtggagatggccgtgctgggggaggccggggagaggctgaaagggcctctacctcaggattgagcttcaaggatgaaggagacaataagcagcctaaaaaagaggtaagaactttgagagcagccctactcccctccagaaattacttactttaactcacaaccctggaggtacaaagctgcatctggtgatggccatcctagctggcagactcccaaggtggtgtaaggcattacatggctagaatcagggaatatctatttgtgttaaaagc

SEQ ID NO: 28151 - DNA, 1172 bp, Mus musculus
gtcccaccagggcctccaacccctccagggcctccagctcctccagggcctctagctcctccagccttccatggcatgttagagcgggcaccagctgagccctcctaccgagcccccatggagaagcttttctatttacctcatgtctgcagttacacttgtttgtcccggatcagacccatgagaaacgaacagtatcggggcaagaaccctctattagttccacttctgtatgacttccggaggatgacagcacggcgcagagttaaccgcaaaatgggctttcatgtaatctataagacaccctgtggtctctgccttcggacgatgcaggagatagagcgctacctttttgagactggctgtgactttctgttcctggagatgttctgtttggatccatatgttcttgttgacagaaagtttcaaccctttaagcctttttactatattttggacatcacctatggcaaggaagatgttcccctgtcctgtgttaatgagattgacacaactcccccaccccaggtggcctacagcaaggaacgcattcctggcaagggtgttttcattaacacaggccctgaatttctggttggctgtgactgcaaggatgggtgtcgggataagtgagttggtggggtgtacaggcattgctgtctctgccttcaggtttattacagttgcttttcttttcttttttatttgtattgctttccctgttttcctttacctcctctttcagctagagttctgctaaggtcattatgaaatacagatacagaaactgggtacagtggcacatacctgtaacttcagaatttgaaattcagcattgtggcagtttcatcttgagttctgggccagcctaggcttcataataactttgaagctaggctgagctagctacgcagtgagatcttattgaaagagagagagagagagggagaatgaatgaacatgagatagggagaccagggtctgatcgtcttaaatgtccccaggagtaaccctggaaatgtaggggttatgttctgttcctgtctcctcttgctgtttctgtctccccttaacctttcatccttgtgttcaccatttagattctactttattctcactgtatcttactcatgctttttctcactacctttaccttatccccatcctctgtt

SEQ ID NO: 28152 - DNA, 1238 bp, Mus musculus
cagcggtcttaggggtcgtggccgttgtcgaggccacggggctcgtggaggtaaagctgaagacaaggagtggatccctgtcaccaagctgggccgcctggttaaggacatgaagatcaagtccttggaggagatctacctgttctccctgcctattaagaagtctgagatcattgacttcttcctgggtgcgtccctaaaggatgaggttctgaaaatcatgccagtgcagaagcagactcgggctggccagcggaccaggttcaaggctttcatcgctattgggaactacaatggtcacgttggtcttggtgttaagtgctccaaggaggttgccactgccatcggaggggccatcatcttggccaagctttccatcgtccctgtgtggagaggttactgggggaacaagattggcaagccccacactgttccatgcaaggtgacaggccgctgtggctctgtgctggtgcgtctcatccctgcccccagaggcactggaattgtctctgctcctgtgcccaagaagctcctgatgatggccagtatagatgactgctacacttcagccagaggctgcactgccaccctgggcaattttgctaaggccacctttgatgccatctctaagacttacagctacctgacccccgacctctggaaagagactgtcttcaccaagtctccttatcaggaattcactgatcatcttgtgaaaacccacaccagagtctctgttcagaggacccaggctccagctgtggctaccacacaagggtttttatacaagaaaaataaaagaattaagtctgctgaaaaaaaaaaaaaaaaaaaagaaaaagaaaaagaaggccttggcttaatctcctcacttgtttaacaaaacaatacaaaggactggaagctggggagatggctcagtctccccacaagcatgaaaaactaagaccaggcaccagaacccaagatcaaacacaccaagcctatctttgtagtccaagggctggcaaggtggggggttgggggaggggggaacaggggcccctttagagcttgctggccagccagcttagcctagttgttaagatcagacaatgagagattctttttttttttttttttttttttttggtttttcgagacagggtttctctgtatagccctggctgtcctggaactcactttgtaggccaggctggcctcgaactcagaaatctgcctgcctctgcctcctgagt

SEQ ID NO: 28153 - DNA, 1213 bp, Mus musculus
catcctggctctttattgatcaatcaaaaaccagtttgggtgaccaaaattagcattataacacaagcagcattagaccaaacccacttcatgtttttatggttacttcctaagcattaaaacctagatcctttaataacatattctgaacaagttgagggaggctatgtttgtgtttataagttggagtggaaagggggaaagtgagaggctcctaaccctaacccctgccccctccagaagtcttatcatttaatgtaagcctttttattttcctttgagtgctaagaggcaaatagcaacttagagaaattgcaggaatacttactgtaaaaagtttgccagtggatatttagggtaggaacccatggcttatatcgtggtataagcctgtgattcctagtggagcagtgcatatgtacccaaggatcttgctgcttcccatgatcagttgtgtatgttttttcagagttcactattaactttggtttattttcttgaccaggaactgaaacatttgatcttggaggcagcagatggctttctgtttattgtctcctgtgagactggacgggtggtgtatgtctctgactcagtgactcccgttttgaaccagccacagtctgaatggttcgggagcacactgtatgatcaggtgcacccagatgatgtggataaacttcgagagcagctctctacatcagaaaatgccctaacaggtgagagctggctggacagcagatatgtgggggaaaagtctttatttcactcaagtagttaagatatttaagcccgaaaaaccaaaaaaaaaaaaaaaaaaaaaaagatatttaagcctgtacattggttggttgaatctagcaaagcttctaaaatttttttccttaatgactataattgtttttaattcacgtgcaaaatatccactctgtagcttattcttagaaaatatttcatcagtgcttgtgttcttataaaagctcatttctatcttaataatatcttaaaataggatggagaggctgttggttagtgtataagggacttgtttgttgtcactgtatctctattaggtcatttcccctccaccagtaggtgagactcagtcctttaccatcgtttggagaataagtgccacctgttctcagcaactgtacaggaagtaacaaaatggaaacaaataactaggagttaaaataggagaaactagggc

SEQ ID NO: 28154 - DNA, 2559 bp, Mus musculus
agaacagagaatgaggaaagagttctcagaagagggaggttgagagaactcgccatgcagacttgtgcggctcaggaatggtggtggtgtgggtgggggaagggggtcctggaagggaactcactaaaataagggtatgtgacccaagtctaccctttttctcattaggaaatgctgtccatgctgggagaccaaagcaacacctacaacaatgaagaatttcctgatctaactatgtttccccccttttccgaatagaactattggggtgaggataagggtggggggaaatcactgtttgtttttaaaagcaaatcttttgtaaacagaataaaagttcctctcccttcccttccctcacccctgatatgtaccctttccaccccttgacttgctgaagaaacgttatagaagaaattaaatgaatttcccaggcttttaggatcctctgaaattttgaggataggtgaggcctgaattcctgtccttatttcttctgaccagaagttgcacagacatgatttgtgctggagtcaaggggcagaacagaagaatctgacaggcactaattggatactgtggcttgtttggatagaaattctgaatggagtggaggaaaggagaaatgccctcatcactgaggatcatgaaacacagtaggggtgtgtggagccttgggacgtgagcagtctccagaaagaggcctgagagagagcatgaacacttatctttgtgagtgagtgagtgagtgagtgagtgagtgtgtgtgtgtgtgtgtgtgtgtgtgagagagagagagagagagtaagagacagagacagatggggtgaggggggcatttgagctcctatgttttgttccctattatagagtatatgcaaaatttgtcccagatcttctttgactttgtgcttgctctttaaagtgtcctaagaaaattaattttttcaggtatttttctatttagtgttgcagccaaagagtatttaaattaagtctttgctgcacttaaattcatacccagccaaaatggaactttaggccaacccccagccttctgttgctagggttggtctcctacagacacagtgatcaagctggatgactcctgctctttggtgctttcaactcattgggaagagctgcagatattaccaaaataggctggctacatgaacactgtcagaaatcccagacttgcccacaaggataatgctgcatttttctgtcagagtcacacatgtttttctggagaggttatttctgcatggaaactcaacttcttggattagctatcttgagtgaaagtcctcactgacgagtatgcaaaccaaatagcctcctgcacagtagcctctccttcctgtcaccaaaacagttttaggtctgctgaagtctggtgttctttgctccttctgcaatcttgaaattggggtttgctttagagcacaaacataagtctgtgttaggtggacttaaatcccaacagggtcacttgataattatagccatagaaatgcagatgcaggtaactgcttttaccctttaccgtcctcaggtgagtctcctagatcaacagcctttttttttttttttttccttaaactggctcctgtcaaagattaagttaatatggaaaagacctcttatgtgtattgatggggcatgaggagcccaggcaaggagaggctcgtggagaggctgagggaatgttactaagtttccctccgtttgtctccagtctggtgccaggcagtagagtggaaaaggaggctatttttttattctatgtgcacacatacagtatacatatatatttatatcacattttactgaaccaaaaagttgggtttccaataaaatacttgttttttaataaccgacttgtttttaactgtgatctgaactataatgtacagttattacagggcttctgaagaagggggggcggggagaagcttctctgaggggctcgctctgcttttccttcacggttttatttttgattgttttttcttgttgcccatctgtgctaagccttaactgtggcaaaaataatgacatgtagcaaagattttaaaacaaagtattttttcttttataaattgtgttgtgttgtgtgatattattgattgcggctccctgacccctttacagacatgcacaactaagcattcataagtgagctcgacacacacaggcacagagcgtagttgaatcttcatttcaagactcagagctcacagggccctggtcacttagccctgttctcgtgtacccacctgatcctgacacatcaggagtagtcagtagactactgctcacactgtctgggagtgggggttgtctcatctcacagaagttgctggggagtgttcttggatttgaagccactatggggcatcctgatgtctttccccagtgtgttctcccagttaaaaggagatgaagggattgtgagctttaaacagttcagatgtggatctgggctctctctactcaggtggtacattgagatcctggggtctagaaatcctggggtctgtgccaggaatccag

SEQ ID NO: 28155 - DNA, 1292 bp, Mus musculus
gtcttctggtttgtctgaagacagctacagtctactcatgtataataataaataaatctttaggcctgagcaagcagggactgagcaagtgaagttgaccggagcgagcagggctgaccagagcaagcagaggtcctaaaattcaattcctaacaatcacatgaaagctcacgacactttttccagcctccgcctcggaccctgcagccgccgcgatgttgatgcctaagaagaatcggattgccatctacgaactcctttttaaggagggcgtgatggtcgccaaaaaggatgtccacatgcctaagcaccccgagctggcagacaaaaatgtgcccaaccttcatgtaatgaaggccatgcagtctctcaagtctcgaggctacgtgaaggaacagtttgcttggagacatttctactggtaccttacgaacgagggcatccagtgtccccgagactacctgcacctacccccggagatcgtgcccgccaccctgcgccgcagccgtcccgagaccggcaggcctcggcccaaaggtccagagggtgagcgacctgcaagattcacaagaggggaggctgacagagacacctacagaaggagcgctgtgccccctggagctgacaagaaaactgaggctggggctggctcggccactgagttccagtttagaggcggctttggtcgtggacgtggtcagccacctcagtgaagttggagtttatgttgtattgaataaactttaaagaaaaaaaaaaaaaaagctcacaacaatcagaacaggtacagtgtactcatatacataaaataaatcttttttaaaaaagacttgaaccccacccagtatttgggaggcagaggcaagcagatctccatgattgtgaggtcagtctggtctacagagtaagttccagcaacagccaaaactgttacatggaaaaaccaaaaaggagaggaggaggaggaggaggaggaggaggaggaggaggaagaggaggaacaggaggaggaggagatgatgagataatggcttaatttgaaaggcggaggctgccctatgtgtgtattcatataaaagtaatacagtcctatctacttgatagatgctcaagaactactctatttctttggttgcctttcgtttttgagacagggttgcactgtgtagtcttggtttgcttcacactcgagatactgtttcagcgtcctttgtgggagtattatagacaggaaccatcacacaggttaagaactattattgaactatggctttgtttacattagctggtat

SEQ ID NO: 28156 - DNA, 2324 bp, Mus musculus
cttagcaaaagtactttgactcaggagactacaacatggccaaagccaagatgaagaacaagcagctgccaagtgcaggagcagacaagaacctggtgaccggtgaccacatccccaccccacaggacctgccccagagaaagtcctcgctcgtcaccagcaagcttgcggggtaacctgggcccctctcttccccttcctcacccactggactgttatatattgtaggcagggaatgggcacctagtcagagctcagcttgccatccaggggagacattctgctgggggcttaggttgaagatgggctctgagttcatttctttgggtaaattgaaacttgtacaccctcatgatagcccagtagagacccaagagtaggaaagactaggagtgcagagtgctgcagcttttcctgtggtgagaatgtggaagatgcaagttctcctgttggaggagcaagtccttagacgggctatcgtggagcagtgtgacaggttcagtgtcccaaggctgaattgacatgctgagaaaggtagagtgaaggagatgctctctgtgcttctaagtgtgctgtcccttaggcctctgtgctctgtgttcccatcgtgggtgtttaggggaccttcaaaagagaggagatttctgcttgcttaaaattacagggcccacctaacccctctgctgtgttcctccaacagctgccctgcttctcaaggagtgtaaagtttaacagacgttagctacttatgaaaaagaaaatggtatcttttctcttccagcatgttgctttttgaaagtattatgggataatggaaagagtttaggagttgaaatacttgggctgtagtttttgtcaagctcaacagcactgatgtgtgagcttggccaggtctgtagcctctctgaattgatcctgttcctcgtctgtaaacagacggaaacgcgtgtgtaggctaactctgactctaaagtcctacacctgccatacccttctggtcatcataaaaccaaaattgaggcaggcccatggctgaacctcagctctgtagagccagaagtgctacatgggacgagagagagtttgagatttaagggccatagcttccaacaacagtctcataggtatcatagcctttttgagagagaaagagaacaaacctgaaaaggctgtccctggatgtgtcttgactctgcccattttcctgggtctgctgttgaccctagctgctacaaagctgctctggcagcagactggataggcctgaggagacaggctcattgacgtggcatcttgcttcagatgtatgttaggcatggaggaagaagggatgaagggagctggtccccagagcttagagctactgccagctggagcagctgctccttagcagatgattcactggtggaggatggaaagagggtgcagggagggaggcagcagcctgtcttgctgtgtcatcactagtttggcctggatcttactaaatgccacctgctcgtcatcgacagagagggccagagtgagaactgctcaaaagagcaagatggtgcagtctctctcccctttccagattgcactgtgcccttaggatgtctggcgagtttgtggatgtgtgtgttaggggaaggacatgtaaatatgcccttctcctgattggccactgcccaggtctctggccatcattcagattgggtagaaatagattggtgaggaaggaatggagagagcaggacccctggtctccctggcccccaaactctttgactctcatttgtaatgtatataattttgtgttttttgctccattttctcatgctgtcatccttaatgagaagtccatgtgggaaggggacaaactgaacatcactgtatagtttcttcaatgtcccaaccatgtttacatagatatgtcatgttattatatatataaatatatatataattttgtacgttttcttcatctccgatcttctcgaattctgtacctttttctcccctgtctgagctgccttatctattggttagatttgtgtctccagagctgatatgttcacaatgagtctggtttttagaaaaggacaggagaaatagggaaatcaagctggcttgtcatcccagctgttcaacaaactgaggcaggctggtagcctgggctacagagtgagttcacagctggccttgggaatttagtgagaccctgtctcaaaataaaaagcaaagatagggctaggaatgtagttcgtatgtagaatactttcctaacattcagaagaccctagtttcaacctccagtaatacacatagtagttagtgtgtacaca

SEQ ID NO: 28157 - DNA, 2894 bp, Mus musculus
cactggaaagaactccagaagtgtctcttgcatcccagaagtaggtaattggttcaccattgtttgggggatattttaattcaccgtttctctgtatgtagtgttacaacagcagaaacccatacttgaaaatgtgcttttcttttttgttttctaggatgggtttgtggagttcttccacgtacaggacctagaaggcggcatcagaaatgtgctgctggcttttgcgggtgttgctggagtaggggctggtctggcatatctaataagatagccttgtgagtgcaataggggactcttaaagctccagccaccaaactacatgcatctgtgaaaacatgtgtatttatgaaggtggacttgaagctgcccaggattttaacagtccagttctactgtagcaacatagcaaaaagaaagtggctacaggattgtggctaacaagaataaatacatgggaaaagtgctccccctggaagagtcactgtctgaatgaagcaaagttccctctcagcaaacactgagaggccatggagaaggacttctagaatgaatgaaaggggtggatggaaaggtttgatttcctatctagagatggaagaggggccagtcatcaggctagtcacaaagctcaataaatatccattactctgctcagagtgttgagagagaagccctaattaacaacgttggtgacttgtgtaaaatggatttgtaacctacaagtcaccaaacgatgactagaagctgcagtgctgtacaggaatgtgaagggaggcctctgagcagtccagggtgtgcttgacaaagtcccaagtgctcaggacttttagccctgtctactttggcttggtttggatgattcttaagtttattagcctagtgatggccaaaaagtacttgacttaaggttcactaattagttacaaaactgaacagcctcgatttttaagaaaatttatgaaatgtatttgtctgtaaaaattgtatatatttttacagaaagtctatttctttgaacataagagggaagtcttggatttagtttttttccatacccttttgaaatttgcagcttctctagttagaaatgtatttcttacagctttttaagactttgtcatccgttctagtgtatatgcagagcctgttgtgtgtgtggactggttatagatttataactatgcagggttaattatccaatcttttttttttgtatttaaagatcacaggtagatagatgtaagacatttgatcccctgttgacttacaaaattgtaaatggtaaagcaggctagagtcttaaccatggtgctattcactgggtttacttgtttaacacaagtttatacctggtgtcaataaaacaaatatgtatttcttgtctactaaggattgccaagctttgttttgaatttctgtattggtctctaggtgtagcctttacttcctttactgttggcgtgttatgctcccagttcccctatagagtcgtctacacttcctccctgtgctcttcactggccattttagttatctgcattagaactctcaccccaacccccccaaaactttgaacctaaataacccctcccccatcctaatcagagtcagcacagctttcctgtcagaggataggaacacttgctctttgagccccgtgaccgacagtgaccagggattggcattcttggattggcatgctttccattgttactttgtctattttggtaagaaaaacatcaaaggtccccttgggaatttcaaaggttggaaattatacgtttatacttttattagtttgctccaagtatgactgtgttcacttaagtttagagaaacactgggttttgctaaactcggttaacaaaagccactggtaactgaaggtatttaagctagggtcatttgaaagcttcagcctcagaatgtgacctttagtcagggctgcagataaaaataggcaggaatcaaatgactaagaatgtaatagggaagaagtgccctgcctgccagcttgggagtgatttgtacctgtgtatttatccttgatcatagtttgcttatttatgtttaactcttcggacttcagagcactttatgtagttgaataaaccctagaggttgaggtgactaaaaggttagcctctcataacccagccatggaagttttgtttactaggagcctgacttcccagctcacaaagggtgaaatgaaagctgaagtacagacaggatcttagtaggtattttaggtccagggccatgaagacttggagagcgcagtggctgggcaaggggctgctttggagggaagaagcatgtggtctgagtgctgactagatgaatagttgaggcacatccttcagagaagagggaggggctgcttggaaagatggctctcagcaaaatctgtttgtcttacacgtctctcagggaaaaaacatgcagtcttcaagcatcttccatgtacattctatctgggtgaacaccttcattctggtagagcacctaacactttaacagctgttcccgaaagggttaggaccaactgcaagttaatgtgggttgtaaatgttcccctaacttctgtttcttctgaagagaaaataaacctttttccccccaaagtaaggtgtggtatgggtcttttcttatcgccttcctctcttgtgcaagccttttagggaagtcagttgaacaaatagaagtgaaataaaagcaaaattcagtattgatttgccttatggtaaagaatataggacctgtaatttaaatttgtggttaatgtattcctgttttaaactagttcggtacgtttttgggttgcgggggagaatgcttagcaccacacctggctttctcattgacaagttccttgtatcttaaattta

SEQ ID NO: 28158 - DNA, 1202 bp, Mus musculus
actgggacacctaagaaggagagatgtagccatagcagcccatgcttgccaggttctccctcccgtatccctggaaagtccacccttaagtctagctgtaaacactgggtagcaggggtcttcatacctgtcctcaaatcttgtctctccctacccccatcctccattccctgccttctctttgaggccccgcctacccacatcctcatcccatctaagttctgctttccaggaaaaacactgtttctgctgcctttgaatggcaccatgagaagaatccaaggatcgctggccaaagtaggccagatcagggcatgcaaaggacagagaggggggcaaagctaggtcctgctccccctccctgggaccccagggcttgggaatttgaggaggagaccaaatgggctgagctgagttcttggagctagggaggaggtaaaaggcaccacgtccttcttcagttgagccagccactgaatctacgacttccctgatggacgagtggccctgttcaacccactcatcagccctctgcctgcccagtgaggctggaaggatggggggtgtgtgtgatggacacaacctgtctgatgctggtcccctctccacctccctctgcgcctctctgctcctccagtctgtccctgatgcctctccgtggtctacccagtacacataatcctgtcctgagctggttttggcagctctctggagaagtgaggggtggggggtgacgagaactcctggggctagggccaggcctggctccctctctggaaaagtccaccccaccctcccctgcataggggagcaggagccgacacccccccccccccccgcacaaatgtatgtttgtcctttctccacgcccagggtgaggaaaatgaggttggaagtgggcatcctgaagtcacggtggaccctggctgagcacaaacctatgctgctcctggtcacacccccttgtgggccagtgacaccaaggaaagtgacttgcagggtgctaaccccttcaccccaggctcacttcaggcaaatgagccaatgcagagtggacgggtggagggagggttagtaagggctgggctagcagaggagagatgctgtcctgtcagaatgccagggttttcacggcatccccccccccccaaacatcccaacaggtgtcttttccctcaacctctcacaacagattgagttgt

SEQ ID NO: 28159 - DNA, 1145 bp, Mus musculus
actcagccacatacccgagctctgcaaaggcggtttagcttcttcgtgtcatttcattgtcttcaggacattatgaaatgaagttgcagactaatggaaggagggatacgtgggagaggcttggctatgagagcagaactggagtcaaaacttcggtctgcacactcccagcacagctctgctaccacttgcagaaaataactttcaggaatggggtaacttctcccactgtgtgggtcctggggatcaaattcaggtcttcaggccttacccactgagccatcttgccacccttgacattaaaacactttgtctaaacaggtatgagggggtatgctctcatcccccttcctcagaagaggatgccctgcggacctcaggtggaagctgcggggagagccggtctctcatgaattgaccattaaacaccttgtgttctgttgagacagagcgtggggccaggaggatgtcctgtgctttgcaccttgttagggacttgtcatcagtggctgtacctctgacgtggcctcagggttctgaaggtttgaataccaccttctgaggctggtggctgctgctgtctgatggctgagaacagatggatcctcagagctggccagaccccagcgatccaagccaagtctccagggaggtggacgagaatgctctcttccctgctgcctcctttggggaggctgggtgtggaccttgggaagagcctttgctgcaagctgggcacagggctgtcccagagccaccgatgcgctgaactaagcagagtgtacatgagatttgcagcaggacagaacaggacagtcaactttggcttcctcccaaacaggggagggcttagtggagcccagggtgtggtcagaggaggacagtggctttggtgacccgagcaaagggtaccactgtgtagggatctctccaaggactgcagtgaaacaggccttgatgaggctgaggcgcaggcttctacaacaagttctttgatgttgaaatgagagagcataggtcagggcaactcagggccacccaagggcctggagggaggggtatcactgtccacctcaaattagaaagcaatgttagggatgcagaggctgttcccccaggaccaggctatggggagacctccctct

SEQ ID NO: 28160 - DNA, 1156 bp, Mus musculus
cattacacctcgtgcatgcatacatacatacatacacacacaaaagacatgatccaggtaagatgcaatcccatgggtattggtagtaggaaaagtaatgaggtgaactgatcttcatatgcatccatacacataaaacatgatccaggtagcccaaggaggaacatgcaatcctacggggtactgatggtaggaaaagtaatgagatgaactgatcttcaagttcatctcctcggaactgagcatcagagacttgacaggagagccagtgtctctgatctgcctcatcttcccttgactccctccgccctcacagaactcctcagccttgtggaggtccttgggagcacctgagacactgcagagggtatcaggaatttctttccccaaagtagagttactgaggaactgggaagctcgaagagaagcagcagagttaagagaccacagacgcattgggaaggtacagagcacagaagagtggcagggtggcagagggtgagggcaagggaatatgagctggtcttctgttggctttttatcttgactttgtttcagttttcattttttttagacagatctcatgtagacttggttggcttcctgctatagctaataaagacccaaacccttgacctttctccactccctcccaagtactgagattaaaggttcaaacaaccacacctggtgaaagagtgtgattgtaatctgccacaagattcgctcagagggagtagctctgtcacttgcttctctagttccaaagccctcccccacttgagtgacaggtcacattctttccccaggaacaggagctcttcttcttccatgaactgagccctgggagctgttttttcttgccacgagggacaagagtctataatgccctggtggctttcatcagggtaaggaggacacgagtctagggggaagggatggagccaaggtgtttgagttcggctcaagcacgcaggcatgtgcctagagtcctagcaccaagagactaaaagagaagtgtcatgagtttgaggacagcctgggccacatagtaggatcttgtctcaaagggagaaggagtagggagtgagagcagagtcttgtagaggccgggtgacttaaccaggtgctcctgctgtgtacttggaagcagcct

SEQ ID NO: 28161 - DNA, 2102 bp, Mus musculus
caggcagtgactctgaggcagtacaaacttcattatgtgcagtaaaaagttttctcttgctagatgtggtagcacacacaagtccagcactgggaggcaggggcaagagaagggcacgtttgaggccagcccgggctatagagtagaactttatctcagaaagaaaggaaagtttctttgttgaaagaaaaagctgaatataataatttcaaggttaaaatgggaaatgatcacaatatgtaaagctagggacagaccactcagtgaccaactgtcttttgtaaacaaggaaaagggaaacattttgatggttctccgtatctattctaagcccttgtctcctgctttcccttactttttctccctcagttattctgactaaattgataatgaatgtaggtaaaatgttgtccctgccttcttaaaaatttaagtagacacttaactttactatggtgcctaactggtggttttcagcaaacattaactattagagaaaggaaaatattgtgtctttatagtttctttctaccctcacccatcacagtcctgtattcatcctgttcttgctgtttcagaggcgattgggtggtatccttacatgatactgcgtaggcgtgtcttagaggcagggggtactgagaaagcagcgtcctgaggaatccatgttatccctcagcaaatagcatcttggtgctttcagtacccacctctcaccctcaccctcaccctcatttgagttgcctgagtcattgctgtggaggggagagctttcttccctgcattaaaaactttgtttgtgtttctgcatcgaatccctaaggggaagacaatcgtggatcttggaatgtttctgtctttgtatctgggaagcagacactgcacactaggttttctggtagtgtgttgcaccggggcacacgctgaggacctccagctaggtgtgctgcaccagtgtgttgagcttttgaaggaattccagcaagttcacacaggactctacagaggaaagaaaaggagggctttggattcctcagtggggtgggtagggaatggagggaagggtggcctgtggttgaagacaatccttttgtcttggagcaaaccactttttttttttcctgaagaaaggctgtccagcagagcccgggagctgtgatctctgtgaggtacagcaagaatcctcagaattcacatccgttttgagccagttctttcctctcaagcctttctgccctataggtctcctcacaaaaatgcatgatatcatgacctcgtgttttgggttgggtataacatagcaaagcaagggaaatatagttatatactgagtcttaagacatttgtttagtaaaaaagaaaaaaaggtatcaaacagagaatgggggcgggggcggggaaattgtgactttcagaattgatttttttttcccagaaattaagtgggggtatttttcagtctagaataaaagaatgtgaattctttctaccgctcttatttaaacttaaatatactgtttacttgaaaaggctctcttgactatttgattttctaagaaaacagggaagtatcaggaaagtggtttctgaaatgttgaagcaggataactgtcttcaaaagcatagcggccgccacaagacaggagtgcgttgtacagttcaaggacggacttttcagggcttggggtttgtgggatattttttgttttgttttgtttttgccacaagatcttcagtgtgtttgtttcagggtggaagtgggtgttatatgaagctgtcagatattttaaggaaatcttcctacaacagtaaatgaagacatctgtatatatgtgatatagtgaaacaaaagacatttctggtattcataaagataaaacaaggattttattcttcctgtgtctgtgatttaaactcggtaccatactctggcttttgtatttcaccctaagtttaaaaataaataaacaagatattttttaaagaatgcacaacatagtgtgtcttagcaaggacatgagtcatatgaagcagagtgagtagttgtcactaaggtccttgatgctcactgtaaaaacacaaagagttccatgaatactcta

SEQ ID NO: 28162 - DNA, 1165 bp, Mus musculus
ctactgaccatcagcaaggccaagacccaaataacaccccaacattgcacgttattacctgtactgaccgaagttttatttcgatgtaagtaatctctcaatagatgggataaatactgttatcctccccactcccccagccaaataatgtggctttggttatgtttacttatgcctgtgtgttttgtttttttaaagaaaaaatacaaacaaattggaaaggccctaagtgtggagagaggactggataatagcaaactgttaccatgtatgctttctgaatttggaaggagggcccttcattaaaaaaacaaaacaaaacaaaacaaaacaaaaaaaaaaaaacaaagtggaaaaaaaaaaacaagaaaggaaaaccaaatttaaacaaaaacccaaactgctacttccaatgctctctatagactgttcaaaatgccttccccagatttccatcagtacctgggagggaaaaatgggcgttttggtgcaaagaacggagggcctctaacaaaaggtggcctgggtctctttaaactgtggaatgggtctctgccgagaaaagcttccctaggccgaaagtctggccggggactccgtaaaatcataccactccggccgatggcgtctctgtgtgcgggactcaagggaaggccactgctgctggtgttgcctcccccacctcctccaagggctgggcccaggtgctccagaggatgggaaggcaggctcaggctctctcgtgaacggttaagaccagggccattgaggtccctgggtcctgtgagcaccccaaaatgctcagccatggtcccttgaaggagggaactatggtccttgggaaaaactgacacagccccagttactccatgctctggcagtggtggagttgggaaaggtacaaccccagagtggtcaacagggggtggaggcggggctggagtagcaaaggggacaccagtccctccactgctaagttcccccgggggtggaggaggggggggtggagggaaaggaactccgctgtgctctcctggaggaggtggtgggccagcgtgggccagagatgcctcctttgtaaaggggttcgaaagatccacagagggcagatgagtgggtgcctctcgagagaagataccaccatgatccttaggaggggcaggtg

SEQ ID NO: 28163 - DNA, 1155 bp, Mus musculus
catcagtcatgaaaaatacgggtaagtgagccactgatgatgctgagccactgatttccgtctttgtttcattgaaccagcaaagtggggtttttttgttggtggtggtggtgaaattagtacaattttttcattaaaaatacattaaaaatggatggacaccttagaaaagccaaaaaataatattactacaccaaagaaaaccacatatatatatatatacacacacacacacatatatacacatatatacatatatatacatgtatgtggatttgagagattagatatttagaatactttttcttttaataattgaaacattgcctatattatctttaaatcagcttatttaaaacttcagtatgtatgacaaatttttagttattaaatattcatttaaacagctggttgtggtggcacacacctgaaatctcagcacttgggaaaagaggcaggatatgaggcattcagggatagcctgggctacatgaggccctttctggacaaaaatgatggagatgggtaggaagatggttctgtgagtgaagtgcttgatttcgtaagcctgagggcctgagcttagattgccagcacccacacaacaaccaggcttagctgtgtgtgcctgtagctccactgttgagagtgagtacccactggtagatactggggagaagcagccagtctagcagaaacctgaagttccagattcagtgattgacgtaatctcccaaaattagatagtgacagaggaaggcacacggtgtcattttggtctccaggtacacacaatgtgggagtgtataactgtgcatgtaccacacacaagaaaagtcatgtgcatcaactttaatggctattgtagtatatggtaattcttgttattagacattactatgttttcagcttttcattttataaagaatactgaagtccttgccatgcaaacctgatgagacctacattgaatctccaggatccatgtacaggtggcaggagagatgtgactcctcaaaattctcctctaacccacatcatccacacactagcaatgataatagtgacaggaggactgtactgcacacgcaggtgcagaaggacagacagaagcattgtatctcatctgcaccctgcccagggtagtatttgggg

SEQ ID NO: 28164 - DNA, 1219 bp, Mus musculus
cctttatgtataatcatacaaatatctaagacatggggttataattactttatcatataatcacatttcagctagggatgttgctacacaaatgttattaggtcttttaaaagactgttaagtcttgtttaagtaagtagacatgttagagtgcttgcccaacatgaataaggctctaagttgagttcccagcactggatagggtagaaagcttattacaattctggtctctctggggcatggtggtacattaggaagttgtagtaggatttctaatccaaagggagttgtaggctcaacagcaagttactcttttcaaataagtaaataaatacaattttcacttcttacctagggtacagccaaagaccggagctttggagagatgaagtttaaacagtgccctacagagaacatggctcgtgagcatttcaaaaagcatggggctgaacactactgggaccttgcactgagtgaatctgtgttggagtccaccgactgagactactgttagcccttgtatcttctttgcctttgtttcttctgtcttctcactctacttcccaaccttaccccaccgtgcgtgtgatctcagaactgtgccaggccgataccagggcaaaaagactaccaagttcacccagtcagcctggtgctaccctccatcctgtatgtgcatatgattaaagagttatttttaaaattagtatgatatttttcatatggtcatagatattagaatttggttttgtgggtgatttttccatattcctaggatcctagtagtttaagtgtgtaaatgtctgacttctaagcaaatggtaagtacagttttctggagatagtaagtcagaaagtagtgttaagtggttgtgggatgagtggccaaatgcagtatgtatttcttaacctttatagctagaataataaggtcatatgttgttggtttctttaggtcaagtcctaggaaattagttcttcaaatgggtatggctattttgattgaaatagactacatactatccaagggcatcagtttgtaaactaagacaggaatcagtaatgtagttcaatttccactgttaatgatgccatgtgactcctctcagcgatatgctgaataaccttttaagaagatttaagataggctgtcatggccgggcgtggtggcgcacgcctttaatcccagcactcaggaggcagaggcaggtggatttct

SEQ ID NO: 28165 - DNA, 1157 bp, Mus musculus
gctaaagcaactgagaattcaaggccagcttgggctatgtaatgggacgttaccctgtctttaagaagaaaaagatgggagactaagtcttggtagcccaggctggcctcccactcggaccttcctgccctggctgggttatggtgtgtgctggcacacttggggtgctgttgcctatctgcccagcttctgtcagcaaaaatgcctggggtgtctgcaagaaactaagttgtaagacatttgctggggacacagcggtgaccaaccaaagtttctccacgggtgctgctgcctgtgcctgggagagtggccttacaaaccctaaaagtgcataaacttgttctttagcttcaagaatatgtttttcagctctttcattaaaactcaagaacacagtgtttaaaatcttgattgtaacctttaactttactttttcagcaaaatcttaaaaatttgaaaagtctcgacttgtttaactgtgagatcacaaacctggaagattatagagaaagtatttttgaactgctgcagcagatcacctacctggacggattcgaccaggaggacaacgaagctcccgactcggaggaggaggatgacgacgacgagggtgaggctcttagtttactatttacttgtttggagatagggtgtctctgtagctctggctgtgctggaattcactgtgtagaccaggctgaccccaaacagagagccacctgcctctgcccacttcgtgctgggatcaaaggtgttcaccaccatgcctggcaaccagcaggttttgaagtgaccgcaaagtaaagccaacttcagtgtgtataatgtttgaaaatgtattttggaagggtcctttgcagtgctgggatggggtcatccttgcacatgctcggtacgtgctgacctggatccccagtcctagtaaagtacttctgggtcacaggtaacagtgctgtaaaatgggtgggtttgctttgtttccttttatcgagacagggtctccctgtgtagccctggttgtcctggaactctgtagaccaggctgacctcaaactcagtcccacccccccaactccaagcctccccctctgcccctctgcctcccagtgctgggattaaaggcacgcactgctattgtctggccagaatttgttctt

SEQ ID NO: 28166 - DNA, 2932 bp, Mus musculus
ttacctaagagtcacgttgtcacgcacttggtctgttgattgaccagcgagttgtggtttgtccgtgagcatgtctcttctgtagagtctggttctctgaagtcctttatattctcgaacaaatttcagagtggaaacaacttatattttctcttgatactcattttctactaagattaaaagctttgtaaaataagaaaaactcagttgttaaagtcaagtatcttacatccttccattttagaggaagagggtcttcggggagagaagagaaagcgagatgctgaggatgacggggaggaagacgacgattagacctccaggaccaggccacctgacactcctgggcgctggagagcgatcacattgtctttgtttctttatgtatgatagctgtcccagtaggagatgatgtgtaactttttataggaaaagtgtggttttactattttggccttaccattccggttaagatttgctagtctgttaatcataatgttcttagaaaagaattctcattcatcttcccatagtgaaattctctagcactgtatttagattctggatttttataattcatgcttaatgtattagacatttttagcccataattaaaacattgttgcttttacacaggtgtagtttggtgcatttcattcatagtgttttaaagttatttataaattaaccaattacactcagctgtaatatgaaatggcagtagtcttttgaatgataaagctggtttttttgtttttggttgatttagagacgatccggctgtcattagcttgaaggcatttttgggggtggggttagggtatctgaaggctttcctatcatggtttgggaagtagaagcagagcgagagggttctcttcagaggcaggtcatggactcagttctgctcagtgacagttcagggccctttaaggagcctgtccctttctaaggccagacttgccgtggagcggtctctgggtggccgtgccagcaggctgtcggtcgggtcagctgtgtgtcccctcccagctgctccagaaggttctgtcaccttcattgcttcattcctgttcccatccaaaagaaagctggcaaaagctgtaatgccccagagacttcatctgcacctcagccatctgtctcggtttcaaacaagtggcatggaagagatggagcattcaagttacagtaccgagggcttcgtgtcagaggcaggcgttgctgacggcccgagtctgctaggataagcagcagcgtcctctcgcagaggtcagactgattgccagctgagaactgatgagacgttcagggctagtttctaagttttcctagtgatttggataccaactctgtgaagtatttattatgtttctgagagcaacctttaattcttcctgtagttttgaaagcgtgatcagttgtagcctttgattggaacatagtggcaataggagactgtttgaaaatcaatcttgaagtgttggtatttatttcaaatgaatgtctgaaaaatagaaaaaacatttggggtacgggtatgtgttttctcgtggcttcaaacatgagcggacaggcccctctctctctctccctttgtcccggaagctccatgcacaaggcacttgctttttaagtcttggttgccagtttttgttttccttttgttttatatacttcaggtgggtttttgttttgttttgtctttttctttctttttaaacttagcatcagcatacgtattttgcctctcttctgggacacatcgaaattgcaacagtggggctgctgctctttcaacttcacatgtctgacctggtttttaacatagcaagtatgaacttatttgtagagaagctaataaaagttgcatgcctgactgagataaatgtgtactgagttcagcgcaagtgcagggatcgccaaaggattggctttgtttccttgtttcagtaattggaactcctgctgtcagtctctaaagaattctctttgcaaactatgccaggttcaaaataaatgcttatttttaaaaatgaaatctatatattgactttttatcaatcatctattgtgcaatcaaaattagagttcttgagtttaaaaacaacgcatagggcctccagataactattaagacttatttagcttagtgggtggtattttcatgcaaataagcaagggtgggttttctattctgtagaagttctgggttctgttctaaccctctctgtactgtgcgtgtgtataccatatgtgaagtccttagagactttgaggttgattgatacttttgtgcagctgtgctttgactaacgccatcacagtgttaaacacgaggacgggcagcgctgatcatggggttctgactattttgttttttttcccttactgctgtaacttaagtttttgaaactgcattgctttgaataaattgaagcgttattaataatgactagcttcagtgtgtgattgttcactcttcagaattaccatctactgtttcaaaggtctttagaaacagaaatgacttttgaagggtagtcagacttgtgacaataataggcactagaaaactcatactccaacagcagtggtggtacacacctctaatcccagcacctggaggcagaggcagatggatctcttgagtttgagtccagccagtgctacacaaagaaaccctgtctggaaaaataaaaacaaaattcctttccctcaccaaaattctggattggctcaaatttccctttggagttgcaggttgggccaggactttattgcctatagttcagcaggtatttataaaacaatcacaggattatatggtttttctagaatgagctcaacttctcagcatagtatgttagttccctacatgtgtatcttgaaacaatagatttttataaatccctagttttgggtttatatg

SEQ ID NO: 28167 - DNA, 1134 bp, Mus musculus
tcctggcagagcagaagcagaaggaggttgagaggaagatcatgaatggagggttagttagtgggcctcctccagccaaaaagccagagccggacggtggggaggaccagcccagtgactcccccgcagagcccaaggcgatggccttctctactgcttaccctgggggctttactatccctcggccttctgggggtggagtccactgccaggaaccccggaggcaattggcaggggggccatgtgtagggggcttaccatcatatgccacctttcccagacagtatcctgggcgaccgtacccccaccaggacaacatcccagctctggagccaggcaaagatggagttcacaggggtgccttgttaccaccccagttccgtgtggctgattcctatagcaatggctacagagagcccccagagccagatggatgggctggagctccacggggacttcccccaacccagaccaaatgcaaacaaccgaactgcagcttctatggacaccctgagacaaacaacttgtgctcttgctgttacagggaagaactgaggcggagggagcgggaacctggtggggaactgctggcacacaggttctgagtggctggaaccttagtggggacaggggctaaacaaagaaagttaagctcaactctggctcatcaggacccagcccctgtgttgatggggcaagtgcagagaggggtgtgggggctggagtgctggcagtctggtgggagcagggctgggctagctagcactaccccagggcagtactgctcctgcgcacacagttgacttgagacttcaaggcagaagggggaagctcataacctcttctgtcccaatcccagggcccaagggaaagtagggaaatactaggtgtgtgtgggtgggaggtgggtggacaccttcggggaggaacctggaaagaaagttctcaagtcagttaaggaaaaaatagaccaaagttcattgactttagaaaaaaagcacatggtggtgtagttgggagtattgagtcgatctgagatactgaacaaatttgattttggtttgaattaggtagatattagggttgaataaattctccctgaaggatcaaggcagtaatgtatgtgcttggcct

SEQ ID NO: 28168 - DNA, 1186 bp, Mus musculus
ttttaaggattgagctcagctaagttaagatgtgattttttttttaaatatttttttttaaagcaagttccctttgggaaagagaagagtggtaagaagcaaccttgtatatggggtttcttcaggtgaacgggtgcagagtgatctattttttaactacttagcaataactacatgtgggtttgagtgcacctgagaaggggtggaggagcccagatgtttggctagactgtttgaaacaataccaaaaacctctatagagcactatcctctgctgctgtgtttctgtagaaagcaacctattttactaattttttaaagaaagacaggaccctgacagagaacatttaaaagttactgactcctgcccctacctaagtgggtttctccttcctgtcacttctggagagtgaacttaacaccctggcttcttttgttaagccgtggctgaccttaatctgtggttagtttattaaaataataaaaaatactttgtaagaaaaattatttttgatattagggctggtgttgaagcatgggatgggggctaggggccactttgaaaggtagctagagaactctattttagtgagctgtcgccatgggccgcacggtcccagtgatctgacctgcctttggatatctcccttttcctgagccagccctgttctccagaggggtagggctggacccagtggtgagagctcccttgcaatttgcacaaagcacaagtctggacagcttctgctctgaccagagctatttctaagagctttaaacctgaaggctatcctgcgccaattgtcccttctccttattttttttcctggggaaaaatcatctatgcaattctatacaaatgaattctgtgttcatttgtggatgcaaatgaagaaggggtgagtgcactgcacgtgtccagagttacctggggctgtttctgggctccaatttctctgctgaggtatgtcatcacccactaatggaatgttatccccgaatttgatttaagtcacaaatggctagatgtgcatgtttgtgcgtgtgtgagatgggactccagtgcatgtttcctctgcctagtcagaaaaatgatcaaacacctctctttggtaacaaagctagtcaagacttctttatggaattattaagtttaagaagttgtcccccaccccctcaaaaagtt

SEQ ID NO: 28169 - DNA, 1143 bp, Mus musculus
cacctttaatcccagcacttgccaggcggatttctgagttcgaggccagcctggtctacagagtgagttccaggacagccagggctacacagagaaaccctgtctcgaaaaaccaaaaaaaaaaaaaaaaaaaggagaattgaaaaagggtttcctcatactgcagtttgtaaatgatataaattatatctttttatttagtttttaagatgcaatttctaagagtgagggatggtgttaagctccatgctgtgccttaaaatagaagtaccttccctctccatagctttccaaaatccatagaccagtaaagcagaaatgaccatggctttatattgtacacttgggaggtgatcccgagccgagaacagagcccgttctctgagatcttgctcttgctgttcttcctttcactcccatgtccaaggttccaggcactttatttttctttcaataaaggagcatttgggtaatgattgtctatgagttactcagacacctctgactggactgtgtcctctttttcaaagaggcagtacccagccacatagccataggcaagaggacagaattagaagccattatctgctctggaaacatacataccctggattctaatattttcttcttgccctcaacctgtgtggactgcaggctcaatgagtcacacaggcactcgtgtctgaatatcttgtggatacccagtcacaagttattgtgtattgcctcctgtgcttaagctgtttaacaaaatactatcatgcttccatgtacaattcctgtgccctctccttcccttggctgtgtgagttgggggtagaggaagtgatagaagctgtctaagcagtggggtgggaaggaccttggcctctttctgtgtttataactggatctgtgattcatcctgtgagtcactcagctccaccttcctcctccagctacccctcccagcagcccttgctcctggcacaaacctataaccagagcgagggtctgaaaatggaaaaatctgacacagctccttgcctctctatcccctttccatccagtggacatctatctgcatttgtgctgcaggtggtgagagtcttcctgttaacctaatcctcaactgcagcccctttgtgcttctggttaggcgat

SEQ ID NO: 28170 - DNA, 1231 bp, Mus musculus
gagccatctcaccagccctctcttgtcttcttaaggacttgtttttgaatacagtgtagccctggctagcctggaactctgtagactaggctagctaactcacacagatccacatgcttctgcctccctagtgctgggattaaaagtgggcactccatggcaggctaaaattttcttttcttttttttataatttagcgggttttgtaaattttgttttgttttgttttgttttgttttttttgaaccaaagtctcctgtgccccaggctggtctcaacttgctaggtatgtagttagctactactaatctttctgcctctacctttagcgttctgggcaattcagatatgtgctaccaggtcagatatgtgctaccaggcctgctcttcctaaggcgttcttactggccttttagaattaagtcattgcacgggcatataatttccacccaagtcctgtcctacacagagcaaaaattctgcttgttttatccttggctgtcaccatctctctgtttaagtcagaaggaaagtgaatgcacatttcattgtcttttttcttcacatcaagagaaaagatatttctgatgtgctaaataaacctgggggaatattagcagcatggctactttagccagtgctgtcagtcaccttcagacagattgcctgagcacgtggcactggctgggctttactgtaggaagggttaagaatggtgtcactgtgtttaagtcatcattgtgcactcttctgttttctttgctttggtttccttttttgtcactgtctccttgtgtggtttatccatagggatgtcccagatgcagctggcccaccatggcccccatggcctaggacacccccatgctgggcctccgggctctggggggcagccaccacctcggccacctcctggaatgcctcatcctggacctcctccaatgggcatgcccccccgagggcctccttttggatctcccatgggtgagtgggtgctagcccatttcttatctttgcctttgtgcagctttctttgcccctcgccctgtctggtgccctttctttgacttcccacattcctgctctcatccctactcatctccacattagctgcttcctgttttcatttttgttaactctttttcttcctgcaggtcacccaggtcccatgcctccacacggcatgcgtgggcctcctccattgatgccccctcatggatacacgggtcct

SEQ ID NO: 28171 - DNA, 2473 bp, Mus musculus
gctaactgtcagagaagagctacagtatctggtgactcgctacaaagtgaatcgcagaacatgaaaagggcaagtttgtttccaaagaaacctgttagaagagcacactgcgtgagaaacactttaaacactgcatttaggaaagttacatcaactgaaaagcactatctttttaaaaccctctgcggttcataaatacaggaaggaaaagtatcaggagagaaggaatagtgtaaccatcttgaaactcagcaaataggatcgaattctacccaatcagactgcaagtccagaaactcctgctttctgggcccaatcaagacgaagataagtctataagtatggccacttggcgtctgcaagccgaagtcgcaaaaatatggcccgtacgaagcagaccgcccgcaagtccaccggcggcaaggccccgcgcaagcagctggccaccaaggccgcccgcaagagcgccccggccacgggcggcgtgaagaagccgcaccgctaccggcccggcaccgtggcgctgcgggagatccggcgctaccagaagtcgaccgagctgctgatccgcaagctgccgttccagcgcctggtgcgcgagatcgcgcaggacttcaagacggacctgcgcttccagagctcggccgtcatggcgctgcaggaggcgagcgaggcctacctggtggggctgttcgaggacaccaacctgtgcgccatccacgccaaacgcgtcaccatcatgcccaaggacatccagttggcccgccgcatccgtggggagcgcgcttaagcgccctgtttcccttccatcccccacaaaggctcttttcagagccacctacgttgtcgatgaaagtagctgtgtcagctttgcaaattgattttcagtgtttcaaatacgccctcaagtgtgtcaggcctaacagttaccagtaatcacattccttatcccaggtttattccatttagagctggtcttgagctcactactcaaatatgggccagtccaaaaaaggagttctaattagggtctcagaactgtgaacctgaaaaatagccccaaaattccaagcgtgatacctaagagcgatagttaacttatttcaacctggtgttttaaggatctgtaagcgaagggaacataaagaacagctgaggcaaaactgccgctctcaataacaggctagcatgaaatggaaggctgcgattggctagaaagaatttcctctaagcaccaccaaggctcgcaaccagaatcggtttgagtaggctccgcctccttgacgctgactctgctgtaaatcaaccaataaaaatggaataccgtgtgaaacctcatttgcatacaagctctataagtaccgcatagcaagccgcgctgaaacagttcgtagttgcccggtctaccttacgttgcatctttagacgcggaggaaaatgccggatccagcgaagtctgctcctgccccaaagaagggctctaagaaagctgtcacgaaagtgcagaagaaagatggcaagaagcgcaagcgcagccgcaaggagagctattctgtttacgtgtacaaggtcctgaagcaagtgcaccccgacacgggcatctcatctaaggctatgggaatcatgaattccttcgtgaacgatatcttcgagcgcatcgcaggtgaggcttcccgtctggcgcattacaacaagcgctcgaccatcacttcccgggagatccagacagccgtgcgtctgctgctgccgggagagttggctaaacacgctgtgtcggaaggcaccaaggccgtcaccaagtacaccagctccaagtgaagtgcagcagagacgtgattgatcggctttacccaaaaggctcttttcagagccactttagttctcaaaaaaagactgtaagcactaagggtctgatctagcaggtaaggttaagccatgatgagtctgttaccctgcagcgctctggtgcaacatcgagcgtttcaaagtgttgggcggtgtcttggcttgctcagcctgctctcttatataacccaagactaccagcccagagatggtcccacccacaaggggcctttcccccttgatcactaattgagaaaatgccttagagttgaatctcatggaggcatttcctcaactgaagctcctttctctgtgataaccccagctgtgtcaagttgacacaaaactagccagtacaattgaccccttgtcaacttgacacacaaacacatcactagtaagcctcaacccttacattcttattcatccccaaggtctaaataactttaaaagtcccacagtctttacatattcttaaaatttcaatctctttaaaatatccatctcttttaaaatccgaagtctttttacaattaaaagtctcttaactgtgggctccactaaaacagtttcttccttcaagagggaaactatcagggcacagtcacaatcaaaagcaaaagtcaat

SEQ ID NO: 28172 - DNA, 2473 bp, Mus musculus; identical to SEQ ID NO: 28171

SEQ ID NO: 28173 - DNA, 1316 bp, Mus musculus
catcaagagccttttaaagtacagcggcggagacccgcggcaggcaggcaggttggagcggcgcagggagacccctgcggtagggctggctcctgtgctgcccgactcctgtgctccgacttggagaagacgggcgtccgttcgtccatacccaaaagagtcggccacaaggatgttggcacctgggggtgggccacgagcggccagttaggggtaagagacggtgcaaggtgacttgtccctggtccttcaccgctccagcactgcgcaagtgagaaagtccaacaggccccgggatcgggcggcgaaaggaaggggcgtgatgtcactcctgggtggctgacggggcggggtgtatgcagatgagggtcgcgcaggggctgcggcgtccgcagcggccggggaaacgcgagagatttctcgcgcggcgtaggagagaacgcgggtcgccagatatcagcggagcgccgagacggcatgtgcgacgagggagacccgagatagggcggggctaagtgaccgtgtgttaagagtgcaggggcggcgggtgtgagccggggccgggcgctaggagagcatacttacctggcaggggagataccatgatcacgaaggtggttttcccagggcgaggctcacccattgcactttggggtgtgctgacccctgcgatttccccaaatgcgggaaactcgactgcataatttgtggtagtgggggagctgcgttcgcgcgctcccctggtatttggtagtctaaaagtaaggtacttaattctccttttgcatacatatactatgtcccttgtgttttgagaactctggggcttggcttgcaacttgagtaattttgtttatacttatttcaacttaaaagaaacacgcaatcctagatacttcctcctctcagctcttgatatacataagtatactgtagctgagtcagatctcattaagaacttgctgagatttgaactcaggagcttgccgtcagtgttcttaaccgccgagccaccttacctgcatgcatccttcttttcaagcaagcttttgttaacaaaatgcctcacctgccgaccaggctatatcagatcttagaggagggactagaaaaggggaatgacggagtctgcgactcagtctgaggaaggagtttctcccatgtttttcttataacaggcaagatggcggtcgcacacttgttttttgttttttggaaacagggtttctctgtgtagccttggctatcccgaaactctgtagaccttctgtcctcaaactcacagagggtttgctaactttaggctgtgactatct

SEQ ID NO: 28174 - DNA, 1130 bp, Mus musculus
aaagggacagatattagttgttaaagaaaaaaaaaaggaaggaaaccttaccaaataatagttttggtcccatcggccatatccttacaactttgagagtctgaatttcgttttgccttattatgtagaatttggttaatttaaaaaaaaaaaaaaaagggagacaagatctgggagtggaataaaacaagcaaacacacgtccccgggtgggctcaaaccaccaaccttccagttaacagccaaacgcgctgaccgattgcaccacagagacacataggagaagagcctccccatctttgtaagaaacaaggctggacttaaaagaatgacccattgcattcggactagaatgtgactttccttctggtcccagcagccagagcccgcagagaggagacccccacagtcggtgagtgcctcagtttggtgcactgggtcatgggccagtctacagaggtcatcctctgaatagacacttgggactaaactcattcgcagtgtggtgtctcccctgccaggtaaataggaacgttgggaggtttgcaccttatgtgtctccgtggcgcaatcggtcagcgcgttcggctgttaaccgaaaggttggtggttcgagcccacccggggacgtgtgtttcatgaggggtgtttgcttgtttcattctgctccctggtcttgtctccttttttttaaaaaaattaaccaaattctacataataaggcaaaacaaaattcagactctcaaagttgtaaggatatggccgatgggaccaaaactattatttggtaaggtttccttcctttttttttttttttttttttaacatcttcgcttggctcctggtttgtccccttgcatccgctgcgcttctctcaccaggatcgccgcggccggaggtaaagcttgctctccgaccgggtgagtgaattagaaggaaatcggaaaccaaaagacgcacgagttagttccagtgggcccaaaagtgggcacaaaattgggcagtaaacagtagatggctttgctgttcagctaagcagcctcgtttttctctgccgtcttcctgtttttcttcccctccgaacacatgtttcttttctgactgaccttttctttcctcccttacttccgc

SEQ ID NO: 28175 - DNA, 1165 bp, Mus musculus
cacacatatatgtatatacacatacatatatgtatacatatacatacatatatgtatatatatgtgtgtgagtgtgtgtgtgtttgtatatacacacatacacacacacacatacaaacaggaaggtccctccagtccttcctattgtagagttatatttgtatgttagcggtgggttgtgtgaaccatcatgggttccagttgtccaaggaagaggatgggatgtcccagatcacaccctttcatcaatgagactccatagaggaggaatagaatatcaggccaaagaaataattttttatttttgagggggaaatgtcttctcaggacagagaagtgtagtaaatgaaggaagaccatgtcgctcttgatgggggctcttgtctagttttacgaccatagaggatttgccttcagtttctcatgtcctgagttacagatcatataaaaacgcacaaaactaataactaagaaaaatggatgataaagtttcttatacaactaaggactaatgtagagcaattttatgtgtaggttccatggtgtaatggttagcactctggactctgaatccagcgatccgagttcaaatctcggtgggacctctctatttactcgaagtagaagagcgcttttctttcactttgttcctgaccttataaaaggtttaagttcgcgttcctttcccaggcttcctttgtcttcaggtgagctggagctgcgtggcccccaggtcagtctctgatttagctgatgttagctggacacggagaccttaccttggtgtctgctctggtacaagctacaatggagcttttagtgcctcgacaatattgaactttggttcaccgttttgcattcaggtcgtgtcggaatttccacaacagtggactcagctccacgcatgggattcaagcgtggtctggcttttgtggcttgaagactgggagggcgattttgcttggcagcgcgttggcagaaagggaaactccgagttctgctggtggatctgtaggagcttgtatggaaaacgggaaactggataaggacagctaacgattgcatgagcaggatgaaatttgaaaagaattagaaccgaaggaatgcaggcagcttggctccagaaaacagactcaaaagcatcgggacagaagttaaaaattgt

SEQ ID NO: 28176 - DNA, 1196 bp, Mus musculus
catgtggatgctgggaatcgagtcttttgcaatggagtccttgctcttaactactgaaccaactctcccgtcctataagtaaattttcagagcactaatctattctacttcaagtttctcctgcatcagatccaggccagctggagcgagctacacggttaccccccctcctcccaaaggggaaaataaggatcaggtgaaaatgtttggaaattacaatagtagaatataaagaaagaatatgaaggcggccatgaaggggtagaaaggtagatgaccaggcgtcatccctgatgtcacgggtatgggcgtggtgtatgcagataagcgcgcagggtctgccgggtccgcgctccgtgcagaaatgtgaggggtttctcccgcggcgagggagggagcgcggatacgcgggtgtcagcagagcgcaagaatgtcgtgtgcgacgagggagacccgagatcggccagggctaagtgaccgtgtgttaagagtgtagaggcgacgggtgtgagccggggccgggcagtgggaaagcatacttacctggcaggggagataccatgatcatgaaggtggttttcccagggcgaggctcacccattgcactttggggtgtgctgacccctgcgatttccccaaatgcgggaaactcgactgcataatttgtggtagtgggggactgcgttcgcgctctcccctgatttttgtggtgctaaaagttagattgcattccgcccttctcacgtctctttacgtgttgtttgcgaggcgtggcctcggaggtaaatggtctccttttacctcagataagcttacctttgctctgtgagtaagaatgtagctacacttccaaatttagctattgtcctttgcggtccaaatgaaaatattaccttccgatctaacaatgttaaactagtcccaggcccttctatcgattgccagaatagactagactactacacagacacaccctctcaaatcaggccagctcctgcaacctgcacctacagtttgtcccctgggacaaatgaaaggacaggccctctttcccccccccccccccccccaaatcagagcacacacagatcttggggtctggggcagaaatttcgttcatggaaaaaacaaacaaacaaacaaacacgatcaaaggaagctcgttccctttggcctcagggtttcttagacgccgt

SEQ ID NO: 28177 - DNA, 1287 bp, Mus musculus
aaagaaagtggtaaccctccatgtggatgctgggaatcgagtcttttgcaatggagtccttgctcttaactactgaaccaactctcccgtcctataagtaaatcttcagagcactaatctattctacttcaagtttctcctgcatcagatccaggccagctggagcgagctacacggttaccccccctcctcccaaaggggaaaataaggatcaggtgaaaatgtttggaaattacaatagtagaatataaagaaagaatatgaaggcggccatgaaggggtagaaaggtagatgaccaggcgtcatccctgatgtcacgggtatgggcgtggtgtatgcagataagcgcgcagggtctgccgggtccgcgctccgtgcagaaatgtgaggggtttctcccgcggcgagggagggagcgcggatacgcgggtgtcagcagagcgcaagaatgtcgtgtgcgacgagggagacccgagatcggccagggctaagtgaccgtgtgttaagagtgtagaggcgacgggtgtgagccggggccgggcagtgggaaagcatacttacctggcaggggagataccatgatcatgaaggtggttttcccagggcgaggctcacccattgcactttggggtgtgctgacccctgcgatttccccaaatgcgggaaactcgactgcataatttgtggtagtgggggactgcgttcgcgctctcccctgatttttgtggtgctaaaagttagattgcattccgcccttctcacgtctctttacgtgttgtttgcgaggcgtggcctcggaggtaaatggtctccttttacctcagataagcttacctttgctctgtgagtaagaatgtagctacacttccaaatttagctattgtcctttgcggtccaaatgaaaatattaccttccgatctaacaatgttaaactagtcccaggcccttctatcgattgccagaatagactagactactacacagacacaccctctcaaatcaggccagctcctgcaacctgcacctacagtttgtcccctgggacaaatgaaaggacaggccctctttcccccccccccccccccaaatcagagcacacacagatcttggggtctggggcagaaatttcgttcatggaaaaaacaaacaaacaaacaaacacgatcaaaggaagctcgttccctttggcctcagggtttcttagacgccgtgttcccgtccatgtcctgtccatgacaactgcctctccagctcctccgcttgaggctggctctcccacaatcct

SEQ ID NO: 28178 - DNA, 1098 bp, Mus musculus
tccttccccttcccttctcctcgttcttgactgggtctcaagtatcctgggcgccctggcacgcacttcgcaactgaggatgaccttcaactcctgattttattgcctcttacagtccaagagctgaaattacaagtgtgtgccactctacctggctctgcattggagtattgagtcaacctgaactctacattgatttcacaagtagcagcaattgccctcaccgtccagctgaggcacagtcgcgtgcactcggcgcctctcccaacgctgggggaccaatcacttctgcgggagaacaggagggtctgaagcctcggaagccagcagagattgctgcatggttcgcactggtcgctggcctgcgctccgtcggggcgggcagctcattctggtcgttagcgcccagtgagaagacgccaaaggcaacactggaccgggcagaactggattgaggcttagccaacagggccagcaccgagcaagcatgcagttgcttactgtcaggcacgtggctcgccgtgatcgtatagtggttagtactctgcgttgtggccgcagcaacctcggttcgaatccgagtcacggcagtattgtattctgtgccagcatcttttgccagatctcatctcgctgtactttaccgcctcacaacatgctgtttccaggcattccctaacacaaaggcttttaattccagcacgcaggagacagagacaggaggatctctgtgagttccaggacagccagggctgagaaaccaaacccgacaaaatcaggttagtttgattcttttgaaatctgtgttggggcggttaagatcattgactgttcttccagaggcgattcccagcaaccacatggcggctcacaaccatctgtaataggatctggtgctctcttctggtgtgtctgaagatagctacagtgtactcatgaacataaaataaaaacataaaataaattgtttttagaaaatctgttagtgtgcttacaactccatttgatattctttcagttttgcctctgtgtgttgtgtgtgcgtgtgtacttacaaacacactgtgtctccatccaaaggcccagggaactctaagt

SEQ ID NO: 28179 - DNA, 1209 bp, Mus musculus
ccgttgctatgcaacatcccagaagagcagctgtagtgcgttaggagaccacctgccctgcaaagtaaacaactcacaaacctggggaacaatggtcggcttccccaccccctacatctctcccttcttcctgctcaaaccaggtggatgtagtgctcagagaaggttcttgtcagtccgtgtgtgtcacacagatggggtgttgtcaaggagctataccaagtgtgttttgtctattgataattgaatgatcataataattataacaattaataattgaacttattttggtcacgagtttcaattggaactagcatttcccttctaatgaattgaacctctcagatagtggcaggcagaaatagaaagttctgtcagttgtgcctcaaaactcctaaaatgacaaatttgacccagatttatcacagcttagcatctaggaaggtctgtttcctttctcaatgctggaaaaattaaaagtttcgtgaggaaatgttggtttacgttgctatttttctgtagaaatgcattaagatgtatagcttctcttaccttttcctgatgcactgtcactaagtgctctcaagggtgcattggtggttcaatggtagaattctcgcctcccacgcgggtgacccgggttcgattcccggccaatgcaatgtggtcttttctgtctgctacctacacgtttttctcattgtgaaattagaatcagactaggaccagaatcaaggatttttttttttttcctggaattgaacttttctaactgtggctcaagcaagaatccagtgcaaatttacaaatattgaatatttaccacagctgttctgctattttaaaggtctgtttccattcagtcacccttagcctgaggttcttattctcatgccagaaagtggtttcaccccaatattctaggcagtaaaaagaggatagggttaggaagacttggacaccgccctgatgtttctcaagatccctgaaccgcagctacggaagaatcaaatagaagtctcatgtttagaatgactctcaccagaacaatccaatctgaggacaatatgtaaggacaaaagctaaataaatcctaaccagagagaaatgttattccccaccaggagtaagattaggagttctttagcagagcggggagttatttcagtaaacccaggttcaactgcaaacagtcacacaaatttttct

SEQ ID NO: 28180 - DNA, 1175 bp, Mus musculus
atacccaaaagagtcggccacaaggatgttggcacctgggggtgggccacgagcggccagttaggggtaagagacggtgcaaggtgacttgtccctggtccttcaccgctccagcactgcgccagtgagaaagtccaacaggccccgggatcgggcggcgaaaggaaggggcgtgatgtcactcctgggtggctgacggggcggggtgtatgcagatgagggtcgcgcaggggctgcggcgtccgcagcggccggggaaacgcgagagatttctcgcgcggcgtgggagagaacgcgggtcgccagatgtcagcggagcgccgagacggcgtgtgcgacgagggagacccgagatcgggcggggctaagtgaccgtgtgttaagagtgcaggggcggcgggtgtgagccggggccgggcgctgggagagcatacttacctggcaggggagataccatgatcacgaaggtggttttcccagggcgaggctcacccattgcactttggggtgtgctgacccctgcgatttccccaaatgcgggaaactcgactgcataatttgtggtagtgggggagctgcgttcgcgcgctcccctgataactggtaaccaaaagcagattactttcccccttgtggtcttcgcgtttgcggacgggagagaactttcggccattttccttttagaaatttaacttcttgaaggccaccaggtgacccttacttccctctcacctttccttctacctgtactttctctattaaaaagcctgcagaagtacccttgacaaattgccaaaaatgacacctaaaaaaaaaaaaaaaaaggaaaaacgacaccttaggtaattataggttgtaagaaaaagatttgacctcttggagtttttatttcttaataccaaaggacacccaaggaacgtatctctcaaaattgggtttcaaacctcagccgtttccttcttagttccagtgcttaacacgcaacagacctgcacaccactacactgcatacgagttttaaagttaataaatcagtcacccctccatagtcttctacctacttgaagacagaaacggctgctaggaagcaattcttcttttgtccattggcttttgcttttctttctctctttttcattcttctctcttttttaggctctagcgcacgccccggg

SEQ ID NO: 28181 - DNA, 1163 bp, Mus musculus
gtccgttcgtccatacccaaaagagtcggccacaaggatgttggcacctgggggtgggccacgagcggccagttaggggtaagagacggtgcaaggtgacttgtccctggtccttcaccgctccagcactgcgccagtgagaaagtccaacaggccccgggatcgggcggcgaaaggaaggggcgtgatgtcactcctgggtggctgacggggcggggtgtatgcagatgagggtcgcgcaggggctgcggcgtccgcagcggccggggaaacgcgagagatttctcgcgcggcgtgggagagaacgcgggtcgccagatgtcagcggagcgccgagacggcgtgtgcgacgagggagacccgagatcgggcggggctaagtgaccgtgtgttaagagtgcaggggcggcgggtgtgagccggggccgggcgctgggagagcatacttacctggcaggggagataccatgatcacgaaggtggttttcccagggcgaggctcacccattgcactttggggtgtgctgacccctgcgatttccccaaatgcgggaaactcgactgcataatttgtggtagtgggggagctgcgttcgcgcgctcccctgataactggtaaccaaaagcagattactttcccccttgtggtcttcgcgtttgcggacgggagagaactttcggccattttccttttagaaatttaacttcttgaaggccaccaggtgacccttacttccctctcacctttccttctacctgtactttctctattaaaaagcctgcagaagtacccttgacaaattgccaaaaatgacacctaaaaaaaaaaaaaaaaggaaaaacgacaccttaggtaattataggttgtaagaaaaagatttgacctcttggagtttttatttcttaataccaaaggacacccaaggaacgtatctctcaaaattgggtttcaaacctcagccgtttccttcttagttccagtgcttaacacgcaacagacctgcacaccactacactgcatacgagttttaaagttaataaatcagtcacccctccatagtcttctacctacttgaagacagaaacggctgctaggaagcaattcttcttttgtccattggcttttgcttttctttctctctttttcattcttctctcttttt

SEQ ID NO: 28182 - DNA, 2799 bp, Mus musculus
aataaattagatgcatgggggttgaaatatctcaaaacattatttccttttacacaggcaccagtgtctgccaaaaaggagaagaaagtttcctgcatgttcattcctgatggacgtgtgtcagtctctgctcgaattgacagaaaaggattctgtgaaggtaaaaacatactgcttcaaatgctagacaggatagccagaactgggggtgggggggttgggggtggtacggagagggtcgtagggtagaggcagaggaagtgctgttaacttgcatggctattcatacttcctcattttattttaactctaggtgatgacatctccatccatgctgactttgagaacacgtgttcccgaatcgtggtccccaaagcggctattgtggcccgacacacttaccttgccaatggccagaccaaagtgttcactcagaagctgtcctcagtcagaggcaatcacattatctcagggacttgcgcatcgtggcgtggcaagagcctcagagtgcagaagatcagaccatccatcctgggctgcaacatcctcaaagtcgaatactccttgctggtgagtgggtgagaagagagacaattacctggttacaaattcagtgctttctgtactcaacccatctaacaaactgccatcctcctctctagatctacgtcagtgtccctggctccaagaaagtcatccttgatctgcccctagtgattggcagcaggtctggtctgagcagccggacatccagcatggccagccggacgagctctgagatgagctggatagacctaaacatcccagataccccagaaggtaagctgcagccggataggttcgagttattttgatctgcttgggcttgtggagttggggtgacctggcatttatttcttagtcggacttctgacaccgttttctctcttcagctcctccttgctatatggacatcattcctgaagatcacagactagagagccccaccacccctctgctggacgatgtggacgactctcaagacagccctatctttatgtacgcccctgagttccagttcatgcccccacccacttacactgaggtgagaactgctattctcacagggtcaacattttgtcctaggccttttgaaggaagggttaatgtgggttttctacttaactaaaaaacctgaaaatttcctctctattccccttccaggtggatccgtgcgtccttaacaacaacaacaacaacaacaacgtgcagtgagcctgcaggaaatgaagcatctgtattagcgcatttctttctgcctctctgcttgaactccagtgtttcagagactcagtctctacagcggggaacgggtacaccccagccgctgactcctcaagatgggtggcaatcagtaggcgggtctccggcttcaagtggtgcagaccagtgcccgcactgtggcataggagtgtttgctgggtggatgtcagaacactcttagaaaaattgagacctgaccactttctcggatgttggaaatgaagaacttgtttgtgttgactgagtcagggcactgctgaccttctggcgttgtctttccaaggtttttgttttaaagggacttttaaattgtctaaaatatcagtagaccatcatctgtgccatgggggacagagccaatttcaagtcatggccaaaattttgtaagaggagtgtttttgtgtgttttttaaagtcagtgttccttttttatatctttacaaagaaaagaccttccacggctggtgagcacgcagcctgtgaaattcggggcagctgctccaagttgacttcaccctgggagcagtagtagctgtgcccactgacggccataaaagccattttacagccagttgcactgtgttctcttgtaagcataatcagatgggagaatctgttatttccctgtaaccccttggaattgattctaaggtgatgttcttagcactttagcttgtcaattttgttttagtctccgttatagatgtaagctccaccagtctcttaaggattaagcccagtgacttggagggtgggggttagggtctctatccctgaacattgtagacccaggctggcctgagagatccacctgcctctgcctcctgagtgctgcgatcaaaggcccagcttggttattgcttttgaggctttctcccaacgcacagacttgtgtaattctaacactaatcctgtgaagggttgtggttgacagctggagcctgggtgacattctacattgagatgccccagcactgatcggggcacagaagcccccagaccccatttcctgtccagtgttgggagaaagtgctgctttcactgtggcctcagccctggctcggaagctcactaagccttagcactttgtcctgtgtcagctccacctgagaactgtgcagccagaatgtctgcgagctgatggaggtttcggttttgttgtttttgtattttgtgtatctttttgtatgattaaaaactatattttctacttatccaaatatattttcaccccaaagtggggttatcctttgtaaaaaaaaataaagttttttaatgacaaaaataaatgttcttttcttgtctatgagatactggagaagttactagaaagtgttcccctgtctcaatactgaaagcccgtggagagagaagtctcttgacgctgagtgacataacggctggtttggcctctgttcagacggaggaatccgtagggtctggtagtagaagctaattaaccacgtccatagtcagaaaactccttcaggatcaggc

SEQ ID NO: 28183 - DNA, 1940 bp, Mus musculus
tccttcatttgggggcttccctaccttatccagaagatctggcttccttttgttttgtgagacatcttattatggcctggaactcatcctatagattaggagggcttcatgcttgtggttgtatcctgctgaaatcataggcatgggtcacaatgagaaactgcctaggaacaagagaatgatacactcaattcacatggggtgggtaggtggcactacctgagctgcttctgagcttacctacccctgctagcagtctagctttctgggtgtgagaagagggtaagggttgaggctgatactggtacacgcacatgtgagcacacacttttttccatttgttcatgtagcccaggctggtctcaaactcttcttctggctgagaatggccctgagctccagacctcccgcatcagcctctccctaggattacagtgactaccaccgcagctgccttaatcctcccctcagtgacaagaagcatcttgttctttagaaacggtagctgttctgtttagagagaaccatgttcctctcttgtccactgagctgtaactctgaatttgtggagaattctatgtagtaagctcaatttcccttctttctgtggtctctgctacattgtattattgttcagtgcactttctatcaagttgggacagttaatgctactataatgcgacttcccatgtgacaattgcagtttgattttaggttaggagctgggtctggtggtgcaggtctgccatctcagctacaaaggaggccaaggcaagattggaaattcaaggtctaccccagctagagcaagttcaggggcaacctgggtaatttagcaagactctatctcaaaaatatgaagtaaaaacaggactgaggatatagcttagtggaagagagtcagcctggcatgtgaagcctgaatttaatctctactgcaaaaaggggaggggagggaaggggaggggagaagacacttggcaggaagaggagggaggggagcagagttagatcagttagctccctgggtcggaacaaggtgaaaagcagctttcttgcttttgaaatcatctttgtgacaaggacacatggggtcagggtagggtgtccagttaaaatagtgtcactgcttagaaaggggtacttggattcctttagttagcttagctctgtctcttgtttcataaaacacactgggttagaatagaggctcctgcattacatggtttgtgtcactgttttttgttgggttttctttttggtttttcgagacagggtttctctgtatagccctggctgtcctagaactcactctgtagaccaggctggcctcgaactcagaaatctgcccgcttctgcctcccaagtgctgggattaaaggcatgtgtcacgttttaaattgatagttataacctcgatgccacgaatcctgcagtttctcctgtgctcctttctttgtgtcagatgggttaagggttatcagtttggggaagaattgtccttgtaccccctggaattatttttctcaaaaatccaagactccaaagaacatgggaaaaattgttctgtccacttttgacgttgaagattttggttatccttttcgtactttctatgtattttctatgtaaaattttacacaattaaaaatgtttttttgtctagtaagccagaatgacttttttcccctgtgacaggatcttgtgtagccaaggctggcttccaaatgtggccaaggttggccttgaatactttatccttctacctctacttcccaagtactgaagtcagggccatgttggggttaaaatcggaaaatgattttgctggcttgttgcttagtatctctgggaaaaaaattgatgaaggaaaggaatgaggtgtatgataaaactgaaccgctccagacgcaaagtaaaccgtctaaaggtttctatgt

SEQ ID NO: 28184 - DNA, 1299 bp, Mus musculus
atcttcacgaggcggggggcgaagatttcgccatggatgaggatggggacggtgaggagagtggaggcgactgcgggaagaggggaaggtgcgagaggggaatgcagtagaaattttcctgggacgtcaccccacgaactgggtctgaaaagatagactcctcccccttgggaaaggaattaggggcggaactgggaagggactgaagctggagtctgtgtcgaagcttccagatagtctaggaaacgcgacaggttttttttgttttttttttcaaatgactcttatttttgttgcttcttattttctcacctggaactctagaaagcatccacaaactaaaagaaaaagcaaagaaacggaagggccgcggctttggctccggtgagtgtggggaatagggtagagtggtctaagaggcagaagcccgcgaatttgggagtgtgagggggacacatttggaggacagttttcggtgatctggtatgaattcttttagaagaggggtcccgagcgcggatgcgggaggattacgacagtgtggagcaggacggcgatgaacctggaccacagcgctgtaagtaaataggacctatggggagtctgtgtgcactggcactcaaatgcaaagtaaagagttgtttaaccagtctcagaaaattgcttattgtaggttcttttcagaatttttcttttttagtttgtttggttttgggtttttttgttgttgttgttttggatacagggtttctctgttaagccctggctgtcctgaaactctttttgtagaccaggttggcctcaaactcacaaatctgcctgcctctgcctcctgaatactgggctttttagcttacatgttcatacaacactttccctacccaacagctgttgaaggttggattctctttgtcactggagtccacgaagaagccactgaagaagatatccatgacaaattcgctgaatatggggaaataaaaaatattcaccttaatttggacaggcgcacgggatacttgaaggtagattttcttgcttccctcacttacaactcttagatacattgattatgttgtttttgtgagttgatcaagcacaggtaggaagtgaaatgacattggaaattgattttgttacccacatgaaagagacagaaacagaatgagcatgtttgtgtatataatggggatatgtggtgtatagctgcgaaatttttcttgtaactatgcatttctggtttaaggaaaagagtacttggttggtgaagtaaaattctgatactttttgttgtttgtt

SEQ ID NO: 28185 - DNA, 1421 bp, Mus musculus
taaaagtgtgtgtgtgacgcctggctaagctttgatacttttatatgctcccctaggggtatactctagttgaatatgaaacatacaaagaggctcaggctgccatggaaggactaaatggtcaagatttgatggggcagccaatcagtgtggactggtgttttgttcgtggaccaccaaagggcaagaggaggtaagatgaagggatgggggttgtacatttatttatcttagtaaagggaacatgagcaagataaataaggattcagtattagatctctgatattccccttctgttttttcattttcttagaggaggccgaagacgaagcaggagtccagaccggagacgccgttgataaatcctctgtcgactgggtggtctctctacaagtccatttggttatgctgccttggataaacagggctagggcggaccttgtgtttatatttaatttcttaccctatctacttggcattgcttttgagttttagaaaaaaataaatgttccattttgttttctatgtttattactttactgttctggaaactgaacaactacagtggggcattgtgaatgattgtgaagatccttctgtctggcgtggcattctaagtttctagaaaggctcatggagactgttcagcatttctttgtcttagaagataagggtagggataatgagatttttcttgtggaattaaggaatgtattttgcataactcttgtgagcagatgttatattagtgtctcttgcttctctgtcagagcctgtgcagctggccttgaacttcaggggctttgtgatgcttagcctactctatgttgaatatggtgctgaactgtgaagtttattagttcttacaatgtaaaagaaacccagcttgatgggctggagagatggctcagtagttaagggcactgactgtccttccagaggtcctgagttcaattcccagcacccacatggtggctcaccatgggatcccatgccctctgaagatagctacaacatactcatataaataatttttttttttaagaaaaaaaacccagcttgggtactatgtaacaatatgcacacctttaatcccagcacttgggaagcaggtggatcttttggtttaaggccaacctggtctacaggagagttttaggatagccagggctgcacagagagatcctgtctcaagaaaaaaagacattgctatccctttatcatagggttttggttgtttttttttttgggggggggttttgtttttttttttaatttttctgagacagggtttctctgtgtagccctgactgtctcccctgtgcctcccaggtgctaggattaaaggcgtgcaccaccactgcccggcttttatcatagtttttagttgaaattattttttggtatgtctgtagcagctg

SEQ ID NO: 28186 - DNA, 1193 bp, Mus musculus
tcaggtaagtggccatgtttaggaagatccaagatctcggaagagtccattctagacacatgatgtgctcttcccctgcccagtgtccctagggatttaaaaatgctttcctgtgaggggagaacatggtcctttccctgcccccgtcactccatagtcacacctgtgatttcgtagccccactcttcctgctcactcacccccacacggactcagaaccttccctagtggatgttccacacatttcagacacccacaaggccaagaactggatgtctgaaggggctgtctcaaggcaaggcacaggagaagggtctgggggagtagggtggaggcagaggttcccagcttttcttctcaagaatgctgtatgatccctgagggctggtaccccacgaggtggttctgaggtgagtgaggtgctgagtcaagacaacacgtcaagctgtgcccttcatctctccagcactacggcccttcagttatcacttcgctagatgaacaggacacccttggccacttcttccagtaccggggaaccccttcccacttcctgggcccactggcccccacactggggagctctcaccgcagctccactccagcgccccctcctggtcgtgtcagcagcattgtggctcctgggagctccttgagggaagggcatggaggacccctgccttcaggtccctctttgactggctgtcggtcagacgtcatttccttggactgagctttttggattatgaaatcaatctccattggccccagcactgagcagatcacgttgtgggttccgaacccctggctgctctgatccctcaggggtcattggccaaaggccaggccagagcttcatggatacctgcttttggccttatcgctgcctaacaggccagtactcacagggttaacatttaacctttttatggtggcacattcctctgggtatggtaacctaggcagtgggaggcagatgggatagggactgagggatgagggggtccttagcctttaccagatcttcagcctcttggggaaaggcactttcctgcctcctctcccaagactctccgttccctacccaaacccaaatatctggtctttgacatccattccgttctctttgaccatacagtcgggcgacaggtcagagatggacagagaactctattttggattgcagatttctt

SEQ ID NO: 28187 - DNA, 1175 bp, Mus musculus
tccagcccattattcctgacctctctcagcctagatctttaatagagtaacttgttcagcatagcttggattctgtagttctgtattgaggaccctttgaagacgtaggttgatagattttggagtcaattcaccaagcaagtcaactaccatcctcttcatatctgtaaaatggtggtggctgctgaaataaaagcagtgctttgcaccaaccacagtaatgcatacctatgattcggtactcaggagagtaaggctgaaggactgaatttatttattaatcactgtcacagttattaataaaggcttgtgtagagtttgctcagtaaatattagttgcctttcctttcttccacccaggatgctgatagacaaatggaaactgggcagcctgctccatgtgactgattatgtcataaccatagcccctgattggctaagaaggaaagaagatcagtgctgacagtaccaagtggatggctgtttatcttgcccattccaaataacgtacaatttctctctttatttctgtggacaaacaggaaattcctaagacgccagaccacgccccgtccaggaccttctatctgtacactgtgaatgtgctctcagctgccaggatgctgttgcacaggtgctataaggtaacgtgtgggcctcctcctcgtccctcacacagtcgcgccctttacctccttagcccactctacccacttaacagaacggcgtgcatttctctctgtcttctctttcctcagagcatagccaacttgatagaacggcgacagtttgaaacaaaggagaacaagtgagtgcagcctcccgtgagtcatgttcagtttggttttgggttttaaagctgatccaataactaaaagatgatgtggtccatttctcctttacctcgtacccgtgggccccaacacccacattaacatttccaaggtccagagcctgagggaaaacttgctacagaaatggagaccatagcccaatacccagtctagttgcactgagtcataggtttgcattggcataaccatgcctcagtttacccttgctgaccataccaccaactaaattaccttgcagatttatgaggcatgtgcttgaccccgagttttaagtgctactgagaggcagtaaatgtttcagaaacaaagttctatttgtaa

SEQ ID NO: 28188 - DNA, 1178 bp, Mus musculus
acccgggtggggatgggagtgggaagggagtatcaagggtgggaaaaagaagaacccacaaagtagcaaagaccattcacactgcatagcagctaaaatgtcctgctttgatctccaacactgtatagaactgggtgtgtttatgtttatgatcccacgacttgaaaggaggggctgggaagttcaaggtcaccctcagatacacaacaagtgtaaggcttccctgggctccaggagaaccacattcaaaacagaaaactagaagaaagataaagatcagacaaaataagccgggcgtggtggcacacaggcctttaatcccagcacttgggaggtagaagcaggcggatttctgagttcgaggccagcttggtctacagagtgagttccaggacagccagggctacacagagaaaccctgtctcgaaaaaccaaaaaaaaaaaaaaaaaaaaaaaaatcagacataataggaacatcacagcaaagaattctcttgatttcctgcactgacattggctacactaacccacagaggaagtaagattctatatgcagtcaagtcaaattcagtccctgccctgtcatggtgggaactggcctagatggctgccacaacaagttctgctgctcatgggccccgggtctcctgtcctggaacctggggataagtttggctgcagacactatactctaaacataggggttctcaggacagacaaaaggcaagtcctgtttcaactcaggcccagttgctttaaaaaataaaactagaaagagattcactagactctgctggtgatctgttgcttactaggctctgggaggtgtgccgtgttgccagcagtagggagctatatagcgtcaggtctctcctgtctttcttttgggtcctatctaggtgaaaaaagccctttgtgtcctcattcaccacaacctggtcctctatcatgtgcacaagcgcggtgtggtggagtatgaagcccagtgcagccgggtactgaggatgcttaggtatccccggtacatctacaccaccaaaacgctgtacggtgacaccggagagctgattgttgaggagctcctgctgaatggcaaaatgacaatgtcagctgttgtgaagaaagtagccgaccgactcacagagaccatggagggtcagtactggatctaagctctt

SEQ ID NO: 28189 - DNA, 1360 bp, Mus musculus
gggaatcattgttgcctagaactagaattctaggtgtttaccaccataatgctttgatatgcacctacacagtgaaatgataaccagtcctgctttgagtagtttcagattccttacttttgatagcttaggctgttcagaaacatggttcaattcttattttgtggtaaagtacctaaaatggggatattcagaaaagttcattttgtgtgcttttacttccctaacttctatagtatatttaaaagtgtgcttttatagaacatattttttgtttgttttgagacagtgtctcattaagtagttctggctgtccttaacttgttatgaagaccatgctgtccttaaactcacaaagatctgcatgtagcctcccaagtgctgggattaaagactgtgctaccatacctttaaagagtaaaatttactctgaaaaatgtcatatgtatataacatgtgttttgggcatatttgtttttgttattaaaattttttaaatttttttctgagatagactttctctgtgtagtcctggctgtcctgaaactcactctgtgaagtacaggctggctttcaactcacagagggccgtctgcctctgtcttccaagtgctgtggttgcatgtgtgggggtatcttgcctgcatatatgtatatgcattgcttgtgtgcctggtgtccagggaggccaaaagaaggcattggatctcctggaactggagttacaaatagttattagctgctgtgttgatgctggaaattgaacatggctcctctggaagagcagccagtgttcttaactgctgagccatctttccagtcctcatgtataatgcattttgattttatccaccaactactacttccctcctacttcctccaggaccctttcatctgatctccctctaacttcatgttttcttttattatttttagtggtagtgcagttagtgttgaccatatggtcattagtgtgggccattcactggggcatgggcaacctactagcagccacatcctcaaaaaaaagtgactttctcctcagctgctgtcaattgccagtggttccccacctcagagttggacctcaggagttcttccctagtctatgctggaattaaaaaaaaaaaaagatatatatgtttaatatataaattttaaatgtgtatgagtattttgtctgcatgcctgtgtagaggtcagaagagagtgttagatcctctggaactggaattatagagggtgataagccaccaggtaggtgctgggagccaaacccatatcctctgtaagagcagtgtgtgctcttaaccactgagccatcgctccagcccccaagatggaattttgactggcttgg

SEQ ID NO: 28190 - DNA, 1351 bp, Mus musculus
actaaagaccacacctgaaccagggctgcctgcgttagtcctgttatcatagctgtaaattgtatcaaaactaaacaaacaaaatagtagatggatttaggaatcatgtaagaaacccccaacccataatattaatgcaaacgagtgtatttcttctctaaatttaaagttaggacttacaggtggaattgtatcgacaaccaaatgcctcttgttcctgaattgagtgatagttttataagtgtgaaacttaattatgtcagttttctcctgcttgagtagaatcaattccttaaagtctaggtagggttctactgttatgttgtcttgtaatggatgtctctacctcctccttcaatctctatcctaccattagtggatttcacagcaaatagagaagaagccagagccctaaggtcttttttttcttaattgtataagagtacaagtatctgctcctggccccattagcaaggtaagactaattcaggggtctgagactctaacgctgttctgtcttgatgatcagagagcaaatcaagaaaattacagtgggaaggaaaaatgccgtgtcactatatactttgattttcttattttagttcaggaagcacagtttccctaaacatcaccatggcatgtcttacttagccttgggttggtagaaatctgattttggttcctctgtgacattaaattgagcagcatatagacgggagatgtgggagattttactactgaaatgttcttaatgactgtcaactcattgtttattgtctttcatactagaaaccttacaataattttcttcataaaataatttccttcaaaaatacaattccttcattaaaaataggattattttattactgcttctataccagtttacagttttggtaattcattgtttatttaggaattaaagttgtatgtttcttgttttagtttgtaaagctcatttttcatgtctgaaacttttcctgttctgttcacttctagctatacttggaatcaatctgatcaatgtaatcatggccaaaacaacttagtttgggaaggtagattgtgttttacattctagcgatgctcatacacatactctgtacgtgtttgaaatggaataaatggagattgtggagcatgtcattaagcttcagcgtctcaaaaggacacgcacggtggagccgcagaggagctgttggtgcccagaaagggcctggaggcgagcagcagctccatgtgtggagtgactatagtgcttcatagttcagaatgagcagaacaagggcgctataatttggtgaggagtccttccccaggttttgttgactcacagtctgatttgggggta

SEQ ID NO: 28191 - DNA, 1482 bp, Mus musculus
ccacacactaggctagcctggccagccactgggcccaggaacccttctgtccccatctctccagcactaggattacaagcacacaccaccattcctggctttgttacaaaggtgttggggatcaaactcaagtcctcacacaaggcaagcaccccaccacctgagctgttattccaggccctggctagatattttgaatattaattgcattgtcctgtcaattattcatcattcctttaaatcctctgaaaatagattagatgtgtgtaccatttctcctttccaaggtaataaaccaggataggaacaatagtgtgtgtgtccgtgtgtatgattagagactcctgttcaggttaatattccaataccaaagattctctagacatggttgtttaactagctaacaaatacattgtttactttccaattaattctttaatattgtttacaaaagcatcttgtatggtcagatgaatcgagtctgagaacttgagctcggatactgatttgagtatctgctaagctgggttccttcataagtcgtctggggtgtaagtgtggtctcaaaactctaaaaagagaccgatgtcaccacccatactctggatccctccaccatgcccctggggtgcctctgttactttgtagtgcatagaagactatcatctgtccatccctgtccaacatccagcaaggcagatggcactttgtcacccagacatctgttaaactggactgaaccccagttctcatgataaaatataaaaccttaatgtggttgagagtggctaaggtacatgccactcttgcaaaggacccaggttcagtttcctgctcccacatcagttcacagatgcctgtcactccagctccaagggacccgacaccctcgtctggactctgtgggaacccgccctcatgaacacttacccacacataaccacacacacacaattttaagataatcaaaataaaccttttaaagccttaacacacaaatcactgtcataagagttaggagggagtaaggctcttcatcagcttgcccttggtgagccggtttctactgtatttaccaaggacaatgtgattgagaatttccacaccacagcagggtctccgctgattaaagcttccgtgatgtggggtggttagaactacaggtccagagcccagtgacagtttctccaggtgatctctagcctaaagagtaattccttgcccacctctagcatcctgataaacaagttggaatgtgttcacttaacggaataattcttcgccaatcaaagggctaaatgtcacatagcatctgaggcctctgcctgagtaacctgcttctctgatgtttccacaaatgtatttttttaagccttgattcatacctttctttgttctgtaattatatatatttttaaaaatccattaaactgcttacatgttggaatgtagacttggggtaacctgagtctttgttctcaa

SEQ ID NO: 28192 - DNA, 1214 bp, Mus musculus
ttggttgatttcagccctgagtttgattatttcctgccgtctactcttcttgggtgaatttgcttcctttagttctagagcttctaagtgtgctatcaggctgctagtgtgtgctctctctagtttctttctggaggcactcagggctatgagttttcctcttagtactgccttcattgtgtcccataagtttgggtatgttgtggcttcattttcattaaactctaaaaagtctttaatttctttatttcattcttgaccaaggaatcattgagtgttgttcagtttccacgtgaatgttgcctttctattatttaagttttattgaagatcagccttagtctatggtgatcagataggatgcatgggataatttcaatatttttgtatctgttcaggccggttttgtgaccaattatatggtcaattttggaggaggtaccatgtggctctgagaaggtatatccttttgttttaggataaaatgttctgtagatatcaattaaatccatttctttcataacttctgttaatgtccatgtgtctctgtttagtttgtttccaggatctgtccattgatgagagtggggtgttgaagtctcccactattattgtgtgaggtacaatgtgtgctttggggttgtttgaatttctggagtccagctttactaaagtttctttaatgaatgtggctgcccttgtatttggagcatagatattcagaattgagagttcatcttggtagattttacctttgatgagtatgaagtgcccatccttgtcttttttgataactttgggttggaagttaattttattcgatattagaatggctactccagcttgtttcttcggaccatttgcttggaaaattgttttccagcctttcactcagaggtagtgtctgtccttttccctgaggtgggtttcctgtaagcaacaaaatgttgggttctgtatgtgtagccagtctgttagtctatgtctttttattggggaattaagtccattgatgttaagagaaattaaagaaaagtaattgttgcttcctgttatttttgttgttaaagttgggattctgttcttgcggctgtcttcttttaggtttgttgaaggattactttcttgctttttctagggtgtagtttccattcttgtgttggtgttttccctttattatcctttgaagggctggattcatggaaagatatttt

SEQ ID NO: 28193 - DNA, 1656 bp, Mus musculus
ccagaaaaaaattcttctgacaaaaataattgtaattcctgacacttactaaacatggagtctaagcctctctctctgtttttacttactgtgagccaggcacagtttaaacacttctgaaaacaactgtacacattgtccatgttttataagtcggaaatctggagcacagagccaggaactggtcctgcgtaatcaggtcaggttcttcggtggtctccatgattttgataaactgatttcacttactaactgccaactgcatgctaaaaaaataatgacacaccacaagcctggcactcaggaggctaagacaagaggattgcaagttctacaccagcctgggctccacagtgaggccacatttctaagaagacaataaatttgtcctcataatgcctcctttgtcacaaaaccctggcaggttggccaccctgtgtcactgggaagcataggcatgaggcactggctggggactaccccagggaagcagggccaccactcactcggtcttttgctgggtgggcgtcatgctcggactccgcagacgtctctcctttttcatcagggccagccaccaggggctcggccatggaggaaacgatggggattttcttagcttggaagtagctgtaggccatctttccacagaccaacagagtgacgtgcttcccgctgctcttgattctctccaccactctgtcgtagggttcctcttgcacgttctccccgttcacttcgatgatgacgtcctcattctccagcccagccttgtcagcagggccaccctgctgtacctgtgaacagaggttctgagtcggttccaagcatggaagaaggcgtgccgggcagcttccctcctgaacagcctcaacacttgttaactgcgctcctttatggcctatacaccctgaactccactgggctcagccacactggcaaagcactgcactgaacatgtgctgggctgaaggcatcacgcccccatcttaggatcccaacttggaagctacagggtggtctcattgctctcccctacagggttcaggcaccgtgcacatccacagcagtgggcaaggagcactctcagaggcggacttccaagtgtgaccactgttagtgtcacggagacttgtggcttgcactgaaaaaaaaatcccatcctaattggctgtttgctgagctgtcagaactagtcaccatacctctttgacaaaggagccaggctgaccccgaatggcattcaggtgaaagccgtagctatcgtcctctttaagcagcctgcagagcttgggcttgtgaccctccgcgtcctctgtgggctctgagcctgtggcctccagaggagcagggatcggagctgggccttccttgacagaaccattaggcagttcttgactttggcagtaaagaagtggagagaaccgagcctttggaaaataaaggggaaaaaatatacatctgagcaattacacgtcactgaatgtcatggcttaatacacagggtgtctcacatgtatgctcctcctcaacaggaggaggggagagtctaaagtttctttcctactgccagagaaggtagaaacgtgcacagacacatacatgtgcataacagaaacagtgcacagttctgcaccagaccccagagctgtctca

SEQ ID NO: 28194 - DNA, 1179 bp, Mus musculus
ggcagccttaaattgaagactggcgggactgggagtggaacgtgggaggcgtggggggggggggcgggaccttaagcatggcggggggccgacggaactgccctccctggggacctcggccgcgcatagcattgtggaagttgtagtttttacgggtctgagtttccagatcggacgaagtctcaggactcactttcccgtgctcctgtgcgcagacttaattggagcaggtccgtgggaggtcaggagattgcgtggggagcttggttataaaatgtggacccgaatcccgggtgtccgaggaacttctgcttttgcggcctccccttcacacggtttgaagtgcaagtttcaggtccaagtaactgccctgactgagcctgcatgcagtaggggcggccggcagacgctaggcttaaactactagacaatctttctgctcccacccctttctctccacctccggcctgactgtcgctgggtcgccccgctagagtcgcttgttctgagagcttggatgcacttgccctccagttcccgcgaacttctgagtagctgctgagccgcgttgcctgcggagccctcagcttccacagcctccatcatgcgcgtgtgggtccccgtgggtgtcctgacctcgctggcttactgcttccaccagcggcgggtggccctggccgagcagcgggctcctaatggccagcgtccggtggaccgcaacctactggagctgaaaatggtgcaggtggtgtttcgacacggggcacggagtccgctcaagcctctcccgctggaggagcaggtgagaggcggcccacagaggggttcttggggacacactttagcgtcccccgtcggggctcgggctgggtccagaccagagggaaacaacagtagactggccctcaggctgtggcctggagtcatcatcccatgctcatcccaaaccaccggtgtggtgtgtaagccttcctggctagggcagcccctgccccccaaactttcagttgcttggtgtagtgaaacttttcaaagatgcataagaatgtcccaggcgggggttcttatttaaatgcagattctgattctgcggatgtggagttgggtcacgtttcgtagttctgtggttgaacttgagttcaaggaccttgtaagtgcctggttgttaataacagagat

SEQ ID NO: 28195 - DNA, 1147 bp, Mus musculus
ccaggcatgatgatgtccatgcaaggcatgatgggaccccaacagaacatcatgattcccccacaaatgaggccccggggcatggctgctgatgtgggcatgggtgggtttagccaaggacctggtaacccaggaaacatgatgttttaagctgctacgattggatgtgccgatccttgtcaagatgagattccaggtcctgtgagctgctttgatggagttccaggagtccttactgttggtcatgcaataggagaagagggacccggggctgctttgagggaggagggaaccaagaatgtatggatttaccggaaaacaaattattcatttaatcaacaggtgtgtttttttaagatttattttttaaaaattatttttgtggacatggggatcccgtgacggcacctacttttgggagtctgtagccgtgtttgagaattgccatcggtcatgtgttgcaccgttctgtgtttacgtcctttggactggcttctcccaggattcttttctggttttttttttttacttttgatttgggctttattttgtgtgtatgtgtgtactgtactatattgtaaaagggattttagcagagactttagtctttggggcaagaggagaacaggaatgctgggctgtttactttcgatggagaatccatcttcagaccttggactattttctttcaactccagtgtatagaaaaaccaaactacgacctcagagcagagtattaacgaaaagcacaaaaaaaggaactgagttcagcgaggggtggggggaggggggacatttttctttttaaaaatactgaagcttgggacgtttgttcttcggttcacgtgctcctcagcacggtctgtctccagtgtacaacctgcccgccctcacggtttcctctctctcctccttcagttccttggttacgtgtgtttccttcctgtgaccccgctggtggccctctgctttcccctctcttcttccccttggcagctgcaatacccaggctctctggggttctccctgaagcctcgcccctgcctcggatgccctctggcctcttgtccctccctgccctccccgccctggtgtactcttccttgcccgccttgtttcttgttctccttttcttaggaattcccaa

SEQ ID NO: 28196 - DNA, 1176 bp, Mus musculus
tcttgggttctataagagagcaggctgagcaagccaggggaggcaagctagtaaagaacattcctccatggcttctgcatcagctcctgctccctgacctgtttgagttccagtcctgacttcctttggtgataaagagcagtatggaagtgtaagccgaataaaccctttccttcccaacttgcttcttggtcatgatgtttgtgcaggaatagagaccttgactaagatggggtgggggtggggtgtctctcattggactggacctaaccagtgatgttaggctggatggccaataaacccctgggagctcttctctacatccccagtgctggggttataagcatatgacctctctccctctccctccccctccccctctccctctccctcaccctcccctccccctcttcctctccctctccctccccctctccctcacactccccctcccctcctctctctctgtctctctgtctctctgtctctctctctctctctctctctctctgtctctctctctctgtgtctctctctctctgtctctgtctgtgtgtgtgtgtgtgtgtgtgtgtgtgtgcactaagggttgaatttaggtccttatgcttgcgtggcaagttttagcttgcaatttccttatggctaaggctgttgaatactttaaaaataattactggctgtttgtagttcttgagaactgttttttcagtccattgattcgtttcctaatgggcagttttggattttttggtgtttagtttttgctgttctttagttgttctagatattaaccccatattaggcatactggggaaagctgtctttcccaccctgcaggctgtttgctctgctggcaggtcctcttgctgtgcagaaacatttgaacaccacgtgatcccagtcttgtgctactggagttctcctcaaagttcttgcccttatctctatcttgaagtattcctcatgttttcctttagctatttaggcgtttaccgttttaaatcacgttctttggttcgcactgaactgattttgctaaaggtaagagagatgaatctaagctgatttttccgcctgtggaaattcagacttgcaagcaccgtttatttaataggttatcttatttcaagcacattttggcaactttgtcaaaaattaggtggccacagccat

SEQ ID NO: 28197 - DNA, 1193 bp, Mus musculus
gcaggtctttctcagagtgtgcttttgtccttcgtagtgatagaacctagtggggaaacccccactcaattcccaatctggcgcgcacccaaagaatcacgaaaaggccttgatgtaattacaggaggtagtttaatgacggagctccggaccgacatgcatcccacacaggagataacgaatgttggccacgaggctcgaaagctaggggtttttatggggtaaggggtttaggggtgtggaattcagcatagcgacacactattggcttattcaaacatcagcagaaaaattacatgtatgtgcagggtgtcagagttctgtgagttgttgactcagttcagatagccctattatgtcttcacattcccctttatcttatggtcaagctgttcccaggaatgttttaactacggggcatacccaggtttgtttttcttttttctcagccccaggcagcctctaggctcacaaacaaccagcaatttatgagtatttaatatgacttacaggtcttgaaatttcatctttctttcagtagctgtcccggctgagttctgggccctcggctgtggtctatgccgtgctgtgtgtgtaatggtggctctttaatgtctatacatttccagaattctatcacctcctttactagatttgttcttttcattatttctatgagtgtgtgtcatttatttttctagcttttgaattctagttttctcaaactatgatctcataagatgcaagacatactattcttttttttttaacatttggtaagatgtaaaagattaaataggtggtggtacacacacctttaaacccagcacttgggaggcagaggcaggtggatctctgagttagaggtcagcttgggctacatagcaagaccatgtctcaaaaacaaccacaaacaagcagggggatttgatttgtggcctaggatggatgagttttagagaccatcctgtgggctgcagaggctgtatcctgctcctgttggaggaactcttccgtttgttctgtgcaacagtttatctctgaggtcactttgctgtttcttagtttggtcgacctctctggacatgagagtgggtactgaaatctctactattatcaaatcaggtcctgcctgaccttgtatgtctgatactgtttgttttttattaaattggaagccccagtgttggtgt

SEQ ID NO: 28198 - DNA, 1172 bp, Mus musculus
ctgtgactttgacctcaagccccctggtgaagaagggtcagctccaggccttgcagtttgagttgaactgcagttaagtcctctgatgctctagggccgtggggcacctagggcaaggcactcttagggatcccggagtacaagcagagctcatgttcagagtgctctcggggtgtggagcgtgatgacaggaggagacccctgctccagcttcagaggaaggcaaacactgagccgccagtcacatcccctcacctgctccccatacttctgcttatcaagcgcaggctgccatggggcggccgttcaggattacttgggaatggtcagaactacacatggccgccacttcaactgcgtttaaaagaacacgcatgtgttatgatgagttctcttataagatgattgtattgtctccctaaaggtagactcccccccttgggaatgattagaattggggctctgtctatgaaaagggtaaactgctgtctgctttgggatgggccgattgtttcccagagtccttgaagaagaattaatagattaattttctcctctgtgtcaaggctacagctacgagcgtgtggatggctccgtgagaggagaggagagacacctggccattaagaactttggaaaccagcccatttttgtttttctcctgagcacccgggcaggtaggtcacacaggtcttgatgagagcaggcaactgatgtggtaggacacctttgtatcccaaccattagtatactccccggcgtctctgaaaggtgaggccattactaaggggtaaaaaggagagaattgaggccgttgccatggttgatggaggggctggacttctagcatgggaccttatactcaagctgtggccccatcaaagagtgggactgaagcctgagtccatagaaatcattctatcctgctttgactcctgccctgggagtgtccagagagatttctatgggaagttgtatccacaggcatggatgcggatcttcttcccagctgtgactggggggtgagggcctctctgctagttcttttcctctaacagcagaagcttaaaatgcagttatagcaaaattgctagctacttagaattatcacaatgtcgatatatatatatatatatatatatatatgtacatatatatatatatataacttc

SEQ ID NO: 28199 - DNA, 1214 bp, Mus musculus
attcagtttgtagataggtttggaattagggaaaacttccgtatctttcatccctgaaagattttttttttatgtgcctacatttttctttaattaaaaaaaaaaagcttatccatccatgttaacaggctgttaaaggacctcaggcttttgacaaatggttcttaagcttttcttctctagtctaggcaattctacagtcttgggttaatatggccagccatgtgtacctcgctacccaagcacagctctagacacaagttcatgcagactcactggatgctcatgcaggctcactgggtgctcatgcgaggtttccctaccattaaagatgtgtgaggcaaggaactaccctcggtgttcataaccgtgcacagtattgctctttgcaccaaatattaacaaagtatttttttctttcgcctcttccctttaaatgtgtttgatgatggaatggggtcactgataaccactgactgagaagtattccaacctactcaggattgaaaggaaatattttttccagtatcttgacacttccattttacagataaatgtaagtcaatcattaggcactgtttctggttgagagccttcctgtctcctgagatgagccagccacattgaaagggacctgctggtcagttcacctacctcctggctctcccacatgagggtggcacagcaagtcctctgcacacctctgaggcctcttatcacaagggtgaataggaagatggggaggtttctgtcctgcagggagtacagatcgctcaatgccttggtacatgagtcctgggagatgccgcttcagccatcccaagccacctccctcagctgagactctgtggagaaccctcgtggtccagtcagctttctgaatagtgttccattttgaaagccaaggcctcatcttggtttttcatcaactctaaggcccttcagttatgtcgaaaggttttatttattttttctgtttttcctcagtgctgatttagaagtgggccacccaggaggattcaaaagccttgcttgtttcccagtaggattgttgtatctacacttcctgttaacagtctaagctgggatcatctgtgtttgtgcattaagttttgacccctcaaagttgtagctatggaagggtggggaaagctgtcttcagtctctcactcaggctgatgcttctctgacgggtgaggctgtggtgatagagg

SEQ ID NO: 28200 - DNA, 1202 bp, Mus musculus
caaggacctgagtctgaaccccaggatacgctcatgtcaaagctgaccacacaagcttctaatcgcaaggctggggagacaggcaggccggttactagggcttaaagcctggccagtaagactgactaaaactcagccatttaatattttcttctcaagacagcatctctctgtgtagctgtcctagaaatcactctgttcaccaggctgtcctagaactcagaaagtatgtgtgctaccatgcccaggttttgttgttgtttgtttgcttgtttttagtgtttttccacaagcatccctggtacccttgggggccaaaatgtgtcagagcccatggatctggagttacagttgtgatctgccgcgtgcatgctgagaatctagtcttctagaagatcagccaatactctcaactgtcactgttctctaccctagagtggtttctctgttgaggaagcagcagactttggagttttgctgccctctgctgggaatactcatggtctttgatgtgaaccagaacatctgagcacttgcgaccagaccctttccttatggtaaaaagccaaaggagtagatctgcggtgacttgatgttctgctgtgatgtgcagatttctgagagggcaaataaactaaaaagcgtctaaaaaaaaaaaagactaagagaacaactgaagaggttgtccagagtccggaggaaataggcaagaatgctcaggctacacagatctttttattaagtactaggatcaaagtcagaaccaagtggagatgaggggctatatcaccagtgctcagtatatcaagacagcgtctcaccatgtagccctaggctgggttagaattccaaatcttgcttttacctgcagtgctaggcatgggtctctgtgtcatgctacagtgctcttcttgaacatttgtaatagccaaggtgattcattgtgtacatacgaattgcttcaagtttgtaaagctcatcagccaggactgccttttaatcctcaaagagtccatgaatgggaagagattgtaattcccattcccccgtgtggaaactgaggcgcgtggtactatataactcacctaaggccctactgctggaatgctgagctagagctagaagtcatgccttttggctcacagttctgtctttttggttttttctaccagttcacctgctgcatttgttagaagcaacat

SEQ ID NO: 28201 - DNA, 1206 bp, Mus musculus
cttgttatgtgtcacccagccaggggcttatgtcagctggacatgagccctcccaggcaggagtccatgttcagcatctgaagcatcctgctttctgagttctttctcccgaaggtggaaagcttgatgctgaaggaggggagggtggaccacgtgagcctttctgaccgagcctgccagacctgacccttcgtttcttccccccattctccctctaagctctaagatatttctggagatcgacaaccgacagtgtgttcaagattcagaccagtgcttcaaaaacacagatgcggcagctgctctcctggcttctcatgccatccaagggaccctatcctaccctctagtgtctgttttcagtgagtggcattagtgctggagtggggctgggaagggccttcactggggctcacccttctggtaggaagaggttgctgtttctacatcactgtccctatgtctgaactctcaggtgaactggagagtccaagaaacgcccagcttctctatctgctcgcggtcgctgttgtcatcatcctgttcttcatcctgctgggggtcatcatggccaagcggaagcgcaagcatggcttcctctggctgccggaagggttcaccctccgccgagactctagcaatcacaagcgccgtgaacctgtgggacaggatgccgtggggctgaagtaagagggctttacaataagacacagttcacagggagaagcagagatgagcagatgggcatattactgaatcataatctcaaattctaaattcacctttagtcaccttgaccacagctcctaatggcttgtctaggtctttgagtatggccgcctctttctgtgcacacctgacgaagtgccgctcaatgtttgagtgggagaacactcaaaagacatggtcttttagtgagaagagaaagaatgagtgctcagaagtgtcacatctcacattgcccatcagagttggtgtggtggccctgtaggtgaaagtgcccccgccacgtctgctgacctgagtgtgatccccagtgcccataagctagaaggacggaagtgacttcctcatgttgtgctgtgagtgtgtaatataattagagggctggagggatacttcagtagtcaagaaaggaactgacctgggttcagtgcccagcacccatgctgggcagcttacagcccctgtgattccagctgccac

SEQ ID NO: 28202 - DNA, 1192 bp, Mus musculus
gttccttaatctcctaacggtgtgtgtgtgtgtgtgtgtgtgtgtgtgtgtgtgtgtgtgtgtgcgttgctgagaatcgaacccgtggccttactcagtctaattatgctcaactaggagttataaatacccagccaataaatggtctttaagaggaaagaagttactatgagatttaattccctcgtggagacagcgtatttctgtttatttccaatataaatcagcctgctggcataaatcgtgcgtgttaaagctcacccggggcaggtaagggcttcactgctggaagtgtagtctgtgtaggatttaaaaaaaaaaaaaaaaatgtgtgggaggctctgcccggggaggcggagtcagcagagtttaagcatttctgaccaatcaaaaggagactgttggcgcgaggagggggaggataaagggggagcgggagatcgagaaccctgcccagtcaccggagccagccctgcttgcagtttcctgaactaagtgcttctgcccacccacagcaactgattctaaggcctgactctagcaatggccttcgcaaatctgcgcaaagtactcatcagtgacagcctggacccctgctgccggaagatcctgcaagatggagggctgcaggtggtggagaagcagaacttgagcaaggaggagctgatagctgaactccaggtaaggcgagccggacacaagcgtaatcaccgggcatctttatggccaaacccgctgaccccagtggttccagggctgtcctcccctatcttatcagttggtcccggggcctccggagattcgggaccagcagtgggagggaggaaaagcagagaggaacgaatggcctggaggtgcagaatgcaaactttttgtgctttttgctaccgcgtgtttcttgccggcgctgcaaagtgcagctgctccatctggtcctgcgggatgccagaacctctctcgaatgccagaacctctctggagctttcgtgcctggcgacccaggctgcgagctcccggctcggggtgctacacgcacaccatccctgctcagtgcagactcctggggtgggggcagggggcgcggggcgctggctctgctcctgcgggtcccgtggcatttgtggcagcggactcgcaccgccttttgtctgatgcaagaccttggcgctctttcccccgccccggggagcgc

SEQ ID NO: 28203 - DNA, 1201 bp, Mus musculus
tgaagagagcaacagtatactcacatacataaaataaataaataaatggtaagttctgagagacagagagacagagaggagaggaagttagtttaccaggggctggagcatggctcagtgaccaatggcatgaagtttttttcccagcactcatgttgggcagcccacaactgcctgcaaatgccagcactaaggggtcagatatctctggctttagcatgcacctgtattcacataactaaaaattacacacttaaaataataacaatttgccatatggattgggtcacactattacaaggactgggagaaaacatagcatgctgtctttaacctggagactcaggacagcagcgtaatccagaccagacttaaaggctaacttgtcagtggtgcatagtcagttcaaggaattcagagccaagagactggacagggactcctgtgcaagtcccggagtctgggaaccataaactatgacattccaagatgggtcagctcaaggaaagaacaaactggcctttcccacatttttgaggcggccccttgatggattggttaggacctgctaacattgacaaggataagtcttcatttactgactcagtgtccaatcttttctagaaataccctcagacaacccccctgaaaaaaagtaaaattaaaaaagaaaaggtttcactagctatctgttacaccctgtcgcctcagaagctgagagcaaaggctgcatacagcctagtgtgcctcttcaccccttcccattgttgtttacaggcccagcaggttgtttttttcttgagacaggggctctacataacccaggctgtactggtctactgtgtagaccaggttagctttgaactgatagagctcctctgccttctggatgctgagattaatggagtgtaccaccatgctggcccaagaataaataaatgtgtgtgtgtgtgtgtgtgtgtgtgtgtgtgtgtgtgtagagttagaaatacaaacaactgacaactatggttgacttcaaaaggaaaattttattgttatttcctattagctctatagagaatggaaatgtaaaaatatttcaaatgataatgttatagcagtcaggcagcatggtgcctgtaactgtgcctcctgacaaatcccactgcacactaccttgtccaactagaccctctccacagtgagtaggttcatcttc

SEQ ID NO: 28204 - DNA, 1378 bp, Mus musculus
cccgtgatagagaaactaaaggaaacaactatttcaaaagtcagacaagtccaggtaagtgtctgttgtagacacgttaatgtaccgtatgctgggcaataccaaacagacttatatctgtagtcagggtaagctttctgttgtctgttgcagagatagggtttttataacactgacaacagaagcacttagtgagctaaggaaacaagacagtgcccactcagacgctgctacactgactaaagattacttttttgtattcttctccaggatgccattggcttcaatatggctggtctcgattatctcaagagagagtgtgaagcaaagagtgaagtgatgttttttgcagaagctactagtcacttggaagagaagaagaaaaaacgaaaaaacaggaaaaggatgattttaacactgacttagaactggaatgcagtgttttttcctgcttcttctcaaaggagcgtacacataaactgagctgttgtggagttggcaacataaaaataccaaaaaaagatcatgttgtagatcttggggtacagatgtcagccttggttgaagaaaccaacatggctgtgactactgtctttcatcttttgaaaaggacggatttagtttaaaaatctgcatttttcagagttggacctttaaattgtgtcaagaagcaaaataatattttttaattgtgtatttgattccgaagtgtctcatatttatggcagattatttgtattagagcttttctgtttaccgtgtgtgtcattgtcctctaaaggaagcgccatggactggggctgaaagggatgatggcctgctaagagctgcctgcttacaccagtgcaggttggtgagtctgcatgtaaggtcataatgctgtttgtacttttggaaatacaatagctttttcattaaaaccacttaaaatgacttgctggttccctgaatattaggggaggggtctggtatttatatatgtatgtctacatggtaggaatttgaaaagtagggatatctagaaaaaagtagattaactcagataactttggatctaggctttttttaagtgggaatttaccaattattaacttagactcccttgttatggtctaatgactaaactctagtcagattttttttgtttccttaagataacgaccagagagaaggccatactgagtttatcttcctaaatttctatctaatggaacctgtaaatgtgaccttgtttgcaaaagcatctaccgatttgaagtcatttgggatgaagatagtctctaaatgagttaatccttacaaggggtgacacaaagaaattcaaagtaagttgtactatgtgaacaaggcaaaggatgagtgatgcagctcctgtcag

SEQ ID NO: 28205 - DNA, 1099 bp, Mus musculus
ctggctctgacacgctccattggaacaggtgactgaggtctgctccacgctgcatgcacgccagccatttccaatgcacttttccatttattacaagcccctttctttggcacatgctgttaatttgtgttgttacctaatgttctcctattttttctctacacaggaaaatgggccttattttgcatcttatcctccatcaccagatttgtgacctgcgccttcccagtgcttctcggtcacaggattccatttaaccacaactcgccacctatcggagtgatgttcatttttgctgtacagatccagagagcttttgtccccacctctctggtatttttttattgactatatattttctggcacataaacaatctaaaactggtaggccattctgaactgcatacattttaaatttgtatatttgtatcaaatggaaatgctcatttttagagcattaatagaaactggggatcaacttttgagtgtctccagtttcctaaaggacactggactctgtcacacaggccaccaacgttgctcacatcatctcttacagtgcacgcttccggactctgttacataggccgccaccattgttcatagcatctcttaaacagtgcacgctctctctgtgtatttaagtgtttctcaaaatatatagaaccaatgtatgctaaacggatgcattgttccctcagatcctggctttaataccatttacattttatacagacgatctgattataatatagaattgcccatgaccaagaatattgaaatgtgtatgatcaaaactgtaaaaaccttcaacaacatagaattggcagattgttggcccaagctacagctgagctgtgcgtgcttcttgggttgtctactttgttcctattgacactgctctgatctcagtgtggagagcatgagactgtaccttcaactgtcttctttaatcatgtgactcgtgactcgtctctttaccaaaagaatgtttgtgctcccagcactcctaagtaaagaccatttcccaggactccatccctgaccacattgctgtcttctcagagtcatcaatgattgtgttggttcagtatcactt

SEQ ID NO: 28206 - DNA, 1398 bp, Mus musculus
atattggtgttagctctttttagaaagtctgatagaattctgagctaaaaccatctgaccctgagtttttctttcttttttgggggggagggggagtggagacttaatgactgcttctatttccttaggacttataggactatttaatgactttatctggatttaactctggtaagaggtatttatcaagaaaatcatccggcaccacggtcctctacccctgcgtggtgtatgaccgtgggcccgagagcgctcttgaataaaaatcctcttgcaatttgcagcaagaacgtttctcgttggtgattttggggtgttgcctctcctgagtcagaacgtgggggagtcctcacgttgtgggtctttcatttggtgcgttggccgggaaacgcgaccacccctcacacccgagaaccgacttggaggtttggggatcccctcttgtgtgcgtgtgtgccggccagtgtctctgttttgagtgtctgttttctgaaacgaacgttggaacatgtgcttgttgtgttgggttgtttgtgtcttgtcctatgtttctgaagcatggcaaagtctgagtttggatccatctgagtttattgagtttgtgtcttggtttcagggtttcaagatcatgggtttgagtcccatctcgtgctttggtttcagggttacgagatcgtgggttcaagtcccaccttgtgccttggttttacaccttgcagagtgaggaataagtgtgcttctctggttttggtcgtctaggtagaagtggacgatggtgtttgtagacgatggggtgatggggttttctgaaatgcgcgcgtctgtatttgcagctgtccttttgggccgtaaggaccggaggactgtggtcggcagacgtgctaggaggaccacaggctgtggccctgggggacgccctgggaggtaaggagagccagggacgcctggccgtctccggatcggtcagagggaccgagttctgttgaagcggaagcttccccctccaacatagtctaattcttttgcctgcttgtggaggacaagaaagggtcgagtgtgtctggatctgttggtttctgttttatgtgtttttgtgtatgtgtttagagctatgtgaaaatctagaaaagcaaaggtaattctcataggtgctttataccctgattagagatagtttacacctgagatgtgagagaatgggttttgagaaaagcagtactctccgactatctggggataatttggtaaaataaaataaaataaacaatatcaattggtctttggagccctgcacctgtagtaaggaatctagtgtggctggagaagccctgctaggagctaattataaacgctgctcttatagggaccagcagcttctcaagttctatggtaagggaa

SEQ ID NO: 28207 - DNA, 1353 bp, Mus musculus
agaattctgttagaggctagaaaaatagcccggaagccaacggtggtctacacagctacaaaatgagatcgacatgagattccctttgactcaccccagttggaactgcaacgtggctaaaggtagggagagcttaaacatctatcgccaggctccggtctccaaggtgcctcaaaatgggcccactaatttggctaaggtaagaggtaatgcaggggccaattgaacctccctcaatgttccttgaaaggcttataaaagcctcaggtggttcactccctttgatcttacctcggaagcccagaaggcctcagtggccatggcctttcataaggcagtcagctcccgatattagaaagaaacttcagagattagaaggtgtattacaagaaggagacagttatgcgatctggtaaaagaggcagagaaagtgtgtgtgtgtgaaagagagaggcgggaggcaaaagaaagagaaaacgggagagatcatagacaagaaaaaaagttgccacagtggtaggagaaaaagaaaagacaggatctagacaggaaacctgggcaaccaaagactgagcctcagctaaagaggctcagctgtgtcagacagaagttacttatttgggatacacccttcgaggtggaaagcagtggctaaaagaagccagaaaaagactgtaactcagatccccaccccaactacaccaaggcaataagaaaattcttgggcaacgccagcttctacagactctagatacctgggttgacgaccttagctgcccagttgtaccccctaaccaaggaaggggaggtgtttgtgtggaccccagatcaccagaaagtctctatgtaaaagagagagcaggtgtcaccagaaaagtcctttctcagactttgggactttgaaaaaggccagtggcttacctatccaagaagttacacccttttgccagcgggtggttttcttgcctgaaagctattgctgccataatctgcttgtcaaggatgctgataagctcactctgggacagcaaataactgtagtggcatcccacactcttaaaagcattacaaacgctcctgtgacacatcagagctttttgttgattggatagctctcctaccctttgtgctcttcagggatagaaacacccctggacagtttagactgacccccctataaattactctacagggggccccctccactggtaaaaatagcctttgtacatggtgctgacatgctgctttcccagcctttgttctctaggctcaaggtgctccagtgagtgagacagcgagcaaaaagcagctccagaaggcctactcaagagaagaagacctgctacattagac

SEQ ID NO: 28208 - DNA, 2422 bp, Mus musculus
gagtctatgtttttaagtttctccaagatattatccatccaaagaattactagaatagcttcggaataattttcagtggcaaatgtgtgacgtaaagaatcatactcactaaaattggcatgaacctaagggacttacagacctgcactggttatttttgttgttgatactgctctatattttggcagaaaaaagggtaaatttttatcaagaactatagttcttattataatataagataaatagtaatgctataaattttctgtcccttgaatttctgtgataattcaagacactttctctcttttatttcatacatacatcatctattgatgacaataaatttgagaacgctataatattttatgaaacactttgcttatgaattctactgtggatttctgaaaacttatttccttggttggtagcttttctttttagccccgtactagcttattactagcagatttaaactgtggaaaaaatataattggacatgttataagttgactgagcatcttccagtgaaaaccattatctgatcctcagattgagccagtactccaaaaacttgccacctcaaacttgttcagtattgataaaagacaacatggagagagtgagctctagcacatgtcaaaactgtatcttttcctacttgaaatttttaaactgtaaatgagaatggtagatggctattactttagaaaaaaagatgaggttttggttctcagagaaaaagaaagtgagccttcctcatacagcacaagcccactcccaagtcaaaggaaagtgaggagctgaaggtgccaaagaccagtgcagcaagcaggggaacctctgttacactcatgcagtaaaggcgccatcttggttccctgggaatgctccaaggagacaagagtccccccacctacccagtgctctgcattgtccacgtgatcctagagcagtagagagaaggcccaggtgtgagcaggacatgttcacacaaagatcttaagactgtcacttgactgtcctcaccctcctgataagaactagagcttgtaacaatgctttttcctctttgaataccaaaggcgattaaagtcaggtacaaacgactgccagtgtcatgtttgattttgttaatagaatttttaaaataattttttccaaaatctaccattatcccatattttgcttactttttgtgtgttttcctccatcgttcatatacttggtgtttgtaaaccttagtactttagactccatatcattgtgtttataaaccctgaagataacccagaaatgctcattaactgatgtctctccaaaaagctggtacctcaccttcagctttgggcagagtcgtgcagattaaataatacataaaagtagggactattgaacaccttctaattccagatttattgctcattttagaatcacaccttttggttcaaacctgagttttagaaactaatgaaccaatatgaagctcgtaaaactaagaatgagcccttcaccaagaagtctcactgcagaacagcaagttccgaggtgaaggtctttcttcaggtgggctgcacattttgtgcgcctctaacaccagcctgtcggtgtcgtccagctggggtatgtgcgcaggaaagcctgggtgttagaggaacgcattctttttgcagaatattgactacctgattccctatgatgtcatctcgggcgccacggcttcccttggcaggttttaaacaagcagtctgaggtcacgatcctcagcttctcctcctttttgctcttcattaccaaagtgtttgtcagcactctgaatttgtcggtaaagactgacaatgagtctcccttcaggctggagttctctgagcgagtgcattcgtgagagaatgagggaacaaacaggtacagagcatgtcatacgcgtcacgctccgcctggcaccaccccggccttacagcatgtcacatgattccagtggcatcttctgtatgagagtgttccatagcattttaaatattccccaaaatgaatcatgtttcaaaattcttaattttatatttcatttaaattaaaaagggagataaaaggtttataatatattttaaacactgttactatataatactaacaacaaaaattgtagttaataactaaagactcttgaaaaatgtcaaagaaatatttgatttctgttgcatctttgactaaaatatttacttcagaaataaaatcatttgtattttgttattactttaattacatgattaagatcaatactttgtagaagtctgtgttactttatatctaaaagaaaaattgtcccttaattcatgggtacactgtgcagttgtaaattgttttttctcgagtatacttcctaataacggtggcatctgtatttctcgcatatagagaaaacata

SEQ ID NO: 28209 - DNA, 1203 bp, Mus musculus
aaatgattgctcaccccttgactatggcaatctgtttacatttaacttctctctaatttaaaattttactcataaactaattttatataatattctattatcaatcagttatcaaaaactatgaatgatagtatgtgtactttttttaaacaatgtctgtaaattacgaagtgatgtgtcttctgctgttcttacagccttcactgtttcataggctttgcacaggtatgtgaatttttttaagaaatttattcatcaggtctagctctgcatcttcatcggaactgctcagaatcaattactggttttctctgcagtccccagtgagcccacttggtttcctgcggcattgactcgtgttttgtccttttcttttcagatacttgtacctgctgttctctggcgatgaccttctacctttagaccactgggtgtttaacacagaggcgcaccctctgccggtgttgcgcttagccaacagcactctttcaggtaatcctgctgtccgatgagcacagccccagaaggaccattcttacctgtgttttgtttacatggaccactacagagactgtctgcagaggagaggcggctgtgggaaactgggactcttatgtcagtatgccggatgaaactcttccctgcaagacttttcacttgtacatatatcaactttgaaattattccattttatacctgaccaaaacaagttctggtacatgtaggacagagacctgatgtgttttgattcttactgagatggccacatgagaaacaatgtcttattctatactgtcagtgcaagtcaagaccatagagcaccttacaggagctagagatggctttttgaaccagttatacatttgttttctcccacagtggagcagctctcaaatcaaatataacacattgtgtagcccctttcctccattttaacaatggaacaaaccgaatgagcaggaaccgaggaacatgtaactacattgtagcaagaagacttgggaaagaaacaaacagatactggccctgtctgaattttccagctcctcattggatttttaccagactggcaaccatttcattcccaacctaggcattgaaatctgtttagattgagtttttctctgaggggcatgatctcatgaagaatatttttcaagtcgttgtctccatataatatgctgaacctggtatttatcataa

SEQ ID NO: 28210 - DNA, 1164 bp, Mus musculus
acgcccggcgccgctgcttggaagccgcggaggctgcggagcggtggagcggaggaggctccggaggggaccgagtggaaccgacctactgcaactcgtcgtcttcgccgggcgcctcccggggcgggcagccgcctctgagcatcgcgccggggcgcgggcatggcagaacccaccttgcagcttctctgcggtgtggctcgcccgatccactctcgggaatgaagaggagactcgcgatcatccggtgaggcaccgagagccaaatggcgagaagatctgacgggacagaaaccaacgatcgcttgggaggtcacccgggcttctggatgtaatcggagagcgtgaaagaggtggcctcgtaaataataataataataaaaaagcacaacaatcctttgagaggagggaaattgagtttattctttttttttttttggccgaggttttgagaaacggttcgatgtgttgtacgtttgatataagatgagaactttataaagtattccgtccaagagcctaaacgatgactaccccagcgctgctgcccctctctggtcgtaggataccacctttgaacctggggccgccctccttcccacatcacagggctaccttgagactctccgagaagtttatccttctcctcatccttagtgccttcatcaccctgtgttttggggcattcttcttccttccagactcttcaaaacacaaacgctttgatctgggcttagaagatgtgttaattcctcacgtagatgccggcaaaggagctaaaaaccccggcgtcttcctgatccatggacccgacgaacacagacacaggttcgtttgttacttaaattatggtacttccttttgggagagcaaggtacagttcactgctttcttgtctctcccccctccccctcctgcccctgtgaatgatcagggtgttgaacgttgttggttcagagctgcctgggtagaaccatacatagactggaaggactcctagggttccttggtttttcccggcagaacgaagtgttcagtcagactcttctgctgtggacagcagggagcggagatacagggagtcagcatgcgcgtattgagaacgtgtttctgcctttctgccaccatgtgaagtcactgaatcttgacagcttgctagacttt

SEQ ID NO: 28211 - DNA, 1748 bp, Mus musculus
cgttattatttgctcttaggtttgtctgtgaggggacagtggaagagaagatcttacagctccaagaaaaaaagaaagatttggcaaaacaggtcctttctggatccgaaggacctgtcaccaagctcacactggctgacctcaagatcctctttggcatctagcttcgtctgctggagtgatgctctttccatgatcctggagtcttagatttcatcctactcgaagtgaggcttgttcctatgctaggaattgaggatgggttaccaggttaacaaaccagttagtcagtcagcttgtgtaatgtgggccatagaaacccattggttatttcagaattaagcctggcatgttagtgcatgcctgtaatccagcaagaagatggagaggtccactttggcctgttgtagactctttctcaaaacaaaccacaaagtgctctggaaggcagccatgtagtccatacttcccagcacctgaaaggctgagtggggattgtgagttagaggccagtttatgccacagagtacatttcaggccagcctgggctacagaatgagaccgtgtcttagaaaaacaaagtaaaaccagtgaagctttggcgttggatggcctggaagctgagtctggaagaactgtgtaagtgctgggtgtgatgctcagggagccattacaagcatagtgacacatgcttagaatgctggcactttgtaggcaaaggcaagaggatctcgagtctaaggttagcctgggtaacagtgagttctttagcagccttaattacatgggaagaccctgtctgtcaaacagcctcaaagccctgtgctgccatgtttgggactgatggcggacctggtcttattaccttgcctatgtaggctctgtcctgtttccctgctggcaggctgcgtcttgtaagcctctttgtaaccaaccatccctatgaggctggctgaatctaggcaggtttagggtcaagatatttcatatatcttgagttgagtattaatcatggtatcatctagcatctctcatttagcctgtgcatcatggtttcatttagggatatatcaacatcagtgtgactgtgtcactcagtttcatcactgtatcatttgatatcacagtatttcatatagtatttgtcttatttaatgtttatgtccatttcagttgccagtggcatttaatctgttgtgtcacttagtttctgccattgtaccacattgtgttatcattggtatggtcttaataaacgccttcggccgtgcacagaggtgatgctgtgtgttcaccaaaccccacctcctttccctcagagcaccagagagcacctgctgtgggtaaggtctgcattactgagttctagctgctgggccacgcagaggagtgacgtacggagacagaatgccctgagcagctctcccaatgcttcttcttgctatttctgtgaacctgctggaggtacaaactgaaaagatgttgtggccttaggaagggtaaataccactagatcagggattctcgtctttcttttaaaaatgattgagaatttcatatcatatcctccaccattgcttttccatcccaatttaatgaactctttttaaacccagtgtctacacaatgctgactgtacacagggccatgcactggaacactggcagcctgtcagaggtcgcatccctgaggaagtgaccatcttttaccatatggcgtgggaaatcataaggccctctccatccatg

SEQ ID NO: 28212 - DNA, 2864 bp, Mus musculus
caccgcactaatgctcccactttctgtcttctgcccagtgctgaacgccttcaagtacccgctgctgatcggcgtgggcctgtccacagtcatcgggctcctgtcctgcctcatcggatactgcagttcccattggtgctgtaagaaggaggttcgggagacgcgtcgggagcgccgcaggctcatgtccatggagatggattaagcagttggagatggagggacagaggaacattgtaggagcggtgggggtgagaagaggactctgatatttttacaaccgagtgtgttacactaaaaccagtcctctctaatctcaggtgggactcggcgctctctcttttctgcatgtcaagttctgagcgaggacatgtttaccagcacacagctcttcttcccacggcactttctgatatgtaacaatcgagtgtgtgtttcccccagctgcagctttttaatggttaaccccccaccccaccccccacccccgtctaattagttttctcctagcggcttatcgatcctctgatttgtgtgtgttgctcacttttgatttagggatctcggtgaggtagggcgaaggcattcagagttggtcattgtgggtaagagggtaccggcccacccgaaagccagcatccacgagcagccagcatcgggagagctgctacctgctgccctccaccctggctcagagctgatatagacctgtgccaaggcaagctgtggctttgactgccctgcccatcccccattgtcaggggtttaaaactctataacttcttggcccgtaagccttttgtttcccctccttctctaccctcttccgttttccgggtttgtttctgtgagtgaggatacggcagccctggagtctagaattcggctttccaccaagcaccttatctcgccaccttagccttaagaatgagtatgaaaaaaatccagcaccacctctgtccagggcagaaggtctgggaggaggaggaggaggaggacacgggggggggggggggggggaggaggggggcgggggggggggaggaactgatgctcgcccacccacgtgctcgctctggtagttcttaggccactgtgctccaggaaccccagggtgagtgggagcagagggcagccgtgccgccgagccaggtgccctgtcccttcatgagaggcactgtccctggtgccacaggaccgccatgggagccacaaaagtgccacattgagcttcttcacaggaaggcaggttgctgcctgcaagactgacggacttcaaggaatcagaaattgcctagagcaagcgtgtgttctccatgaccttttcagtccttgaagtctttctaagctccccgcagggggtagtgaagaggggtatactttgtgaacgtttgctttcctattagaaacatgaagggaacccagctatttagtgttatgtgaatggcctgtaaaatagggttgagagcagctgcctctgcctggctgggcccagcaggaacgggacagcgggcaggcacatcttccaggtcaccagtgcctgctccatcagggcctcagccacacagattctctcacctcagcatagccttcctgagcctcccctgagtactgaggctcaccacccagctggtaccctcgccctgccttctgcctctgaaggatttaacattgttgtcttccaaggggggacggggagaagagtcctttctcttaagcaataaagtaatccgaaaacatggccatcacgtgcagctctagtcaacacggaccaggatgcgctgagcccccacccccacccccgccttctctccatgtggcccacggtggcttttgtattttccacccaatttcctctgcttgttttgagcccaccttgggggctgctcgtgtaatgagattttgagaaggtagctctagcccaggtggggtccaggtttagagtcagtagcagatgcaccccacacaagcaagagaggccagagaaaggggaggcttggcagacacggttggtctacatgtcgctttcttgttgctagctcagacgtgaggcacaggtgactgtacaaacaggaattaggggagagaaccaggtgttaggagcagccttcgagcctgtgccattactgaagaagattcagggtcttggcagtacagccctccttaggaggatgagagagacttagcctggggtgagatgagccctagatgtacataaagccacagtggtccacgtgggtactggatgatgagatgagtgatcggacctacctttccctttcgtctgatgttgagatttgaacctgagttgtggaggccatgcccaaacccccatgttgcttagggttgggagaggggccagaaacctcaggacctagttccttttgggaatcttaccatgctggggtgtgtgtcttgttaagtgtggtcaaacactcttgatgtaccaaatagtgctccccatgaagcgctcttcctgaggcccccaccctgcaacactgctctgggggagggagaggccgagccaggccttggcacatgaaattgcacttcttaaagagaaaactttatagaaggttgggtatttttcctaatcacaaaaatctcccgctgaaagaacctaagctacattcagattgaagcctcgaaaattactttaaattgtttactttacgatgtttacacacacggctcacttttttagaaaaataagaaaactgcaaactctggctttttaacaacttttcagattttttcatgcatgggatatgctggcccctgactcaccagctggattaatcctcatttagaaatgtcccgagatgtggatatgtgtgtcttccccctcccagccacatgcccag

SEQ ID NO: 28213 - DNA, 1151 bp, Mus musculus
gagcagaaggcccttggcttccccctacctcccaaatcttaggtgaagttctgtcctgtccaacactagcccagagttacagggggaggatgattcgggagagtagtctgtgcttagctaagttgacacactctaagccccacagtttcacaatgcagcattaaagatttatggcttcagcctgccacagtctctcagaggccccagaactggaagcacactgtcaggttgagttcagttagctaacggtctagtgtgtgtgttcgttgtgacctgagagtctgttccttggtggtagaggctctccatctctgacagtcctccgtgccatcattgtctgtgatgcaggaggtaatggttagtcgaggcagagaaagcattggctggaaagaacccgttagttctcactcaggtggattcaagcctcctttctcccttgtgacccaaggaacctcgtgtgaaggctaagggatttctggatataaatggctacagaggactgcaggcctgggaactatcacacaagaactatctattgagagaatcaggtttcactctctggaccacccttcttcaccctgtgacctgttagttacaccatcccttcagctacctggtggatatttcaacctgtctggacctcactggctgttcttaacctgtgggtctcgatccctttgggggttttgtatcaaatatcccacatatcagatatttacattatgatcagaacagtagcaaaattatggttatgaaatgacaacagaataattttatggttggggtcaccacaacgtgaagcactgtgttaaagggtcacagcgttaagaaggttggagactactgccctactgtgtcctttggaaaatggttttcgctggctattagcttcccaactccttcaacacagctgccacctccagctctgactctcatttcccttccctgttgttcagtagaggagaggaccccggggtatcccttggcttccacatgtgctctgggtacccactctgtggtggggatcattgttgaagccactcaccttctgtgtttgtgttcagccgcccgttacctcaccatttctcaaagatgcagttggcatagtgaccctgcataaagcctccttcaccccgtggaagggagtgctt

SEQ ID NO: 28214 - DNA, 1166 bp, Mus musculus
atgctggaggtgggagctggaaagatgcgggcctggacttggggtcaatgggaagacccaagtttccatttacctccaatggtcacgtgctattgttcaagatactattcgaggccttctctgccggctaccccaccatcaccaccagctcagctctcttttgctgtcaggctagctccgctgtccccagccatcaccatgatcatctacagggatcttatcagccatggtcattagaacagagggtgccattgatgactcactcattgatggaaatgcttccgccaaaggcccggagggtgaaggtacccaaagcactgttgtcaccagtgttgacattgtcatgagccatcatcacttataagaaaccagcttcacaaaagaggcccataaaaagtacatcaaagactacatgaaatcactcaaaggcaaacttcaagaacaggaaccggaaagagtcgagctttttatgactggagctgtggagcaaattaagcacattcaggctaatttcagtagctatcagttttttattagtgaaagcatgaatccatatggtatggttgttctcctggactaccgtggagatggtgtgactccattcatgattttctttaaagatggcttagagatggaaaaatgttaacaaattggatctatcgctgtcaccgtaattggctgctgcttaccatccatacaacaccaggacttaggacaaatgggactgatgtcatcttgagcttttattttgaccatgatttatttggagcggaggcattgttttttaagggaaaaaaaatgtcatgtgggttgtctaaaaaaaaaatgcattcaaattaaaaaaataaataaagaaaagaaactatttgagatatggctaacaggaacttagtggctattacagatattcctagcagctgctcggaaatactgccttgaacttctgtgacctttgcacaggtgacctttgctgagtgtggtcctagctaggctccaggcttcactgcttgctccatctctcctgcaccctagtttgcccaaaatgtaaactttccttctccaagctgttcttaaaacatttcctcagtggttcacaacctcttatatctgataacctgcatatcagatgtctatattacaattcgtaacagtagtgaaattcagtt

SEQ ID NO: 28215 - DNA, 1193 bp, Mus musculus
tgcctgatttgtgtgatttgtgagaaacctctccatggtcgacatgcatggaattctctctttaggagaacttaaaaataggtcaggtcagccccgatggattggacaggttaaggtgtgagtttcctctgtgggagagagcccagctgggtattttcagggtctcccattagcctgtgatcctaagattccacttatgggcactttctatgtctgtcatttttaaagctggttaacttggtggcttcattatttcccatcccctcccaattccccacgggggctctaactaaatcagaccacatttggagtctgtgtttctctctgggcagcacatttcaaagggccattggcctgttccaccttcagagagcagagccaagacaaatgggtggaagtcgctcagagacacattttgactccatataagaaagcctcgtcccgaggacgggaggaggtagtgggtgctccgggaacaccaggggaaatgatgtctcaaaggctcatgtaggtttctttaaaacctcgctaatgtccagactcaagtactagatctatggagcccaacagaaactgtccactgttcggaggcgccttctccgccatcctccctacaggggccattgatgtgagtgacctccgaccggtgccagacaaccaagaagttttctgccatcctgtgaccgaccagagtctgatcatagaacttctggagctgcaggcccacgtgcagggcgaagcggctgcgcggtaccattttgaggacgttggccgggtgcagggggctagggctgtgcacgtgctatctgtgcagcctctctgtttggagaacttatccctgagaggatgctgtcaggatgcctggtccctttctggcaagcagcaggtagctaaagaaaaccagcaggtagcaaaggatgtcacactgcatcaggccttgctgcggctgccccggtgtcacagcaggtctcttggccctgaaaatctgtcatgtccaccttggagcctgagtaactttgaacagctggtaactagtttgactcttcatgatcccaacctctttggtccccagtaaagatcgttgagacacaacgtgctactgaggactcggggacccagttctgagagggggagtttctttctgcttcttccctggatgtaaacataagacacttcctctgcagaaataaact

SEQ ID NO: 28216 - DNA, 1120 bp, Mus musculus
ctctgcagtttctctgcaggagccagtcagacctggaacttgttggaagcttccggtcgaggtgatggttgcctctgggcggcagccctggttagctgatcacacccaggtgtcatgatgccaacatcctaggttcctagtttttggttttggtaacttagtgcgtagctccaggtgccgcatctactcgccaatctaactcatgttctcagatcggtgctatggggtttcctgtgctgtgtaatgtactcttttaagccccttgggtcctctccttttggatcccataatgttgtggaagagtttctctcacaactgataagcaagaggaagacgccttcatagtaacaaggattctcttccaagacatttttgtttttgcacatttgaaaatgccacccgtggatcaaaatatacccaaacattttttctttttttttctttttttttttttttttttttttactttcttagcaagacttgaaaaatatgtgtagcgtgggcccaatttgtatcttatctcttccttcagccggagttgttggaaccactttatagtcaagatgaaagcattgaatttcgcttcaaaggactgactgcacatgtgcagaagaaaccctgcaggaccctattaggagcagatggtggccagccaaccagtccgtcagggaggcaaaaaggctcagtcccatcattgccaaaaaagaaaaaaaaaaaaataataataaacgagccaacctgaaggaagggtcaagggctccaggcggcacccagtttctgagggttgccctgatcaaaggcaatgactggggatgagggggggacgggtggttgttggcttggctttggcaagcttggtctcttgacttacccctgggcaggtagctttcttctgtaggtgctttgccaaattttcaaggggacatgtctagtgaagcctgaaggggctgccctgagtggagggagcattatggccaaagtggcccctgtgcacaggcccagtggagtgtgctgagctgctacactgagcttagcagagtggagcgtgggagggcgtcttagagcctggttgagaggttggaggagtgcttccctctgtcttccttccagtgagcctttc

SEQ ID NO: 28217 - DNA, 1071 bp, Mus musculus
ggctgggtctatggacatgtgttgtcggataaatggtgatggcgccctcaagtggctagaaggcttcactgcatattgtctgttgaggcttttgtcctccgagatcagagtactcaagagagactcctgacatctgtcctctccagtgtcacatttatgagcatctccactgtgctaggcctgtcccaggacactatatgaccacaccctctctcatcggtgtgtttctgtagcaagtcttcatatttgtttccaacaatggtgtctctgcgttcatgttgaagacagagatggggtaagaagactatccgtgcatgaagtagagaactgttggtttgtttctttttttttttttaaaggagaagctatttgtaagccactgcacaaagacgttttatatacactgcagagacctgtagtaaattatgttgacaatacgctgtttacattttctggagtctgatggcctcctacccctcactgaagcagccacctcctgctgtgggactgtgctcagtgggtggcctggagttttgctcttggcactgatgtaccagattcaagttttacacgctgtagcttttctatgcatgccctcacccaacctaaattatgtttttttgtataaatgataaaaaaaaactttctcaagacacttttgccacatgctgaaatgtatcacaactctacacctaccagttaagagtgcagccctggagctgtgacacaggtgccccccgggcctgctaggcagactgggaagctggctttgctatgggttatgtgactagttttcctttggtgggaaatttggggtaagaagacaccagtgagaatagccttccagctcacagggcctctgctgccgagacccaactgcccttcccaagccccgctaatgctcatgaatggaagtggacaacaggcatgagaataggagatggacagtccaggtggtgagacttggacaccagttactactgtgggtgattgacagatgccaactgagaaacattggaatattgcaagccctagaggtgaccacacttagttgggtctttggagttcata

SEQ ID NO: 28218 - DNA, 1195 bp, Mus musculus
tgcttcaggccagggcatttctggaccaccaccaccatatcctaagatccctccctggcggcattgtggatacagacaggccaacatcatctttcaaaactctgccattgccttgtagtattagttacttctcttgctgcaaacaccttaaggaagggtttattttggtttgcagtttaaggatacacagtccgccatggtagggaaagcctggcagcaagagctttaggtagctggtaacattgtatctacaatgtaacctcaaaccagggagcagagggatgaatactaatctggtcactttctcctttttatttactctgggcccccaggtcatcccatagttaggatgggtcttctcatctcagacaccctaatctagaagctccctcatagacatgctcagataattgtctcctaagtgaccccagatcctgtcaagttgacaatcgatacgagttatcacacttgctgaaagccctcatggttccctgtatctccaggaactggcttaaaattgagtttactattagagtctaaaaggactctaaggatgtttgaaactggaatctctgatgcgggtcctatgatcttgaggtgactgaccgatagttaaccattgtcaacttgacttggcattacctaggaaatgtctgcagaaatgagtcattgatgagtttctagagaggcttaactggggatggaagccctatcctgagagtgagccacaccattccatagactagggtcctggaccaaataaaaaggcaaattggagagagaaggcacaggcaccaacattcatctctccctgcttcctgactacagatgcaatgtggcctcatggccttgctgccacaccctcctgccatcaccaagtgtttcccctttcaaaccacctcccaaaacaaatccttcccccattaagttgcttcttttcaagcatctggccacagcaaacaaacaaacaaaaacccaagtaactaataacaaataaacaagtaaccggtacccggccagatgtcctctgatctcatcctgtgtaaacaccaaggccaagaaggagggagcatcaagtcggcctgagctcaccatctttctcttatttgagaaagggtctcactatgtagggctggtcctgaatgcattgagatctacctgcttacatcccaagtgatttacatcccaatgagta

SEQ ID NO: 28219 - DNA, 1144 bp, Mus musculus
ttccatgtgtgtctgacttagtgctgatttcatttgcagacctacatggtggttctgtgccttcccctactcccttctcatctttgtgtatgacgaggtgcggaagctcattatcaggcggcgccctggcggtaagtgggacaggcagggctggacttcctcccgtcaggtcacaggtacgcggccacggacacaactgtgctaaggtagaaacacaccgtggtttttaagaccttaaaaagtgcaaggcaaatgtagagaaagccttaacataaacctaataataataatattcttagagagagctaattagctacatctgaggtctcagatacacatatgcatacatgcgagcgtgtatacacacacacacacacacacacacgattatccttagcgagtccctgtcctggtttttcccaaaagaggactcactacctatggctctctctctctctctctcaggctgggtggagaaggaaacctactactagcccactgccctgcacgccgtggaacattgtgccacacactgcacccacccctaccccctctttgtgtacttcaagtcttggagctcggaactctaccctggtaggaaagcaccaaagcatgtggggatgcagacgtcctggaatgaagcatgtagctgtaacggggggcggggcgggggggagggctgcctgagaaacaccgtgtacggggacgacagcgggcaaggtttatacgtgcctttttgtttttgtaaaaaaggaaaacctggaaagactgaaagattacgttttatatctggatttttacaaataaagatggctattataacggaatttgcttttgagtccttgtcgtttcttgtggcagaggttgaatgtgacaagctgtgcggtgtttccaggtggatcccaggccgtcagctctgaagcatctcctgggccttgttaggaaaggcagcccagccctgacaaggctgtcagctgcgttaataagctccccaggtgactgacacccacatctgagagccaggggccaagaggaaactgttcccattcttctggtccacgagctcccctgacccactttcctggacagtgccctggttcccgcagccaccgccccacctgttccttggctctgggcttctttg

SEQ ID NO: 28220 - DNA, 2103 bp, Mus musculus
cggtactgaaggccaagtctggggtgtcttatgtcttagaatgatagaaccctatgacacagttacagcaggatatctgttctgtgttcattgtcaaagaagctcctaagaatgtccgccctggtgctcagtaacagtgactagataggaagagacggcttcagtttcccagataaggtacttagatattcatcacactgcagcccagtggtgtggtgctaagagctaatgttgtcagctcagtgtcccccacattgagtactctgtcccttggtaactctttctggagaagtctgtcttccagccactcttgttctttccctgactctgtcttactcgtacactttcacatttaacatgcaacccaagatgttgaagggctgcagtgacccccactgtctaaggcacggggaacctaacaggtgtgtgctctccttcgtaggtttctgccacctcctcctgcctgacgaacagtttcccgaaggcttccagtttgacactgacgatgtcaatttccccgtggataacctctgcttcgtgggtcttatctccatgattgaccctccccgagctgctgtccccgatgctgtgggcaaatgccgcagcgctgggattaaggtagggcctctgtgtctcctgactccatcacagagccgtgggtcctgttctcaacagtgccccaggtctaggcagcttctctctctctctctctcagatactcttaaaaggttgggtaaagagcagatgtgcagttggaggcaaggaagcaccttacttagtctttgataaaagaaacacaaatgacaagaaaaagacaaaaagattgaggtttaaatttggaaatgcagtgaatggcgcattccccgtgttgtgagctgacttctcgttgattcggtctctgtctttttctgaggggctcaatactgtgctgctgcatttacgccctcttccgctgtcctcacgcttacgagaatgcctctctgagaagctgatagtaggacgttgtatttctaaacatgggctggggacacggcttagtggttaagtgacctgaattcgcaccacctcatgcagctcacaaccatccatgactcgggctcctgggagtctgatacctccaaggactcctgcacttggtgcactgtccccctaccccttgacacaaactcatacacacataatcaaaataaaatctatagttgttgtccttcagaaccgggcaagtgtgaaagtgctaaccagcaatatacatgtcatgatatatagtccaaccaatattaggctttctttcttcttttaatggttttagtagaatttgatttttatgtttctgtaagtatgatatatgcagtatggatgtggtcatgtgtcataaaatcttggtgttgggatgtgtttccgtaaaaccgtgtttatatttttcataagttgatacatgtcattcaacttcctgtttcaggtcatcatggttacaggagaccatccaatcacagcgaaagccattgccaagggggtaggcattatctcagaaggcaatgagactgtggaagacattgctgcccgcctcaacattccagtgaaccaggtgaaccccaggtacgacagacagaaagcttaagtatgggccctccttggctctgggccgattgtgtctcggcttgcaccaagggagtagtgagtgcacctgcactactagggaggagtcacacatccatggtgctcgatgtaatggtgtaagaggctgggagggaatcccacttgctgagcttggaagtagaggcttaagggatgttcagagtgcttggaactggagaagtcagatgataaatagtctggactagccactggaccgttcatgcctcgtcagtttccaggctgaaaaaataaatgagaaaggacaattgttcagatggctccggcaacaaagaagggagaggccatcgaagtagagagagcatgggtgaggtgctcaggcagtgaggtgcttgcctcatgagcctcatggcctgagtgatccctggagcacatctggaagtaggagagaaatgactcttaagttgttctcttggcttccatatgtgtggcttggcatgtgttcctgca

SEQ ID NO: 28221 - DNA, 1174 bp, Mus musculus
cactgtcacggtaagatgcccggggacagcagcagtggccatcgctctgatcagcttgtgtgggtacagggctcagccatgaacctcttgcagggagctgccaacgtctatatttatttctgtgcagtctttgattccacatcacatggtaaactttgacagagaaaaccttagcacaggtttatcagaaaccccaaagcatatcatgtttttaagttatcatgtaacccagctgagggcaatggaggaaaatagtaatttggaggtagtatggagggtagatagacttgataaattctgtttgttttgtttttgtttttttacattgtttattggagatgggaggaagtccctaccatcttcatgacatcatgacttggggagaaggctggagagattgaattctaaacagatttcttctgtattaagatgtggtggaatttgtccagcctggatgagtgatgtccgtttcttgcctgccctgtctgcaggtctgtctgacactcactgccaagcgcatggcgaggaagaactgcctggtgaagaacttggaagctgtggagaccttggggtccacatctaccatctgctcagacaagacgggaactctgactcagaaccggatgacagtggcccacatgtggtttgacaatcagatccatgaagctgacaccacggagaatcagagtggtaaggctggagcccaccttacgccgaagcgcctgctcaccttggcctatttattctgtgtatatgtgggcacaggcatgccattgcacacacgtggaggtcagagggcagcttgcaggagtctgttctcccctgctgtgtaggtcccagatcatcatgctggccttcactctctgagccttcctgcttgtttttaagcccatgacactgttttggtttttggtttaatacttattgttggatggagagagagggagaaaggagaccaatgaagctaccccatgcacatgattaagaaccactagaagctaatgtctttgattaggaagtgggatgtatcagttcagatttttatgagactttaatagaactggtaatatgccacagtctgcatagtgagcgagtcttgagctggagagatggttcagcagttaagagtgcttgttgatcttatggaggacctaggtttggttcctggaacctg

SEQ ID NO: 28222 - DNA, 1331 bp, Mus musculus
ccctccagatgtgttttctattctgtctgagctacctgactattccctctggggcctaacttgtctgtttttacttctagctgtacctcggggtggtgctctctgctgtagtcatcataactggctgtttctcctattatcaagaagcaaaaagctccaagatcatggaatccttcaagaacatggtccctcaggtacccactgcttcatccttcccttttgagagattgacagttctcacaatataagttagtgtgacattaagatagtccaagtatcaagtgacattgtccccgagagcaagggcagcgtcttgtgagaacagccctagggtaactgttgagctgcagtgtttttatataaacatgagtgatatctttgctgtggacccaggtaatttgggatacacgcatttttgtaacttggttttttaatttttgagctttacccttgctttgttgggctccctctaacggtgtcaaccatcttcccttctgaagcaagcccttgtgattcgaaatggagagaaaatgagcatcaatgcggaggatgtcgtcgtcggggatctggtggaggtgaaagggggagaccggatccctgctgatcttagaatcatatctgcaaacggctgcaaggtagctgaaccaggagacctctcttggctagctcggctcggcagacctgggtccgtggtgagactggggaatcacctgatgctattttccctcacatacaggtggataactcctcactcactggtgaatcagaaccccagactcggtccccggatttcacaaacgagaaccccttggagacaaggaacattgccttcttctcaaccaactgtgtggaaggtggggctatttaaggcactccttggcatgtctgagtattagtgtgggtattaacagaaagagggagagggggcagggcacagttcctcatttcattggctctgttctgacagctttccttagcagagagcagagagggaggcttcccctgctgccaggaaagcccaggaagtttttctttgatccacacagtggtctgtgctgatagcaacaggccagtgtgacttctctcctggcggtgtataccagtgctgtcaccagactctgctttaaaacagacagcaagctacccagaaagctggttctgtttaaataaaggacaggaatctgcatgtgtgtgttctctgaaaccaagcacattttctggcctctggctgacacgatcccctcacaccttctcttaaggaaccgcacgtggcatcgtcgtgtacactggggaccgcaccgtgatgggcaggattgccacgcttgcctctg

SEQ ID NO: 28223 - DNA, 1166 bp, Mus musculus
cctccataagcagtggaagcattcttgataccgcagtctacgcttgtctctgaaggatgctgctactgcagcctctttaagctaaggaggcttccgtgacttaacccatctctagccaacctggacagatgagggccccgtctagacaagtggttccccacctgtgggttgccatccatcttggggtcgaacggttctttcacgggggttacatatcaggtatttatttacagtatgattcataatagcaaaattacagttgtgaagtagtagtgaaaaaaacatcactgctggggaacgccacaacatgaggaactgaattaaagggtcacagcattaggaaggttgagagccacagtcctagacacccaagaggcattgggtttctctgactcaattcagcaaatgtcacccagcgttggagaggaagctgtctcaggagacagtcgtgagggtgatgcttagcctaggcagttgagggaaggaagtttcaatagggatgaggagtgagggtgctttttttccttttgattttaggatgtataattctttttctccccccttaggacgaccataaactcagcctggatgaactccatcgtaaatacggaacagatttgagccgagtaggtacccgtttgatgcctgccatagcaaatcatagttttccctgtggtattgtgttccaccttaggtcagaccttactaggaggattggactgacagctgccattggctgtgtgacatgcacagaacttggacttctctgttgccgtttcttccctgaaaccttgttggagtggacattagtttctctgtgttgcagagcacccggttttgtaggtggttccaaagccaggctccttcactcaaagtgtctatatttgtaaaacttgagagacatacagcagctgctagctgggtttttagcagttagtgtccttgtacttttctcagcctggctcatggtggtgtgtcagaacttctgtcaccctgaggtacgacttatgtacaaatctcaaaacacaccttccctccaaaatgtgttttgtatctttaagttctctcccactgctatgagaactcgtctgcgagtgctgtcacagtcacaatcagtacagtgactgagatggatgacactattttagtgacagtctgagtctttg

SEQ ID NO: 28224 - DNA, 1228 bp, Mus musculus
gtgagaggaccccaggacgaaggaatcaaagggaaagcaccatccgccgccgccgaaggatgccggcctggattctgcagagaggaatccctcggagtcgtgcagctgctgtccaaccccggcccctcgagaccccagaaaagctacgctgagcaagtagactagccccgactgcgccgcacccactgtggaccttccgcaccctactccgcaggctgctcactcaagtccccagtgttctgcaggcgggagcgctccgtagcccttgagagacccagacacccgcgtcctgggcaccggcgccctcctgccgggagcccagggcaggcagtcgctagcgcggtctgggcccggctgggaggggttagaggcggaggcggagctagctggagccggtgtcaggttgctccggtaacggtgacgtgcacgcgtgggcggagccatcacgcaggttgcatattttaggaagtgaggaggaggcacgggctcgagctgcggctgggtctggggcgcggagcctcggcgggaggaggcggacacgtggcagcggcggcagcagcggcggcagcagcggcggcctcggtccggggcgccggccgtcctccctctttcctcccgcggcagccctagttcccgcctctcggctcccccggctccgctctcccggccgggagctgctctcttctctttctagtctccagcaacaggacccggcgcggggcccgcagcgccgccaccatggggaagggggtgagtgtctggcgagcccgggccccgggcgggggcgcgggaggaagcggcttagagaccgggctctcggcaatggaggggcgggtgctgagcgcgggcagcggcccgggaggaggagcacccggggcggcatctctgagccgggcgcctgccctgcctgagccctctggtcgccttcaccgcgcgccttgcgcttcctttctccctcctcccaccgtgcccaggggaaggagcgctcctccccttcccccggggagctccgacagggccccctcgcggtggcggtcctcgccgcggcccggcgccggcgagggcagcctccgggtcgagactcccttctcctggaggcgctggggctcggccagctccccgcagaggcgaccgccctcccccaaaggaaaaaaactggcttccccttaggccgaaccagcccagcgaagctggtgccagaaagggtgtgacttcacagcccaaagat

SEQ ID NO: 28225 - DNA, 1099 bp, Mus musculus
aacaagagccccttgactccatctgtcccatttctacctaacttgctttgcctatgaaacgtgcttcactggtggattagagtggaacggagttttccagccccatagagagattcctggagcctgaggcagtgccggcaaggtggctttctcagaaaagtccaaagattcattcagcgagataaagacacttttgaattaactcccagggacaaatgtaacaacctccagagcttttatcttgagtctctgattcttttgaccgtgaaacagcattaggataaaagcatttgagcatgcaaattgtctggctttgcctgtctttctgtctctctgagccttcagacatggccaggtgcgttccctggtgaattcattcatgtagaacagtggttcccaaccttcctaaggctgtgaccctttaatacagtctctaatgttgtggtgattcccaaccatacatttattttggttgctacttcataacacaattttgctctgctatgaatcataatgtagacatctgtattttttccgatggtcttagaagattcctgagaaagatcattcaacccttccccaaaggggccatgacccaaaggttgagaactgctgatgtaggccttgccaaactgccagcctacaaaaacatcaaacaacagacccttgcctagagaattagttatggcgctgagacacctgatgcacagtgacaagttcagttcacgctatattataagtactgtagtggaagcatgtggcatagctaggagccaggaagggagatatagcccttgccttcaggtgctgttgcccctccgttatagacatgaaggaatagtcatctagtatgatcactgtgcctaaaaatgggaccacaaaaacctgtaatgttaataatatcttatttttataaaggttactccatgctttaacttttcagatcctctggaacaccaaaagtatgacctgcttaactaaagttaattttaagtgttcacagagtgtgggacaccagcaaggatgcagccatggcaggcactgtcccacccagggtatgaattgaactctgataaggatcagaccagagatacctggg

SEQ ID NO: 28226 - DNA, 1477 bp, Mus musculus
cacacacacacacatatagtgtaaccaggtgctttggtcttactttgaaacctttaggtcccttctactggaagttcctcaggatgtcttactcaggaaatattttaggagaacgaggtaaggggtgggcagtctgtgagagaccagctgtgtgtggagggtaatgtcacagcagagctgctccgccaccaacaccattcagttgttaagtgccataaatgtaagtactgcagcgttaaaggtaacatcttacagtactatgcttcctgctcctggttaaaccatgggtcttaaaggggttaaattggagccctgtgttggtatgtgcattcccagaagggcaaagaacggtttaaattaaggaattaatttattttccctcctggcccctctccatctcctttgcatagaacttcagacttcctgaaattattgttttggttgtaaattgaatatcgattttttttttcttcaaaatgcttaagtttgcatcgattcctgaaagaaaagccaaaatcacaagcaggatcctttaaagtctttgtgctcccagcgttttaccaggccgagttgacgtggaagcgaacggtgtagaggagagtttgcaaaagaaatgtgaagttgcagaaagctgcatcacacaactgaagacaataaagttttatttcatttcttggaccctcatagcctactctttttaaaggatgtaaattgctccccaaggctagtaggatacatgatcctattagaggacacaggattccattaccttaaacgtttatagattcccccccccctataacttctaacctaagttattaaaattctaacattaactgtggaagaactcaatgaagagtgtaggtctgagattgccgtctttcccgggtgattttcattatctacaaaggtagataagacaacttttgttcagaattgtgtgcttaaaaaaaaaaaaaagaaaaagcagtctttaatagtcctggaattgaatgctcaggaagtgggaattaaaatggactttaaggttatgaggctcacacatccttaggtaacccgtggggtcaaaactgtcttggctaaagttcataaagtaaatgcttacccaacatttatcatctcccttctttcctctaactcccttttgagatctgcaagaagacagattcttttttttttttttttttacttttgggtactttattgagttgttttccctactacccttcacctcccttatcccttccaatcccctgacactaggtaggagagagagaaggtgagagaagaaaggggacatcggaattcttaaaccacttcctgttgtttaggggtgttgaggtccttggtgcaggtccaatcttcatcatcatcatcatctggatataagaagacagattctttatagcacagagtatgaagtcagtggcctgggtatgtttgccttatcacaattcactgttagtgtgggcttttc

SEQ ID NO: 28227 - DNA, 1504 bp, Mus musculus
gaggaggctgtgacaaacgggttacgggatggaattgttttcgtccttaaatgcttggacttcagcctcgtggtcaatgtgaagaaaatcccattcattgtactctcagaagagttcatagaccctaaatctcacaagtttgttcttcgcttacagtctgagacatcagtctaaaatttctatacttgtggctttatgaaaaacaaaagaatatataaatatatatatatatatatgtccaggaggaagttcttttataaagattttttaaaattcttcaatgctgactcaaactggcagaggatagaccagtatccttcgaccatctgcactttatttggaaggaagcaggagatgcccaccccaacaagtgactgttggcatctgactttaatagatgggacttctgaagaagctgttccctggagtttctgtgacagctgtaaaccaaagtgtagctgctgtgtgtccttgggagcctcgccttacaactggtccctgcctgtggcccagtaccacacccgcctggacttctggtctaccacctcatagatcctaggggcctcactttattctgcttcaggaagccaaacactacacacccacttgcgtgtttgtgcatgtagttatccacatcaccacaccaccctggggagtggtgggcagtacaggaaatgtccaaccgcctgagtttttaatcatttgttgccttacattgcgaagagaaagaaactgataggaaatgtgcactgccgttttgcagctgttaagtgattggctttccattttcccctgagagagagcctacctgccctgtttttggccctgctcctctgttggcccttccctagccctgggattgcctacctgggcttcactctaacgcccactctccttagcatctggaccacagctgtacatggtgggcagcctggccaggctagcttggtcctccagagatgtcagggatttggctttccaagtatacccacagctctttgcacagcctctcccagtctttctcccgagaagtagggtatgactctggggatctattcagccgcagcacctcccttaggctgcagcaggagcccatccacccagtcctcctcagccctgcttcacacaaaccaggagagaccaacactgtgactcccagttggcaggtgccccatgtagccatctaatttcccagggagacaagtattcaacaaagctcatgtgccaagcttccctgccacgggaaaccaaacagtgcccaccaccctggcaactactgctgtcccatccctgaggtttgtgaccaccaccactgtgcaacttatcacaaggaaaagggtcgctgggaaagggagagttgagtcagccgtgcagtcccgaaggctccttctgtcagcatgttgtagctggtttcagaggacaatgcccttgatgtcccatttgtagacatagctgcttcctggcagagtcctgtgcaggggagtgcccaaggagtcatttcctg

SEQ ID NO: 28228 - DNA, 1216 bp, Mus musculus
atggggaatgccagagcctgggaaaggagaggaagccgccatagtgggagccatggggagtgtaggagccagcagactttcctgggagggctaccttgacttacaattgacctgactcagaaagacttctcatttcagccccactgaattccggtgaaaaccccgcattcatttttgccctcattttacagcatccagcgagcagccttggtggttctggaaaattactacaaggacttcaccatctataacccgaacctcctaacagcatccaaattccgagcagccaagcacatggctggcctgaaagtctacaatgtagatggtatgtgcttgaaaccgtttgggggggggggcgcacagttaggtggctctgtggcttaaacctcatagtacgtttgcttcaaccctgtattctgtgcttgccttacggtcttttctcactttagaacaatttatatttttagtttaaatgtagacaaacatttttttccgggggaatgtcagttacagtctatatatgtgtatatatatatcaagttcatccacttggagattttggtattggaaactgtagctgtgtttcctgcctcctgctgggaacactttagattgaaagtcctcggaaaggaatgtttttcaaagtctgagctgtttaccaaaagactgcgatgctctcagggctttcggcctagaatactccaccctggcctagaaacgtattcagcctagagagtcagctatctgggagctcctctctagtctctcagtcctggccaggaatggcaaccagaagctggaggcagactcaccaagtcagaggccagtttcattcagggtgtcagatgcttaagtgtgagaaacaggactccctcttacgtcttgctgggcacctgggctaagacaagagctttgcagactcccagagagattcatgttgtcagtaagacatctggtttacataggtatcagtttttggtattagtgttcaaatattttttttttttttaaatttggctatgtgaggggtatgactggtaagcctcacccttgattgggaaacttagttctctaaggcacccagaagaaagcattaggtcctggctgtgtctttgtgataagctaagttgggtcatgctcagggtgatacgggacttgtaggtcgattcacagatggggcggggcgtattgcggttgctgggctttggtgttgggg

SEQ ID NO: 28229 - DNA, 1245 bp, Mus musculus
ctgctctgtggagctactggggggcgggggtgtctggatgtgggctttgtaagcctagaacttagcatgggcggagtttactgcggtaagggtggctgttctcctgtagtggagtcagctcagctcagtctaacagctgctattaatgtcagagcagaaaggcctagacccagggcttcccagaacttttcaattcgagggatgacaaggtgtcatagtaatgaaatctcccaaacaaattgaaaggttagattgtgttttctgggttcaaagggcaaacataaaatatatggcgaaaatttcaatgaaaatagctatagttaaaaatgtccctgtattaaaagctgattctatgaacacttccaaaaaagttggctaattgaagtattttattttgttgtggcttttataaatcatcctcgttatcttctctgtcatcaggatgacaactggggagagaccaccaccgcaatcacaggcacctcagagcacagtatatcccaagaggacattgccaggattagcaaggacatggaggacagtgtggggctggattgcaagcgctatctgggcctcaccgttgcctcgttccttggactacttgtcttcctcacccccattgccttcatcctgctaccccaaatcctgtggagggaggagctgaaaccctgtggcgccatttgtgagggacttctcatttctgtatcattcaaactgcttattctgctcatcggaacctgggcacttttcttccgcaagcaaagagcggatgtgccgcgggtgtttgtgttccgagcgctgttactggtccttatctttctttttgtggtttcttactggcttttttatggggtccgcattttggactctcgggaccaaaattacaaggacatcgtgcaatacgcagtctctcttgtggacgcgctgcttttcatccactaccttgccatcgtcctgctggagctgaggcagctgcaacccatgttcaccctgcaggtggtccgctccaccgacggagagtcccgcttctacagcttgggacacttgaggtaaggggcatgcacacggagtaagcagaaaggatgactaataaccctagaagacagatgttattagtcggcaggggtgagatgaagccctagaggcagatgctaagactggagccccacccttctctggtgttactaagggcagtgtgagctgtggggtgtctgtgcctttcccgcgatgctaagactggggctt

SEQ ID NO: 28230 - DNA, 1179 bp, Mus musculus
tctcatcttggtttgctcatatgtcaggtttataaataattccttttgcactgtttgcccagatggactttggtttttgttcccatgttaactttcactccagctgctccccttgatgtttcccctaagggccccaagtgtgtactccacaaacccattcaggggtgggttcctttaccacttgtcagctgtcacagcaggtcccatcacagtgagagcattatcagtcagtctatttcagcagtgagcatggtgtccctttctttatctgccttctgttcccgtagcactcactacaaaggtctttgcatctagctttcagaggaatctctccattgcagtcctgagggtagagcaagctttcggtgccctgtgtcgtataaattctgcctggtgttagtgctgtgaaggcattgcagagctagcacattgaatggagaaagaatgtttcacacttgtgtgaagatgctaatatctcttgcaatgggtggaagtatttagtgtataaaattttagtatgaaattatattaactaataaaaacctttttgagaagatttgctcattttactgagaaatgagtctaagaagttgagctggaaaaaaaaaggaagtttagctgagcagtggcgatgtacacctgcaatcccagcacttggaaggcagaggcacatctcttgaattcgaggacatgcaggtttacctagtgagtcccaggagactacacagggagaccctgtcttgaaaaaagcaaaaagaagtataggagatttttttcacatattcacatacatagcaaccatggcaagtgttcatgacatagatgtcataagcagcttgcaattattcaatatattcagcagtataaacctttgaaaagcacattaacaacctattcattgcagaagtcctgaatgtataatttaccactgaagtctatttccatgtttcttaaaatgcacctaatgaaatagaaatttatggatggaatctggaatttacatcttaataatcattccagaaaacggcagtaccggtttaagaacatgtctgttagggctaggagatggctcagcaggtctaagtgcttaccatgaagtcagatggcctgagttcaattcctcagaacccacatgagggaaggagagaaccaacttctaaaaattaccttctgacctac

SEQ ID NO: 28231 - DNA, 1195 bp, Mus musculus
ctcacacttgtgtggcaagcattttaccactgcctgctcctctctaggtggctttctgagactttgtgagagcccagtctggaggggctcccaggagctggggctttccccctaactccagtaacaactcatggtacctcccaaaacagctgagagtcgggaaaaacaagaattatgaagctgctagccacacaacaaagcatactagtttacagtataagtaagagtatactaatgttcaaaaggcatagattactacgtaaaattgtaacaaccgcttattttcattatcagttatgcattttacataattgtatgtgctatgttcttacaggaccagcaccgtgggtttgtctacaccagcgtcaccataaagacatgactaatgcacctccctacaaattcactaccctgtgacatcactaggcaatagaaattgttcagttccattaaaacagaaccaccttcctatgtgtggcataatacagatcaaaggacattatgtggtatagaattagcctatgtaatctctatctcatcaagaggaaatatcaaacaaaacaaaactggggacactgacaaaataggtgactgacattcttcttctatcaaggaattaaagaccgagggctgatgttatcactcaactgttaagagaatatgctgctcttgcagaggactcaagtttgattcccaacacatcaggcagctcacaatcaattgtaattctagatccaggggatctgacatctggcctccatgaacgcccacatacatgtgcagtgtacatgtaaagacaccctcacacgcacacggaggaataaaatacatccaaaaagtaaaggcagaaatagaagagattggagaactaccgtagactgaggactgtggataaaggcagtggacagtcctaaatgtgatcctgagaaagaaaatggccattagtgaaaacccaggcagatttgtagttgatttgtattatcatgtcaaggttaattgcccaattttgaaaactgttcttttgttatataaaggtatgtgggagaagctggttgaagtgtttcttcctattctgataagtcctctgtaagtctaaaattacctcaaaactaatccatcgctgatgtctgatgaggcttagcatagtgtttgctttttaagatgcacatcctccactttccctgtgtttcacttt

SEQ ID NO: 28232 - DNA, 1126 bp, Mus musculus
atcagtgttttcttagcaagaaaaaggttttgaatgtccttagaaattaactaaacattgttagacaactctatggctaggaatttgtattggagatatttttgactcataattttcaaatttttttccctcataattttcaattttttccctaaggacttgagtgtgtgttgtgctacaatttttaaatttgaattaaatattgaataagacatttattgtgttaatttctgctaactttatgaatttaatctgcatgacttaccaaatagtattaagatattttcttaatctggtaattctaggttactagtttttatattaaccactattattttaaaattgcttcagtaatttaaagttaatgttaagaactttcactaagtgttgttttacctagtgttagtattgtttggggtttttttttgttttgtatacatagatctatatatattgactttttttttttaaacagatgagctttgatccaaaccttctccacaacaatggacacaatgggtaccccaatggtacttcagcagcacttcgtgaaactggggttattgaaaaactcttgacctcttacggattcattcagtgttcagaacggcaagctagacttttcttccactgttcacaatataatggcaacctccaagacttaaaagtaggaggtaatctgtcagctcacttttgaactttctactgtgtgtctgcttgttcctgataggacttttcagtctgttataagccagaaaagatgaacatattagttttgcttactactgaaatatgtgccctaatttttactatggcaatgtcattttgagatctgaaaaacttaactggtaaaaagatatatttgaggtttgttttttttttttctttagatacttagaagatttaaaggaatgaaattataagatttcttaaactaaaacaacaaaaaaaaatcccaagaggctagaaagatgccacagtagtttgaatacttgatactcttgtataggacctacgttcagttcctagcaccaacctcagcgcatacatactcagttgcaaggcatctgatggcctcttctggcctttgtgggcaccagtcaccaaatgttgtctgcatacatac

SEQ ID NO: 28233 - DNA, 1163 bp, Mus musculus
gatgctgggggtgcatgctgtttagcattattttgtttaatcctctcagcaatattgtatgttagaaattattccattttatagataaggaagctaaagtaagatgtttccaaatctgtattatcttatttgtaatgtatataaatgccatgaaaactaggtcatgatctatagctgcctcagtctaaaatagtctaagactaactcagtctaagtctgaaatgctcgtgtgtgtgtcagttggttggaaggctcaataaaatacacattgctgtacttgattccccagagtttgtctttacctaggtctgaagtgaggctcaagaatttgcatggtctcctaagtttccaggtaacgttgatgcttcgggcctaggaaccatactttgagaaccactggtttaaggcaactcagatattacacaccttagaggtcagatgcaagatgctgtttttcaagcattagtccaacaaacatgacacattctttattttagatgatgttgaatttgaagtatcatctgaccggaggactgggaaacctattgctattaaattggtgaagataaaaccagaaatacatcctgaagaacgaatgaacggacaagttagtgactttgatactttgtatttccttagggccccatatttgcatatttttcacattagaaaaggaagattgtcccttgcctcctcagtttgcacgaagagagctctagtatataaagataacttttaagattagatcagaagcactggcatttcttgacctgaactaaaaacatggtcaagactcagtttgggttttacatataaccctgagtctttacttacagtcaatttgcatactgtaagtttgaaacttggcagcatgacatcctcttgtggatcatattaaaatgcatccctgtatatagtatagaggatattagaactcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccatcatgtgatctataagcgtactttaa

SEQ ID NO: 28234 - DNA, 2698 bp, Mus musculus
taatcctagcactcaggcagtagaggcagatggatctctcttgagtttgaggccagcctggtctacagagttgagttcaggacaagccatagttgcacagagaaaccctgcctcaaaaaaataaaataataagataaattaagaggataggtactaagtttagtacttcccaataacagattttttattgttatcatcagttccttagtttataaagtgtaatactcaccctgctgtgaaaccagtgttctccaccttctttagaaggtatctactttggtaaagtcaggaatttatgaagaagaaaaaaaaaatccatgtatgaattttaagtctgaaagatggggagtttgaacaaagtttttatccagagaagattgggtatcataaaccttacatttgttcttaataatgagagaatttttaagacctaggaaactactttgtgattatagactcaatagtttctaacaacccagaggatttaaccttcatttttcatttcttctctagcactggtgctgtaagtgctcgtaatattatgctgttgaaaaagaagcaggctcgctgtcaaggagtagtttgtgccatgaaggtaatagttaataaacttgaaatgtttaggtttgctgtttggttttttaactgcttttaagctttgtactacaaacccaaaccacttgcttctcctgcctctgctttaagactatttccttgttaactaagttcatagagcttcttgattgcgagtctttaggtcaagtcttggtaaggtagactttacagagttgtactctttggcctatagtataattttaagataaagcttactgatttttttttaagttgtaatcatacatttgtatattgattggtaattaatgattttgtatttgggggctttttgctttaggaggcgtttggctttatcgaaagaggtgatgttgtaaaagagatattctttcactatagtgaatttaaaggtgacctagaaaccctacagcctggagatgacgtggaattcacaatcaaggacagaaatgtaagatgggtcattcactaactctaaattattgccctttttaaagattagtagtggattatatatttaagaaacgcttaaaattatgtgacccctgcccacttcaacctcttgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaattgtctttatcagcaatgtcttcttctgaccaatcagtacaatattatgatgatacactaaaggtggagtctgtttgattgatgtagttgtgtgtagtggggtgtatcttttaataggtattttaattaaaaaaaaaaaaaaaacaaaaaacaaaatagatgctgatggtgtggttcagtggcagagggctgacctagcatgcaaaaggcccccagtactgcagaaagaaaagagacactaatgaacggtaggttgatgggtatgtttttgcttatttgattttcactgagtgattaagattaaaagaaactgttacctgaactggggaaggtcctactgaattggactgcatgtgctacttctctgttcccccgtcttaccatttgttaactggtgggaagtaaggtgaaaggcatcattgctggataaatgtgagatccaaagggctgaaatgtttttccttagcagttcttgatatcacagtgcagtgttaacaacagtgcttgatttatggttgtcatgggaccttagatgatgaagcttttatattgggcttatattgtcagcacttttttccccttcaggctactactatattataaataagctatttactgtgtgttcttcttgtttgacttagagctaaaaggatgagaaatctccagctaaaatcgtttttccttctcatcagaatgacccattgccaggacgaatcaaagttgactttgtgattcctaaagaacttccctttggagacaaagacacaaaatccaaagtgaccctgctggaaggtgaccatgttaggtttaatatttcaacagaccgacgtgacaaattggaacgagcaaccaacatagaggttctatcaaatacatttcagttcactaatgaagccagagagatggtaagtgtttaagcattgctggaattttatctgacatttagggttcagtgatggactctgatttacactgttggctgggaacttcttaggctgatgactagtgaataaaggtgtctgttcccaagcctggtagcctgtgtcctagtctgcactgatggagaggccaagaagaacacacagaggcaagttgttagaggatatttcttgtaagctaatgcctgttgggaagtcactttattaagtagctaagaatcctacatatttgaattagtttgggcttagttctcttagctatcttggaaagacatataaattaattttaaattagaaaaccagataaggggattgctaatgaaatgtgaataagacatcaggaaatatattttcttaagatttcctctgtgatgtttagtaaacagtaagttaaacagcactaaattgatttcaccgcttttatggtaatagtttgctttttttaaagtgagtatatgtctgaatag

SEQ ID NO: 28235 - DNA, 1120 bp, Mus musculus
attttccaaggagtgggacctggaaattctttttttcgagacatggtttctctgtgtagccttggctgtcctggaacttagaaattcgcctgcctctgcctcccgcgtgctgggactaaaggtgtgcgccaccaccgcccggctttgatgttgttcttttttttaaaaaacaaaaacaaaacagaaaaacctatataaccagttaaaaatgttaatttgtgtttttattcagggtgtgattgctgccatgagagatggttttggtttcatcaagtgtgtggatcgtgatgctcgtatgttcttccacttcagtgagattctagatgggaaccagctccacattgcagatgaagtagagtttactgtggttcctgtgagtagctgttggggaaagtgttaagggttggtattctgctgtctcctttgtaattttaattttgttgattttgtttaatttgtaggatatgctctctgcccaaagaaatcatgctattaggattaaaaaacttcccaagggcacggtttcattccattcccattcagatcatcgttttctgggcaccgtagaaaaagaagccactttttccaatcctaaaactacaagcccaaataaaggcaaagacaaggcaagtgttaggtgatccagatggtttgtatgtcttttatctttgcctccagattgcattgtagctcatatagtgaagtatcgtctcctttttaaaaattctgtatacagcagtgtattagtcagggttctctagagtcacagaacttatgggtaatctctatatagtaaaggaatttattgatgcctcacagtctacaatgcaactcccaacaatggtcagtagcagctgtgaatgctcagtcccacacggcaagcactcgaaggaggggggggtggagagactcgcgcacactcttgagaccactcgccttccttcttccaatgtccttataatagtctccagcagaaggtgtagcccagattaaaggtgtgtgctaccacacctttaatcgaagatgaccttgaactcggagatctccctgtcttaatctggggtccatagccactaggcctcaagatccaggtcagaaacttgtatctcccagcctccag

SEQ ID NO: 28236 - DNA, 2590 bp, Mus musculus
tttgatttgtgctagtatttctttctctttttaattggggattgaacccagagctttggacttggtagacaagggctctgtcagtgggctacagccccagcccgatttgtgctagtttttaaaccaagttaatttctcacacattgataatagtgactaaaaacactgaagtgctctgggacagtaaagaggatattttcagctgctactttaagaatattaaagagttttcttcatgagaaaactaagcttcatgctccacaaaattttctcttggctagaaatgtcattctcagcttaattttctgataaaactgaaaggctcagtgatagtagattgaggcaactctgagtgaaggcaagcataccttttattcatgcattttgtcttgtgttgtttagagggtcctggaataaatttctgtggctctgccaattctttgtgttaaggattcctaagttactgtaattatatatcttccttccctttttctgttatcatttgttagtgttcttgaggatatttaattgtgttttatattttctttaggaggcagaagatggcattatagcttatgacgactgtggggtgaaactgacgattgcttttcaagccaaggatgtggaaggatctacttctcctcaaataggagataaggcaagatggttttacttacttgaagaaaggttaaaggttgtcttgattatatttgctagaggatggtttaaattttgctaagtttggctgcagcattttttcactggaaagatgaaatacataataaaacagggtcttgtagcttatgaaacatactgaatgataggtttttaggtttgagttctttttagagatgagtgtgtggcatacttgtaattctagcagttagtaggtaagtgccacaaccactagatacagtcagacaagtaagctaaaagtactcactaaaataaaaccagtataaaattacaccaaaaatttacattgcctactttttagacagcctctctatagaaattaaaactacaaagtgtacattgacaggcaaaacttaaatcatttatgaattgagacagcaagtgctttctgtaaatttttctgtcagagtaattacaaaatagatctggagtgaaaagcttggtctgggggatgttttgggtcagcttcttaaaggtacagagcttgtggaaatgacaatgatactaactatcatcctcatcgttttgtaggttgaatttagtattagtgacaaacagaggcctggacagcagattgcaacttgcgtgagacttttaggtcgtaattctaactccaaacgtctcttgggttatgtggcaactctgaaagataattttggatttatagaaacagctaatcatgataaggaaatatttttccactataggtaaggaatgccttttgggcagcaaactattcctattatattcttttatattaacgtttcaaagaatttaatataggttgatactttttggtaattacaatttttgagacccagcttttctatttgtaattatggcaagttacatacaggagttaggcatctgccataaacatagaaatgcatttacctgcctttacatatttttattatacatattggtactggtgtgataatacagttatagcatatagtaaaaaatacgggttcattgaaccaaaactaagtattttaattttgatctaggttctcccacttaatatgttactttcatcagattgtaactttttgatttctttaccttcaagctagaaatagtggtagctcagtttataggttcttgattgggggggggttgttttaaggatttaatgaatccgtaccttaaaacagtatcttaatatatgcagacctcccatggatgttggaaggagaaaaggctccatgctactattgatattagtgatagtggcttattttaatgtcactttattatcttttccctttagtgagttctctggtgatgttgatagcctggaactgggagacatggttgaatacagcttgtccaaaggcaaaggcaataaagtcagtgctgagaaagtaaacaaagcccactcaggtaatgagtcatgactcctattcatcctatgctttgacggcaggatacagggtcgggagaaggataaggccatacatgttctgtaacatttgctctcaggtacccagagcagcagtatatataccttcactgtttgtcaattattcatgttcttgacactaccaaattctgggcatgacagtttgtgcatgattttagtaacatttcagagataacattttgaatttggaggatgtggcagtttattaagagtcactatataaaaccttagctttcttggaactggctgtgttgatcaggctgacctcaaacttggaagaaattactggttctgccttccaagtgtgtgtgtgtgccgtcgtgcctggctggcatctgatctggggtgcagtggagttagggattatgcatctccagtaattaaagcccgtcctgctttcttttaatccgagaaatatacattctacatagaaataattcttaatggagttacagaaataggcattct

SEQ ID NO: 28237 - DNA, 1099 bp, Mus musculus
atttacttgcttgcttgcttgcttacttgtttatttttaagacatggtttctctatgctgttttggctgatctggaattcaccctcttgagtactggcatttaaactttcatggatgtctcagttttttagactttattgctttgggacaagggataaagtaacaacattagtgaggagaaaataagtgtgattattaataatgtcacttggtggggattgtcttagtcatgcttagaatagaatgaatggcagttgtttcagaggtatgactttcctgatgaattctatcatacaccagctgaatttagctcatcattagtaatgccatgttttctaagtcctttctaattagggttagcattatctttcaaagtgaattgctcttcctttctgtggtatgtgttctccattgtaaattttgttttgtgtgtgctctttttccagtttggctttattaactatgaagtaggagatagcaagaagctctttttccatgtgaaagaagttcaggatggcgttgagctacaggcaggagatgaggtggaattctcagtgatccttaatcagcgcactgggaagtgcagtgcctgtaatgtctggcgagtctggtgagtttctatggtttattatggttggaaataactgctctgagttcatccctcactcattcatgcattctgtgctttctttgccactctcctctggctgggtttagtaggaactattttacacttctatctctatctaattttgtctttttctgctagtcattgctttgtttgagataggtctcagttttatatccgtgacttaccttactttcagcttgctgccatgtgccaccatatctatttttctatctctggtatttattgtctggctttgagtcctataaccctgacctgagaaacacttaggtactatgatgcgttagcactgtgtgtgctgtagcttaaatactaaacggttatatgatccttgtacttaagagtttagcttattggctcgctctttctgtctactcacttttagactttgtgctgctgaaatgtttgagataggtctcagttttataccttagtcattctaacttatgc

SEQ ID NO: 28238 - DNA, 1374 bp, Mus musculus
tactttgttggccctatgaaattctgcactctagtcagtatatactctaccttcatgacttaacactcagctgcattcttttcctattttttccctgttcattatgctttaattctgaggaccatatgaaggtagaatatattacctttaaaaattgcaaaaatttatatagcaaacgatattcttaagttgatggccaaatgttaaaatgttattttcatatcatttataatcttgtcacaatccacttaacgaagtttgattacatttcagtgaaaattatcttcccgagtagtttttttttttttttcttcctgggatggggggggtaaataactttactacaattagtatgtgtggtgcagaatttcatgcaaatgaagtgtgccagcagtgtgataatttaaacatatttaaacaaaagacgaatgcacaaaattgctgctgcttagatcactgcagcttctaggacccagtttcttttactgatttaaaaacaaaatgaacaaaaaaataataataataaaaaagttgtgcctgaaatgaatcctgttttttttaataaatagccccgtggttccagtgccctgttcaatacaggcacttgatccttggtgtagcttctgttcaactttgtatcacgggaacggattggcctgatttctcggccttcatcttgaattggccccaaacagggtccctggcaagtggagtgaaggctttttgtctaacaatgacaagggtcagctcaggggttgtcggggagggcgctttcatcttccccgttgtcatttgaggttttgaactctgggtaaagaggccgtttatctttgtaaacacaaaacatttttgctttctccggttttatgttaatggcgaaagaatggaagcgaataaagttttactgatttttgagacactagcacctagcgctttcattattgaaatgggggcggggcggggctggactgggtgcggccggctgcaagactctagtcgtcggcccacgtggctggggcggggactggggcgccttgggcgcctagtgattacgtagcgggtggggccggaagtgccgctccctggcgggggctgttcatggcggtttcggggtctccaacagcttctcaggttgaagtccaaaagcctcccgaggcggggtctgcggagtttgaggtaaagctccggcctgcctggcgtcggacttctcagcgtgtgaacgcctggcggggcggggagacgcggagacttggcgagctgaaacaaaggcttgggtgggggactctggctggctctggggtgattttcggagccggaaaggggagtttcgggaagtggttgtgccaggcggaccccagagcttgggtttgcagg

SEQ ID NO: 28239 - DNA, 1374 bp, Mus musculus; identical to SEQ ID NO: 28238

SEQ ID NO: 28240 - DNA, 1067 bp, Mus musculus
tgcctattattcctgcttacagacttttgcctgatgcctgctgttagtgctacaaggataaagcttgtgtggttctcaccaggactggaagtacctggtgagctctggggtaagcctagatatctttacattttcagacccttattcttagccacgtggaaactgaagccagagtccatacctccatctccttccccccccaaaaaaattagattaatgttctttatatagcttttttaaagtatttaaaacatgtctataagttaggctgccaactaacaaaagctgatgtgtttgttcaaataaagaggtatccttcgctactcgagagaagaatgtaaaatgccattgattgttgtcacttggaggcttgatgtttgccctgataattcattagtgggttttgtttgtcacatgatacctaagatgtaactcagctcagtaattctaatgaaaacataaattggataccttaattgaaaaaagcaaacctaattccaaaatggccattttctcttctgatcttgtaatacctaaaattctgaggtccttgggattcttttgtttataacaggatcttgctgtgtagtcctagctggcctcaaactcacaatactcttcctggatcaatctcccaagtgctgggattacaggcacattccaccacacacacctgactgagctcgttcctaatgagttttcattaagcaaattccccatcaccttgaaactaatcagaagggggaagaaacatttgctatgctcctgagtgctaacactgggatcattcacatggggtttgcattcctaggcaaactaaactgctgccttttacaacaaggctcagtcatcttcctgaagctgctgagaccagcacttggtcttgttttgttttaatatgtctatatgactggtggtggatccctaaatagtttattaattaaactccagttaaggagaaagttactcaccttgacccgtttgaccatatcccgtgtgtgtgtgtgtgtgtgtgtgtgtgtgtgtgtgtgtgtgtgtgtgcacgcgtatgtacgtacgtatgtatg

SEQ ID NO: 28241 - DNA, 1754 bp, Mus musculus
atggagccaattcaggtttcagatgcccttactaacatatattcccacggggtgtgggttttggcacaacagtgacaaacttaaaagccaagtaagagccgggcgtggtggcgcacgcctttaatcccagcacttgggaggcagaggcaggcggatttctgagttctaggccatcctggtctacagtgagttccaggacagccagtgctacacagagaaaccctgtctcgaaaagccaaaaaaaaaaaaaaaaaaaaaaaaaaaaagccaagtaggtccagttggtatagtatcaaagtgtttttagagtaattagtgaaggtctgctttacctcaaagttgcagagcctctcttcctgagtttaagtgcctggccggcagtcacaaattaacatgttgctgtaaggcagttagttgaagctttgttcacacattggagagtatgaaaataaagtgttctaagagcgctgatactggatctgtgtaaacctggtaaatgccgtttgtccaggacttagcgtgtgtgagttggtagctcagtacgagtttactagttccgcagtgtgtacaatggaggcgggtttgttttagctggccacctgtagaatcagcctttaaactgctgtgaactttgtcatgacttgaatatgaagatagacaaaaactctgtaaagacaaatgtttgttttcccccttacagaacgtgtgagcttggttttatcttcctttgtatttagtcataacctctcaagctggcagctccgaccaaggatcagaagctgtgtgcgttccacctggtggaattagctcagctctatatgagaagtggagttaatggaaaacgtgttgactgggtggtttctatttaaaagagtgatgataattcttgaacagtagtttttattttgctatttctttaagctgactgatgtgccacaaaattattttaaggtatttgtgttttaagagtgttctcatgagattagttgtagatattttttaaaatacaactggtttttaaaatctgagtattgctctaagcaagtgtttagactcttacgggaaggtgggtggaagttgtttggcttccgtatttccatgcgtgccgtcagacataggtcagaacgccaactgtgcatcctgctgtttaaagacctcttggcctctgtgaccctcatgaaggggctgatattttaagttgactgtttgattgtaaattaatcctttctaatttttaaagacttgcttgactgttttccttgttaaataattttaaaaaaataaaaaactggaagttctttgcttaactgtattttccctactgccatagggtttctactgctgttaagagacaccatgaccacagcaactctgataaagaaaacatttagttgggctggcttacagtgtcagaggtttagtcagttatggtcacggtgggaaacatggcagcgtgcaggcagacatagtgctggagaaggagctgagagtactacatcttgatgtgaaagcagcataaaaagactgccacactagacctaaggagcaccttttggagaccttagagtctatccccacagtgatacacttcctccaacaaggccacacctctgtgggccaagcattcaaacacatgaatctgtgggggccattcctattcaaaccaccaaacccaccaaggtctgtattaggaaattatatttcagatattgatgttctttttgggcagtgcaggggagactcaagctcctcat

SEQ ID NO: 28242 - DNA, 1191 bp, Mus musculus
tactatgttatcaggagctcctgctgggtgaggtggcttatgcctgtagccagtgttgtagaggctggacggggattgcgactagtttgaggccagtctgggcttcagaataaaatgggcttcgtgtacacatgtacatacatacatacaatacaacttctgtgaagtttttgctatgatttttttttcacccacatgaggttaatttcttaatttaaaaaaagatttatttttttgcattagaccagggtttcttttcccgcaaagctaattttcctacaaactagtgagaatgttcacaaagacaaacatcacatgacttccttagtgtggaagctagaggggaaaaggagggcacaaaactaaagtaggagagctgggggtggggtggagtaagaaagagtagaggggtgagtgagatcaagtactttataagcgtgtatgaaaatgtcacaaggaactccattgtacaatgagcatacaggaggaaaaatgattttaaaaacttgtggacatgacttaagtgaaagtcatggaaatcctgaagtgcagcttctgtagcgagaataaagtgtgtgtgtgtgtgtgtgtgtgtgtgtgtgtgtgtgtgtgtgtgtgtgtgtgtgtgtgtgtgtgtacgcgtgtgcacatgagcctgcctgcctgcctgtctgtctgtctgtgtatgactggtccagttttgatcagctgtactgacagagctaggctaagatagtgtcctgcttgttaatcagggctaggcagaagcagcaggaggaaggatgaccctgcctcaggaagttttgaatggcttgttatttataaccagtatgcggtagagcgggagagcaggtctctgcttactgacaggaagagtttcagccggccagtgttcacatttgaggaagcggtttatggagctgactgattgaagctctgcggaaggaaggatgagaaaagtgactgcagatctgagtcagaggtagcagagatgtgggaaacccagccaggacagggtaaagggtgcctatgcctttggactgagtccctgtagcagcttgtgtgaaagtctgtgtgctaataggtcagctgaaataaatatatgacagactgatgttacctagcaacagaagacaggaggcgggaactagcttccagtgtgtttgtgaattggttcctgtctagacttgt

SEQ ID NO: 28243 - DNA, 1161 bp, Mus musculus
aacagctaaaataagatcattaaagaaaagactcatcttaggcttggggtttagctcagtagtaaagaacctacctcgcatgtacaaagatcagagcttgcccacaacactgccaaaaagagaaagaaaagtgtgttaggattttcctgctgtgaagagacaccatgaccaaggcaagtcttataaaggacaacatttaattgggctggcttacaggttcagttcattatcatcaaaagtaggagcatggcagcatccaggcaggcatgagagaggcagaactgagatttctacatcttcatctgaaggctgctagtggaagactgacttccagacagctaggttgagggtcttaaagcccacacccacagtgacacacctactctaacaagtccactccctgagccaagcatatacaaaccatcacaaaaaggaaaggtttaatttaactgttttccaggctggcatgttgaacagtctcactgatgtcttcttcgtaggtttgtttgaagtccgggctcttcaatatttggaaacaattcctgagtcggaacccagcggggtgaatagaattttacgtagtcttggtgagtcgctttgccctattggatgattaaccttgtggtataagtccccgagtcatgaccatgaagcctctctaggttgtactctttggggatacattttaaaaagtagttctatttaccagaaaataatgtatttatatatacagataaattttgcatataattctagggtgtccatggacttcagacttaaaatccttgggggctgggaagcagaagaggattgcctcggccttattctgcatttcataaacatgggtccttctgatttttaaattctggactgatgtgaggacagtggtgtgcctgtcacaagacaattgccttaaactctgggctttggaatgtatgctcctgattagaccctgtccttaactagctgagagaccgtgggcatttatgccgcaggctgtgatttcatccacaccttgggttagattagatcagatgataatctttagggactttagagaggtctcttttgagcatttagaattctctagggagtgagccaggtaatttgaaacttcagtccaattgaaaaccacttgagttagattatgtcttgagttct

SEQ ID NO: 28244 - DNA, 1167 bp, Mus musculus
acaatgcaaagatgagattgacagagaaataaggagaataatgagagtttcaggtactagggagacagacatggaggacaccatggtcacacgattctcatcactgaagcatcatattgctttaaatacgtggacggtttgtgctttctaattccagtactgtcaccattgattaaaccccccttttgtcccatgtcctatcttggagaatttcactcatgttagaactttaaaaaaaaagcagacaccaggcatggcctcctcagaacacgtgtcctgctgggatagcttgcttctcatatgtcagcattatgctttatggaatggagccaacattaaaatgtccttttaaggacatagctatctgagttttggtgtttacaatttgcagcactgtgataatctacatgtcatcttattcaagctttagatcagcttcatgatattctacaagaaactggagttcagagaagctaaggaatttggccagttatatacaagaaagaactaagccaaacacttgacttatgaacacatacaaagctggttagtcctacagctgtaaatgaactctttatagtgatgtttaaagttctctgtggagcacaccagagcttcctttttggctctgatgagacgttaagctatgggggtctagacaaggtttgttcctttgtttcttcttctgctgctggggataggacccagggccttttgtgtgctctgccacactggttatttttacatcggtgtgagtttttagtgtttcctaagcctcttcatcaaccagatgctgaaaatctaaagtaggagtagcacctgggaaagggagtttgtcagtgagggtacagttttcattgataagtgagaaatgttgtggtaaatgtcagttgttttctgtaacctttgcccactgctttacctggcatggaaaatactcattcagacttggaaagtgttgtttgttgtactgggatacaactcactgacttgtatagtattgtcattgtcactcatactagggtgtctgaatgaatccatttaagactggtgctgtgcaatatagttcccacacatgggtccagggaagagaactgagtctgtcctttcaaatgttagtgcagctcacccaggggagctcctcccagacagctctctcctttcctt

SEQ ID NO: 28245 - DNA, 1680 bp, Mus musculus
gcttgcttacggatttctgtcttcccggtctctccgttgcccacagcatcttctcaccatgctctccatcttgagatgccatgccggctcctttcacagctctctccacgctagtgctctttacatttgtcctggagatttagttacaggaaatagtggctaaggctatggggtttggtggtagtggtagtttgttttgtcaattccagaattttgtccatcgtgtaaacctctgcctgtgttcttttaatcttatgctgttttcctgtctcttctgtctccctgagtctcttgtttctgcttatttcttaaggtaactatcatgagacgattgttgggtaacttaagtaatgcagagagcccctgtgtacccttcccctgctttcccataacgttgttttttaatggaaagttaaaaatgttagtgcccatagtgaaactacatatgtttaaaataaactgtgcaagaaattttacatccgctcatttttccctcttctctctttttcctttgactctctttcctagctgggtgtcgctggtgagtaagaactatgagattgagcggacgattgtccagctggagaacgagatctatcagatcaagcagcagcacggggaggccaacaaggaaaacatccgccaagacttctaatgactcaggcgacgtgggctccgcagactcagcggggactttctcggagcgactgtggtggttacatggttagagaccatggactatgtaaactgttgtattgcttctgtgtgagtgtcttagcaaaataaagttgtcaacatgttgctgtttttatgctataaaaacctggttttcagaatgagtatgactttagaataattttgacatattttgtagcagaattttttttttaaggcttcaaattttgtaatgaagctcctttatttttaaggcatccaacatgttctggaagctggaaaccttgaatttgtgttttttgttgaataaagttacagttctaagcatttttatgtgtggctatagtgaactttattgatggtattcaaaagaatgaggctcccttctagggatctatgatagaaataggtgtagtgagaattgtggaattttggattcttttttaaaaatgcagaaatataagaatatgttttgggctggtgagatggctcagcgggtaagagcacccgactgctcttccgaaggtccggagttcaaatcccagcaaccacatagtggctcacaaccacccgtaatgagatctgattccctcttctggagtgtctgaagacagctacagtgtacttacatataataaataaataaatcttaaaaaaaaaaagaatatgttttcattttaatcccaggtgtgggtatatggggctgctttgaagcaactgatgtgcctcgtgctctagtagaggcatggtttgccagctgcaggtagtttctgcaattgggtgacatttgggataatggaaacttttcacagggatataaagtctaaggccccaagaggcagtgttggttgtggtttgtgagtagtcgtgttcaaagaagaagcaagaagaaaaattagattcaagtctctcgcacgctctttctcactcacctttccttctttcctaactagtgatagcggtgaaggccagaaggataaaaggtgggagaaagaagaacccaca

SEQ ID NO: 28246 - DNA, 1127 bp, Mus musculus
ttgagaggaaattatgaaacaaacttaattagaacccacatttgaagagataacatttgaagtaaaatagatgcgttttaaattcttgttctttcaaaggttacctattgattccgatattattcttttgttggcagaagtatttttaaatggaatttaaaaaggattaaacagactaaatgggggttggggatttagctcagtggtagacctcttgcctagcaagcgcaaggccctgggttcggtcctcagctctggaaaaaaaaaagataaacagactaaatgtagtaagtttaacactgaagtcagtagtgctagatatttgtacatcatattcatgctataggagtttgaaattgttctacagatgaataaactgggcttcatgagcttaatttaaattattaaatattgaattcagtctttatgacttctttagatctgataaagtagttaggtctattaaaacctaagtcatgcactttgacaaattttaactaggcactttatacaaattactttgtgaatttctgtaactgttgattcatagacataggttgagttgatgacctaatggtacatttctcttattcaggattaaagaagtaaatgagactaacaaacgtgtagaacaggaaattaaagtggccatcttcacccttatcaatgaaattaataagaaaggaaaatctctcttgcaacagctagaggtatggtttaaagcaaagattaaaaaatgcttctcctgctcttcagctgttctcagtggttactgaaagtgctcttaaatggtttgcaaaaggcaaatagaaaatgtcttttttgtttgtttgttaattttctattcagaatgagaattttatttagttactttgtagttcattttaatagcactggttggcttggaaatcatcatactagtcttgaacctatagaacctgtctcccaagtgctggaattaaaggtgtgtaccaccatgtctgacataaaacactggttttttgtttgtttgtttgttttaaagccatataacttggtaatagtgataaccattttaggaaagagttattactaaaacatgatgtaaatgaagacaaagcaagcactttgaatttatttccttccta

SEQ ID NO: 28247 - DNA, 1145 bp, Mus musculus
gtcttagaactcatttgtagactcagattctcctgactctgcctctgcccctctgcccctctgcctctacctctgcagtgctgagattaaaggtagactccaccaccacaaggcttatggaactggttttgattggaaaaatagtgcattgtaataaactataagtatgattgtttgtgtataatagtttaatttctgagtcatctaagtgaaccaatattagagggacaaaacccccaaaatcatgttagcatatgtaatggcaagttatttgtattcttttatttcactggtgtgatttacagaattttagtattaagtgtattcatgtagctttgtatatatattcatgtttgtatactgtatacatgtaagaattaaatgatttttttaattgtctttgttttcttgtagttgagcagtcctgagagtagtttgacaccacctctttcaactaaccttcacctagagagtgagctggatacattaacaggcctggagaaccacgtgaagactgaacctacagatatcagtgaaagctgcaaacagtcaggactcagtaacctagtcaatggaaagtctccaattcgaaacctcatgcacaggtcggcaaggattggaggggatggcaatagcaaagatgatgacccaaatgaagactggtgtgccgtctgccagaacggaggggatcttttgtgttgtgagaaatgtccgaaggtctttcatcttacctgtcatgttccaacacttctcagctttccaaggtaccagcaaaatagttcatttacgttcttgttattcccaaatctaaacatataacaaagttattcagggcttccctcaaagaaatcccattttaaagatcaagttctttaataaaaagctgcagatagtgaagctgataggatggatctagtctagtagttgagcatgtgcctagcgtacatgaggtccttgggttcaatctcaaacactaagatgggaaaagaaaactagctatatatataaacagtgccatatatatatttggttgtctttgtcttcttaattgtaatacctgcctcaatctcagagggtatgatttgctagtaatctaatgaggaatttccctttttttttattacattacttagttacttgtatga

SEQ ID NO: 28248 - DNA, 2361 bp, Mus musculus
tttgcagggtgattcagaagtagctaaggcagggaaagcagttgcattgtactttgaagataaactctcagagatctactcagacaggaccttcactcctttgccagagtttgagcaggacgaagatgatggtgaagtaacagaagactctgacgaagattttatacagcctcgtagaaaacgcctaaagtcagacgagagaccagtacatataaagtaaaatgactcggacttaaatcggttgttaagaagaaggaaacaaaacaaaacacccttttatttaagtgttgctggaatatcctgtgtacagtggttttacctccttacagaagctggtagctttcatacagtattagattgaaataatggaaacagaaaacattcttgtcaagaaaaggggagagaactctgtttgcaactttaagaacaaaattagaagtgaaaaaatttggggatttgctacaaatgaagacggttctctggctgttagaaatgtagatgatcatgtctgataattggtgcaggatactgagttgggcaagcctgcgagatgtgtctctgctggagcacacaggtactcaagataacttaaaagccttcccctccacagatacaaatgggttgttttctggttaaaagtgagtacatgagattccacttgaatgtcactaaagatgcattgaatcatgccactgcattttctctcattttgatctatttggccttagtttttaagttggtttaaagaactcagcagtagttttattttattcttagatgtagggtctaggaacataaccattgatcgtttagtcaacttcggtggtgtactaaaatgatgataacttttagtagtggatcatacagatttatggaagtcatttccagaaaaccctccaaacaattacacttactggtcaaatcatctgatcacgcagttagtcattcccctgaaagcaggacatttatttcagaattttctgtgtaggttaattagattgagaaggtgacaactttaacctagtcttcttcataccagtttccagtagaccactattggtaaacagaaatctgtcagctaccaaatgtgtacaattttctgtatttcactttgtcttatttgtaaatagtgagctcagacttctggcagatcagcaacatttgctgagcctgttttttaagctaatgtgtattcttactaatgttcctaccaagaatggatttgtaatatatgctgtctatttctaatgttcacattcatattttgaggttctatcttattttaatagagaacagacgtctcaaaaaatcttcagaagcagcttattattgaaatatcaaaatactgaaataaacccggtggggttagattactcatctgtccaccaagtgggacacgtgcatggactgggggctttgaatgacttagaagagacctttaagtaaatcctgagaacgagccaatccccacttgaatggtaattggaacaaacccaaccttgttactacctgacggcaggagccgacctgcagcagacaggtgtgctcgctcgggtttatcttcctcctctgcgttgtgacgctcagatcaagtgtgctctagactgtgtgcgcctctccgctggattaagagttgtagtcctacttctgtatggacacagtagaatataaagtgaccaaagtagaattcaacatcagaaacatttcaggtgtcagcagatgtgtggcaaatcatttgcctctcaaaaagttcaaagtaaggagttcagactgtagacctcctcagaaagctatttgacgtaaatgtcgaagaagtgaatatttttagtgtgcattgaatcaaataaagtgctctaaagaaattattacacagattcctttgggttgttttttcttaagggatgtgggtaaagaggaggagtatttaggccttttcatactgcacttaaaagagcttgatcgtgttattacctcatctcctggcttccatttagcttcccttataaattaaccttcaaatcatttatcattttattgaagtttcaagtttgttttttaggaggggaagaaaatttatttttaaaatgttttatttatatctatttcttttctttgatttccatgatttgactttgtaagtaaatgaatatctaagggtacatttttggcaagtgggggcgcagaggtttgacgtcatttcctgacacttctgggttccggtgttttttatttgcttctcatgtgagtcctttacaaacttcttagcagtaaattacaaacaatctctgttaagtggagcaaacacagattgttaagcaaatgtttctcaatatttgaaaccctgagagagcgtgtgttcca

SEQ ID NO: 28249 - DNA, 1174 bp, Mus musculus
ctcagaaccccttgcccagtggtagcaccccacagtgggctgggccttctcatatccaccattaatctagaaaatgcaccacagataatacctacaggccaatctgatggagtcaatttccttttttttcaggcttttttttttattagatattttcttcatttacatttcaaatgctatcctcaaagccccctataccctccccccaccctgctccccaacccacccactcctgcttcctggccctggcattcccctgtactggggcgtatgatcttcgcaagaccaagggcctctcctcccattgatggccgactaggccatcctctgctacacatgcaactagagacacagctctggggggggggggtactggttagttcatattgttgttccacctatagggttgcagatccctttagctccttgggtactttctctagctccttcattagaggccctatgtttcatccaatagatgactgtgagcatccacttatgtgtttgccaggcactggcatagggagtgatggtgcacaccggtaggatttgctgaaggaggcagaggcaggaggatcacgagttcgaggccagcctgggagacaatttcttaattgaggtttccccttcctgtgtggctttagtttatgtaagcttgatgagaactaactaccacaggctctgtttagtttatgtaagcttgatgagaactaactaccacaggctctgttacacgggcctgtttgctacatgcctgccagtccaatccaccttccaaacccttctgggaaccctcttcatcttaaggtgtctcccataggtttccatgtccccaaggtgcatcttccctcatattgatgtattgaaagtctcctaatggaggattggctgtgtccactgcctactttctactggagttgaactgggttaacctgggaaggtttcctggagaagttctaagtcattttttttctttttaatagtaggtacaacataacttgggaagggacacactatgccattgcttaggatttaagtactgattgttctggggaggtggaggtagtctacgttggaacagagggacagtgagtcacatattgagtggaaagaggcacagtgaacatggagggttaggaggatgctatgtggccatgctctcccacaaatgcta

SEQ ID NO: 28250 - DNA, 2813 bp, Mus musculus
atacaatagtatgcaaaatctctctctagaatgagatactggcactgataaacattgcctaagatttctatgaattttcaataatacacgtctgtgttttcctcatctctcccttctgtttcatgtgacttatttgaggggaaaactaaagaaactaaaaccagataagttgtgtatagcttttatactttaaagtagcttcctttgtatgccaacagcaaattgaatgctctcttactaagacttatgtaataagtgcatgtaggaattgcagaaaatattttaaaagtttattactgaatttaaaaatattttagaagttttgtaatggtggtgttttaatattttgcataattaaatatgtacatattgattagaagaaatataacaatttttcctctaacccaaaatgttatttgtaatcaaatgtgtagtgattacacttgaattgtgtatttagtgtgtatctgatcctccagtgttaccccggagatggattatgtctccattgtatttaaaccaaaatgaactgatacttgttggaatgtatgtgaactaattgcaattctattagagcatattactgtagtgctgagagagcaggggcattgcctgcagagaggagaccttgggattgttttgcacaggtgtgtctggtgaggagttgttcagtgtgtgtcttttccttccccctctcctctctccccttattgtagtgccttatatgataatgtagtggttaatagagtttacagtgagcttgccttaggatgaccagcaagccccagtgaccccaagctgttcgctgggatttaacagagcaggttgagtagctgtgttgtgtaaatgcgttcgtgttctcagtctccctaccgacagtgacaagtcaaagccgcagctttcctccttaactgccacctctgtcccgttccattttggatcttcagctcagttctcacagaagcattccctaacgtggctctctcactgtgccttgctacctggcttctgtgagagttcaggaagcaggcgagaagagtgacgccagtgctaaatatgcatatttgaaggtttgtgcatcacttaggatgggattccttttctctcctccatgtgatatgatagtcctttctgcatagctgtcgttcctggtaaactttgcttggctttttttttttgtttgttttttgttttttttttaaagcatgtaacagatgtgtttataccaaagagcctgttgtattgcttaatatgtccccatactacgagaagggttttgtagaactactggtgacaagaagctcacagaaaggtttcttaattagtgacgaatatgaaaaagaaagcaaaacctcttgaatctgaacaattcctgaggtttctttgggacaacatgttgttcttggggcccttcacactgtaaaattgtcctagtattcaacccctccatggatttgggtcaagttgaaggtactaggggtggggacattcttgcccgtgagggatttgtggggagaaggttaaccctaagctacagatgtggtccacctgaattaaattatatcagagtggtaattctaggattggttctgtgtaggtggtgtcagggaggtgcaggatggagatgggagatttcatggaacccggtcaggaaagctctgaaccaggtggaacaccgaggggctgtcaacgaacttggagtttcttcatcatggggaggaagagtttccagggcagggcaggtagtcagtttagcctgccggcaacgtggtgtgtgttgtcttttctttaatcattatattaagctgtgcgttcagcagtctgttggttgagataaccacgcatcattgtgtagtttgtcactagtgttataccgtttatgtcattctgtgtgtgatctttgtgtttcctttcccccaagcattctgggtttttcctatttaaatacagttctagtttctaggcaaacatttttttttttaaccttttctctataagggacaagatttattgtttttataggaatgagatgcagggaaaaaacaaaccaaccctgtccccacctcctcacctccctaatccaataagcagttattgaagatgggagtcttaaatttatgggaaaagaggatgcctaggagtttgcatcgttacctgagacatctggctagcagtgtgactttacagactttgaggttgtcactctgcaaactgacatttcagattttcctagataacccatctgtgtctgctgaatgtgtatgcgccagacatagttttacattcattctggcctggggcttaacattgactgcttgccctgatggcatggaggagagccctacgaacatagcgctgacctaggtcagcattgcctgaccttggaacagcttaaggctttaaaccttctcttagaacgtgcatttccagtttctcccttcccaggtgagagaggaactggaagggttgcataggcacacaccaggacacttagtcactccagagtccccagttgcaactaggaggtggttaccctgttaaccccaggaagaagaaccccatttcaaacagttccggccattgagagcctgcttttgtggttgctcatccgtcatcatccgctagaggggcttagccaggccagcacagtactggctgtcctattctgcattagtatgcaggaatttactagttgagatggtttgttttaggataggagatgaaattgcctctcggtgacaggaatggccaagcctgctttgtgtttttttttaactgatggatggtgcagcatgtctccacgtttccatggt

SEQ ID NO: 28251 - DNA, 1076 bp, Mus musculus
cgctgcccccacttctgctgctgcattgggctccaccagttccattgctcatctgttctccccccagggttcctcaaggcatgctgcagcttataccacacaccctagcactctggtgcatcaggttcctgtcagtgtcgggcccagcctcctcacttctgccagtgtggcccctgctcagtaccaacaccagtttgccactcagtcctacatcgggtcttcccgaggctcaacaatttacactggatacccgctgagtcctaccaagatcagtcagtattcttacttgtagttgatgagcacgaggagggctccgtggctgcctgctactagccctgagttcttaatgggctctggagagcacctccattatctcctcttgaaagttcctagccagcagcgcgttctgcggggcccactgaagcagaaggcttttccctggggaacagctctcggtgttgactgcattgttgcagtctcccaagtctgccctgtttttttaattctttattcttgtgacagcatttttggacgttggaagagctcagaagcccatcttctgcagttaccaaggaagaaagatcgttctgaagttaccctctgtcatacatttggtctctttgacttggtttctataaatgtttttaaaatgaagtaaagctcttctttacgaggggaaatgctgacttgaaatcctgtaacagatgagaaagagtcattactttttgtttgcttaaaaaactaaaacacaagacttccttgtcttttattttgaaagcagcttagcaaggctgtgcttatggcgtatggaaacagagtgatttcattttcatgtcgtgctgtccttactgggcagttgttagagttttagtacaacgagtactgaaacctgtgcagctgctgctgagctgctcgcagagcagcactgaacaggcagccagcgctgctgggaaggaaggtgagggtgaggactgtgcccaccaggattcattctaaatgaagaccatgagttcaagtcctcctcctctctctagtttaacttaaattctccttatagaaaagccagtgaggtggta
